United States Patent 10,233,495 (METHODS AND COMPOSITIONS FOR SCREENING AND TREATING DEVELOPMENTAL DISORDERS) - sequence listing, part 183

SEQ ID NO: 1177 - DNA, 96085 bp, Homo sapiens
tcacggaaggaaatggaagtagttggaagagaagcttgtaggtggcaacatgaaagaactgttagctggtggaagctggaagacaggagagatcgtcaaatacgactctgactcccttacattgtctcaggaagcttagacccttcaaagcagtatgcaaaaaattcagaaacaaggagctcagatgaagcctttttaagctggggtgtcagctccagcactgttttttttatgaagttagttctcaagtgtttatcctaatgggcctcaggagaaacttacttagattctcagattaattgttgctcagtaagtaagtgaaaaacccatttctgttggcttgggagtgtttgaaattatggacagcatttatctgcatctatgagtcatgtttgggtttttatttaaaagattttgatttcattgaacttagagcaaccgagaacaagaactgggtttcgtggcaagggaaaatcaagtcagatgtatacatttgccacatttaagacctgtgtaggtaacctgggaatggccgtggccattttacaagtccccaacaaatagtcaaataggtccaaatttatgtataatcagagaataaaactgaggtgccccgaagtgaaatgaatccgggtcacaagatggagacagaaatgtattgaatttttcttcttttgtgtgaatgacaccttccaaacaagacacattactcgtagtcaagcctgccccagaaatcatgtctccaaagcttctattaaaatagaagcagaaaacaacgttgatgggagtttacattatttctttgtttctgcgaacctttatgtatgccttacaatgcaccaggcagcatgcaaggcactttacaggaattgtctcatttaatcctccccaaaaccctgtgagatgggtatattaccctattctacaggtaggacaactgaggttccgagagattagatgattcacccaaagatgcaaaggaccacagacaggcctgggcagaatttatgctcaggtgtgtctgcctccgcgcctatgctcctaatctctacaccagattgcttctcgccttgagactctttaagttgaataacacagatctattggcaaaattctgtctacacctttaattgaatttttccttgagaatacttcctttaatccgcagagatgggtaacataaattaaatactactactatttacagaaatactagttggcttctctgatgacattttacataagctgcaagctgctcttcaactgttgttatgtggtttgaaaatatatttgataaatacaatggttatcactaaagaagaaaagttaaaaataaggtgaaacatatcctatgatcagttttattaaaatttatctcatttctagagtacttctctttcaggggatatatttttaaattataaattcaaacattttctcattaaaaataaaattatttgacaattaaaatttaaactttatagggccagagaaaggagctcaggtgcaaattgtagatcagtgtagtctggctggactagaaggcagctttgcatgagacagtgagtttcaatgtctgagtcttctgaataaaggaaaaaatctgttcctcagtccttatatccaaatactatggtgttaagggaaaaaaacgaaaatagcatcacagttagggcatgcaatatcaactaaatactttcaaagagaaagtaaccaagaatttgagttgtgcgtttgaaattataatcatttattctataaggtatgcaaaaataaattcttaaggatatctacttgtattagtgctataattagttttcattttccacaattgaaaataaatgaaagaggactgaggaagagaaaaaagcagaagtgctgaaataaaattagactattaggcctgatgcggcggctcaggcctgtaatcccagcactttggaaggcagaggtgagtggatcacctgaggtcaggagttcaagatcagcctggctaacaagacgaaaccctgtctctactataaatacaaaaattagctgggcatggtggcaggcgcctgtagtcccagctacttgggaggttgaggcaggagaatcgcttgaacatgagaagcagaggttgcagtgagccgagatcatgccaaaatacataaataaataaataaataaataaaattagactatcaaattttatattagtcttaaaggactcatgctttctactcttcatttttactgcttttgctttttgtggtgcttccagttgcctggcctggccctcaaggatttacatgttagagacagatccttcaagcccattctctaggctctttggtatgacccaggaatgctcataaaactatcagcaagtactgtaagtttggagtttttcatgttccttccttccttccccttcactaagcattagtaattcgttactacaatgttgtttgaacctcactgaatagaatggatgggctgatgtgtcattcagcctaattccagcactcgttttttaaacatctatatatggaacactgattttaatctcgggatgtttctaatatagcttcctttcaagtgtttcactgagaaataaaagtagatgtgtaaaggtcatggaagaatctaaaattaacacagggtggcacatttgagccaactgatgggaaaacagaacgtgagatttagaaaaaattggggtgtgtgtgggaactgaaacacaagctgtaattctgtggttaggattcttgctcctgtcatggatttgtctcatacaggacacatttctcaaggtacactcagaaggatttcaatggaaatattgctaacacattaaaatggtaatgattctccaaccttacagaattaatgctgtgataacgtatttcctgtgtgttttttctaacacggggttccttctacttcctactccatatctacaaacctaacagtttggcaacaccacttagacaatacgaaagtgcacatttgctactagcaactccagttgatgactcacttttcacaaatctgggccaaaactcgccaataaggaaactaaattttattgtcctctatacccttccttaagttaaacaaaaaaatacaacaaaacaaagaaaaaaaatccaaggtgctccagcgtgagtgtgatcgctgccccactgatctgtggagtagcattgctgggcaggctaccatgtgacggtggataaagggatcaccgcagtctaagctgggactttaatttgctttctaaaaatgtatagaaaataaaaacagttttaattgtgaaggaaaaagcactgcatataattcagaaacagcaaaacttccattttgtcaccatcatatgacagatacattttttcacacccacaaaaagatatattagtagatgctaaaagtaaaattactaaattctcctaaattcaagatatgaactcaatcattttatttaaagtctaatatattacaattacaactgctaatgggatatgtaccatatatatagatataaaatatatctatatatatagagagagagactttgtttagtgtgagtattaaaagttttttcagtgcaaacaattgtttaacaaagtcttcattgtatatgatcacaatcagtttagggaattgcataagggtacatatgacattcactttactaaagtagtacttgtatagggctttctcattatgttatgttatgttactttacgttacgttacgttatgttatttatttatttactttttgagacagagtctcactctgtcacccaggctggagtgcagtggcacagtgttggctcactgcaacctccacctcctgagttcaagcgattcttgtgcctcagccttccgagtagctgggattaccactacgcccggctaatttttgtattgctagtagagacggggttttgccatattggccaggctggtattgaactcctgacctcaggtgatccgcccgccactttggtaggtgatcggcttaccaaagtgttgggattacaggcatgaggcactgcgtctggccttcattatgttatttcatttcatccttgtaacaggaagtactagctaaggcaagtatcattagttctgttttttttggaggaaagaactcaagctgagagaggtgagctggtttgtatgtggttatacagagaggaagtgtcgtagtttgactccagggctcctgatggcaggttgggtagcacaagtgcagaggtctatatttaaaatcttctgcgtaactgtaaaattaccagacaataaatttgttttaaaccttcatggagaaaatcttgggacgttcttttatcatgggcatgttttgatactccacctccactgatttttataggtttttacattatatatggagtcaagttgccacttcatggtttgggttagccagaaacttcacctagctttctcatttttcatttcatttcctattgtatatttttgtggataggataccaaaatagcactagaagttaccactgaaattaagcttataaattcttgtgttaatatccggcagttaacagtacatcctcctgacatggtcaggaaaaagcaaaatgaattgacacaaccaatgaatggcatcttgacatttttctagtactttgtgacaactaatttgctgttcactgctaataaactgaggtagtttccttattaaaaatatctgaaggccgggtgtggtggctcatgcctgtaatcccagaactttgggaagccaaggcaggcggatcacagggtcaggagttctagatcagcctggccaacatggtgaaactccgtctctactagaaatacaaaacttagccaggagtgatggcgtgtgcctgtaatcccagctacttgggaggctgaggcacaggaatcacttgaacccgggaggcagacgttgccgtgagctgagattgggccactgcactccagcctgagcaacagagtgagactctttgtctcaaaaaaaaaaaaaagaaagaaagaaagaaagaacaaattaaactttcaagtttatataacttcctctaagtatttcattaaactgctctcttatcaatagctatacatcacggactgttttaaagtactgcttatttctgtcagagaaaaagagttgtaaaccacctacagctactgctatagttataaaaacttcctaagtgtttaataagagactattggtgttatcatataagctattgccactctgactaatttctacagtggcttacttggctataagggcattaggttttgcaaaggaaagactttggtttgagtctctcatttatacttttaagctgtctttgggttaatcatcttatcttccctgttttatctttaaaatagagataaccactctcatctgccaaagaatgatggtgacattagcatatgtcaaaaagtttcacataatgaaaattatagatgttatttgttgttactgttaaatcatacatgaggaacgatgccatctactttgtcatcttcaagtgcaaagtgtacggctgaatagatgacataagcatacccacactcaagcaggcagtggaatctgtattaacagtctctactccaaatcaagaaatatatatgtaaacagacatgtcagcaaggggatacttgatatgttttttctttttaaaagaatcatggctgggtgcagtgactcacgcctgtaatctcagcactttgggaggccgaggcaggtggatcacctgaggtcaggagtttgagaccaacctggccaatatggtgaaaccctgtctctactaaaaatacaaaaattagccaggtgtgatggcaggtgcctgtaatcccagctacttgggaggctgagacaggagaatcacttgaatccaggaggcagaggttgcagtgagccgagatcacgccatcgcactccagcctgggtgacagagtgagactccatctcaaaaaaaaaaaaaaaaagaaaagaaaagaatcactatccctgtgccagacaatagcagatttttaagtgtattctttactaattcaacaggaaaaagccactaggtctgagatccactgagacttgcctagctgacaggcttgttagctattgccaagcttcagtgggggttaggggagtataaaatgaatagtgcgctgatgaggtcaaggaatcttgatagattgtgtgtgtttgcatatccccctcaactcaggctttgctcttgcagacagagggaaatacatgatatttcacaaaatagaaacattcagttttagctctaagtcttgcactagcttttgcttactgggatcccactttatgtacatcagtgattctcaatccccgttaggtactggaatcacctgggaagattttacgagccctaggctgcactccggagatttggatataataataattggtagagtattctaataggcagccaggactgtgaaccaccaatgtggaccagtttgatgttcaagtggacagtgccatctctaccattaggaatgagtactcattatgttggaactggtagcttgagtagtctctgtgtgtatctccatgaagacatagctcagatattgtctttcttctctctgaatttttgtttgaacatttaaattacttctggtgccaataaacctagaattgggagctgagagtgtatttgtggaataaatatcccagtgcgcatttttacaaacaataccttattctttccttctattattgccatgcgctgagtgatgctctcaattctgtttcccatgttgctgtcagcatccaggataaaggactcttcattattggaacaaaagtcacacctattaaaaaaaaaagttgtcacaatgtggctttacagcatggttcagtcaatggggacaggtgaaatgaaaacttggtgtaagtcctcagataacaaagtcacaaattttatgtgtgatcttcttttccttagattttttcctatattcatcctcaaaacttaaaaatagcaaatatatttggctgatacttgaaaaaagccccacactagtgtgtcaccatacatccttttcgttgtaaatgttaatattaaataaaaatgcataaattagaaaatttagtatctagattttagtttttagtggaagtaacattcaaacacggaaaaaatgaagttatgttaatgaataaaaaactcaaggaaatcataccattttatatctataaaaggctggcttttaatcagaatatgcagttggatggctaagtttttccagggctaattaagtgcatatggaaatcaacatcatgaaacagttattaaattcagtctctctctgctcaagttttggggaactgttcaagctctcaggcctcaagtgtttaattataaaataaaggtgttgatgttatttatctttgaggtccatgaattctctctctgttttaaacatttcaccattttgcattctgactttctggactagaatttttttgagcagaaagcttgctggtctctaatttgcacatgtcttgggcagattctacagattttttaaaccaagaggaattttattattattattattattattattattaatattagagacagggtctcactctgtcacctaggctaatgtgcagtggtgcaatcataggtcactgcagcctcgaacctctgggttcaagcaatcctgccgcttcagcctgtagctgggattataggctaagtgaaattttcaagcttcatttccagaaaaaaatgagtggttcatctttagcagccaagagcaggaatgacttatgtgagaggaaaatgagaggctaaagtcagtgagaaaaaggggaagacagaagggaatgtggtcagaaaaacgttccgttactattcctccctggtccttgagctgagaaggaactccagagtgttaaactatcgcatctgcaggggtactggccctgtaacgtcctcctgcagagtactcaccaccttttaagtgctgacttaatggttctgagtccccgctgggccaacagctacaggaggacaggggacaaatcgacgtattcactctgtccccatagctaagcagggcccgagcatgccgtcggcgccccataaacatttgcacacatgcagacaggcacaaggtacccgaagttgtttttgctaagagtttctactttctttaattgtttattattatcaaacacaccgataagtagagagaatagtgtgatacacccccatatacccgccacccagatttcacagttatcaagattttgtcacattggtttcatctaccccttttttttcttctgtattttatttatttatttattttaaaatttttctagcctggccaaatgaaggatttctgtgttttaaaacaaatctcaggcatcttgtcattttagccctatgtacttcagtgcatctctctaaaaaatgagcaaatttttccaatataaccacaacactacttttatacctaagagaattagcaataattccgtggtggtgtttgcacctaaaccgtatatcagatttccccaaatgtttttaaagatgtctgtcttacagttagattacaagatttaaaatttaaaaagaatgaataaaaggtgaccattcctcaaggaatttctgcagtttttaccaggtataaccttataataatcatgaggtaaaataaatgaacattttaatgcttattgataagtagagtaaactgagccaaagagaaattatgtactttctcctttattagaaacatcttaatgacaaagtttaaaagtcattatatgagagtcactttgccttattttttcattatcatattctccattttctagactataacatccccatgttaatcttgcgttagacttgctatctttcacacactcgtattacaggtatgagtgtatataatgtgcacatatacacatgtgtatacctagattagacatttgcatatgtacttgggattgtgacatcaaacagctaaagttctcttgtatctggaagacaagcttttagattgtattccttttcccccaaagcaaggaaaaagatcggggataccttagtcaaagatcttaatttcatactcttgggctttaggaaatgcaaagaaatatgttagagtaaggcaagcctgggtgtttctcaagggaaatacagtctgctatctgagttcacttggggctgttgacctctgacaccccacacctcccccatcccacacccatgactctgagggcagttactaagggcacaagccctagtatggaaactataggccagacttattgccagctcttccacataaaaaggacagattctgtggctattttctaatttaggggctgttatttttccctctttgtaattggggctataaaaatagaatgtcatttagaagccttactatataacagcacttgaaaagagatttagggggaggggaatgtgcctaagccttaagaatacatcaagctcttaaggaagtagattgtgccatgtttgaagatgcaaagataatcactgtgctgggaactgtcttgaggggggaggaagccgaacaacaagaggaaagcagcgttcgctcctgatttcgcacaggaagtccacagcacctcctgccaaagcgagataagaaagctcccatgcactattctggacaaggccactgttatcagcctcagctcggcgctgtcctctctttgctccaagcctccgtccctttcctaatgagctatatgactcctacctccatttgcatacagcatgccaagtacaatggcagggaggtatttataacccctgaaaggaaaaaaaaaattatgggctaagagtgtactccatgtcatctctgctgattgctctggacctgaaacaacttaatttcggactagagattgatataaataaattaaaagaaagcagccaattatgtttccaacacatggagctaggacctcatgtgtgatatgtcagccttctacattccaagtgggagccatctgtggaactccccatctggtctaagttactagtcttcttctcttgacacattatgggaaactgccaccctctatatatgcagatgacactactgacctacatgctttgggttgattttcttgtaacagtgatgaatttgccctcttcccaccacactcaaaagtatttggcttctctgtgaccaaagacagatgaaggcagtctggggccacagaaaaaggcaaagccaacagaggtcaaacctacgatctttctttctttctttttttttttttttctgtcacccaggctggagtgcagtggagcaatcttggcttattacagccttgacctcctgggctcaactgaccctccaacttcagccttccgagtagctgggactacatgtgtgtgccatcatgcgaggataatttttgtatttttagtggagatggggtttaaccatgttgcccaggctggtctcgaactcctgggctcaagcaatctgcctgcctcagcctcccaaggtactgagattacaggtgtgagccaatgctcctggccaaacctaccatcttgacagtattgactgctggcagaatttgtactcagttctggatcatttcagaacctgtgcacttgaccccaacaccataagtaacatgatatccatgtactaccatcatgtgacaagaaattattatgcttcagtacttcttggacatagtaagaaaagacatctcaaatattcagtacacaaataccattactatgttgaggattccatggctttttttttttttagctacttttgcataacatggtcagtctctttccaaaatttgctaaacatctctcatctcacacaaccaaaatatgttgaatgaccagtgcatgcacagtctgcaattacagtttatattacagtttctatgagagctcactttgtcaccctgcagttcctgaattcaagacaggttccattcacctttacaaatccaacactcaatgaagtataatgcacaatgcacacccaaaggtacccctttgtgttcacctgtgctttttcttaattgctggtttttaacaattcttatttttagattttcttcactcctcctgccttcctctcccctccccctacttaaagctcagagctggtactttctttcctttagaggatagattgtcacatctggtggaatcagaagggaaagcccagctgggtgagcgttagctactgatagtaagtattgtgttttctttgaagtggttctcttgtgaggaaatgatcgattctcttggagaattgggtgggatggttcaacacttcatttagcctttctagaaattgcccatctgtttagtgcctgttatggtacccaagactcctatagcaatccagtataaaattctcatttcataaatgatttcctgccagtctaataaccacattgattctagaaggtctgctctacagccttagtcttaagacacacagatttttttaaaaggatcctctttcaataaatgatattaagctggcatttcaaatctctgttgtgccaatatctgattcttggctgcttgaagggaaacaagttttgtgagctgctactatgtgctactaaagcttgggctagaagcaatacacattttgcctcaattagttctcacagtcaccctatgaagcaagcattatgatccttatttcataaatccttttatcaataaggaaactgagactcagaaaaatcaaatgctttgctcaagttcacagggaaaggagcagaattaggatcagaacccagactctcctaactcttcactatcccagagctctgtgcatcacgtagggtgacttctgatcccaagaaacctccccagacctttcccaccatgggagaagtctggctcagagtcacctgttacagaggaaaactctggggggcctctaaattcaaactagcacaaagtcagacaccaggaaaattaaatttatgtttttaagagggagaaagaagatgtgcctgtctatcggtggacaaggacaggggcaaggggcagaagactactttatagttacatttttggcataaattctagttcgttttggtcataaacatgctttgatggtgaaattataggaactctttaccttctactggctgatacattttatcattaaaaaaaaaatctggccaggcgctgtgactcacacctgtaaatcccagcactttgggaggccgaggcaggtggatcacctgaggttgggagttcgagaccagcctgaccaatatggagaaaccctgtctctactaaaaatacaaaaattagctaggtgtggtggcctgcagtccagctactggggaggctgaggcaggagaatcgcttgaacctgggaggtggagtttgcagtgagccaagatcatgccattgcgctccagcctggtcaagaagagcgaaactccatctcaaaaaaaaaaaaaaaaaaaaaacttacaacaaaataaaaccatccaatatttatcacaatttttttctctccttggtaacatatttttgtctgcatgctcagtgagcatgttctgggatgaagctggcctgttttattacaaactccaacactagaatgagtggcccggggacaggagtgtgggtgagtggtgatttgagtacccaacacccgatggctgcctatttgagccagagccattgtctgggaatgaatgtttatataaatgtataatgaaagcacatttaatttggcaacaaagagggtccagaaagttctacaaagtctcaagacagataataatctccttctctttttttcttttttggatgatgaaatctgaggacttgtgtgaactctgcttatctgtttaatgagattgtactgcacgtgctaactgtgattagaatctgtttgtaaagaatattgaatcatttcaagctaggaaacaaaaggatagaggagtaatgaaaagcaaattgaagctgtaaaatgtcttttaaaaaaataggaaggaaaaaaaagcccatctggaaccctgccagagggcacaaccggggctggcccccattatggcggccatcctgtagcagggcctgatgtaaacattcctctgctactgtgggtgtcgtgtcaaaacattagcgattgtgtgtctgagccatcagattaacagaatctgcaaacactatctttcccccttctctttctttttctctttctctttctttctttctttctttcttttctttctttctttctttctctttctttctttctttctttctttctttctttctttctttctttctttctttctttcttctctttctctctctctttctttcttttttgagacggggtctcactgtgttcctcaggctggagtgcagtggcaccatcctggctcactgcaacctccgcctcccaggttcaagcgattctcctgcctcagcctccagagtggctgggattacaggcttgtgccaccacgtctggctaatttttgtatttttagtagagacgggttttgccatgttggccaggctggtctcgaactcctgacctcaagtgatccacccgccttggcctcccaaagtgctggggttacaggagtgaggcaacatcccaggcccctcacgttcttttttttttttttttttttttttgagacggagtctctctctgtcgcccaggctggagtgcagtggcgcgatctcggctcactgcaacctctgcctcccaggattacaggccagagccaccacggccggccacgttctcttaaaacagatgaaacaatataggagagtggatgctggcagaaaaaggcgtagcattggaaggagtgtttagacagaatggttcctgctcctcttgctccaggaaaagggcctgggccttcagggtggtcacagggtcaggctgaggagatcctggaggagtgactttcttgtgcagtgagagaccttgtgacgccttggagctcatactgaaaattacttcttgcctcaatggagaagggggagtggagaagagtttcgggggttgtgggctttgggtcggctccctggacaatggtggaggggatccagcgtcctgggccacctctgtttagataagagcttttccgtgagcgtcttggctcatgctgcttcctgctctcgagggccctgtggtccattcacactcagaacatggcccttcttcccagcctctgcttttccttcctcctggctccttctgctggcttctagagtgagtgccagcaatctccccgccctccaccccccaagccagacactctctccctcccagctccccactctccttcacacagtcttttccagggccaggggatcctcgtggccccgcactggggtaactgaaaggctaaaagagtgggtgtttacttggctacacccagataggagcctcacaggatacctattttgttcattcacttttcttcttagtgaaggactagttggtgaggaagggtgatttgagaaataagaaatctttaaaaaaatattaggagtgcctacaaaaaatatcctttaacacattcaagaaggaggcttaaaatagtagctgcattcactcagtggagaatattttaagctatcattatattttgttctcacaaaaaggaagagaacagcttacttcttatttagtggtcaatactgaaacatccagaaagcttttgggagtggaggtagggaatcacaggttagcataagaaacatagatgttagagctagtcagacctgaggtgaaatcatggttttataacatcctagttatgtaactgtggatgtcaaaaacctgactttgagaatcgtagtcacagaagattgctcagagggcttaccagtcttgttgatttcttgtatcattctaaaattttgtccttagatcacaccagcccacaaaatcacttttaataaattctgctttggtgctatgtcattggccaacattgagggatgttagttaccagagctgacactcactgtggaagaagtgtggtcagggagtttgcctactattagtgtcccgcagcgtatgagagaagaaatcatttctcttggatctcagttctctgaaaggtatcttatgagccccttaattttgcaaatgtttgtttcacttcttctcgctcttgacaactggaaagtaaagcctgtgggccgtaactccatactagtcttacacattttttgacttcaccaaggctgcttagttatgtattgtcctttttgtgaactacctcaaattctttgggaatggatgtgttcttagcatagccaactcaaaaaagcaaccccatgctaccatgtcttactagttttattacaggcactaaaaatgcacacataagggaaataatttaaataaagaattgaaagaagattggtttgacatcagcaaatattagggtgatacttaatgtgtaacacacttagcacagtgcctggcacacaggaaacaaatcattaatgttagttgtcagtttattatctgatttcatcgagagctacttacgtatggacagggactatattttgttcatcattatagctttggtgcctggcccaatcacttgggaaacagtgggtgagcaacacttgtcttttgctcagttaactccctgatgaaagagtggatcctgccaaagaatggccagatgagatgtggacccaatcacacatcagatgtcaaccctacctcacatcagatgtcaaccctgccatctacacttcaatcaagtgtgctgaaaaaggggctctagtgactgtcaaatgacctcacatacacccctgacctaagcactatgtcaccaccatcagcacctctccatttgcaatgatgaatattaatggatacatgggatctgccagggccctggctaacctcagcacagcagtgtcagcacctgacaaacccatagtcatggacagtttcaactcaggcaaggatgctgacatgcaaagcagtgtcatccagtctaatggcaaataggaaactgactggcaatggcctcctcttcttgcctatcttcaaagataggcacaaatattggcttgtcaataatagcaccactttgcccgggtgcggtggctcatgcctgtaatcccagcactttgggaggccaaggcagacggaccacctgaggttgggagttcgagaccagcctgaccaacatggagaaaccctgtctctactaaaaatacaaaaaattagccaggcgtggtggcgcatgcctgtaatcccagctacctgggaggctgaggtaggataattgcttgaacccgggaggcagaggttgcagtgagccaagatcgcgccactgcactccagcctgggcaacaacagcaaaactccatcttaataataataataataataatagcaccattttattcaactaaaacagagtttgctcactcctatctcatgtaagatgtaaaatcacaccccttgcaagaattagatgatttaattccttctgttatttagaaacatatatgtttattgaagagacaagtcaaattcatggaaacatatcagaatacaattgagcacaggcaagtaaaatgacaaaagcccatatactactataggctgaacaagacttgggtgattgaccatttgaatagctgaggtagaattcaccaatgagagtagatccttggatactgtaactcctttgatttcctaaataatctgaaacagccaccatttctggtcccattctgatttctttggaataaacagtcagaggacctgtcccaagatgcaaatatatttcctgggagaacattaacctaatagcatggatcatcttgtcaggacattagtgtgtatatgatgccacttcagagggaagtggctttgcagtgggcagccccagagctgcctaaaagtactagaagtaccaggtacctttcagcaaacaaacttagcactcgcaatgtaccagccactgtgctgagtacttcacacctattatgacatttaacttcctcaaacaaccttatgatgtcagtgctgttaactccatttgtagatgaggaaacccagactcagagaggtggtttattttgcccagaatcatacagccaatggatgccagtaggtggcagagccaggactcaggcaacagagcccacgtccttaaactctaaactatgttgcatctcttgatgtcaccacactggttttcaggattgtgagcttttgatgtcaccctactggttttcaggatcgtgagcttttgactaaaaatgactcattttaatgtctaagtagttgtgacacaaccaatcctggtagtgacaaatgatatgctttcaattgcctggttgatgttgtgctggaaagctgctcactttcaggctctttgacatgttaaccaggactagtgtcctaataagatactcaaactctctacctgatctggaaaatggtaataattctagcatttctcttagagaagttctgtgataattaaatgagatgatgcatataaagcacatatccagcacttaacaccacataggtaaatgcttaataacttagctataaagaaaataaaaataggaaccccaggctatacagcctctatcagccaccatcttctattatatttggctctagatggtctttaagtaccaatttttgttttcctcatcctacgtgttcaagtacttttttcatactcacaagggctgatttgtcaataaggtagcaatcagtgatcatcttatataattttcaatgatgatgacaaggcaaatggaacattaaagacctaagaaattggaataacatgcacccatgtaatgttttttaaaagggtgagtgaaaacccaagactttgattttcaggcatggagggtagagtttctgagatacagtgcgcatactgcaggctgaaggagtgccacaggtagaagaccaccaataataagtctgtgaaagtccatcagcctggaaggagggacaaagtgggcttctggccaatagatagcagaacatccaggcactagccaggtagtgactgcctgcctcaaccattcagcctctactgaaaaaatttcacatcaggtccaaaattacctttccaattttggtttttattttttctcaaccaaatctgatgaaccaaccacattcatctctggcaagttcttttcaactttccaacccgtttgtatgcctgtgttactgcatcacatctttgtccctctccccttccatttaactttccaagatctacccatcctcttcagggcccggatcccacctcctccttggtgcggcctctaaactgcaacattcaccatctaccacccatggtcggctcgtttggccagattataagcacctcccatggagactcaatacagtgttatggtggaaataatagtaaacaggaaatcagagacatgcatctagtcccgagcttgccattaagtagctgtgagatgagataactatttatctttgagccacaatttctcacctataaaacaatctctttttaaaaattaaatctttaacattccttaattccgtttttttttttttgagatgggggtcctgctatgttgcccagggctcctgggttcaaacaatcctcccacatagctaggattacaagagcacgccactgtgcctggctcaacattcttcaatgctgagtgaattaatcgtttgaagtgactaggtcaaggcatgccgaggctgaaattagcagcctctatgtccccatttcattccctcatcaactacaaaccctcatgtttcctccttcattttcttttgacccctccttttcatctcctttaattgctctcctgactaaatagccatgagttttgtgaggcccactgagggctgagtgcttgctgaatcctaatccaggacattaattctgaacaataaatgagagaatggggcttccctgccctgcaagagatcaaatacccctggatggtgggaaaatcacagaaaaggacaatacgaataggggaaagtgccacaataagcaggcccattaactgttagttagacttgccaccctcctgaggctggtcttatttagacctgctcatcccactggagtttatactccagtttctactcccaactgcagatctggggcccaagacagctgtaggtcatcactggttctcaaagatatcatgaaatttgagcccaattcacctatttgctgctcgtctttttctcctttcctctcccatcctctgctcaactctaactcaacagatgggtcagctctaactcacgacagacaagagcaaacctaccaggttaggcaggcgccctcccaaacctattccctgcagacttcagctctttcctctgggaatccacagggatgtcctctgaggagtcctatgggacaccagggaaaaataaccttctggaagaccaatctatctagccccttgtattttatttatttatttatttaagacagggtctcactctgtctcccaggctggagttcagtgacgactgcagcctcaacctcccgggctcaagccttcctcccgtctcagcctcctgagtagctggaaccataggcgcatgtcaccatgcccagctaattttttttatttttatctttttgtagagatggggcctctctatgttgcccagaccggtctctgcaactcctgggctcaactgatcctctcacctcagcctcccaagtgctgggattatagtcatgagccactgtacccagccctccccctttataccataatctgaaaacacctgagaaataactccctgagcttcagttttacttatgggaaaatagggcaagtaatcaccattccgtaaaactgttgttcagattagagataatgtgtgtaaagggatgaacatggcttttggcaccaaaaatgacttattgattaagtctatcacagctattataatgaagtagaccattgcattcaaggtggcaaaacgtcctaggaggcttctagagaaagtatgaagaaacaagggctagtgattagaagctcattaaaaggcactgtcagggccagagtctaaatccatcatgccctttccatcttatcaatccaacaggttctgctttgtcacctaaaagggcactgattttacattaaagtcacatagataccatattttaagaaacaatctaccaagtcagtgaagatatactaaaatgtagatccccaggcagaagtgcatgttttataagtgatttgttctacttatctatcacctaaagatcttgtgtcaggacattagtttctagattcaataataaaaatgctcattcaatttttaaaaatctgtaaatttggccaaagacaatctgagaggttctgccaatcttcttaaggaatcttcacaaattttgtgtcactatcttctggtaacctgagaagctacactgaatcttgctgaaaagatcactataaaaaccatccagcggccgggtgcggtggctcatgcctgtaatcccagcactttgggaggccgaggcggatggatcacgaggtcaggggatcgagaccattctcgctaacatggcgaaaccgcgtctctactaaaattacaaaaaattagccaggtgttgtggcacgcgcctgtagtcccagctacttgggaggctgaggcaggagaatcacttgaacccaggaggcggaggttgcagtgagccgagatcgtgccactgcactccagcttgggcgacagagcaagactccgtctcaaaacaaaaaacaaaaaacatcccgcatagatttcctgtgactcagccttttagtttaatttaaaacacataatgaaatgtttgatagcaattacaggagacagttaactcattagaaacaattattcatcatattcactgtattactaagaagagtgggaaaaggaggaaaatctcacaaagcagagaaaagtggcaaaggggcctttggcaaaagaactcatgctctgttctcaggactttgtatgaaatattaataagggctgttgtccgaacagtcacattaagcagcatgcacttcctcgtccagtaattatataacagaatgcaagaagtttctcattagtaagtgaacattcacttttggcttgtgatgaaagcctcctgtataagatggccagttttatttggctgtttgttcaagctcaaagtcctgctaaagtggtctttggtcaagtggtcttctttaaagtcctcattttgattcaaggttttgtttgtggtaaattaaaattctctgtagcatggctgaattgaggctgcatacccagacacacactgcatagaatatatgttgagacacatggatggatacaaattgtatgtgtacttaggaagaatgtgatcaatattaaaacatgaggtatgtgaccgtatttccaaaagaagaggtcttaaattatagcttccctcagacatctgacctacattttgcccccaggaaatgttgactttttcaatttttatagtgttaaaactttcattgtgtaggtggaaaataaaatatgggacataaaactgttacagcataaaaataatagacattcatgttggcagtcaattaaatttgggtctttgagtacatttctaattaactaccattaacaattgtcttgtttctgtcctgttaattttacataccccactgatgcgccaaactatgtttcccccaaatgatctatccctaacacatccctaatgactcaggccctcctttctttgccaatttgctgacgtaaacaatagagaaatgcaattaggcaagcccctctcggaagcccttctcagagttcctagatgcctctgcttttctgtgatattgtaggccaccccaccccccatccccggatggaaggcagtaaaccacccttactcttagagtggtcagctttctcttgacaccatccaccccagccccccatagtactctactgctggtgcacacgaagagtgtttcagacatgagatgtcacattgtcattgagaatggcgggaaacattattttctagttaacttctaaagcatgtaactattttagactccagtcctgacctacttttagagttttgcaagcggttccttgagagtccatgcatgtctactagatttttcttagaaaaccccccattttatctaagaaagccaaaagaataatgttctccctcaaccttccatgagttgagaacccaacatttttcacaccctgaagggactcatctgcagaagagcaaataaagcaggcaaagctttagagctaactgggcagagaatgagcatgccttcatttgtttgggctggatcgaggctggcaaggtggtccaggttggcactgcggaaaatacggcttggccccaatggtggaggagctgctgcacttttttttttccttactgggcccttattaacattataatcacagagtcagttttgtatcacagagtttgtacctccatttaagacttttctgacagccattctactttcataagttgaaattttctgttaatttgttaccgatcctcagagttaatggtcaaattgccttacagtttacaagaaacagaagggaaacatcagtgtgcaaacactgggaaatactttcaagcccttttgaaggaagaaaatataatttacagtgattttctaagttaactcattcatagctgtgtatgataggaaaggggaagcacgaccattgccatttacagaaggggaaatagaaacacagattaaagaactggccaaggtcacacagaagtcagggacggtgccaagaatagaacttgcttccttgattcccaattctctatccttgggaggatgtagtagatattttacagatacatatatagatccaataagtaatcaccaaatatgtttaatcttgtataatgcaaacataaatgctaaagacaagtggtattacctttatgttttacacgtggttggtgcctaataaatatttgtgtgatgagcagatggttgacagtatatttagattgaatatcagtgacgtgccaagttgctttgtaagatgtcagcaatattaatgcaatgtagacagaaatgtttctctacatattttgactagttatcacagatagcttataaagaaaacgagttttttcacaaagaacccgatgttacctaagtttttttcccatgagtggggaataacttagtacgtggtacaactctgtctattataatcaatcagtgttacttcttcctttgaaactatgatttgtgataattatatagggagagagaattaaactggactgtgatctaaagaatgtgtgctctcaaaacaaaactgcagtaatcaaaggctgcaggcattgaacctccctagaataaagacccaaacacattcaacattttagaaacagatctttgttttagaaagaagaaaagacaatccagaaacaaccaggtggactctagacacccatggaggaggtgatcagagctcatgagagtaccaggaaggagatcagcagaagccccccaccatcccgtttgtggggaacagatgagcgcaaagacccattcaggccacacaattgtccagtcagctacccgagggtctccttggtattcaagcacacgtaaagaaaagtagactttcaacatcttagattcttcctgagaaaacagtgatctgcagcacaaactgattatgccaagactgtccttgccctatcctctcctgggttcctgaaatccaccctttccattccacagagaaggtccccttccctccagtcctgtattattattgttcctttagaaaccaaccaacctccttgccatggacaatcttatctaaatagtatctcctgtgaggctgcatcagtactctggcagagttcatggaggactgtaagatcaagcggagctcagtccttggggggtttactcgtactacttagttgttcaaaatgcaggcggaacgtgaagttctagaaattgaaagtggactggctgagcaggcatcagctcccccacatgcccagtcagcccaccccagcctcagccaacccacagggcagaaccacttcctctcatgacaggaaaccaatgaatggggcaggccacacgaactgggagaattacttcattccctcatgacacccttccatttactcttccttttacttttgtctaactcttctgtagttccttaatttttcttcttctgaaaagtcatattttcctgaattccacagccaccctccaccccagacctactaaattactattcttaaagcacaacaaaactgcattttacattccataatttgcattcatttcttagaaatgtttggcaaaactgctcactgttgtcaaactagctctatagtaggcagaaatatcctttaagttcattaaaggttctcaggtcttatttaaagaaatgtaccccaatgctagcaatgattacaaccttgcaaatctgtggtgctctgtaactttctaaatacattacctcattcgatcctcatagtctctctatgaagtgtatatcattatctttactttatatgagcagaggctgcaagctatagacatgtggaaggcactatatgcttaacatccttatgatgctctctggctttttgctcagactcatgggagcaggtttaggaatatctatttagaagtctacctgttggctgaggatgagaaaaataaaatattccaccttattcagtgttgataacttattttggtgttattaatattcaaaagagatatcacagttttattatcacttttcttttctttctttttcttttttttctgaagcggagtttcgctcttgttgcccaggctggagtgcagtggtgcgatctcagctcattgcaacctccacctcccaggttcaagcaattgtccctgagcagctggaattataggtgcctgccaccgctcctggctaatttttgtattttaagtagtggcggggtttcattatgttgcccaggctggtctcaaactcccgacctcaggtgatcctcctgccttggcctcccaaggtgttgggattacaggtatgagccactgcacctggccccactttcctttttttaattaaaaaaaaaactaaaaagggaaagattctgctttatttcttcttggttcattacctgtatgagtttaaaagtaatcatcctttccctcctctcttttattcctaatgttttataagaacaaattctaggcaaaacgaaagccacaatattactcagtcaaaacttagctcgccttcatagcatattttactactttttttttaaagggtgacattttcagttgaactatcggtagttataataacttaacatatttacatatttattagactctaagacactaaataatttgagttaggtctgaacctctttctatagtagatacattaactgtctggccatattaaaccaattaatagttttgagctccttaaacaagtacattctgtcctcaaactaagcgaatgctttggccgtggatatacatagatacgccctttcactagagcctaaaatttaaatgccaggaattattctacgtatttgagagtaatgtgcatatattagtcacccaatctcttttgatgatcatgtatagacaccagtatgcaaatatgttaccatataactcaaaataagtgcaatggagcatttcttactcatgtgttactaaaattcctgtctacaactgaatctaagttagtctaagtgtatataaatatgtttatataaagacatatttgagaacttttggtaattaaagagggtttcatttatctataaattttagcttcatctctctgagagggtgaaagagtggttctgtttattttctggtgtacaaagtttctacatatatttctgaaacacctctaagttaactgtactgatttaaccaccaagcaccaaatctgggcctcacacaggtaggctactcaattagtacctgctgactaatgtacatcgagctgtcattcttgtacatcaaagatgtgtacgtttttggcagataatttcaagcagcaacgtattaaagaaataaagcatatgcaaccttaaacttccatttgtgatcagtcttgtaagtagtgaaaaaaaatgccttgaacagagaataattcaaatggccaacaaacatttaaggtaatgctctgagtcttgagaccattctgaaaggaataagacatgttttcaggccttggcgaacttattccatcacacagaagagagatcccttacaccacaaagaaattggaaagaaagctaatgtttacaaagttccattcgaggtggcctcattccccaaaccatattttattagcatcacttaaacccaaatttataaatattatgttctatcaccataattgttattttctaacatagttactagttctaatcctagatagaatagaaattttagatttaatattgccaaaacaaaatttaaatatatttagaaaaggctctgttattccagaaaaattcaactctacacttttatccgaatctaatagcttcaattatttagttttttttttatttatttgcatgttaggttggcacatatgtcaagaccctaaacggatgggtcgataaatattgatgcataccccaaatttgcaaaatagtatagaatttcagtagatctcactgtcttatgtgttaaacattcacagtggtaaagaagatatttaagatttgtaagtcttctctatttctattcttagaaaatgacagtcaaatgagaaatcagatgtgtggaaaacagctacttcccaggaattccatagctcaccagtaactttccactctgagagtaatacaccctaagcaaaacgagttggaattgtgggaagaatctagaaaatcaaatagccacttctatctgtttatgttaggattatgctttgtttacttttcctgtcaatctttttttttttttttttttgaataacaatcctcctgaacactctgcaagtggagttaaaagtaataaggaaaatagtttggcataatgataatccttgggcagtttcaataatatcttattgttgcacctatcaagtctattcctgttcttcaaattagctcccataaactatccttagtatcatccctctagactaaacaaaaagaggaaaaagcaaacaaggctcagtcatcaacaggatgcaaggaaatgctgcacaattagcagagggtagggatgtattcatttagcaaatatacactaagtatctactgtgtgccagccttggcccagcctaaagacacaagggtgctctcaatcagctcttagcttagagagagacaaacctttgcgcatcgagtgatgtaacaagggcgtgaacaaagtgctgttcatactgagggggaagaagtgattctgaatgaggcagtgaggagagttcacagagaaggtgacgtaagagctgagccatggggtttgataaataaagccctcttaggaggcaggcaatgggtggaggtgcatttcagacagatggaagagcaaagcccaaaagtaggaaacatagtgatcactggtgttgggaagaacttggatcataaccaaagaatacaaaatgaaaaatgggaatgctaatgcaactgacatagtggtattgccaaagtctagggatcttcagttgagaaacaggagaccagagttccaacctgagctcatgtcacagctcatgggaggaccttagttttgtgcttgtgcttctaaaactgtaaactagagagaaaaattatgaaattgttagccagtgatagggtatattcagtaagaaagaagagtagctgttgcccacctttttccaaggcagggagagcctttgcctcaaatatacagtacatcccacatgcagattcccatctgcgtccattaaaaaatcttaattccaggtgtcaaaaagtatttgaaagttagtaaaaaaactgactgtccctaccttgcttcggaatgattatggttacaggggtgccagaaccacttgattgtaggttgagggataccatatgcggtacaagtcaggatttgtctgctgcccagtgggtagagagccgggtctggaaacgatgacacggccttttcgtaaatctggggtttcactggaaaggagatgaagaacgggacagaagtcaagagcagttctaatgactttctcctgggccacacatgaaggaccacattctcactggctttgatgtcagggaaacaaacaagaaacaaaaaaacaaataaaccctcctatttgtcaagaaaatgcagatttttaaaagtagtagcagggttttgagattattaataatttgattccatggtatgtacattgtgattacagtgataaaagatcatgccgcctatggaatacaacaaacaaacacgagattgttaagatgggaacttaacgttaagtgttttttcaaatgattatttgaaattttgctatctttgatgttgttacgctgatttttgaattcataaatgttcactaatttgttgcctaccagaaccagaagaaagtatgaacagcaaacttaccattgacaattagagtggcagtgaggtttttaaacacatttgactgttttatgctcagcaagattgtataattccctgcatcctcttcagttacgtccttgataattaacgagtagccacgagtcaaatagcgagcagatttctcagtcgcaggtaacccatcttttaacctgtggttaaaaacatgatcagtaagtcatttcacacggcctctcaatatcactttgataacacggtcattgaagtttttgagctcaagttgaccaatttcaaacctttgatcatcagtgttgatttttaaaatgtaggcattaacttttgagtaaaggcagatatgatttttagactgggtaacacttcatatttattggcaaggaagaagaaataaagcgagcgaagatagaaaagcagtagcttagtgtgcccacaggcatactggtggccactgtgacttaagtattaacccagaagcaggggctctgattccatccgagatgtttttcagagttttccacgaggctccatcagcagtataagggccattgtaagtcagatcaagtagatcacttctccagataaaaataaaaatagacttttctattgtggtctcatgtggagttcttattagttttataaatggtcacaccagttgtccctttcataaactagagtgaaatcaagactatcaagatttttcctctgaggaagaacagttaaggcacagaaaaaaaaaaaacagaaagcataaacttaaagaaattttaaaaacgtattaaatactgaatcgatgcattgatatcactctgttgcacacagaactgagagtcagaggcttgggtgcttgacctggctctgctactcactgcaggctgctgcaaatgtgactaaccagtttgggctccaattttctcaaattttctagaggttctcaaagtttccttataactctaaaattctatgatttcattaaaatgcatggttctttaaataggcagttttaatccattaggagtttcttgtgttctgtataaaggtttaatattgggaacttagttcattatcatgcatgattataaagtcctacaaacaaattcccattactagtgtgtctcagatccaaagtaattaaaatgaggatgctacactttgtgattacaaatattgtcttggtattactttaaattatttcctacaacaagtcagcatttttgacggtggattgaatttttttttaatgcccttgctacttagttactgaagaaatcaacactaacagatgagcgtgccctcagacactggaagagtgaatgtacctcctggagtcatcagattactattcaatttactattaaacctaaaaatttactactaaacgtttttgatattctgaagcaaaaaagatcatttttctactgcaatggcatgaagacatagcacaaagttaaaattttctctttaattccctattaagtatttgagggaactgcaaacaaacactgccctcatatgacattgaaagccaaatcagctctggttagggagattctaaaatggcgccacatccctattgtatggattgttttgctaatcagttttgtactataccctttgtttaaaatgtaatgacttgagccaaagatattggcatttaacagtaattttgtaaaatgattgcagatcataaacagattacattgttttacatcaggtgttgtaccagtgttttaaaaaacaactgctgaaggaggttttgaatatgtatctttctagccaaaaaaaacttaattagttcaaataggccccatcgtccccctcttcaaatgagtaagtcttgtctctattaatgtttgtttaattttaaaacaggactggaactttcaacccagctgtatataaaagaattattttcagcattctcattacaagagcccacttcttcagggttaatagagcatgttacatattcaaaatgcttcctagtcattgctcaacacatcccattcaaagaatgttgacatcataggaaggtttagagatgcagaaagttagccacagtaagagactagactgaagcgagcactcaaacaaacctcatctctcgcttaccttgctacattatttccttttccccagcccttctcacctccaccacccaagaatctacagagttctgagctctctggggctgtctgaggaacgtctcttggtattttgtcaggaattcgagtcattaggctcttgcagcttcccacttacaaagtatgtcttaaactgttatggaaataaggatggtcctaccatacaacttccggcgagggaaatgccttcactttcatagagagccggtaagaccgcttgccagctacggtttcaagcacctgctgttttcgatgtttcacagtgatgaatgctttatctttgaaaggagaagtgatacatacattagaaaagaataatttccataaacaaaaccttagggcctcattcagggagggtgtaatcaatgagtaaataaacagagctgaattatgatagagcctatcaatgagcccaaatgttgatcatgaataggatactttaaaagcactgtaattggtgaacgcctttcaaatcaaatggtatcacgtcctagccacataaaacagtggcagagcaacagaaagtgaaacaccttaaatatctctatcacaataacaaagaagtgggaagatatttctaaaaatctacctggccactataagcaaggtgagaaaaagttgctctgtacaccctaaaacaaccaatttgatatcaaaaatcaactggagaaagacaaaaggaaataaaggctactgatagaattgttccatagtttctgccctccacactgtttccttttcagcaatggaaataaggtctttaagcattttctttatagaatttgcatactgaaattaagcaacagcattaggattccttgagagtaaaagcaggaataaaatagcattaattctaaatgatttagcataccatatttttatttctctaattcatggtagtacctgagaaatttttcttagataataaagataaaactcatcatctttttctgttttgtttatacagaacactaagaatttcataaatatattaggttctaaccgaattattagccataataagcatctaaagaaaggactctctgttcaattcaaaagtattaaatgtaaagagtacttaatgtggtttgctttttgacagggggaggagggaaccatggccaagctgtattcattcatgataatgtaactcttggccaacagaaaactgacttatttagagaacacagacatctacaatgattagaaagcatagcatgagttggcaacgctgaactatgcttaccatatatatgcactgaggtgttaacagatttgaatgatggtccactccttacacgacaagtataaagtcctttgtctttgttctgcattttgtcaatagtaagaacactgtagaatatgttggcatgggaattgctttggtcaattcgtcgccttacggaagctctcttatttttctagaaagaaaatgtataacaaatgtagaaggagtgagtgttcatgcttaaagttatataggattttaacatttcttagatcattagttcgacaacagcttctgttttatactaagaatcatgtcaaatccacctagagcgtaatgtttggaaactacatctgtgtctagaggtgcttcaaatatgtagcatagcaggatttatttagcacttaattttcttcaaatacactttcacatatactatctcaattgtttgtcccaacaacctaatgagattggcaggctgactgcccttttagtgatgaaaaaactgaaggaagtgataccctggcccaagttggctaggaactgaagttgtttgagcataaatctagtgtccttcctctggcacacacacctctctacacagtaacctgttccctaggcatagatatcgcacacaaacgtggacaatcataagccttagttagtgtctggcttaatgacagtgcttctctcaccaaatcaccatgtgagtttccttttttgtccctacgagatatgaaggaaaatataatgagtcttggctgtacttactaaggtggaataatgctatagtttcattatttcactatttgaacagtgcttgcccatgtcagctaaatcacagtaaatggatctttaaccaagacttggaaggtgctgtcccaggtttgtctcagagaagatcaagaattagccttaggctctgcaatctgacctggccacaatgacagtcctgctcactgttttgagaagacaagatcacattgccgtctccttttttttttaagcactatattttataactaataagttatttccacctctcaatccttccccatagtcatagggggcggaggggaggagcatggaaaaatgtctttgggagctgtccagaactgatttttggatcttgagcttagttctcctctgtgccacgtttaatacacttctacccacctgtccttttacttccccattggaacagacagacacatgttgaggccattttcttcattctcagcaataaccagagagaaaagtcaattgccactatcaaaagtcagagaactagtcccctaacgtaacagactgagggagctttctgcagctctatttatacaggtactacttcctttgccaagctgagtaacactggtattgcttctgacttgggaaagaactcatcctgtgttttagaattgcttcgcccagtactgcagccaccagccacgtgtggctattaaaattaaatgaaatcaaaaattcatttcctcagtcacactagtcacatttcaagtgctcatctgccatatgtggctagtggcacagtactggagcacaaatacgggatatttccatcacagaaagttctgctggacagtgctgttttagaagattattagcatttaatagatgtgttgtagatactcttacttacagcagcaatgctagcaggataaaagtttcttccctcttggcacttacggagaatatttgatttctattaaaacccagaaaatattgctacaagccatagcatttttatttaaatgaaacaatacctctcctagagaatagtttatgactgataagtccttaatgtgtccctacagggcactcgttacacgtttttgttgctaagttattccatttccatggcgagaaatgtcgatgaaaaacaacactagcttgaggctgatgcattaatctttcatacataatttaatcataaattgactttgtaattgggcaatctgaacgacataacaaatgattgtacttgagatatgccgcataaatcatgctgacacacaagaaatgggggctagaactactgtcaaaatttccgtaacagtttatcatagtttccccatctatacatttttaaaacaattattgtttgcaaggatgttcgatttgaataagggaacccaacgcaggcttcattcttctcatttttctgaaggacagaattgctcccctgacacttaacaaatggaatattggatggctgggttgtaatatcttttccaaacatgctccaatcaggtgcctgactgtctgccagtatcttaaatgaatgcgctgacagagacagcctcctggaaagttgttgttgttgttacaaaaggcagtccctgcctggcatttggtgataaatttctctctcatctctaaatcctacagagtagtttccaagaatgaaacaatcccttttcttccacctagaatcatgcaatagaaataccagtctacactcttcaaaacaaaacccccagacatcaaaagacagtatctatgcatatcacactcatgaaatgccaggcaaagaaagcactcaaaccaaacccaaagcttctttattgactaacactgccacaggagtcaggattttctgatttttcccatctcaaaacccctgcgggatttcacttgcttaaaatactgtcctgcagaagaaatagaaaaatgggtcactcacttcatcagggtaactccaggtcatttgaactctcgtgttcaagggagtggtagcagtacaattgaggacaagagtatggcctctaagtaatttgactgggcgtggtgtgcttatttggacatctatgattgtattggctgcaagcataagagagaaattttttaaaattaagatttcattacacagataaaaatacagagcacttcggcttatgttcatgcctttgaagcatcacttactttgtcgatgtgtgagatagtttgtcttatacaaatgcccattgactgttgcttcacaggtcagaagccctatttctttgtacgttgcatttgatatgatgaagccctttctactgtcccagattatgcgttttccatcagggatcaaagtgtcaagtggaaactgaaaaggaagaggcatgcattaacaaggtcctattagcactggttggcaatactgtttcaccagcagtttgtgaaaacatgatttttcatctaaaatgaaaatagtaaaactttgtagtttgcttataacaaactaggttaaaaactctagtttgttataattggttcttgagtttttttgcatatagcaaaagatatttgcattatgataaattatagtaattatgataatttactatcagccttggcaacaagtggcatctacccaggatagacctacttgtcatgtcagactttcagttggagcccataactctttggcctccgggaatcttcataataagctggtcagacactcaatagacaaaccaattaagaggccgggcgtggtggctcacgcctgtaattccagtactttgggaggccgaggtgggcggatcacctgaggttagcagttagagaccagcctggccaacatggtgaaaccccgtctctactagaaatacaaaaattagctgggcattgtggcaggcgcctgtaatcccagcctctcgggaggctgaggcaggagaatcgcttgaacccgggaggcagaggttgcagtgagctgagatcacaccactgcactccagcctgggtgatagaacgagactctgtctcaaaaacagagagagaaaccaattagcattttttttctaccggggctgccagattattctcatttgttttcatcatccagcgcttttaacaagccatagtttttcctcccattttgcatagtttactgaagaagtggctgtcttcaaaagagtgtaaataattccaggtcctccaagattcataacattaactcagcactcactggggctgtcattctgacgatcctgctgtgtcacaaggaaggcatcagctctgcctctggaaaggaaactcccagaagctgaagctgctgatggtgaaggcagcctcggaggccagagactctgcaatgaatgaagtgctctctaatgctcagaagtattcccaagcacggtgagtccaaacagaagaaaataatccatgatctgactttctccttatgccttcttctgacatcaagaatgtaacatttaaagactacaagataaacactctgccttgggattaaactttatttataaagggtcattgctccataaagtggcccagccaaattcccctgatgccaggttgccagcccaatttcagtggtggtagactcccaactaccactattccttattcccagttgaaaaagggggaaaaaaatcaaattaccttcccccaacagattataaaggaaataccaaacagccacaaagaagctcgaaaccttttctatcgccttttaaaaagtacacctggcatccctcgctctatccagttatcatttatttctattgcttgctgaaggcgctgatctggatttgtgatcctatggcagagatttctagtccagaagccactagtgcctctcttccagggactatgcctacatcggaatgtattaccggtgttccttgggtttgaaattaattacatcctgtttatgaagaactgaaagcaattaaaggattcgctttcatgtttcagtaaatcaaggtgctacctgtaaactcaggaatgcagtcggtgggaaaaaaagaaccttctcttctaatttagtgcaagcaaaggaaaaacccagaaaaatttaagtcagggactgaaatctatggtactttacaaataagtgaaaacaagcatgtgctgaatctaaaagaaaggattgctgacagacgtcctcagtacaacttaaaaatacactaaaatttcctccgaagtgtttctcttactctcatctatccattacggctgttagtagcattccattgacaaagtaactttacatttagctgacaagatctaaagcagtcaaagactgtagcccatcagctgtggccaccaccgcatgtgtaagaatgaaggcagatgggcaggtggatctcagcctcgaaaggaagccctgggcagcaaggcctgtctgcagctgaccatggctccgacaaagcaggcatgtgaaaaggagagggaggggacagaaaattagaagaaaagggacaataagagaaatgaaagggaaagatattaacttcatgtcagcagaaatacgtcataggttagaatatttccagtatatatgtgccaaaccaaaatccctgtgaaaattttacacttctctttctctctttttaaattgtgcactccagatcgtaggcagaaaaaacagtaaatagactcccaccagccccagatttttatatgggaattttggaatgctcctgatgaccaaacaacccatctgcattagcgctcccatgaaagagaacgtttccctctccacgtggtgttttccatattaatcatacagcaataattatctcagactaatgggagtaatgccatgctattgaaaacatgacttggtaatataccaagtacagtattgggtgttaaactgttaaataatgctaaagctaacccttgaatagggctgatcttgtacttagatactgttctaagtgctttccatatatcacctgacttaagttttctaacagcaatgtgaggtggtactattgtcattacccccttcctcagatggggagagtgaggtggagagaggtttgataactcattagtttgcccagtgacaagtgcagtatgttcagagtgcaggcaatgtggcaccagcctctgctcttaaccacacttgtcttcctcctatatgaactagaccattcaagaaggatggcaggaacactgaatgagaaggcaaggtattggctcaaatgcccagtatgacctgcgaagttcctgacactctggaaaccagggtgtttttatcttgaccaactgaggagttcaactcctctggcgtttccagctctgctgtataatgactttctatttcctggcgatggcacacaaatgtagtggaggccaaaacctgtctctgatggactatgttgaaggcctacgtgagtaacaacccaggagagtgaatgcaaggaaagaggataaggagaatcctccaccacatttcaggactcagggttgatgggtgagactgaacatcattctctgaacttttccagcctaactgccacagctaccagcaccaaacacttcctgagtgcctgctctgtgatgcactgtgcgaggtgctgctctggggcggacttgactttctctcttaaagttctaagctctcagaacttagcacagttttccgtttggggagcttttatccagttctgagtcctggtatactcctaactcttactgctgattaattagctagaatgtcataggtttagtttttgtctttattagattctaccctaaatcttttacctttccatatgtacaatttacaatatagtatgaagaaaagtttcacgtatggccttctttcctccctttttccctaagagatgaagtttgggtgctcagcaggagacaggccttttatcacaaggaacttgccaattcaaaccaaacgtgctggctccttatgcatgaagccagaacatatcgatgcctggagaactgggcaccctgctgacattctgtcttctctgcagtaatctggataatccactctctgcaaagttattaatttgtgtaagcagcagaattgatttttctcacatttgcacacagttgggtttgtggcaatacataacatttttcacgatttcagttctttcattattcacatcgatttatgcttaagacaccatcattttattctatttaaccacatgcatggacataacttctagcactattccttatagtaaaaggatgttacaggaaagtccactgagaagcccaggtgtttgtaaggaaattattccagaaagatagaacgagtaaaacttcattatgcttatttgcagtgaaagtatgctgagaatagcggtgttcaaatttaccttttttaaagtaacagtgatgttaggtgacgtaacccggcagggaatgacgagctcccttccttcagtcatgtgtataatttcggggatttcactgtacatctctacgaaaggtctacctgtatctgaatgagaagaaaatgaaaaaaatatatacataaatgattgacatgcaagcatctagacactgtagctagtgtggtatggtaggcattgccacagtcacgtcattctcccttaatgtaatccatacattcacatctttgtctctgaatttggccctctgtgtttctacccagaaaaagaaagcttccctaataaaacctaatttcatatctgttgttggcctctgatcagattgccccaataccttaatatgcaatgtggtatggggggaccactgtgggaaaaagcctaaaagtgcagtaggagagaaaggagaaaattctgcatagacttctcaccacagctatgctaagtgcctcaggaagcgccctccagagcctttgtaagtgctcaaagggcatagatgcagtggcgaaggtcaactctctttggagaattcaaggtgatgcagaagtctagcaagttgaggagaggattatcatttgaatgacagaagcatgacttaaaggttttctagacttttcctcggaggctaataataatgaatgagaaggtctgagctgcttagggggaggcggacaggccggagaagctgtgttgaatgctgcatttatttcatatgtatattaggcttatttctttagtatgcgctacttacctgctaatagcaaagtctgtgcaagtgcctgcagagaagtctggaaaagactttaagcaccaatacttccttaaaaagcgtggcatttggccagtctcagaggcaaggaggattcaaacacctgttcagcttccctgtaactcctcagggaaccagaatgagtccaagatccttttagaaacattctcagtctaccctgcccttgccctcgggaatctattgacatcctcaggcaacgatctcttcgggagtcattgtgttctgatcgtcccgcatttgttccagccttatatactaaatggaaagaagtcctgtgtgaactctctccatttggacctgaaagaaccaaccaggcccccacctgcttgctggtcctgcctcaggtttgtggattacgaagctaattcaggatgctgaatggagaaggaattggagagaaacaaaagcagtaagcaggcaatggttgcccagactagatggtggctacagtgatcattatggtagaactgtgtccccaccaaaacgatatgctgaagtcctaacccccctgtacttctgaatgtaacctcatttgaaaacaggattgttgcaaatgtaattgcttaagctaagtaagggagggctcctcatccaatgtgattagcatccttgtaagaaggcagtcatgtgaagacagacagggtgtgcagactcgcactatgtgcagatggaggcagagacaggtgtgatgcagcggcaagccaaagaatgccaaggattgcgggcaaccaccagcatgtaggaagaggcgagggagggttcttctgcaggtttcagaaggggcatggcccagatgatttgatttcagacttagagtttccagaactgtgagataatacatttctgtagttttaagccaaaaaagaaaaaaaagtgggccattgctgtagcctgctgaagatgggatagttttctgcacagcagtgtggaatggaggcacagatgtgagctctagagagaccctttcaccacagcccatcttgtgtggtccctggcacctatatgttaattattcccactcatcctccgggaagccttgctagcccccttccttcctgcacccttctccaccctagcccacattagggactttcccagtgttcccattgattctgttacaacacggtccacagaaccagcagtttttttctctgggtactccttggatgctacattcctagaggagaggaaatggattgtattcatgtctgtctcatgtgtactgaatgaatgagtgaacgggtatccaaccccgtccttttacagatgagaaaagaggcacaaacaggtgaaatgagttgtctagatgggcacagccaggcctgtaggccagttacttctgcctccaatctagagccccttccctggcggcaccctgaaggctgaacctctggctacgttctcttgaaggcccccatagaaagggctgccagcaggtgacaatggtttttcagagatgaaggctgatttccacacattcagtgggaaagtaagtgcctcatggtactgcatagtgttggagaaattctgaaaaagggctgaacaccaaggcatggtgtgtgagagcaggctttggggcaggctttgagtcggagggaggtggttcagagtacgcctcaaagcctgggtttaatcctggctgtggtcctgtgtaactgtgagaccttggggaaatcattataccctctgtgcctcatttgtaaaatctaagtgaaagggctatgatgaggattacatgaattaatatatgtaaagcacttagaatgatgcctggcaaatagttagctgttaattttcttattattattatgactcatttgaacttatgaacaaagtgttagagttggcagttaggcagacatgagtgggacaggagagtgcccctcctcccaagaatgtcaggtgaccatcaggtgatggtcaggtggttattaaactgtctttctaaaataataattagtcacagctggcaccagagaccgtctcccaacagataggaaacacctgaagctggtgatcagcagcttcctgataagatctcagaagttgggggagcaggctcaagcatgcacactcaaaggcaaaatggcacagtttaaccggtatatgactttcctctgtgaatgctcaactggtaagggaaaaacacctcaagtgagcacaaacacaacttcagtaaacacagtgcgcatgtggctcctcccaggtgctggcaggccactgtgcatgtggacagcccatcccaaaggaaaaatcaggggaaaataaacacaaacccttgaatctctccagttgcctgcttggccctctgccaagtgtagtttgcttcctctcattcctgctctaaaactgtttaataaactctcgctcctgctctaaaatttgcctcagtctctccctctgccttacacctactaatgcccttggctgaattccttcctccaaggaggcaaggatcaagttgctgtagacccatacagattcgctgctggtaccagtaggtagatatgaaaatcacaaattatactcatcatcttaactatcaaaaatataaatatatattgatatagtggcataggaaaaaggattggaaacaaacatactaaaattttaagagccaggtgcagtggctcacacctgtagtctcagcactttgggaggctgaggcaggaggatcacttgaggccaagagtttgagaccagcctgggcaacatagcaagatcccttctctgcccaaaaaaagttaaaaatgattatctttgggtgttggctttatggattattgttgttcttatttaccttcttctatatttgtcagtctttctagaatgatcatgcattattttatagtaatatttttaattattaaagttaaaactcaaatgataaagctccatccatttttgcttaaggaaaactataaattttgcatttgatttacctgagtttcatcctctataatagaatgagacattaactgtcacagttaataaacttatgtgtttattaggaaatctcagtgggtgtagtaacatatgcagagagaaaaagttaatcagatagacacaagggtttcttatcagaattaaattcttcctttaaataaagttgctgagctagacattcagccatggactattgggatttgatcattcctttccttcctcttgtgagtctatatttttgtctcttttgtgcatcccaaggtaaacacaaacactaagaaatggtttaattcatttaactaaattgtaaatccttcatatttaatttactgtctccttaagcaactgttttcaacaaaggacactggcacaaaaagttcctacaggagataataaaatcagtgtagtcatttctagactaatgaataccaatcccaaatgaaaatagaaaaggttaattcaacatatctttgaatttcttctttccctttggtactgtggatccccaaaaaacttaaattttactacagctattggcctctaaaagccaataccaatttcagcactgggtccactgaaattctatccgaagatatcagaacttcagtgatttgtgtccctccaaacactatgcaaaacacattatttgtgtgacagtcaaaagtggcattataaatccactgtgtttgcaaatgagcatatgactgtagatacacacacacacacacacacacacacacacacgaacacacgaacaatactctctgggcttattaatagtatatttcctctgcaatttacttcaaggaagggctaagaatgaatttgcctgacatataataatacaaacatattttgttttgtaggaccatagatatagaagaggtcacggttccattaatatcaccagtaaaaccacttactactcccgtaggacacatctgtctttgtcacaaaattaaaaatgacttccaatcccagccagcactgcagagtgatttcctgagaccaaattggctggttgttgaaagagtgaggaagagctgctccaaagactgccggtgtactggcagctcagacacactgtcaccagggactcatgccaacactcagctaggtggaggtcacactgccctcacctctctgaactcttagagctcaaagcagtgacaggaaactggcatagaatatgaggttttctcacccactgggagtatctgggctgtcacctatccttcaggacaacaagtgggctcagacacagagaaagatcaaacagggacccttgctcagaatggaacgatgtctattttttaaatgtgttttttccttttgaaatctgtaatcatgctggcacattgaagcatacagacatagtggcccctgcatgttatcctcaatggattccatttccaactggcatcacctgggagctctgctgtgttcagagcaagtaaacaatgttcaaaatttaggacttgtgacttgaagaggagttcaagagtaaacacattgttttctagcacatgtacatatttatggtttttacaaagtttttcctggttgcctttcttttaattgcatttttatcctggtcatgaggacatctagtcattttaaaggagggtatgattttcatttactgaagatgaaggggagaggataaaaaatgaattaaccaatcccatgaaaagggttctatctagacataagagttttcacatcacacagatcttcatattgtggaccgtaagtaatactcaaggagaatgtactgattggtaaaatattttatttgaaatatgagcaagaaaagaaaacaggcaggttcttccatgacttacactgcctatcaaagccactgacaactcaaaacagagctttggagcaaccacaagaaagttggagtagttatactaacatcagacaaaatagacttttaaataagaaattattagtgaggaaatggttagtgaagatagagaggggtgtttgataatattaagagggtcaatccttgaggaagatataacaattaaaaacatatatgtacctaataacagagcactaacacacaggaagcaaaacctgacagaatcaaagggagaaatagacagttcaacaataacaggtgaagatttcaataccccactttcaatagtagatagtgggctaggcatagtggctcatgtctgtaatcccagcactttgggaggccaaggcaggtggatcacttgaggtcaggaattcaagaccagcctggtcaacatggcgaaaccccatctccactaaaaatacacaagttagccagtgtggtgatgcacgcctgaagtctcaactactcgggaggctgaggcaggagactggcttgaacccaggaggcagatgttgcagtgagctgagatcacaccactgcactccagcctgggcgacacagcaagactccacttaaaaaaaaaagtggatagaagaactggacagaagattttaaaaagctagtagaacaccagaacaacactactaaccaactatacccaacgacatctatagaacacttcacccatcacagcagggtatatattttcctcaagtgcacatgaaacattctccaagatagaccatatgctagaccataaaacaaacctcaataaatttaaaaggatagaaataatacaaagtatgttgtctgaatacagtggaatgcaattaaaaatcaataacagaaataaatttgaaaaattcacaaatatgtggaaattgacacatccctaaataatcaatgggtcaaagaagaaatttaaaaagaaattagaaaatactttggtatgaatgtaaatgaagacacagcatactaaaatttaaaatttacgggatgaagctaaaacagtgtttagaggggaatttatagctataaatgcttatattgataaagaagaaacatctcaaatcaataacctaaacttccaccttagaacattgagtaaagaacagaaaactaaacctagagaaagcataagggagaaaataataaagattatagtagaaattaaagagaatgcaaaacaacagaataaattagtttcattaattttctaaaccaaaagctggttctttgaaaagacaaacacaactaataaaccttaagccagacaagccaagaaaaaaagagacaagactcaaattactagattcagaaatgaaacagggccaggtgcagtggctcatgcccgtaatcccagcactttgggaggctgagacgggtggattatctgaggcaagggttcaagaccagcctggccaacatggtgaaaacccatctctactaaaaatacaaaaattagccaggcatgatggtggactcctgtaatcccagctactcaggaggctaaggcaggagaatcgcttgaacccaggtggcagaggttgcaggagccgagattgtgccactgcactccagcctgggtgacagagctagactaaaaagaaatgaaacagtggacattactattaaaattataaattaaaaagcattatgaaggaatattataattatatgccattacattagatcacagatgaaatggataaatgccgggaaagacacaaactactgaaacaagctcaacaagaattagacaacccaagcagacttttaacaagagattgaattgtaacaacaacaacaacaacaacaacaagctgctcacgagggaaagtcagggcccagatggcaagtcaattctaccaaacataaagaactaataccaatttttcacaaacttttccaaaaaatagaagagaagagaaaactttccaactcattctaggaggctagttttactctgatatcaaaatcaaagacatcacaagaaaatgacaaaccaatatctattacgaatatagctgcaaaaaactcaataaagtactagcaaactgaattcagaaacatataaaaagaattatatacaatgcccaagtgggatttttttcaggaatgcaagattggtttaacatccaaaaaccaatgtaattactatatcatgtcaatagaataaacatcaaaacccacatgactatcttaaaatggcagaagaaggatttgacaaaaatccaagctcctttcgtgatgaaaacactcaggaaaatgggaattgcactgaatttcctcaacctaataaatggcatctagaaaaaaccctacgtctaacatcatatttaatggtgaagcactggaagtttccccctaagatcaggaataagacatcgttgtccaccctcaccgcttctattcaatagtgtactagaggttccagacagagcaattgggcaagaaaaataaatccagattgggaagatcaaaatggtacaggtattttggaaaacagtctctgttttcagatgacatgatcttacaaaatgctaaggaatccactaaaaaactactagaattaataaatgagttcagcaagattgcaggatacaatgtacaaaatgaattatattcctatacatttgcgatgaacaatctgaatgtgaaattaagaaaacaattccatttataacagcatcaaaaagaataatgtgtttaggaatatatttaacaaaagaaatgtacaacttatactttgaaaactataagacattgtggaaagaaattaaagaagatctactaagtgggaaacatctcatgttcatggattagaagacttaatattgttaagatgttaatgtcccccaaattgatctacagattaaatgcaataactgtaagaatcccagatgacttcacagaaattgacaaggtgattctaaaattcatatgaaattgcaagagacccagaatagacaaaacaatcttgaaaagcaaaaacaatcttggaagaccgcactccacatttcttgatttcagatgaaaactacaatgatcaagacagtgtggtgctggcacaatggattagtggaatagaattgagactccagagatgaacccatgtgtctatggccacttgattttcaaggagaccattcagtggggaaagaataatcttttcaacaaatggtgctggaacagctccacatgcaaaagaatggagttgtactcttatatcacaccatatacaaatattaaccaaaaactgctaactataaaaaatatatattttatagttatataatataatatataatatattatatattttatatatatttgcaaaagggtctcacttttctaggctgaagtgcagtggcaggaccatggctcactgcagcttcaacatcccaggcgcaagtgatgcccccacctcagcctcctgagtagctcagactataggaatgtgccaccacacccagctaatttttttttaaaaatttttttgtagagataagggtttcactatgttgccagggctggtctcaaactcctgggctcaagcagtcctcctgccccggtctcccaaagtgctgggattgcaggcatgagccaccacacctggcctaatacaatattctcagaagaaaccagaggtaaatcttcatgatctcaaatatggcattggattcttatatatgataccaaaagcacaagcaacacaagaaaaaataaactgaactttattaaaatttgaaacttgcatgcttcaaagaacactgtgtagaaagtgaaaaggtaacccaaagaatgggagaaaacatttgcaaattatatatctcataagggacttaaatctggaatgtataaaatatatttttatatgcctcaaatatatttttaaaatctacatatataatatataaacatatgtttagaatacataaaaatctagatatattatgtatctatatattatatctctagaacatataaaatatattataatatacaattgtatgaaataataaaaagttgaagaactcttacaactcagtaataaagacaagctaattaaaaatgggaaaaggatctgaactgacatttacccaaagaagataaacaagcagggaataaacaaatgaaaagatacttaacatcataagccatcatggaaataccaatcaaaaccacaatgagattcactgcatacccactaaaatggctataataaaaaagacataattacaagtgttggcaaggatgtggagcaactggaactctcatccactgctggtgggaatgtgaagtagtgcacccactttggaaagcagtctggcagttcctcaaattgttaaacatagagttaccagatgacccagcaattccacccctaggtatctacccaagtgaatgaaaacttgtgtccacacaaaagcttgtacacaaatgtttactgtagcactattcataataggcaaaaggtggaagcaactcaaatgtccatcagttgattgatggatagctaaaatgtgatatgtccatacaatggaatattactcagaaatagaaagaaatcaagtgctgatacatgcatgatacatgaaagaacctcaaaaatattatgctgagtgaaagaaattagtcacaaaagactacaaattatgtattctatttatataaaatatccatgagacaaatctatgggaacagaaagtagataagtggttgtttagggctggggggataaggggtgatagctaaaggctatggagtttattttgagacaatgacatattctaaaattgaccgtgatgatgatggttgcatatatctgtcaatatgctacaaaccactgaatcatcattttaaatgggtgtggtatgtaaattatatctcaataaaacttattttgaattaaaacagaggtttagtctctttcttagaaatgatgatccactgtttcctgagctggctgagctggaatggttcccagagatctcccagggtaaactcctcaccttatgagtctttgcagcatttctctcccattcccctcctgcatccagtttaggccactcacaaaaaataaaattttcccctgtgatagaaccatcatgatttaaatatgtctttcaaggttgggtgcgatggctcacacttgtaattccagcactttgggagcccaagacagaagcattgtttgaggctaggagtttgagatcagccagggcaacacagtgagaccccatgtctacaaaaaaattttaaaaattagctgggcatggtggtacacacctatagtcccagctactctggaggctaagataggaggatcaatcgaagcccaggaattcaaggctgcagtgtcactgcactctggcctgggcgacagagcaagaccctgtctctaagaaaaaaaaatgtccttcagttccttgttggcagtccctggtgggcaggtggcataatgaaacatctctgccttcacatagatgggaatacttgcctggtgtgtgtgggtattatagtccacatggaatgcgcaatttaatatctcctagtaagctatcctgattatccaaatgaatatcttaagaacctcaactataatttatcagctaaaaatataacaactgtcgccactattggtggattcatatacaaattcaaaggtgataaaaaatctcactgagactggcttaggaatatcagaaaatcagttgctagtttctgccatccagacagacacttacatgttacacaaatatttctatttgagcagggtaaacttagagaaaagtcattgtgtttcagactcaagatgccattctgaaatgaaacatttaaaaatgtattatttgtgtggtaaaaaataagaagtgcctctttctaaaaaagagctctttgcctactacctgcctttcctcagaagaaagacattgctttttgttttgttttgttttgtttgttttgcattgcttcacttataacagcagatcgaacagcaagagcagagcaaaggagaagaattagaaaggaggaacaggagtggtggttccttttctccttcctctggcttcgcctaagccccctgggatgctctttggaatgtgggtgtctagcggcaggggatcaggaaaaccgattcccctcaatccaatgtccagcagaggcggacacatggcacactgtcaacagatgtttatggagaagatataagattgaagcaagcaagaaaggtgaaatcaggacgtattatgtacccagcactgtgcacacggacagtccctggactccagtcctcagagtctagctgagcagacacacacacacctcacacacaagaatgctcatgttgattagaggaaacagtactgatacctgccttgaagggaagtagggacctcattttaaaaatttacagctaagatctgagtaagtgagttgaagatctcagtgagagtggaatgctggctagatttaagcttgatggactgtaagattaagaatgtctcagctttctgtgctctctgggttttcacactaagctggctggcggtttctaggttctgttaaccagatgactgacctcagtcagagatcttcatcttgatcagttgagacatctcagaagaaaaagagaaagggagaagggaaggagggaggaaaggagggagagagggagaaaagaaggaaggagagaggaagggagggagggaaatgaaaaagaaaaagcaaggaactctaatggattactataaatctttcttctactgctaagatttttggccatgtcccaagtcctattatttattcccagctctgcctctgaatcataacattataaaactgtcaaaggacttttaagatgccctaattctgcctatcatgttacagatgagaaaactgaggcccagagaggagagactgtcccacaagcacaggaatacaattaatggctgagcaaaaactgaatttacgcttcctgatctgaggctagtctccctccaccacaccaaaatctggccctgacactcctcaatgactcaagcgtgacaattacatcttcaaatatccacactcagtgggagaaatgagggcccagaaacaggggtagcatggggccttctgacggggactagaaatgggaagcaacggactgatgaagactcaccgcggaaaccaagcttcagtcattggaccctctgcttagctctctgctgtaaggtgctgaggactttttaggagatggtgaggacaacctcagaaccaacagttggccaggcacggtggctgacgcctgtcatcctagcactttgggaggccgaggtgggaggactgcctgagctcaggagttcgagaccagcctggacaacacggtgaaaccccgcctctactaaaatacaaaaaattagctagacgtggcggcaggcacctgtagtcccagctactcgggaggctgaggtggaagaatcgcttcaacctgggagacagaggttgcagtgagctgagatcgtgccactgccctccagcccgggtgacagaacgagacttcgtctcaaaacaaaaacaaaacaaaacaaaaaccaacagtcacaccagagcaagccctgttttctggagcctggggaggaaattccctctcaggggcagaggatgcctggtcagactcctctccagcagggacactggggacagtgggttttccgagaggacagccccgatgcattccatcagcatagctgtgtgcggggcggcgggggaggggagcgggtcggggtggaggagggcagttgaggggaggcaggagtcaggggaggagtcgggctgtgtcgaagtgctgcgctgatgacctgcgccaccacgggactctctagggctcagcttcctcatctggaatgtgggacaggcactttcctgttcctaaactcgcgatttgttatgcattcatttgaaatgttcacactgggcgtagcacactgacatccctccgggggccagacacacgagtggaggaactggaggtgggacaggaggtgttgtggcagctgggaacgtgagcccatgcctgaaggggccgtccctgcttgctgcagtccattgttgccaagtggaaatatgcgccagtgtggctagtgtttccagtttttaaagataagtaggaaatgaaatttttacgtgaactcttctagctattaagcattggcagctaaaagtgctgtgtctgccaatcaaaacatgtgtgccagctgaatccagcctgcatacttccagtttgcaaccctgcatgcactcctgtcccttctctcccattttataatgcacacaaagttctgagggagttggggtgggagcccaggcaaggacacgttagaaagaccgggggctttggagtcaaccagacttgagcccaaagctttgacaggataatttacgaagtatgcagccttaaacatggtattgaatttctttaacttttctgtaaaggaatttctcttattgggttgtttcgaggatgaaatgagatgatgtatgtattaataacaagcctgagccggacattaataaacgatagtgacctacaccaggtgcttaatgaatcccagcagaggaaaggtcctgaggcctcatctgatctggtcccatcaagtgagtgtctgcttcctagatgcgtggggactaatcactcccaagacattccttccttccactttgggacagctttgcatgtcagaaagtgtttccttaagtcaagctgaaattcttagatagttgttctgccatctaggattataaagacgaagcttaatctctttttcacataagagaactttgaatgagactgtcactcatgtctcctattttcccacccagttctttatatttttagattaaatatttaagtcctttcaattgcttcttgccaatgaaaataataaaatcatcaaattacttcatgctcacaaccctatgaggcaggcacccattttaaagatgatgacaatgaagtgtaaagggattaataatttgcttgaaattcctatttttaatgtccctcttgaggtgtaaactaaacagcaagtctggcaccacctaagtctggcactacctttattcctggtgctatatatttcttcctttcctcccctccccctccccctcccctttcctttcctttcctttcctttcctttcctttcctttcctttcctttcctttcctttcctttcctttcctttcctttcctttcctttcctttcctttcctttcctttcctttctgacagagtttcactcttgttgcccaggctggagtgcaatgctgccatctcagctcactgcaagctttacctcctgggttcaagtgattctcctgcctcagcctcccaagaagctgggattacaggcatgtgccaccacaccgggctaattttgtatttttagtagagatggggtttcaccatgttggtcaggctggtctcaaactcctgacctcaagtgatctacctgcctcggcctccccaagtgttgggactacaggcgtaagccaccacgcctggcagggtgctacatatttcttaatgtatcccaaggttggatacattctcttggtaaatatggagtcaactgaaagtctgaagtcttttgcatgtgtgctgtctcagcaatggcttcccccatccagtactagggtagttagtgggttttgcaagccaaatacaggcctttacatgtattcctgttaaatctcattttgctaatccctgttcactgctctagtttgttggaaaattttgggatcgtgatttagtcacatgacatgattttgacccccacatttgtctcattttctcaatgtgccctcaatttcctttttaaagtcaaggaagtcaggtaagactaatatacttaaaaatcccatgtttctttcatttaacaaagatttactgagcaccttctgtgtactataccctgtgctgggtcctggggctatcatggtaagcaggacgaactcagtcctgtccgtagagcttgtgagaggtgagtcctgtgtgaaaggtcagtaggagcaccatcccgagtttgggggtgcctagggtgcttcccagaggggggatatttaacttgagacctgaaaagtgaggaagagtgagctgttacagaagagctgggtggggggagtggggaagggtggaatgtcccaggcagagcacccccagtccacacccctcttactgctctttccccagtatggttaattgtaactcattttctttgacctaccaaactgcaggccccttaaaagttgttggtatcatctttgtacttcctactgtgtccagcacggtgtttttcacacacagggattactaccaatcactactgcctcctaagtgttaggcagtctgtattgtctcatgtagtctcctaatagcccctgaagtaatactcttctcattttacagttgagaaaaccaagctcaaaaaatggtaataatgagtggtagtattaataataataaactcgtatatagtgcatactatacaccaaacaccgtcctaaatgttttgcacatatgcactcttgattatgggaggtggttataggcaagaactttgttgccatctctgccatacactagttatataaccttgaaaaagctacttaacctttctgagaaataaatggagatgactgtgataatactttcagactaagatcaggatcaaggcaaggatcttccctctcactactactttccaacatcacactggaagtcttaactcatgcaataagacaagaaagggaaatagaaggtatacagattggaaaagaaaaaataaaattgcctttgttcacagatgatgtgatcatctgtatagaaaatcaaaaagaatcaacaaaaatacccctggaactagtaaaagattatagcaagcttgcaggacacaaagttaaattcaaaagtcagttgctttcctatatacaagcaatgaaaactagtagagttgaaatgaaaaacacaataccatttgcattagcacccccaaaagtgaaacacctagacataagtctatcaaaatatatataagaatctatatgtatgaggaaaactacaaaactatgatgaacaaaactgaagaaaaactaaatgaatggagagatatttcatcttggataaaaaggttcaatattgttaaaatgtcagttcttcccaacttgatctgcagattcaatgcaatcccaatcaaaatcccagaagttactttgtggatatggacaaactgatcctaaagtttatatggagaggcaaaagacccagaatagccaatataatattgaagaagagcaaagttggaagactgacactacctaacttcaagacttactacaaagctatagtaatcaagacagtgtgatattggcaaaaggatagacaaataggtcagtggaacagaatatagagcccagaaataggctcacataaatacagtcaactgatctttgacaaaggagcaaaaatcatcttgtcaataaatggtgctgaaaaactgggcatctgcatacaaacaaacaaacaaaaaatgaggctagacacagaccttacactctttagaaaaatcaacacaaaatggatcatagagacctaaatgtaaaatgcgaaactataaaactcctagaatataacaggagaaaacctagatgaacttcggtatgacaatgactttttagatgcaacactaaaggcatgatctacaaaacaattgataagctggatttcattaaaattcaaaactcctgctctgcaaaagacaacatcaagagaatgagaagacagggcacagactgggagaaaatatttgcaaaagatacagctgaaaaaagaattgttttccaaaacatacaaagaattcttaaaactcatcagtaagaaaacaaacaactctgtttaaaatgggtcatttcaccaaagaagacctacagatggcaaataagcatatgaaaaggtgctccacgtcatgtcattgggaaaatgcaaactaaaataacaatgagagaccattacatacttattagagcagccaaaatccagaacactgccaacagcaaatgttggcaaggaggcagagtgataggaattgtcatttgctgctggtgggaatgcaacacgagacagccactttggaagacggtttggcagtttcttacaaaactagcctttctattgccctaaaattgagcaatcatgttccttggtatttgcccaaaggacctgaagaattacatccacccaaaacctgcacatggatgtttatagcagctttattcattattgctaaaacttggaagcagccaagatgtcctttggtaggtgaatgggtaaataaactatgaatataattatataatgaatttatataatgaatataaaaatatataaactatgaatataaaaatatttatatgatggaatattattcagcaataaaaagaaattagatattaagccatggaaagacatggaggaactttaaatgcatattacaaaatgaaggaagccaatctgaaaaggctacatactgtatgattccaactacatgaattctggaaaaggcaaaactatggaaacagtaagaaagataagtgtttgccggccgggcacagtggctcatgcctgtaatcccagcactttaggaggcggaggtgggtggatcacgaggtcaggagctcgagaccagcctggccaacatggtgaaaccctgtctctactaaaaatacaaaaattagctgggtgtggtggtgggcacctgtaatcccagctacttgggaggctgaggcaggagaatcgtttgaaccctggaggcagaggttgcagtgagctgagattgcaccactgccctccagcctgggcaacaggatgagactccctctcaaaaaaaaaaaaagaaagaaaaataaggataggtgtttgccaggggttgggattaaggaaaggatgactaagtagagcacagtagattttagggcagtgaaaatactctgtatggtactataatagtggatacatgtcattgtatgtttctccaatccatagaatgtccaacaccaagggtgaaccctcatgtacactttgcacttgggtgattatgatgtctcactgtaggttcattaattgaaacaaatgtaccattctggtggggaatgttgataatgaagactatgcatgtggggacaaggggtatataggaaatctctgtaccttcctctcaattttgctgtgagcctgaaactgctctaggaaaaaaaaaaatcatacacacacacacacacatagacatgcacacacatctaatttttaaaatgagagcactacttcacagggttgttgtaaggataaaatctgttaatgaatgcaaagtgcttaggatggcacccagcatggattaagacccacctaaatgttaaccattctccttattaagcaatttgtccaaagtcaaagacctagtgagtatccgaacagggatttgaaagcagtctgaagcctggatcatgttgtttcaactgtagcttattaattgacatttgatgaaggaaggaaggaagggaggggtgtttactgctttagtaagctacctattttgaacaacacaatcagctagccaacataattcagcaaaaatacatcaaatgacacacaacaaatattttaaatagttaaaggaaaaactgtagaatattagaactggaaggaccataaagataaaaacagatcacctcctcatctccaagcaaggcaagcatttcattatcattgttgaagttatgaaatgccagaaacttaaagccttttcagcttaaggggatttcttctgaaaaagtcccttgcttatttttcttaaaagatcacttgagggagagtttttaaaatccttaaaaccataaagttttgatcaattgtttttcacacttcttgattgtaggggaaaaatgagagaatatggtcaattttattacctttggacttcattgccatctttagatttcttttccttttttctttccttttctttttttttttttttttttgtgatggagtcttgctctatcgcccaggctggagtgcagtggcgcaatcttggctcactgcaacctccacctcctgggttcaagcgattctcctgcctcagcctcccgagtagctgggactatacacatgcgccatcacacctggctaatttttttgtacttttagtagagacggggtttcaccatgtccgtcaggctggtgaccccaagtcatctgcccacttcagcctcccaaatactgggattacaggcatgggccaccacacccggcccatctttagatttcataattccaccacagtcatcaacttttcaaagccttaaattgtgtccaagtggcttattcaggactatgttcattctgattatttttgagtacttatatagttctactaaatgcctgatgatgtataactgcgtcgttgctagtaagtcttagcaatgtggctctagagggatggcatgccaaattttttctggtatggattttagagagccccagaaattgttttctctctgagggaatggcctgaacattttacatgtccacacaccaagtgctaaggatgaaattattaggacatcctaggagaatacagggtctggggcaggggccaaagagagaagatgcatttgttcctgactgccagcaagtctaccaatgtgagtggcttctgtcccaatcatatatcagggtcttctatagtcaagctcccttagtgtttaatgacagaaatgtttttagaagggaaatgtgacatgtcagggcttaaagatatcaagaatgtcttccatccaatttccacgtagctggaaaggaaaatggttaagagttaagttactgttctctaaactctcaccatgtggtcctaatcagctgtctgccagtgatggatagaatgaataatctccttcatacttcagccctagaaggagtgcacagccaggatgtagaggggtctatttcccaagaaaaaaactgcgattgcaaacaacatcatcagtgtgtattttaaaccctagaaatatctgtttcccctctttcacatctttatcaaaatgaaaaaataaatccagcaaaacctgaccttgcactaggtttttgatgaagatgtgtgcagatgggccagaaaattcctaggagttctttagagaatttgaaggataattctgcagatgcacgtcagtctcaggttgctgccattttaggaatctcacctgggtttccagacatgtcatccagagactgagagtcctacctttgttcaccccaacatgttcacctgtctcctgagcaaatgcatccagtagggatgtgagaggaaaaacaggatccatcacccaacctgtctgcacttgtggcctcctggtaatgcagggactcaagcgactctatggtgggaaccctagacaattcctgatcaaaactttggaaaccagttcctactggaagattagtgttagaagaaacacacatttcagaaaatacatggaaggagccacatgttagggatagaggtgagatgagtaagggagggaagctctttggatgggcaggtggaggagagaatgaggccatgtggaaaatggaaatttaaaaccagagaagactctagacattaaccaagcaatattagataacgtcatggatttcctaagaaatctatgcctaaaaaattcaaccaactagtgtggctatgagtttgggttttattttgggcgctttcttgttttcttcctgcaaaatgtaaactgtttttgcctattttcccttggaggagaattttgatgaatagaaacaatattttctctttaaagtttctctcatgaaattatagtgattccattgacatatttttgaagctttggcaatctgttcagccatgtgctgctctctgcccaacacagtgctgacctgcatgaaagcgtgaacaccttctttcggtctggggatgaagggcccacattcctggtgcatttccatcttacaagggtccttctgatccccacagggggaaagtggaggcggcaaggctcggcgatgaagcctgcagattgctactctgttgatgtccctgctggttccatggagatgtttattggacttgccataccagtctggcagattgggcaacaaacaccatctgcccaaccatcacccagctgggcagtgttgactgagccttctgtgtgtgccaaattgtgtcagatctgggaagggatctaaaggcaggcagtgctggagcaacagccacgcctcacagaacatgaatagggctccccattaggggctattaacagagccctcttcactccttagagacccacttctgaacaatagttattctctaaaaaataaaactcatgctttaaaaaatacttacaaatctgtgagctatggtcctagagagtaactgggggacttcacaattgcaggattctgtgactttgctttttatgtctctcacagatcaaacaacagggccttgtgtggagtaggtatgtaatcaacatctgcagacagattcctgttggtggaaactcctgggccaagcctccgagtgggaaaactcagttcaggagtgaaatgagtggattgcacagaaccaccaaaagcagtggacccaaatcagctaaaggagagggcttctttccactgccacattttctccagacctctgtttcagtactggtgtgcccctccccccaccccacccccccaaaaaatcacagtgcttacaattggcactgcttacctaaataatagatatggtctatcctggtaacttttaaacttattatgctaactttcacaaaaagaaatacattttacgtcagacccattacacacacacacacacacacacacacacacacgcacgtatgtactttacatttatgagggtaaaatggatatatgaatgtataaaattgaaacaaaaatagttttactaaacaacacttacccttactctttgcaatttacttggatattttcttttctattctgggttggtttttcttttttgagacagggtttcactacgttgcccaggctggagtacagtggctattcacaggtgcaatcacagctcactgcagcctcaaatcctgagctcaagtgatcctcttgtcccagcctcctaaatagctgagactacaggtggatgccccagctcctagcttttttttttttaatgcaggttgaaacccattcatttgattccatagcccattaatgaatttggaggcacatttttaaaagccctgctcaacttagtaaatttttcctttaaagaaaaagaataaatttgagattacaaaattttaataactgtataatctatgttcttaacaattaaaacaacaactagctcgtagtttgatgtcaagagctgcaactccagtacaggggaaatagacctaacctagctggatcctcatcctggtttctcaatgtatgagctctgtccagctcatgcaagtcactgaggttgttttctcatatataacatggaagaaataccaactccctttctctcagagataattaagtaaaagctcttaaggaaatctgaagttcagtacaaatgagttcattgaatcctcctcagaatcgccactgcactccagcctgggcgacaaagcaagactatctcaaaaaataaaagtaaaaataagaataaaaaaagaatcctcagaatatctgcactggtaggatttctacttgctcaaggtttcatagccaggtagagcctttttttcccccgctaaacacatttatataaaagcataattattattctctcccagaatatctaagttgttagaaattctactgctttcagttatatacccaatgtgtccgataatgtttctacctcagattatgccgctgtgcaaatctcatgagttttatgcatatgggaaaatcaactgcggaaaaatttcttataaaaatgctccaacccattgactttaatagagccaaagaggaaaataatcaagtaaagagaaacagaagagaagagatgagtttcttttacagggatgaactagaagggatccacccagccccatcattttgcttttcgattgtaatttttcaagaggagatattatatttaaataggccctagaagcttacggctggtgagagagagatataagctaacttcacagtgtggggagctcaacaccctaagtttaaggtcttgctaactaaattaaagatactgacaagtgttaactacttcagagatgccattaaaaaactcgtctggtcagttttcttactttacagtcataactcatatattacaataatattttcaatgaaatcctctaactgtgagaaaaggctgacctggagcccatttcctgtgtacaccagagtgtcagaaaagaagtgcaaaagtgctcctttctctctccaaggggatgaagttcacttaaatggccccaacattactgttcttctagaaattaatagaagaattgtactctattgtaattaggaggtgctttgtaatttgtttttgtttatgacctggtgtttcgtagctataattagattcaattcatttttaacaaagcaatttttacaaatgcatatcatattttccactattatgattcaaaagccataccaagggtatatccagagagaatgatgataatgatggtgcctttgcatcaaggtaatttagtgtggcaaacctccacctggctgtgggaccaagtggccccttccaggattctgagtgtcacattgattcccctctttccctcagccactcaacctctgatcaccaaggccaacgaatcccccaattctgtcaactctccttccccaccacgaccaaagtgaactcaggacaccaccttccacctgctttgatgcacagagcaggcccctatctggccttcctgcctcagtcttgccccttccgacctcctcctgccactgagaatgtgaagggaaaacctgaccaccttattccagtgcgagcactttcccatgactccccacagagccctaatgtgaagtgaattcttggtcctttgcttgtaaaatgaagagaacgatgcttcattggatggttgtgaggattaaatggcatcaagtaaatgaaaccatttgtttaagtgaaaagaaacaaatgtaagaaattattatattagcggaaatttaaatttactagataattcggtaattaagtaaagtagttaaatataattacttgggtacttaaattgatttaatacattatgctagaggtttggtggatttatacaagctggaatgataaagtgctgatattgatttttctgtacattacatatcagatgttacatcctaatcagtgctcaggtgggaacagcgcctgttacacagcaggcaatcaataatgcctaagtaagagtttgttcataatttacatgctgggttttgtgacatgtagacagagctatactcctgattctttttcttaaaaccctattagactacaaatctaccttttcaaaagatgtgtttacatagggttactcatccttagagaaaaataaaatgaaatcccaataatctgcagatgcttattggggctgaaatcccccaaacatattctaaagtaaatattcaacaataataaatacatgataaccaagttaatatctagcgagtaatcacagctgtatattaggaaatggttggagttttattaatgccagagacaatgctctgagtcatcagagataagttttgtgctcctgaactaaaataaacctgtcatggaagtgttcggtaacaatggaagcagaagatcaaattttctcagaaagagagttaataaaataatgagagagagacataaaatattagactcctcggaaaagttatgattgtttaatggattatatcacagctaccttggactttaataaggtgtgattatgagaccaatatcaccctaacaggaaacaaataacaaaatagatgttactgttcatagtagtacagttacaggctcatagtaactgtttcctaaatatttgctgattaaattaattagcaaacaagattcagaaggctcttctatggttaccattattgattccaatatcttttagtatcagtgctatttaaaaatagtggtctcataatattatcataacaatttttccaccaagctcatataatattcgtagtatatgtatgtatgtatatgtgtgtattccataataatctatgaaatacaacgcatttcacaatccttccttatccaaaaacaatctaagtgatagataatttcctaatgtccaacaaattatgcaagtgttttatgatattggaacttgtaattttctgcgaatggttgtggactattacaggaaggcagacatgataaatacatgacctaacggccactgctccccgacaatcccacaagagacatcaataatcaatcatggcactttttcccactaagcctggaatttatcctcaatgtcaattttaacatagtattccacaaagcacctgttaatccattcatttattcatttagcaattattatggatttcctaatatgtgcaaggcactgtaccagggaggcacattgcagataaaagtaaccaggacagacatggaccgtgccatcacagggcttagattaacaatggatttgacactcaaagtcatgattgtttgccagatctgctctgttgtatagttgaaatggaactaattctaaatagcagtgtctctcctttgtgatagtaggggactgagtggagaggcttgcactccctggcttcataaagccatgatgtctattgaatagtttaggagttaaaggtgaaaatagctgaacactatttattagaaaaaaagagatggttttctttttattcatttaagtgttcaatttgcaagtcagactgataaacctataggagaaagttttatgaaaatattagaatgaataaatttttctcccactcccctatagagacaggggcagtctgtgactcactgcagtgttttcctttctccacagatgtcggaaagaacacaatatgctacgtggaattagagaaagagaacagatggctgagtacatggctttttccaccactatcaagcgtgttgtctttccccctcagctgcaaaattacctctctgaaagtctctgctcttaatgctgcaccttctctacccttcctcattcctgcctaccatcctttcatccctgctttagaagtgggctgacttccccaagcaaaattccccggcctacctcccactcatatgtggaagtgagctgattgcatcccttgacggcaaactgcttggatggttagtcccttacagttatctaccccctggacaagcacaaaatgtcaaaacagaatttggaggatcggggacatgaaagtggctcagtcaaaatcaggctgatagcagctacaaagaggttactgtcaataacaggcaactgttctgctgtctcctaagactaatcctgaatttggatatgtacatgttatgctcagggaaaaacactgtctagttgccttatttcacaaattaaaaaaaatctcatggccaggcacggtagctcatgcctgtaatcccaacactttgggaggccgaggcaggtggatcacctgaggtcaggagttcgagaccagcctgaccaacatggtgaaacccagtctctactaaaaatacaaaaattagccaggagtggtggcagacgcctgtaatcctagctacgcaggaggctgaggcaggagtaatcgcttgcccctgggaggcagaagttgcagtgagctgccattgcactccagcatgggtgagagatcaagactccatctcaaaaaaacaaacaaacaacaacgaaaaagaactgcctcactaaaatgttagttctattgtactacctccaatgcaaagacccagttcctgacctcaccagaaggtagacccacaatgtatatttagctattgatgctgatggttggttgttttcttttgttttttttaaacctgattctgtgcctgaagtgcctactaatattgctttgtgttctctacagccttgtttgtgtgtgtgcgtttttttctttaatcccctcaagatttgaaaattggaactaaacaaggaagaagaaagtgacaggccatttttattattctttctcagggttccaattttactgtgagtttctacttcttaaaagattttgcatttctcccctttgaatgttacttcatttgttcattctctaaggaaggaagaacagtatcataaaaattatgaatgaatgaaaatgatttttttacgagtaccataaaaaatgaatcaaacatgattcatttttgccctttgccctttgcactgtatcttggtcagtgccagttctcatgtcattatagtagttcctcagtgaacatgaaataatacaacattgtccattggaaccagttatataacactcgagataacagcaacattgcgtttattaatttagtagaaacaacagtattttacagttccaacatataagagaatgcagctgtgttaaatgacaaaaatcatgtattctattttgggcttctcaataactaagaaatagaactaaaatccttttattcacttattcatccaactatgggccacatactgtgctaggagctgtgggtacagaggtgacctatacagaccagtctctctctttgtggagcacatagtgactaactgggccttgacaattctggttaaaattgacatccacgaaagtgtctacaactaggatggaatctctttcctaacccgtttctttcatactcactaggaaagcaacctttccaatggatcagggtagatttatgactcatttgcaaagcaaaagcaaacagaatgtagaaaatggaagtcttaccactaataaatatatagattgcagattctgtttccttcttctttgaagtaggtacagctagatatttgcagctgtagaagccagtgtggtttgcttgagctgtgttcaaggttaaagtactgcagaattgtttgccatttcttccacaggcagatttagttatgctcagcctttcgctttccttactcaccatttcaggcaaagaccatttatgggctgcttcccccctgcaatcacagataagaaaacaaaacatatttatggctgggccctaggctcagcaccagttcctcagcattcattttattaggaagcggaggtcctctcttaagtgtagtcatcttcctctttacgggaaagcaacacattcagaaaagctgtagaacaatactcagaataaagatgcagaactatttgggcatcccttcccccatttccctgagtgagtaatgctctcccttccccatgaatcccctttcatgggaagctggatgcctatggtttgcactttgcagatcacaggagatcactgaggtccctacctttttactctgccagggaatgattttgccttaggcatggcaactagattattcccaaaccaacacagccacttacctgcattggagatgcagtgtctggcctgcttgcatgatgtgctgggtgccttttaaactcagttcaggatcttttaattttgaacctgaactagatcctgaaaaacaaatttttaaaatgtattatttgtaaattgtcttcttacctttttttaagttatctttccatgaaggtgagtttttcatttttaatttatttacatctttaatttacttgtatctttaatttataagcaaaagatacactaatacaaatttctcttaattcacaaattttttctagctctacccttgctcataaatattatatatccttttataccaaatgacctaaataacatccaaaagcctatttatgtagaatggtaatggattcatataggttcaatgaaattatattaaaatatataactagttataatattcaaatatgcaataacttagtaaaaactctcaagaataaatgtcagtgtcatccaaaatatattttcaatactgaactttttccagtgtgggtcatctagtcctataggcctgtctcatctttttttctgaataaaaagtacagaaattttcctgggctctgaatttcatgcaatcattagttgagcaatgatatttttggccaatcatttccctttctgaaccagtttcctcatttggaaaactaattatagaatcaaaatcagttttagaagacatttggtttgtcttacgtaatctatgagttccctctacaatggtacagtcaaaagggaactgttcacacgcttacgtgacattcgacaaacatctcggaggattgttgtgaggcaataaagtgaggtggtgaaagtgctttaaaatctacacatctccatatgatgcaataatgacatccattttagtgactagctgtatcaccctagacaagtcatctctctttccagatctcagttatcttatctgtaaaaaagagattggactagacgaccttgaaatctctgaccttccatttctcacagtcccagcctgatatagcttggatgctgaccctccaattctgatggtgaattgtaatcctcaatgttggaggtggggcctgatgggaggtgtttgggtcgtgggggtggatccctcatgcatggcatggtgctgttgtttagatctgattatctgaaagtgtgtggcacctccccccttctcttgttcctgctgccaccatgtgatacacctgctcctgttttgcctttgacatgagtaagggctccctgaggcctcactggaaggcaagcagatgctagcaccatgcttgtacagcctggagaactgtgagtcaattatacctcttaataaattaccaagcctcagatatttctttacagcaatgtaagaacagcctaacagacagcctcatgattttttgaaccataggtgctacagaggctgagcctcccttgaagctattactgaccaatcagaatactatcactaaggatctctctcgcctccttcctcccctcatccctcagtctctcttctccttctccctcttcttcaccagcctcctcctcctcccctcttcccaggcagctgcaatgcctccgaaaggcagggaatgaggggcccaggattagcgttccttaggcgggaatagaagttagcaggagagaggaaagaaattcttggagggaggaaaacttagtatttggcaccaatctcagggtatagttttctttaaaaaatcagtttaaacagtggaagcaaaggtagaagctctaagtgaatggtcatggagggtttaccattaggtcacagatctgtgagatgatgtgtgtgtcaaataccctggttatgcccagcagtcctctccagcgtttctcttggatttgactatctcaaaaactggattcagttagaagatctgcgtttgaggcttagcttttccacctactgactgcatgaccttggcatcacttaattggctgctcctcaggctcctcgtgagtggaactggaaagcctacgagccacctcacaggcagggtgtgtgcattcggtgctgtgctgtggaagaggctggcttgctgcctggcacgtggcagatgcccactatcaccaacatctaggggaatcacttcccctccccctgcttctgtcagaatattttgctgggtatataatttcaaagatactaaattaacatatgcttttctggtattgctgatgatataaattaatatcttttaaatttttattttattttatttttgagacagagtttcactttgtttcccaggctggagtgccttggtgcgatcttgactcactctgcaacctctgcctgccaggttcaagcgattctcgtgcctcagcctcctgagtagctgggactacaggtgcgcatcatcagcgtggctaattttttgtatttttagtagagatggggtttcgtcatgtttgccaggctggtcttgaactcctgacctcaggtgatccacctgcctcggcctcccaaagtgttgagattagaggcatgagcccagcctaaattaatatattaaaagtaatttttacagacagtagatcccggtatcaaagtactcctaaataaaatggctgaatattaactaaattaaaatccctgtttcatatggatcccattggtctatcaaacaacctcctagatcaagtcaaccccttcaggtacctaggaatgtattttaactcatacttatctttatgagtttcttgaggcaacatgtggcccaaaatcagggatctgtggaaacgccagacttttctaaagccacagccagcaatggataacacctgccctgagaaacttccatgccagaatagtttctgcccttctttatggcatggaactctggggatttaattgagcaattgttcatgtgctggaaaagatccatcgaagcttcctgtggaaacttctggcattacttgtagttatctctgtggtctgtctggagatgctgagcgctcccgtccaggaaaagaagcagttcccctgtttgtgacatcccactgcctacatcttggtttccagaccacatgaatctttctttatcagcaacttagaacaccagtactcctgaccctcatcagaggaaaccgctaacttcaaagaaccacccaaagcccagctgagagaagtgctatttatttatttatttacttatttttgagatggagttttgctcttgtcgcccaggctggagtgcaatggcacaatctcagctcactgcagcctccgcctcctgggttcaagcgattctcctgcctcagccttccaagtagctgtgattacaggcgcctgccaccacacccagctaatttttatatttttagtagagacggggttttgccatgttggccaggttggtctcaaactcctgacctcaggtgatccgcccacctcggcttcccaaagtgctaggattacagacgtgagccaccgcgccgcgcaagaagtgctatttagagaagatctcttagacagtgtgccctctacttgttcgtgtccacactccccatgctgtcccccaaccagaagacaacataactgagtggttaaaagacactgacaaaaatggggttattctaaaaaaaagcgttgccacataatttgtctccagtaacatcagtgtattttgcacctggaatgaggaagctagataaaaaacagttaaccaaaacacaggtaaacagaagtataaggaacaaatttccaagtaactggtgactttgagtgcatcactatccttcagttaataggaaactagaatctcataaaggttattggaggtgtcaagattatagtttaacaggaaaacgaataagaaaaagggaaagtgaaaatatttatttcttgaatgttttgaattcacattattaggccttaacacatttctttgaggcagtttcatgtccatgtacctatctgagtaacaaagattcaacatttgttttagcatctactgcatgctagacacttgcccatcttattagtgatttatataaagatagatgtgtatgtacgtacccataaacacatgcatagtcatagcatggggaagtcagcttgatcgtctcagtagctcagagtcatgttgcccatttacataacaaacctacaggctatttcattttcaagggtggagtgctataatttagcaatgaatctcagatgcagatgagaactttctaatgcttcacatggcagcctagaaatctgatttaaaagaatgatttttgtcctcccaataaatgatcttgtcccttctgtgaactactgttttcatcaaagtcaattacaatataatcataagaggcatacagatctccttacatcacgaaaacatttaaataaaataaaacaaaaaaactcaacatagagcatgaaaatgggctttatcccatgctactttgttagaaaaactgttaaggtcaagcagtgtaggctaatagcattaaaaaaccaacatgtgaacgtggacttatttgaacactgacactttgtattgatcttatctgagtcttttcttcattgtttttctgttctgtattatctggcaggtggaacagaactttatgactctttgacacaaatcccttctctcctttcgcacatgctagacctcacatagaaagcctatacgtagagtgttctaaaatgccacccctaattccccaccttagtttcattaggcaaaatggaatgttttctttgacttcattgggaagagtgaatacatatccaagtaaatgatggctttattttgcaactaaatccaaagcccagatgattgaggctctttcttcaaatgctcttcaaagctgccatgatggatactaaaagagccaactcccactggaggtcattatgaaccagacagccttgaggtcacttgtaaaactcaagactctcaatgtaaagtctgtaaagtctgactaagagtatgtttagaaaactgctatttttactaatctaaataaacagtgttctagctggtcgaacccaacttcaagacaaatcccctggtttctctcccaccagatgccaccttggcaccccttattctgttgaagtcttagggttattctctgtaagaaaggagctttatttgaatataattcatgaaacatctgtgtttttccattttttattatgagtcattaatctccctagctctgccatttgtgagttctgttgtggccatgggcgggccacattaagcctccgattcttcatctgtcaacacaggagattagggttcggtttttaggatcctttccagctaaaaattctgatcctggggtcacagtaattgataacaatgtataagttagaaatcacattttagaaatacttatggttagtaaaaagacaacagcctaattttaaagatcaaccaaggctctgaatagacaccttcccaaagaagatatataaatgaccaataagcccatgaaaagataaaggacatcattattcatcaggaacatgcaaataaaaaacacagggagacaccacttcatgccgactgggaaagcttaaataaaaaagacagataagaacaagtgttggtgagaatgtggagaaactggaaccctcttacatcgcaggtaggacttttaaacggtgcaacccactttggcaagcagtatggcaattcctcgatggttaaacataagagttgatcataatttaaacacatgactcagcaattgcactcctaggtatctacccaagacagatgaaaacatccatccacataaaaacttacacacaaatgtccacagcagtattacctataacagccaaaaagaaacaacccaggcccagcgcagtggctcacgcctgtaaccccagcactttgggaggctgaggagggtggatcacctgaggtcaggagttcgaggccagcctggccaacatggtgaaaccccgtctctactaaaaatacaaaaattagccaggcatggtggtgcgcgcctgtagtcccagctacttgggaggctgaggcaggagaatggcttaaacccgggaggcggagattgcagtgagccaagactgcgcaattgcactccagcctgggtgacagagcaagactatatctcaaaagaaagaaagaaagaaagaaagaaagagagagagagagagagagagaaagaaaagaaagaaagaaagaaagaaagaaagaaagaaggaaggaaggaaggaaggaaggaaggaaggaaggaaggaaggaaggaaagaaagaaagaaagaaagaaagaaagaaagaaagaaagaaagaaagaaagaaagaaaggaagaaagaaagaaagaaagaaagaacccaatgtccatcatctgatgaatgggtaaataaaatatggcagatccttacaatgtggtattatttggcaataaaaaggaatgctgatatgtgctgccacatagatgatcttgaaaacattatgctggcccacagagaaaacgtcatgtaagcacacaaggagaaagcagctatttgcaagccacagagagatgcctcaggagaaaccagacctgccagcaccttgatctccttgatctcaagcttccagcttccagaattatgagaaaataaattcctctagttttattgttaaaaaacaaaaaacaggccgggcatggtggcttatgcctgtaatcccagcattttaggaggctgaggcagctgtatcacctgaggtcaggagttcgagaccagtttgaacaacatggtgaaatcctgtctttaccaaaaatacaaaaattagccaggtgtggtggcatgcacctgtaatcccagctacctgggaggctgaggcatgagaatcacttgaacctggaggaggagatttcagtgagctgagattgcaccactgcactccagccctgggcgacagaaactctgtctcaaaaacaaaacaaaacaaaacaaaacaaccacagacacacacacacacacacacacacacacacacacacacaaaccccacaaatcattgtgctaagtaaaagaagccagtcacaaatggccacatattgtatgattccatttatatgaaatgttcagagcaggcaaatcctggagacaggaaggtagattagtggttgccagggcttgcggggaggggatggagggtgactgataatcagtattgggtttcttttgggggtgatgaaaatgttctaaaattagattaatggtgatggttgcacaactcttgaatggaccaaaaaccactgaattatatactttaatattcttgtctcttacagtcatattttggggtgtcatattctggtctcctatagtatgtgagatttacctcaataaagctgctatttttaaaaacccagcaactgatgactaaagtaatcacagagttatgttgaaggcctagaatatccagttattttgaaatttgttgccacatattaccccatcagtgtgagattttacactagttgtttttccagcttaaaactttagaaggctgattttagagacctaattttcccttaatgttctgtaacatcactacctaatagtagaagtttacaaacatgttgcaaaaaacttgctgttccctcccccgttacaatcttttcaatttaatttagtgttagttttaaatcactcctaattgcatattttgaattttccctatttaaatggaaatttttaacaaattatgtcactaggactctgaataaatctggtgtttccttttatatcaattttttatttctaatttatttgtttttaacttaaagctctgtatattccgtttatttgaaatgaaatgcatctgtctttgattttgcatactgtgttttcagtagtacataatcctgaatgataaatggcctctttatctaaatagagatccctaagtatcatgtttctaaaatttgaatttaagatcatgagccttttacaaaggttgttcgaggttaattaagcataattcacaataagagaaaatattctttccttaagatgtagcttattaaaggccgaaatctcatagactaaatctcatagaatctttggggttggtggcaaggatgggagaagggttaagaatgcaattgcaaatttccggacgctaccaacatttttatttgcgatgcttattcttatagggctctgaaacttaataaaaaaaagttaactcttagttcttaacctctgtgtcatatctctatccaagtatttatcagataatatgaagtgggcattataagtgaatgcctagattaaagtaaccacattaaatggagactacactaccagctatgctgacagggcccatgctttgatgaagagcattataatgtcccatctcctctcacttccagaatgatggagaaaggccagagagttcatattccatccaccaacagactaaatagaagatgtgaaagtcatggggattcgtatgaactgaaagcatattttttcagtcccacagttagcaatgatactaatttttaaaatgtcaggtttgtcttccaaaacaattggccttaaatcaagaaagaatgtaaagaaatgaaagaatgtgcacataaatacacacacacatgcacacacacacacacgcttgctgacacgcatgcatacacttttctctccatgagaacgtcaagtttgtttgagtggtggtggggaggttgatgtagaactagaagaggtttttggtgtgtgctttaattacatttttcattcagcttaggctcagggaaagctctttctaggcggggatttagaaattgacttgaatgtggcaagagtatgaagctgtgactcactgctgactaatcccttatgcagataagattatttgtgacttttacatgggcaactttacaaatatgtaatattttattttagagtaattgtgttattggtctttaaggtccacaataggactgaatgtttaggcagctgctgtccagcaacattatatttagtttgtagaaagtttctaatcctaggaacctgctttttcctttaaatctttatagtatattaaacgcactattttaccacactgatttcttgctttagaggttttgccattctaagtaatcctcaaactattagattcaatatgtgaagtctctgatctcaaagtctgaatagaaaattcaaaatagtcacgtatatagcatttatgtcttgaatccaggtgtcaaaaaataaatcaagaaattacctaaatgtttaacaccagcaactggaattggcacttctccgcaattatgttcatttcaataattctgctctggtttgttcattttaaggctgtcttacaattcatattttaattgtctgtcaatgaaactcatagataggttttgtagctcttggcacaaaagacatcacagtgttagccactgaagtggccaaagtctaaaatcatcaaaacttggacagttttcatcccatccatacatgggtcattgactttactcatttttccttaagcttcagaaaagttatttacacggaaaaaaatctgtgtggtttaaaatgtttaccaggaaaaaatgctctaataacgtcaacattcctactgtctatgtttatgagggaaacatgtcttccgcatgcctctctgagctttttacttgacactgccttctttgagggtcacagtttaacagggcacattcattgatcattaggcctgtcaccaggctaccatcagggacctacccttccaatgacctatagccatgcacaactccttttcatgtgacatcagagttaattaaggttggtttgggagaaatctcctgctgaccaaggagttaccttttcccaaaaaatgctctactcctacaccgctggtctgttattaaatgagttcaaaaaccacctccatagagctgtctaacaatatgtcatttcagtttaccatacgatgtcatgaaagttatctgagctgcctagggcaaaggtcaagatctggttgacagggcacgagacataactcgtaaaatactcggtagagaagtctggtagaccttcgtctggttatgcaaatggacacgaacagagaaaacactctttacaccctaaaaatgcatacaggaacgttttgtctgttaggaagggcttggacacatctctgttttctctatcagtggcaggacacttttacatttgaagcatactccccacgggcttatgttcttatccaatgtcactgtttagaggtctgagaggaaactgagctctgacgtcacgtcttatagaatggatcataattgccagtagtgttatgctactcagaagttgtttcaggctgaaatatacacattttcagattgtgaacacctggaagagacatgacaactgattgctcagtggagatgccatttcaataaacacactcaatgtatgtgagactaaatatacaggtggcttagtgaaagtaactgagtttttaaattagtttgttaattttttatcaatttgtgcatcctctttagaatcatagtgtctgatcagtgacaaaatgcttttagctgcaagagcatttgcatagagttgtattattaagactagtagtactaataacatgcttgaactgccttaactttagatttctaatctctaaattatttaggattgcaaatttcagttctgccaaaggcatcctccgtgttctctttaaataaacaattaccagtttggaagcatagcatggaatgcatgtgactcgcaatctaaaatggaaagttttctgttttacatagcatcaggattacagtttggtctatgtccagatattttaccaaatactctgctttcattactgttcagtgtcaaagttccaggcatctatagagatgatgacagcatgtttcaatgttatggatttgtcatttatgtggatccctgtgggttcccttagaaggaaagtctcacagaaaagatctgggagatatttgatcaattccgtataggagcttgccatgtaacagtttaagtataaaagcgggaattggaacttttaaattttattcaactacgtcttataacctgtcatgtgacataatcttcagatccacacacagttccttctggaaaaaaatgaatatgtcatggagctgtaatgtgatgctgttaaactaccataaaatgcatattgttccagtttctattttgattcccaaatagtgccttcacatttttgtataataaaatgaataagaaaggctggcaaacaggcagacagacaagtgtgcaccttagcactgtagctgttcatgccagaaaagccaaaaatgttattatagcaatacaaagccttatctattctcctcatgcagactttcagcttcagaatcgattacaaataatgacagaataccatttgctttgtatataaaaatggaggagagatgaaatgagattggaaggccgaatgtgataaagttctgatgttaattttcagcttactttgatacagtttatgaagtccaaattatatagaaaacatctttctggagtcctttagactgttcataaagggtattctttaaattcacccactaacaggaaagttgagaagatctctatctttgcaaccaataatatatacaaaccctctgacctttgagatttaaatggccaagagtgtgcaataaagttatccatcataggggaattgagtttttgaaagctacattagcaaatttctaagactcattaaacacattcttgatgattgtgttttctattgtcataatcagtttccttctaagttaaacaatttgaaatataattgcctttcattacacatattttggagattaatcatgcttcggaaatggggtggacatgttgattaaactgttattttttattctgggtttttctaatttcacattttcttaagatatccttcacgtagtaagtatttgtaagagctgtgctttcctaagatttcaaaaacttaaaaaaatcttatcttagatggaattcatgttatacaagttttgctgagagtcaaatttctggaaggaaaagtaatccattaaaagtagtacattttcaccagcagtatctgaatttttaaaagaaataatttaccgaatgtttttcactcatttcggcatgtgatattaaggccttccttacaaatacccatagaagactttagcgttgtttgtattcaatgcctggggaatgctggttttcattctcaggggatatatacccatacaccttcattactctatctagaactttatttctagaaattagcttttttaaaaatatcatccaagacattatatctctgatagaagaaaaacaacaatttctgttatcagttggccaccaacccaacagctttaaaataacttatgaatcagctcattctgtaggacaaaaccaaaaccaaagtagaagttacataaaaccaaaaggaacagctctgtggagaggtagtaaggtgcccaatgccgaagctgctcccatgaaattaagccaccacctcctttggatgagactgatgaactgagttaagggttggactcttaggtgcaatcccaggagtctgggaactccatcctcatttagctatgcttcttatctctcttttactgccaccaatcctggtttttcccctcactacattctctatatgacccctttctctcactcccttaccttgtttatttttccatctttaacctcaacatttattctttcatttaattttttgaacgtataccgatagagatacaacaataaacaagacaaacgaggttgcttcctttacagtgtttatagcttagcatggacaacagataaataagtatatatagatatatatgtaatgatgcataaaaataatttctgcttaaagaaatagaaaattacattatatttgtgtgttatcatggggaagtgccaggtgtggaggtacctcactcagcccagggagtgagagtcttctattagaataaagttggaggtgagacctgaagaatcaatgtgtatttgctaaaagaaatagcagggtctctttctccttcaaagacttccacatctttccaccctctaagcttcatctttccttttaaacaagtgttttcttctaacagtttcacatacatttccttgtttcttagaactcttgttttcctcagcctctgtgctgggaggagaaagctctatcatcttctttcaatgctgtggttcgcatattttttgtctggggtctacctgacttcacctgccactaggaaaaaagccacaagtaatcatactttagatacatacccaggtcacgttgtgcttgttaaaacagagcaccacggaagacgaccggggtggagactcagcaatgagggaatgaatgaggactgtcagatgtgatgcgttagccaggacttcatgttcttaacgtgtccttccttttggcaggtcacctagccagtaccacacatgacccagagccaagaggaaataattttcaaccaaaatgttctcattccaggtgacaaaacaatggcagcaatagtaacattacctagtgactcgggctctgttggtgtacctagaaattaaaggttccaatcaactatcttctgtgctgtttgggaacctaagccagttaacagtctcccagcaggaaggctcatctcaaggaaaatatctcctgggaagcaattctctagaagatgggcagtgtagatcctcattctcaatcctgagtctacagtcgagtcaggagaacatggccagcttagccaaaaatgagaaaatggtcactggacctagaagataacccaaatggaaggaacagaatattgcctgtgtattgggagaattgttgccagctcctggccatatttctcctaacctcctccgcttatacacacacacacacacacacacacacacacacacacacacatacacgtacttagaaggtgaaccaatgaggaaccatgactcctagaagggcctcagacccagagaaatggctcaggatatgatttcagtcagttcagccagtatttattgagtgaccattatgtgccaggcactgtactggattcacaattgcaaagatgggtcagaaacatttcttcctcttgaaggtctttcagctctaagctggcctcttaggggctgtcatttagaagtagaataggtgaatactaagaaatatggaagataatctaagtcaacaaatagagatctcctgcaaactatgtacactatgtctttaaggaacacatcctttaatataggaagtcacacattcttcaccaacataagtgatttatcttagtaaaactcagttaaattcacaaaataagaacacttattcaatgataaacatgtaacacaatgaatacaaccatatctatacctcaaaataaaatataatggattacttgatgataatcccttgagcatcttttaaatgaatgtattaaaatgttataaaataaaaatcttctacacattcctgaactcagcttggaaatagggcatgaatctagaataatgactggctataaaatcgggatcaggagaattaaatttaatatggctcatgtttttcctcatgcagttgtgggagaaaatacagacctcgccgggtgtggtggctcacgcctgtaatcccaacactctgggaggccaaggcgggtgggagtttgagaccagcctgaccaacatgaagaaatcccatctctactaaaaatacaatattagcccagcgtggcggtgcatgcctgtaatcccagctattcaggaggctgaggcaggagaattgcttgaacccaggaggtggagattgcagtgagccgagatcactccagcctggacaacaaaagtgaaactccatctcaaaaaaaagcctggacaacaaaagtaaaactccatctcaaaataaataaataaataaataataataaagaaagaaaaagaaaaaaaaagaaaagaaaatacagccctccaaatcattggaagaggaatatttcttaaacctcccctcctaagtttgtatttaacattatcccaaaatggtgaatgaattactccagcaaggcaattccatgcccatcggtttggactataaagcgcatttaagaaataacaacaaccaagcaaactttatttctacagtttaggattttactccctctaagaaaagataatctggatatagaaccactaagtttaatgtcagtctcaaaaggctaaagtgaagtagaaattcctgaaaattcactcctgttagtttcctgaatttcccatttgccttctaagtgactttgcgtagcgaatactttgatagggtatttttcattgaccagttttgaagacagaggatgggatgggagcttgagtggctgaaccacttttagcttgtacatcaacaatgtgtgtcaaatatttcctaaccctcaagaagttacaggtactcaaagtccattccagggcactgcaattactctatttccacacatatatttttctctagttctaccagaagtccttatggagaggattctgaagccataaaaattttcaaagaacagcagtgaacaaaaatctgatctagcaggagacattaagtggaaaaagagagttaaacaatgttttccaaaaagaaaacaataccattaatcatagatgcagtgttgttgccagagtttacactgccttttaaaactgtttgtttgtaatcctctctagcatatccctgcctccccatctgtttacatacatttttggtttctctaatgccaacttagagaaagaaaacaatcataaaaatccaacagtggatttttacatacatagacaccatgcatatttttacatagtatatacaccattccgtataatttccatctaaagcatgtatccatttgaccaaacgttccagctttttctttggagtgaaagataaaactcctcaataggtggcaggataggatttttctcagcttctggtaacatgacagtattctggttgaaaaagtgtccttctccgagtaacaggtcaagaaagaagaaggaaaacgctattttctccttcttgacttcttgcaggtctatgttaaaggaatgatctaagaaggagggagagacacaggagctacggggcttaaagaaatgctccccgtgttgctcactgtacaaggactgccaatcaaacagggaaatcaaagtgactgacagtaacttgtttaagaaaaaggctcttggatggttgtcttttctcataaatatgacagtttttttattccaaaccctgaaaacaaaactcttgccttttttctttaattcctagatttaatcattcaagatactttgagtaaatgttggtggaaagagtccccgatttcaaaattaaaaagacctaggtttgaatcttggcttggctgttccataaatggatggccctcagcaagtcagcagggtttcctcagccttggggcttcaatccataaaacaaagttacaggtgtgcacagtaggtggctaggaagagacttgatggagttaacacagaaagtgccctgtgctgacatgttcacatttttttcccttccctgggggacagttaatgtcctcccctatccaattcatgtagcatctgccttcagggtcaaacacacttccaggtcgttctgtgaggtattttagtttcattctggaaaagctgtgagctttctggaatctgaaaggtgcagaggagcccacgttggattcctggaaaccatctgtgagagggcagtcccagctttttcctcggacctgcctgatatgagcttttctagaataaagtgctgtcctcatgctgttgtttgtcatctgaactggtttaaagccatatctaggagagcagtttggaagcccacataaaatcatgtccttgatggctttggggctccttttctgactaagttttttgggaggtccttgaatgcctacgataagaaaactcacatgattaaaattctgtcttattggagatgtgaacagtgtctgccacatacagcagtggaatctcccaaggccactttaagctggagtagcagtggcttctcacattctttggagatggccaaactccaaggacagaaggagggaaagactagcacagtccccttgatgctttttccttctcctcttttcatttaggcttgaaggcatggtaggaggatccctaaatgtcgggtttgcaagtctgatagactcagattcaaataattccaagtttacttaccacttctgtgatcttagggaaagtatttaatttacctaagcatcagtttttgcatggttaagaggaccgtacctctcgggactgagtaaaataatatatgtaactcctgttgtggtgtggggggaggggggagggatagcattaggagatatacctaatgttaaatgacgagttactgggtgcagcacaccaacatggcacatgtatacgtatgtaactaacctgcatgttgtgcacatgtaccctaaaacttaaagtataaaaaaagaaatatttgtctgtaatatttaaatgcctaataaatatataattgaaataaaaaatatatgtaaatcaattacatatattgattgtatagtcagtagggtttggttgcctcctttctcccttccccaaagcatgtctgtccctgcagtctcggcacctccagaaaaaggtgctaaatcagggcctctatgataagagccccaagaagctgcagagctgcctgcactcagaatcttggggtcagctgtcctcccttgctggtgtcatgttagtcatcagaggctgctgcccagcatgcctgtcaggtactcaaaacaaaatttgaattaagaatagaaagctcttctctggggcctgttttattttttatttatttatttatttatttttactcccagatactgtttagaagggtcaagacattatgtagcatttattgttatttactataataagttatttactgtattttcttggccaaactccagcttaatagctagactgaaaagcaaacatgaagtgttacacaatggtgtggtccattgtgaggctgtgctcctctccacgcagagaggcatctgcttcccacccctcgcatctgagctgggcttgctttgaccaatagaatgtggtagagcggtgttgtaggcgttccaaagcctaagcctcaatatgccttgcagcttccaccatcacactcttgcaacaccgctgcccccagggaaaggaagccccggccaggctactgaatgaggaaagatctcatgaagagggaggcccagcaccaaggacccagtggaaatgccaaggactatagatgcatgagaaacccaggtgagacccgaagggaaactactcagctgagcctagcccaaaggtctagaagaatcatgaagcataatgcattgttgtgttgggtgactaagttttggcacatctcgttatgtagaaatagatggcagatccaaatggctattgtgcctcagccttgtagaaacagtgactgtgtggtagttcaagtgtatgctctttctgtatttgaaaataaaagcaccaaagtggagctcacgcaatattaagaattacatgttgtacgggttaccctggatgcccccaggaagggggaagcagtttgaattcttggtgtttcacaagaagtgttcccaggaccgtggtttcacacgatgggaggccagctctgtctccaaccagcagtagcttttcacaacagtggggacagaaccctggcacatcatgaaagttaggaggccaccctgcctccaacagatagaattcagccacccaagtgggagccatactgatcccagcaccggaaatgcagatacggaggcccggatggagaggaaattttgcagtcatactggaggaaaccagggctggaccaaggcacgtgggtgcccgggacaggccaatagtatggtgtttgccaatatttacatagagaaaagactgagcactccacagcataaggcagaagcataaggcagagaaggaggaccattgttagtctagacgggcaattcacttctgcccctaacgtacgtacctcactcggcaaaacagtccccctctcctcagaaggcaatttaatctagactcattgattcaatgccctggcatttgatctaagtattctttcttgcacactctactagcacatactcttcctggcaggaattctcgtaaatagtttcttccaccttgtcgtatgtctagtgatgatttagtgccttttacagattggcatttgggcaggtgcctcccatgtggccaggcctctcaaactggcccctgggcagaggttctcaaagtgtgatctctggaccaggcacaacagcatcccctgggaacttgttagaaaagcaaattcttggccctatcccaggcctactgaatgagaaactctggggtggggcccagccagctagttttgcaagcccaccaggtgattctaatgtgtgatgaaatttgaggttcttaacctcagctgcccattggaatcacccaggagctttaaaattacctatgcctaggtccctctcaagagctcatgattaaattggtcagaggtacagccaagacccgaggatttttaaaagctctccagattattctaatgtagagcccaggctggggaccacggccctagagagaggcaaaggctttcatagacatcacttggcagactaattcctaattagggttttgctacaggtggccttgagtttaagtggttttatatttgtgtataataacagccaaggcttttcatttatgctaggttcacttcaggcctcttttaacaaaagaatctgataattgttgtagctctgcctgtgtagtccacatgggtggttcggtggcttgagaggaaatccatttgtgctccacccattaaatagaaggatagaagaccaggctgagaaaaagtgcctgtgagcaccgtgataatctgtgaaaaggtaaaagcatttgtcaagactggcaatgatgacaaggaagaatgttaagtgcaaatacattccatttcaagacagtaagaggcacatgaaatgtgtgatcggcagcggcacaatgcagcgagacaatgacacctccctgacaaccaaaaattctgcaggatacttaccgctgctggtttttgccaccaagtcattttctttcaaaagcaaaaggcttgtagaactttatggtgaaaacctggctatttaattgcatttttactattttccaccaaatccatattttccaagaccttgatctcgccacccatgatttggttaaccatggtattcttcaagaccacaacctctgtttactttgattacaagtctaagccaagtacaagattttgtaaagaattttggaggaggacaccgatgtcccagcagaaggcggcatgagaccaacgtgggagccagaagagagaggttcctggctggcccaggtctagtcccttagtcacacacgtcaaagttcatcactagggtgttagtgaagaggaaatgggaccaggcgcggtggcttacgcctgtaatctcagcactttgggagatcgaggcgggtggatcacttgaggccatgagttcaagaccagcctggccaatatggcaaaaccctgtctctacaaaaaacacaaaaaaattagctgagcatggtggtacatgcctgtaatcccagctacttgggaggctgaggcacaagaatcatttgaacctgggaggtggaggtggcagtgagccaggattgcaccaccgcactccagcctgggcagcagagcaagactccgtctcaaaaaaaaggaaatggaccctgacaccagaactgactttggatcctttactaaaatcaatgcttctcgatttttaatgaaaaaacaaacaaacaaaaccacgtggggattttattaaagtataggctctgagtcatcaagttcccaggggatgctgatgttgctggacctcggagcacacagagagaagcacgttttggagtatgatgtgggaatgtgcagtgtgggccgggatgggggtgaggatagggaggcaccagctcgagcccaagccatgggattccaatttttaagaacatgtctcgcacctagcagggtagtcctgccaggaacccatttatatgaagggttgaggaaacctcatcctaaagaaagaggaagttagacagaccagtgtggtcctgtaaccaaggcccctattaaaacagagttgattctgactgtggccagacctctgtcattcaggtatgcatctcagcccagcacccaaggacttgggtttaagagagggcaagaaagtcaaaccctaaaatttgaggactctgttctctctaaaaattgtataacacgctgcaggaaaaggctgaggtgcttagcacctcaccaacagaggctaacacaggacttctgcagtgaccagagcctggctttggtggctcacaggccccagcgaagcatcatgcccacacaggaggggaggacatgagacagtttctcaaagagttgaaaatcatagctgatctcatacatctcaatcgctcactgaagaggacaaatattatctgttgagaacagttactttaagtaatcccttgtaaatgaggccaaatgaacaggcaggagcacattactatactggaataaactcatggaataaatttgtgtctgagattgcttctgcgaaatgatagtgtggccacatattcattcatttactcattcgttccaacacttaccgagagtctctgtactaggctttatattaggtgccagcggtctaaggacagctaagacatggggtctctaccaaagagaaaggacacagacacataaaatcctgacaatgcaaagtgagaattactgaaggaggagtacacctcagggctacaggagagcagaagaaatggcaagtgctgtctgggagctacaaggaggagctcccagagatggtgattactgggctggatcttgccagcaggagaggaggagacacagagggagggaaaaggtcttgcaggcagacgagcagcatgaacagagtgatgaaagtgaaggcgcctctgaagaagggggaataatttgtttgactagggtagagtttgtgtagctggaacccagtgtgtgtgtggagagaagtggcgaaagacaaagctagtaccataagccacaagtatgtaagccacagctgttcaggaaaaggataccaagtgctcgtaaggaaagttaatcttctcatcaaatctcttggcatgctactaagcagccatcattttgattcttagtttaaaccccttatgtgcgttaagaaaatagaagaaaacttcatattaaaaagatgtcatttcgaaagaaattttagcactgtaataatgttagtcaataaatatttgaacatctgtcttccgtctggggaagaggaaatacaccagtgaagaagagatgttgtctgtagcaggaacatcaggttctgttcctaggcctgccgctagccagctgttgaccttgaaaaacagcactggcctcctctgggccggttttctcatctctggcatgagtagattgggtcaatgaggttccatctagctcttacaacgtgtgtgtgtatctgtgagacaagatcaagttcctcaaagagctcaaaattgaggaaaggagcagcaatcagaaacagctttcaggcatccagctttaccaagatggatgggaaatccccaggaattcttgacatctccccacatccgccccagcggcaatgcaggaaatctagtccactatcttcagcagactcaatgcaactgtttccttaatgaacccccctgcagccccgtgagctaagtcagaggctttcttttcaagccctccctcaaataccccattcctccaatttccttcccctccctcaatctggtataaaatccagcaatttaatcagcagcatgcaatttccacagcacccaagagtgtgaggaaccaccagtgatcctggaaagcatctggcaggagatcttgtcatttcttacaagcctctcctataaacgaaggccaatggagcagaatggactgttcggttctaccaaattgcttaaaccaaatgccacagatggtctatacttttaactactcacagtaatatatttttacttaaaaaaaagtctggtatgatttcaaatgcccttcctcccctacctgcaatgacaaatgcactgaaaaatgatgatatttacttgatacccaacacacccctaactgtgagatccaaaccaagaattagacacgcctggcctctactaacaccagcaggcttcgcatttaacattcacgtgccaagatagcttctctcactttttctccattcttatccccacccacatacacatatcagtttaaagcactacagaagctacttactctgttatttgttcttgtcttgcccaactgcccaagccaggtcaaatatcagccataactctgctgtgtagatctcaataggctgcataaccttcctcgaggacattacattattttggtcaatatgaaaccattttttggtaacacatcaccttcaacttccatattaaataaatttaaagtagacttagaaatgtctcgatcatttttggaaagaacaaagtaattacttggtttgtttcttaaaagtcacgtaaagtagactcaattttaaataaggggtttagtatccctgttaaaatctggaactttttttaaaagaataaagccattctgttaatcaaataagtgttagctttaaaaattcaagaaataaataggggtttaaaatgactgctatccttagaagagttaatgcaactagagttttgagggagcatctactttatagagttatacattctgctagtgaaaaaagcccaagataaagatgactgctggctcaggcatcctctaccagcccatctcttccaaaacagcctattcaaggccaaattgactggctgtttaggtacatgctactaaagaaaaagaaagtttaatgtgattagcaggggaaacccagttcatcctaacagccccagcatcatatggtttctcatccactctatatacaaatataaataaggtggggaagagaaaagagaaagacagacacggtgttcaggccatttcttggaatcattcattgaattttggagtcagaaaagggccttagaaatcaaccacctatactaacgtcttcattttacatacgaaaacaaagtacccacttggtgatcgttagaaaagaaaccagatagcctattatagaatgtccaacagggaaattttaaaaatgtaacaaagtgctaaaatagtaagcaacaatatttgaggaactggagtaagtagtcacctacagttcctttgtaacatgatgcttcagttggaaaactgtaggctgccaaagctcctaaataattaatatttcgaatatgcaatttagaccaaaaaaaagtgcagcttcataaaaccttggagaaaacaacaaaaattgttacaaaaaattaactttattataagagatttattacattcaatttgaaataggtattttcatgtgcactttgatttaatattattaatatggacttccttcacaaaattcacaatttcagtatttccacttagttatagtaaattgtaaatgttagctgttcaagaactcaagaaaaatgagggcaaagaaaaaggtctgtagctttcatccaggttgtgataccttaaaagtaagaaatgagactcagagctggagaaagaggactggtatcctttatagagaaagagcaatagagaggacttgaaagtatctgaattattggcatctttttatttcccagaatgtctggaagaggtaaataagcgctttagaggggaaaggcattatctttttgtaatactgagcctctggttattttacctctcaatgcatgtgcacaccaggcatgcacacacacagaatattaatagctgataagtattcaaagattacatagtacctgaaggaaggcagacccaggttcataatgacgcaagagaactctgcagtggggaaccgtggcttcttactagacattgcttcccggatatgcagcctctcagttgagcatgaaagccctgatgcggtttgtaaagtaggcggtagctgattgttttactgtgagatgcttgttaaccagacagagaaactatgagttttcaaaagcacccatgatgccgactgagctaacatgaactaacagagtgttctgttaactgttaggtaaagaggttctcagcttgccaatgttagtcctttcttcccaaaaaagtgcaaataaaaaaaaaaaagaaattcagagttgcaaaactgctgccccatttaagtaaattataatctaagaaaaatcacaagaggatcccactcacatttctgtaaagtttccactgatctaagatgcttccaattacaaagaaaacgatgcttcactaaagtcagcatgttttcaaaataaagatataattatgtgaagcagaaaatctaataaatcacgtacttttccctccgtaattttagattcatgtaatttagctagatttatctttacataatagtcgagtgaggtatttaaattctctaagcaattatattttaatacaagtgacttttcaaaacaaaaaatgtatttgtgaaatagaaaatacaacattttatttaatatagttatgttagcacctttcccaacctacagtgagttctcagaagttaccacttcgccctgtctccgggtttagtagtttctccaatctaattggaactattacttgttacttggaaactgacggtctagttagtcttcccactgagaaagaatatttaattattactgctttttgggtttaacaagctttttgttgttgttgttgttgtactacgctccatcctattgacttttcttcccgggaatcattgcaatgacttattttatattactatattttatttcatattttaccttttctccacgatgcttaaaagaaaggcgctccgaaatctggctctctgcgcccaggggaacgaggcacaaatctccgccactcagccccactgagcagagactgcgagtccgaaccctcaagttcctcggggctttgacccctcaatggcggcggtctaactgctggtaaaacccccggcccctgactgttccaccgcccgtctcccaaacgcccagcgaaggctgacttaggtggcgggcggacctcatcgattcctcaaaccacatcgtttggtcaaaatcgcccgccctctcttcgctcggattttaaaggctaggcttgtaagtcagtaagttaacggtatttgggccctgggctgcccttgtgggtcagggtcactgatgtccgcgacacggactggaccgcgcaccacgcctgctcccggcagaggccccacccgggtggctgagcgcagcgcactggggccccgcggtccgagagcggcggggaggagcgggcgctcgccgagcgttccccgggacagtccggcttggggactcaagcgggtcatgggatgccggcgctggccctctcctgagatcctcctgctcccccgcaggcacgagtcccctccaaatcggctcccctcctacactctcgtgacgcgaggtcgcggccagtgcccaatatcaccaaagtcccggcctcagcccagccccgggcagcctggcaggctttcaggagcctctgctcccggctccgggggaccctgcgtacctgccccaggtcctctgggaatgggctctgggtgccaggcaggtcccggtgcgtgctgctcctagtgcccagggcctcggcagtgagaccccaacccgacagctggataagggatcagcgatcctgtcgcaaacggacagccccagcgcggacccggtctgagcgctgatgctcgcgggtccaggccagccactcctcgaggcgctccctcggagaaagggcgcagcggccccaagcgtgcccgctgcaactagtgtcccaggttctcgccgtagccagcttctccgggctacagcctcgtctccccgcgtgcaccccgccctggcctcggaggctctgccctccggccgccccatcgcagcccgcctcaggccccggcccccagccgcgcctcacctgtgagaagcagacagctgagcagcgcgcacagcaggaccccggtgtcccagtagctgaccatggtgagcgcgacgcggcctgctcgcccggtgcccgcgctccccgcggccaacgacccggccgccagagtccgtcctctcgttcgccgccgccggccccgcgccctgagcgcccgtctcgcggctccagccaggagacaaccacttccccgggtaatcctcgccgccaggcgcccgctggccgctgcacccgagccccggagcccgctccgagccgccgccgctgccggggaggagccgagaggagtgtccgcctggcgcgctccgagcctcccgcggacctcgat

SEQ ID NO: 1178 - DNA, 194783 bp, Homo sapiens
tgtgtttttggaagtttattatatgaagatggtatacaaaatacattcatcatgactagaaatataggaccaaaccatgtctgtcttatatctgtagcatatattcttggtttgtataaaagtaactttaaaattccagtttccttaaatagttatgcacaaaacacacatacacccacacacacacacacacacacacacacacacacacatacagttacaccactgtcggccaaagatgcactcctcctttaatcaatttaaatgaggctagcgagtatctgtttgatgtttgcattcttgtgggctaggaaacaaggcacgggtccctaaaattaacatctcggtgtcacttcttggactgacaagacacagacttgcacatggtttcagccccattccacccagactgttccacgtacattatctcagaaactctgaaaggaagtgctcgttctttgttagtgccaaccatttttgtcataaatggcaaatgattggaatattatcagttaattcatgtttcaattttcagtgctattttaatgaacaagcactttgtaactagctcattattacaagtctccatttttctttctacattaagactccagatggaaccattctttgactgatggatggactcatgtatgctacaaacctgagtttgaaggagctgagtaacaattctaatggttttgcttttctcttgaaaaggagtatttattatggtctcttaatgattaagaattaattattgaaatcaagacatgaatagctaaggttttatttgttatcactatttgctgggctattatctgatttggaaaaaaaaaaaaaagtagagaattgactgaggtcttcttttttctgtgtttaacctccttccagttacctgatttataaaattgccagctgtcacaggtggtttgcgtatgtaaagaagaggaagaacaaagatttgtcctctcttctggctctagcctgcttttgtttggatttagatcttggtggagaggactgtcccactcctctcttctggctagtgagtcttccacaaaagccgctgccaggagccagtaggctcactagggaatgtgctgatgacggtcccatctcttcatacagagagcctttaaacaaggatgtggcacataagaacagaggcatacattcttcggttacttagagctcaggttctacagttaaattacatggataaaaggaagcatactcttctccccaagaagcagcaatccactgttgcctctccagcttctgactggctgcagaaggtgcagacatcataaatacatagaccctaacttgcataaatagcatcaaacagagccagcttagcgatccaaggcccacttgatctttagaccctgaagagtaggcgccctttcctaccctgtctccctattcccatcatgctcagaccccaggcaagtttcaaagcagttgaaaatgggcttttcttctagtgatggctcattaactaatatcctgagtcccaactggagaaataccttgcataaattacataccacctttttactcaaggagcttaaagtgcttaatatgcgccagctaatgctcttccacatcctttcagattagtgtgagatagtggaatccccattaaatgaaaaggaaacgtgactgacttcctgtgttttgggtcccaactgtgttggtgaattggtttggttggtatagagacggggttttcccttgaccttattgacctttttcctccatcagccctcgttttgatatggagaaaactcctctcctcaggactgcattttcattcttctcagctttctttcacaactaactgtgcaaaacagaataataccaagaaattgagttaagtgtctggactatatattaatacccaaaatagaatgtgacattttcagtgtaaggccatcatggcctggagacaacctaactctggctaagttttcagtgcatcttactagaggagccaaaagtatgggctcagagttgagtgccaccctcagtgctacaaatcaaaacatgccacgaatgagaatggacatagaaccacttccataggtaaagttctaaaatttgctttagttccaaaaaagatatttgtccttttcttgcctcccagaatccagaaaatgtcccctcatcgctgtccatctgctcctggctgggccctcaaatgtagaagggtcagagctgggaagccactgaaatggcattgctgagccccgtccccctccgtgcccacatggtgcgtctcaaattctttctcatgccttctcccggtttctcttttctcccttgctttttgctttttttccttttcctcctcacatgtcttaggcctgctagaggactcccgagatgttgctcaggccagccagtgatccctggggctaacgggcttgttgccctgggttttgggctgcagggctggcccagtggggtacgtgatgcattgggtgatcagtgcagctcctcaatcaaactggtcctgcgtgccctgaggtggcgggggttggagcagggaagtcattgggtttaggaaggatttctctaacactgagtaacatgaggatttagcagtagtgttcttcacttgtcactatttctctatctggagttacattcttgttagtcaaaaaaaaaaaagcactattaaaaaaatcacaaaaagcagctggctcccatggaaagataaaggtgtaaacttatatatgcataatactggcaaaagctagtttcctgggggtataaatacacatgtgcttctagaaataaggcttcgtgtcaaactctagatgggtggggtggagtacaggaccaccgagttgtagtctgggggcggggagcagcacgcgattttcctttccagctcagcgtggtcgtaggtgaacctgcgcttgccttcgctgacgtgcccacagctggaatggcagaaactgggcctgctgacatcagacagccccgactccttacttttactggttactctcaagctaaagaaagaaaggaaagaaatcaaatattcaaaattggttttttagaaaacaaagacactaaaatctactctttctgagtgggtcatttgttcatacctgtctagagttcatggttttggaaccccccccccctcaattgctgtcagatttcctctgttctaaagctgcacacggcctccctcttaacagcttggtgtcattgggcagaaagacagtggctgggggagggtatgaaatgtatgataagataacgcaaatccataatccaggtggaaagtaactccaagacttgggtgcagccctctcctattcttgggtcaaacagcttctgtggtaggctgagaaatgcctcctaccctccaaaatattcaaatttttcatattttatatcccttctggcctccagaactgcaagagaataaatttctcttgtaagttgccaagttagtggtaacttgttacaacagtctcaaaaaacaataaagctccacacacacaagtgagtgcctctctgcctgtcgtgcctgtgttctagaagaggaaacgttttagtcacggtgctgcttatcaccagcaaggctcaagggtggagaaacttgcttctgggtcctctgtgttacatccagactaggacagacacctgaggaagaagcgctgctcttgccctttaatattcgttcaaattttttattttcaaaggatctgggatgaggcagggaacccgtgaagcttgttttagaccggtctggactaacgtgtccatgttctatattttcagtctcagagtagaggatacaatttatggtcttctttaacaaatatctagataaaattagtcaccacccattttctgaagtgttccaaagtaggaaacaaaagagcaagtatcctaccttcccctttgatccattcattcctcattggtgcctctgatctactgtaactcaattctaataccactgtgctcatgtgaaaaggaaacacacacgcagatgtttgcctggaaatgcccctgtctttcccatttacttgtggccgatgagttgtgctaactacatcacttggaggcacttgttgccatcctttgatttagatcagggttcaaaaactataacccatatctgcccacctgtctggtgtttttttttttaatgagagctttatggagatataatttacatagtgcataattcgcctatttaaaatgtgtaagccaatggttttttgtatagacacaaattgtgcaaccatcaccataatcaactttagagcgttgtcatcatcccccaaaacgcacacctgttagcagtctttcttcctcacgccctccagccccagcccaaggaaactactggtctactttctgtctctagatttaccaattctgggcatttcatgtaaaaggaatcatgcaataggaaatattttatgactggcttcttttacttagcataatattttcaaggttcatccatattgtagcatgcatgcatacttcacactttttattgacaatattatattgtgtggatataccatactttattcattgagtcatcaactgatggatatttaggttgtttctacttttggctatcatgaataatgctgctatgaacatctgtgtgcaagttttgctgtggacatcagttttcatttctcttgagtatatgcctaggagttgaattgctgagtctcgggataactgtttaaccttatgggcaacagctaaactgttttccaaagtgactgccccattttacatttccaccagcagtgtatgagggttccaatttctccatatcctcgccacactgacttcatctagctatcctcatgggcgtaaagtggtatcttatggtaatttctttcccttttttctccctctgtcacccaggctagagtgtagtggtgcaattgtggctcactgcagcctcaacctcccaagctcaagtgatcctcccaccccagcctcccaagtagctgggactacaggcacatgccagcacaccccggctaatttctgtagttttagtagagaaagggttttgccatgttgctcccgggctcaagtgatccacccacctcagcctcccaaagtgttgagactactgcatgagccaccacacccagcccctcatggtagtcttgatttgtatttccctaatgactgatgatgttgagcatcttttcgtgtactcactggccatgcccacctgtttctgtaaatacagtgtgtgggaacagagccatgcctacttgatgatgtattgtctacggttgctttttatactataatgcaagcttgcccaacttgtggcccacgggctgcatgaatcccaggatggctttgagtgcagcccaacacaaactcgtaaactttcttaaaacattctgagatttttttgcaacttttttagcttaccagcgattgtcagtgtccgtgtatttcatgtgtgacccaagataattattcttccattgtggcccagggaagtcaaaagattggacacccctgctaatggcagtagggagcatttgctgactatctagccctttaaaaaaatggctgcctaccccggatttaggtgaaagaggaaaaggttctgccttcgggtgagacagggacaggcatttgaatgaggaaaggaaggaacatccgacaggtgcagcttttcccagtccagcaccattgcaaggtagagactcgcacagagaagctgcagtggcattcggtggtgcataaggcaaggactccccagtggtggccacggcgtggagggaggagctggtggactacaagccagggctttgtggagaaattgtcaagtgagaaaagggtgccaggatgaaatgggaaagtcattcatctgtaggggctgagctctcagggtacaggtcttagccccggaaaacagtactgtgtctcctcgtgtatgaaccctgccggcatagggagtgacagcgggggcatcctctcccaccgccgggagcgtgtctctgtctgcaccacgcataggtgggcacatcaggcttctttcacctgaggcactgtgctggccacatctggactgcctgtctttgcaagattttctgcatgttttccccagagcttgctgctcatatgtcccgtttgatgttcccctttttttgccctctggggggaaatggttttctgcaactcccggataccacagttcaggagggcaagtagtcctcaaacatccctcattataccaccttcccccagcatctcccctcgtacccctccatcaactgatcacagaaaagatacccaattcttactcaatcttgagcgaggccttgggtttgctgtcagtccaggtgaagcgcttcagcatgggagaggccaacagagtgctgctgtcgccctggtagtcctagggggagaaggagaaaggttatactcttgcctggcccagcgggggtccatgctgagcctgagggatgatcctgggatacatctgttgatccaggctctgcctcaccctccacaatcccagcctattgagacaaagcatttctctaagttggccactacaaacttgacccgctgcaaatcatgtctgatccccagtgactttgaggcccttcctgaacatgaagtaaatacatttaggcaaaaggggaaatggcaagtaacaggttagcattttccatagtaaactgtgatgcaatttattgcaacaaagatactaaaactaatttggcagatcacgattgactatgagtatgctatggtagtggtggccatcatagacacaaattctaagaaatcgtaaagacatcattcgattttttttcttgaactcaatggaattctcagcccccagcccttggtcatggtctccagcaattagacttccttgttggtttcttttggcagtgagttgcctgcagactcttcactactttgttaatacggcatgttccactaagtggatcccacgctttgttcctgccaccctttaaggctcttacagggcagtgttcctgtccttaattacgagtaaacacctaagcaaataaagaagctgtcatcattcaccactgatttagggtggggagggtgaaggttgagaattctttcacgttttgctcagtatttttcccttggccttgaaaaaaatgtgccaagcagtcaaacaagatatccatatacttcacctttatattcttcagcttatttttgatgcttaaaatatttaaaataatatttccctttatctggtgtgtctgacaaggttgtggtttttcgtttttgatttttttttttttaagggtgactgtgcttgcttcaaggccacactgattgtggtgatcaccttcacactgtcattggccttccaggccctttatgggacaaggtcattgccagcactccttttttttttgagacggagtccagctctgtcgcccaggctgctagagtgcagtggcgcgatctcggctcactgcaacctccgcctcccgggttcacgccattctcctgcctcagccttcctagtagctgggactacaggagcccaccaccacgcccagctaatttttttgtgtttttagtagagactgggtttcaccatgttagccaggatggtctcaatctcctgacctcgtgatccgcctgccttggcctcccaaagtgctgggattacaggcttgagccactgcgcccggcctcaccagcacttcttaaacattaatgtgtgcaggaatcccctagggatcttgccaaggtgcagcctgactcagtgggtgtgggcaggtcccgagagctggcatttctagccagttcctaggtcgtaggaacctgcctatctggagatcacagtgagtcccagagtctgcaacatcagaactgcagtatcgctcctgcccatgctcctctcctccccttagcccctcaaccccacatcacagggctttagagagaagagctgggagacctcttgtttgccaggctatactggttagcttctcccattgtgattgggtaggaacacagctgttcaatctgtagaacctcaggggaaaggagcataaggcttaggtggacccctcccagcctcaaggctgcttgcaggaacgcgctctctgttacatcacaaagcccatcacccacacagctgggagttcctctgttactctgaaagcaaagctgcatcactgacagctaagcagcttagaaacacacaatggagtttcctcagggtctaaattcctaccacgcagggacttgggtcctggagtgagtgcatggaactctactttcaaattagttctgcacagctaggtctagttgtcagtcctccccacactgtcatttcagccactcctgaatccagaccctcactgaccaagaactactacattactggcgttggtgtttggaagggatctgaagaaggggtctatcggggtgcactaggtaccttaacttcacgacttacatcaaacatggaggtggcattcggtaaaagttcttcaaaggttttgattctttccaggctcatgaacttgaaagcatttacgtatctaatgaagaaacagaaagaattatcaagacaggaaaaggcatccagctctaatgagtcaggagaccacaggcaccatatcccagctaagatgaaccaacacaccaacaggaatcacctaactcctgaggccccgatctccccgccgtgacccctgggaatcctgacagcattgccactgcctcccgtggttgtcaattcacattctgtagggttgaggaaactcccagagggacctactctggtccgttgtgaaatcagagaatgccagacataggagagactggaggcatcatctcgtctgagtgcccaatggcacaggagagaaatgatgtgcagggaagtggtatgactttatcaggtgctctgaaaaggatgtgaggtggcaaagtgacctggcatggctacacggctaaatattatttaatggcataatcgagtgctagcgccaggcttgtattttgtgtgtgtgtgtgattacagattgggagaattgggtagtgttgtatgatgtctctataactacctactgacttttgttgatgatgtattaggaaagactattggagacatccactctgtggttactcacaaggcaagttcacctactgactgaatttctcagtcccatactctgtcactctctgccagtcccagtgtcttgggcaagctccctactggcttaaggctaagcagccttagaagggtccacatataactttgccatgccacccaccccccctccctctctctaacccagccagaccttgccaatttatttaatccgaactagttttcccagctttacaaaatgatgacacatctgcttcagcctcttgggctggttgtgaggcctgaacagtgaggctgacctgtaatccatcaccacaagtctggatttgcccactgggtttctttgaggcctgtcacaggtgggtagcagtattttcttttttccttttttttttttttttttttttggagacagagccttgctctgtcacccaggctggagtgcagtggcacgatctcggctcactgaaacctccgcctccctggttcaagtgattctcccacctcagcctcctgagtagctgggactacaggtacgtgccaccacacccagctaatttttgtatttttagtagagatgggatttcaccatgttggccaggctggtcttgaactcctgacctcaggtgatccacccatctcggcctcccagagtgctgggattacaggcgtgagccactgtgcccggccgcaagcagtattttctgactgctgcagcttcttcccatatcttccctggtggctgaactgaggttagagccagagagctgtgcctactgcaaagagagatgctagaggcccatagtacagtctggaggccctaaaaggagtcctgactgcatcgggtacagggagggagggtcagaactcctgggttagaaaattattctgccactttctagccacacagtttcggcaagccttccttctgggagccttaaggtccccatttgtgtaacgggaatgatatgttcttcccaagactgctctgggcgtaagaggagttgatacatggaaaaagcctagcaccttgccagacccagcacttgtctgtgtaaccgtcatccctgcccaggtttcgtgcacgcctaactatcagtcctgaagtgcagtccccgggccagcagtggccacagtacatatttgttcccttgccttgccccttctccaattccctctgcagtaatacgggatagatgcgtttgttaggtcaaaacaaagcaaaacaaatgaaaacacagctcgctttgtttgtttagttttatctaaggtttcaccaaaaaattcaatgtaatggggaaaagaaaagatgggggaaggttctagaataagatagacaagaaacttaagaaaatgtaatctgttattcttaattggatcctgcttttaaaaaaaacatgtaaagacacttgggtggaattatggaaatctgactattagatggcattaaggaatttatttggtgcgataattttggtgtggtttacacaggagaatgtccttctttgagtgcagtcacataatcatagcccactgcagcctccatctcctgggctcaagtgatcctccaacctcagcctcctgagtagctgggactacaggtgcccaccaccacacccggctaatttttaaatttttagtaagatgaggtctctctatgttgccgaggcagattttgaactcctaggctcaagtgatcctcccacctcagtctcccaaagtgctgcgattacaggcacgagccactgtgcccagcaacaatagccttcttccaaaatgtatactaaagtatttaggagtaaagtgctattatgccttaagcctccttttaaatggtttggcaaaaagaaaaatccgtaacaaacacaatcatagagagtataatagacaaaatagggcaaaatgttaacagttgaatttaggggatgggcatatgggtggtgatcaacataatctttctttctttctttctctctttctttctttctctctttctttctctctttcgtctttctttctctttcgtctttctttccttcttttttttgttggaaaattctgtgatataaagtttgagaaagaaatcttacctgacatcatcagagcttcctgaattaaacttcggagctgaaatactttccttgaagaagtcctcagagaaggcaggagttgagtatgtaaacccactatttcctgtcagtatggcattgattgggatgtagtctttaccatcctaaaataccaaaggtagagctctcgttgcaccaattctgacttcaacaatttctatgaaccattatgtcaactttgactatgtcatttgcacaatcttggttgtgttttgagaagataattctgtatacacacacacacaccctttttttaaacttctgatctcagctattatattaatagctcttaaaaaaaaaacaaataaaatgcccccctgacgtacattcaaaggcattttgatgtaaataaatttagttttacctgttgtacatttgcttgaagcaaatcacctagtttttccacaagttctgcaaatcttggcctttcttttgggtctctgtgccagcagtccagcatgatctgatagctggtggggaaaacagcaacagaaatagttggagagcagtgatcatcctatgcattgccttacgtactacaaagggagggctgtcatcatccgcataaagcccaagctttctgtactatgtgaccctgcttcatttttaggtttgggtttatagcaccagcacttaaaaggctgtctgggccaggtcctgtggtcagtggaaaacacgtctaccaaggcagactaaccaacccaccagagctcatggatacccaggttctttgttgtgcctgtggcctctgcagatggaaggtctgagttctgtgaatgaaacacagcaattcggaaaggaaaccccaccgctcactgcagttcaatgtgaagtggagtactcctccccacacttacagaagtaggacgatgtccttaaagttaaaaaaaaaaaaagtcatacagccataaatatcaatggctgaatagtttgtagtacttatttcattctcgagttgtaacaaaggttggtttgagctggcttcttaaaaagcatgtggcatttccaagtcctcacacctccctttatgggctcagcagtggagactggtggggaaggtcctgcgtacatgactttgtcacttccagaaggtgaagcccacagtgtggagtttccggggctgtgagcaaggttcctgtgtgtagctgatcattctcccccagcactgcaaagccgctgttacaaactggcctcccaccactcaaggcacacagcacaggttgggctcctggataatgaaaacatttgtcttaatagcacagaggtcaaatcttgtcctgggattccaatgtcaacagactcctctgtgattcttctcttacattttatttttatttttatttttatttttatttttatttttattttgatgcagagtctcactctgtcatccaggctggagtgcagtgccatgatctcagcttactgcaacctccggctcccaggttcaagcgatcctcctgccttagcctcctgagtagctgggatcacaggcacccaccaccacacctggttaatttttgtatttttagtagagatggggttttatcatgttttccaggctggtctcgaactcctggcctcaattgattcaccagcctcggcctcccaaagttctgggattacaggcgtgagccactgcgcccggcctcttctttacattttagatgtaaaggtatcaggctcctctcttggtcatgtctgcacggaatcgaggtctgtacctaccgccctctctgaaaaacacaggccagaggtccatacacacactgcattaagaattgattcttcttgaaccttgtgctcttcaagggatgtttattatatgttaactcttctctcagaagatggtctggatgagaagggactctgacttacactcaaacctgaatgggctccgaatttggctctgggtgggaattgggctgtaagcactatgtgggctgggcctcatttccacacctctcgcctaccacagggcaataaatatctgctaaaagaagtcagactggtctccgggaagagataactctgctccttctgtgaattcttcagctgtactgcagacattacttgtgctgggagatggcggttgctggggaaaaaacctgagaaaccctagttcatatcctccctctgacacttcttagaggtatgcctttagggggcgccaatggctccagatatctcttaagtatatttctattttgtttcaaagtatatgaggtggctgccaaaggcagtaagaatacagggaggtaaaaaaaaaaaaaaaaaaaaagaagaatccgggtgtggtggctcacacctgtagtcccaatgctttgggaggccatggtgggacaatcgtttgaggtcaggagttcaagatcgtcctggacaacatagtgagactttatctccacaaaaaaatacaagaattagtcaagcatggtgatgcatgcctgtagtccctgtagtacaggaggctgaggcgggaggatcacttgagcctgggaggttgaggctgggctccaaagagaggccttcaggcagaggctctgggctcgtctcctcctgcaccatcgtctccccacaggatcaagctgctgtctgggagatgcaccatcctgagcaggacactccctagtttccctgctgacactcgtaaacggaaccatctacaaccacttgctgtttgttacttttgactcttggattccgatttctagtttccactcttcttgcctaaaatccaatgcaaatcatctcagcaaacatcaaatgaaaagaaaaaaaaaataaaaaaattcattgcttattcccttattgaaagacatctgattcaacagtatctgggccaggaaccaacaactcaatgttacaagattttgtaccactaagtaaatgggtttagtaaagttatgagacattagcttgcatccaagctggggatgaggggcccccagaaagttttctttccaagctatcacccaagttcccaaatacacaccgctttaggccaagttcagatcacagaatcccagttctgagaagctgcacttggtcctcacccagcccttcctactgttagaacaaacaagaaggaaattactccatcagctttcacatgctggagaaaatggctgaaggtttgaagtctggccttctgaggaaatatttcacagagcttcttactttttaaaatttctaaaatctctccctcctcagaattaaggaaccataccactctctctaggtcacctgaggcacgggagctacctgagcgaggtttatgtaaagacttgaaggtttgagaaagtccaaagcagtttttggtccaaagctgatgtgactttgtacctctgagttatttgcgaccacagcctgggtatgaatgggaaacacactctgcagcagtgtaggatggtgctgtggactctggactcaagctgaattcgcttattaccaacgcaggcttgagcaaatcacttacatgtgcggtgcctgttttctcatctgtgaaatggggatcatggtagtcctactttataggactgttatgagcattaaataaattaatgcttaaaatagtggcacttataagcaccaaataactatttaatcagtactattcaatactgttataataaaaactaatttcaggccaggcatggaggctcacgcctgtaatcccaacactttgggaggccaaggccagtggatcacttgagctcaggagttcgagaccagcctggccaacatggagaaaccccatctctacaaaaaaatataaaaattagccaggcgtggtggcacatgcctgtagtcccagcaactcagtaggctgaggaaaaagaatgacttgaactcaggaggtggaggttgcagtgagctgagatcacgccactgcactctagcctggacaacagagcgagacactatctcaaaaaaacaaacaaaaaaacccaactaaactaatttcatactatttagaatttatatggaagtaaaaataaaacttaatttcatactgttttgcatttattttgatgtaaaaatattgttatttaataataacaactattagtgtaattgagaactttctcgagattttcagactatatgaagattggaaggacatatttaattcaaagcatgagtggccatatcagagaagcatttctactgaggaacgtggggtctgttcctaattcatcagccgtggtctagggacatcagtccagaggcttgggttctaaatgtctcctttgcttctcagctgacagacggcacattgcttcagttctcggcatctcagtttcattacttgctaaattcagattacaatagctgccctgaccacccctcaaggtctctgggaacttcaaatgagactatgtgtgggaaaacacttagaaaatcataaagttaatcatctagctctatccccagctctcagaaacaggccttgcctcagctccctgtacttttctgatgaggacaccacgcaccagtgacaagaacaggtcccctcccgcttccctacgctcaggcagagctccccagccctgctgttgggcctgagtctcctgtccacctcgtccagttccccatcctgggtctgacctacccttaccccgagatgatgaaggaaagagacagtgactttgccctttggccaagcccacacttcctgcattccctctgattccttctgaaaggccagccagggcttctgacaggaccccattgtgtgggtggaatgggagggcccctgccagttcaggaaaggtggtgccgcctcagggaggcccaagtccttgtcagcagctccacaaaagtgcaagtgtcatcacattcctgctcaggcctcaaagtgcaaaacatccacaaagccccaggaaaaaaagtgtccaagacaggcaagcaagtgcaatttgcacagtggagaaagcctcacatggacacccgaaaagccatctgaccaggcagcttcagacagctgctgggcctattcctaaaaggttcttttttttttttttttttgagacataatctcactctgtcacccaggttggagtgcagtggcgtgatcttggctcactgcaatctccgcttcataggctcaagtgattctcatgcctcagcctcccaagtagctgccaccaggcccggctaacttttgtatttttagtagagacggggtttcaccatgtcggccaggctagtctcgaactcctgacctcaagtgatccgcccgcctctgcctcccaaagtgctgggattacacatgtgagccactgcgcccggcccctattcctcccaaaggattctaaagaagttgtattgcccacaaagccttctgtgaagcataatcatgacatcaggaagttccccttttcctctccaagacctgttctgcagaccacatcaaccccctcacgggtgttctgtgcagacacaggactggtcacaagaccaaggtctagccctccatccctggggctgctaggcctgtttggctcccactccgtgagtgaggccaaggtcttgcattcagttcctgggtggtctgtttgttttgcctggattcatacctagaaactgaatttctaacttcagttcccagctagagcccttgaaaagtcatgtcagtggtcaggacaggaaataggtagggatgggtcaagggccacgtgccccactgcaagaaaacactcccagcatatctgggcctgatgggctgaggggagcatctctaaaggaaagaagaaccttggcatcttccaagactgggactctaagaatccataaaacatcccctctcaggaatgccctggtgaaaagcgagctgtcagatggggagcagagggcaccaagggctcacatttcaggagtagagtactcaggagctctcatcctcatgccttccctcaggcgactgcaaaagtcctcatccatttgtactcctgggtatggagacccacctgcgggagacaatgtggaaaacacagggcctgttatggcttaagggtacaaaagaccaagaggggacaattcagtgtttctttcctccctttaaagctacgttttagtaataaattcccagggattacaacagatctcaacataccgtacaacacacagagaagctcagcaaatccttgctaaggacacccgcttggttgggtggtcacatggtgcggggcacctggtgctcacaggctattcctatggctacttctgcctgtgtggtcagaggaaggggtgtcgtctgaagggtccttgccttctccccacaagtaactaaagaagtcccatcattagagactcatcctttgggttagtgagcttttgttttttttgaagagacgggtctccctctgtcaccaggctggagtgtggtggcatgatcttagctcactgcagcctcgaactcctgggctcaagcaatcctcccacctcagcctcccgagcagctgggactccaggtgctcaccatcaccacacttggcttgggcttctttttaaaaagccaatagacttgggataggctacataggaatcattcacacttgagtgggaatgactttaattcactttcttgcaaccttcctatagtaccagggctctaggagttgtgacaggcctgagggaaggggggctttgcgctccagggctgggctgaatggagtggaatggggtgggggctgcccgtggccaggagtctgcagacctaagggcgccagagaggcctaggctttgccttctgccagctttactgcccaggattcccctgcaacctttccttttggggggattcttgccagggctgggggtggcaaggccttctaatgcactcttgctctagccctgcagcctcatctacctcagcatttgtttgtgtgcattttctagtgattactgctggtaggaagcagctgggaggcgtgcagtgctggcaccgtgtcatcgcaggaccactgcagccgccaagctgctttcaaagactggaagcaacaggtgcctgtcatcgaaagcaggggaatgattttcacacattacaggaaaccagggatgttactgggtgacttttatttgctgtgaaaggcaaatttttggcaaagcccaaaagactcttggcgagaacttgagttttagaggcctcagatcatcactgtgtgtctgcaagcagatgtgggctctgcacgcatctgtgtgctttgaacaggacttccagccacccatagtggatgttattgcaagcagaataaatacaaccagtgttgtttattgcttatcctgtataaaccagtgtccagagccatatcatgtgttcatatcagaggcactggaaaggtctcctgtttctaacaacaccttcctcgctggggcagctgagcttgttatggcctttcctaggaagaaattctgaggtggtgggagacgcggggagggaagcggtaagggcattagaggtgtgggtgttgaggaattggaaaaggacagaattgggcaaagtacagaaaaagtactttgcttcagactttatacccttgttcatgatcgtataaagcccttttacatgaccttgttctgaccttgttcatgatcatataaagcccttttacagtagagggcagacatgcgtacgccattactcatctgagagtctacatgggcccattacactttaagagttttttgttacagtaggttctaatctaaaggctgtctaaccaaaggacattcagcagaagatgcagacatttatttctgggctgtttgatttcttccttctcccaaatttacctaaggagaagatttcccacagcaatactccgtaagaccacacgtcgctcttggtgctgtagattttgtcaaagatagattcaggagccatccatttcagaggaagtcgagtctagaagagggcaagggggccttgagcagaagggcatgaaaacaaagcacattcaacccgagtgtccatggggtcacctcccagataacatacggcctataaatcatttccgagagcagctctggtttcctaacatagagaacaccatagtatgcagtgttacgctaaaagagggagctagagtgctatactgagtcccatgaaggcagtatatgttcagtaagcccctctgatgtgttcagcatgtccttatctgcatagctctgtgagaaatcctcccccacaaagaaagcctgcactccacagggacacactcagggcttggaaaaggaaaagagtgatctgaatttgaagatatcctgaaaactggtggtggtttccaaaaatttttccaaaggaggattttgaaagcattcctatgcaaaaagacaagatttccaaagtcactgaatagggagagtgtgcaaaagcatcagaaagaagagaagaaggaaagaagtcagtgttgaaagagaatatacagttagttttcaaacatgtagacaaatcttcctctctttcagatagcaggaatcccagtgagttaggcctcaccactttagatgatggggattgatgggaggtatgggataaaggagagacaaggagaaaggaagtgggaggggcagggaggctgactcagatacagacgaacagaaaggaggggaggactaacatgaaggttggtgccatctctccagaccagggccccaaggaaagtctgttttcctttatttttatttttttatttttacaaaggatcaatgtgaagtcatatgttttccttctatacaacagattctggtgcagtggctctcgaagtatggtcctgggacatgctgtgtcagcaccttctagaacaaacatgtccaattcctggcccgcgggccacatgtggcccaggacagctttgaatgcagcccgacacaaattcgtaaactttcttaaaacatgatgagatttgtttgcatttttttttttttttagctcatcagctattgttagtgttagtgtattttatgtgtggcccaagataattcttcttcttccaatgtggcccaggaaagccaaaagattggacacccctggtctagaaactggttagaaatgcaaattctcaggctccacccaagagttactgactcagaaactctggggggtggaaggcttgttaggccagcacactgtagcgtaacaagccttctaggtgatatgtatgttcaattaagctgggaaccactactgtaactcattggcgcccagacataagcttaaccctcagggtatataggctgagggttaaggagaagggaggacatgggaggtcatccacaaaagtgaaaaataacactatgtctaaaaacaagcagggaagagaagccagtacgagccagcggggagatgctaggcatggaaggccatgggaggtaaacagtctcctccatagtcagctactgctgacggtcttccccgccctttcctgagacagatacacctgctgaatcaatcatctgggtttatttgagggaaagagtccaggctgttcttttcagtggtacaaggaattccctcaggattcaaaggaaggtaatgctaaggtctcacccaggccccaccaaacacttctcaggttagcaagtctcacgcagcgctgcccaaaggacaggtgggaggccaggcattagggaagagcagaagcaggagacagtggcctttctgagccttacacaagggctctctgggatgccgctcatctggactgtttgtcttcacagaaagccaatgatggttttcagggactacagctgaggaagtgtaaatatttaccaagtctgtggtttaaaagtgataggacacacatgagtcaaataaacatcaaactgacttacatctccttttctcacataatcggggttcttataaatatcccgggcaaggccaaaatcacaaatcttcaccacgttgttctcagataaaagaatgtttctcgctgccaggtcccgatgaatgcactataataaaacagttgcataatcaatgcatttccttaacctaaccaactaatttcctacacctgtcagtgtcattatcttaatttgggaatccatttcacatgctgtgaagggagcacctctcggtgcacacagagttaccataaacatgaagagcctctctacaaatacaggtccccaagccctcaaagtcaagaaatggtctgaatccactgggctactatttgatcagcgaagctggttatctaagatttaccagtgggcaaactttccccacagtcttttatcctgagctgccaagatgagatctttctccagctgcagttttgtgggagggccctatatggctatattaatagtagctctcctatgaagtcatgtcttctgagatttgggccagatttgaaaatatgccagaggatactgtggagagccgatgccaggtttgtctagtctgaaacctgtgagttttccccagaattaagttctatccactggtatccatgactcctcattctcaaaactcctcatatcaaggcaaattaaggcacttgcagtggtgtttgttctacatttaagaacataggtatcagcaaatactaggaaaaatgaatttatagcaaaggtgtgtgtccagccctggcagagaagaaaaacagtaaacagcaagactgacctttctggaagacaggaactccatgcctctggccacttgaaaactgtaagaaatcagatcttccatagtgatgggctccttgtagaaaccgtcagaatctggaaagcattagaaccgtaactgtttgtaatggctcttgttatcccaccaaatcccagtttattggaacaatgttagcaaaacataaaacaaaccaacaagtagatcagagttcatttttaagagtatttgagtttcaacatgaacaccagagatttttccaggcctccagcccactttatccaagcatgggggcagggggatgatccattaagatgaaaatccctgaggggagaaaacggtacagttccctgtcaaaattagtaactctgtaaattatcttaattcaaatcttatctcctcaggacattaccattcgagtctcccacggatgtttattagagtgataaataagaaaaaaatttcagagatgcatagtatgttgtaaaaatatctcagcgcgtaggacaggaaggaattaatacctaccctcctcttcctcaacatcactcagacttttatcttcctgaaagccggagctcgcaaagctttcgctgctggtgacgctatctagtcttggtttcttgccttgttccaggcctggctccattttttctttcttaggctccatgtgtagtgctgcatcctttgaagagaccgaaaaggacccaggtgaaaaggagctccagcacagcagtgggaaaccagtccctcaactggcaatcgcctgatgagaaatgagagcgtttcacttctcaaaatggatcgtgaactagcacaggggccctacggtgtccaggagcctgactacctctggagttgcagagtctattgtgctcttgcctgggcttctagacagcatcttagatcagataaaaaaaaaaaattaagagtggtgggtatttactgaatgcttactctgtgtgagctggtatattaaaagctttaggtacatttcttgtttagtgtttccaacaattttacgaagtagttcttatttatacatggagaaacaggttcagagaagtaaagtaatcaaattcacatgcagctaataaatagcaaagctggccgggcacagtggctcacgcctgtaatcccagcactttgggaggccgagccaggtgaatcacgtgaggtcgggagtttgagatcagcctgaccaatatggagaaaccccgtctctactgaaaatacaaaattagccgggcatggtggtgcatgcctgtaatcccagctactcaggaggctgaggcaggagaattgcttgaacccaggaggtggaggttgcagtgagccgagatcacgccattgcactctagcctggccaacgagagcaaaactccatctcaaaaaaaaaaaaaaaagcaaagcttgaacccaggattggtcgatgcccacatctgtgcccttaaccacttttccatgccacacgccatcttgtgaaggatgacatcactgagaggaaaggatcctcagtgtgcttggtgcttcactctgtaatccctaggaggagttataagagaaggctatagttaccaatttctcaggtttctttggggaaggagggaacatggacattgctttttttctcttccatttaaacaaagatacagtttgatcctaacaagggtagcaatggcctttcaccctggactgcacatccaagccctggttcatttggctcttccattaatcatgcgatcttgggcaagtcaccttacttttctgagtttaattatcctcttctgaaaagctctattatactattattttatgattcataggaaaggagttgtcagttctgggtgttcatgggaaaccagaaaagatttttattgccttttgtaattcatctagtaactatgacactctaaaacctagcactttcagtggctttataacaagaccatgtttgtagcctagattctgctagacagcaatactgaggcagaagcagagagggactggagttcagtggtgtcccttgatccatttgcatggtgtggcagttctaggattaacccgcgtaccccatccttcctgggcttttctagaaatgtcacaaagcaagagtgatccctccactagagggcacagtgggagcaagcagagcactgggagaaagcttcaggagggacagccctaacctagtctaaaagccaaaagggcaccaaggttcccagcccctgaaaagagaccttccggggttgcagagggaggcaggcctcagagtgaatacccactgccattgcaggtaacccacctgagggcaggtaaagactttcactatttgttattgtgtttccacaatgcagttatattggattctgttcagttggggactggaattttatttttcacaagatcctttgtgggacagaaggcatcagagaaagcgctggcaatagcatggggagaaaaatgctccacaggctcactcagggctctgcatgtgaaaactctccctggacagccttcttccccacggcacccaaaagtcacagcctaggcatgtctccaaggaccaaaactcaggctctctcactcccttcctgactcccaatcaattgtatattcagctttgcttatcagtaccacttttgttaaataaaggtaatttactgaactcttgggactctggcagaatatagtgaatttattacaaaccatatttaaggatcccagttaatttatttggaaaatgaagtattccattttcaatttagccttttggttttgcctttcctttacctttatcttccaaatatgaaagacagccatggattttccacaaaaacactaagctccaccaagttgcacagggaggcaaatcattaaatatagccagagaaggaagcaaactcttcaaaacaaaggacgcacaaacccaaacgttccatcctgcccaggtccctagggtattctgctggcttagctcttcctgaagccagtccaaaatttcagtactaaggggaatttgtactgccctcagcccaaggcaccactttccactttttcttatgcttttttcacctcatttagtgtggtgcacagaaaaggcagtggaggaggagtcaagagagctgagttctttcaccttctgacttcacctcatggtaggtgtgtgtccttaagcgaatcacttgacttctctgaacgcatctgcagcctgcgagtgtgaaccaactgatcacaaagatccctttcagtttcaagattctaattattaggccgggcacggtggctcacacctgtaatcccagcactttgtgaggccgaggcaggcggatcacctgaggtcaggagtttgaccagcctggccaacatggtgaaactccgtctctaccaaaatattcaaaaattagctgggcgttgtggcgggctcctgtaatcccagctacttgggagggtagaggcaggaggatcacttgaacccaggaaacggaggttgcagtgagctgagatcacaccactgcactccagcctgactgacagagagagaaactctgtctcaaaaaaaaaaaaaaaaaaaaaaggttcttattattagaggacctgacttaaacctggggaaaatgatgttcttgcatatattgccggtccggtagaacatctctgtctttaattagatcaaagtttgagggatgagaaaattggccagctgtccagtggttcttatttgtgtgtgaagattcttgcccacattataaagatgggcatcattcttggatttcagacattttatccaccatgtagatcagtggtacgaagttggactcacccaatttttctatcttagtaggtcaatgatgttgatgatgatgatgacagtggtggtgacagtgatgattaacatttattgaatgtttgactgagagatttttattctctcaacaatcccatcagctggattctattataagcttcatttaataaacgagggaactgaaacagacaggttgagtaatttgcattcccagatttcatgagaagtagagacaggatttgaatccaggaagtctgattccagagtctcaatgtttaaccaccacactacatgggttcatcaccagtgttgctgattactggttaataatgttgaatcactgtcccctggacttcttcagctcagagaaggacacagtattggtgccatatgtcacactggcaaagttttagtaaattatttctcctccattcaataatctctctctctctttttttttttttttttttttttgagacggagtctcactctgttgcccaggctggagtgtagtggcttgatctcggctcactgcaacctcagcctcccaggctcaagcgattctcctgcctcagcctccctagtagctgggattacaggcgcgggccaccacgcctggctaatttttgtatttttagtagagacgggttttcaccatgctggccaggctggtttcgaactcctgacctcacaagatccacctgcctcagcccccaaagttctgggattacaggcgtaagccaccgtgcctggcccaataatctcttttaaaccttgtttgcccttaggtcttgggtccacatgttccttttactacacagcttttatttaataaggctggttcagagtatatgtagggatgacatgggtagtgagggtgtcaggaagtaggggaaagggcagtggaaaagaaagataatgatttttggccctggccacatcattggtctactgctgattgtcaagtcactcagttgatttagccttagtcaaaatctaacctaataaatggagacaattatattaactattatcttccttaaagaaataagtgacttgtgtatgtatgtttgcgtgtatgtacacatgcacacatatatagggggagaaagagagaaagttattgttagatatttagataagtggctagtagatttactctccaattatggctgcatacgcacacagggatcaaatgattctctgtgctatccacactagagtgtaacagattatcaggggaaaaaacatgaaaaaaggagaagaagcagagattgagttttaagtttaatcattaacaacacaatacaggtttctcttgctttatgttgttacagactaaatgaaaactcattgctatctttaaaaacctccaacttttgaaatccttaccttgttgagaaaaaataagtcacgtttgctcttgaggtagttggagagatttccatatttgcagtattcaacaatcaccatcagaggccctgcagccaaaacagcacatgctcatgctcagccacaccaagccagtcagccatttgccagccttcagcctgcctgagaaacctcaaaccaaccagcctttgtattagtggggcgaagggatgcgatttagggatgagaggcccatgaatacggtgactttttcagtttaacctaagaaggggtttaaagaatacaattgaaatacaaaaaaaaaaaaaaaaaaaaggaggtgaggggcagtgcagaagcattagagagaaaagattggaagaaggacagaaatacgtttgaggaggggagaggcaaaagccagcctccctgcctcttaaccagacccttgcgagtagagcggcttctggttactgtcacaccagtcctggaactattaagcagctcctccctccctaccacgacagagacggctacctggccgtctctcgccagcagtgtctgcgcgatttgccttggggcttgccagaggatctacagtaggaatcggcaaactcttcttgtaaaggtccagctagtaagcattttaggctttgcagatcaaggagctactactcaattctgcctttgtagcctggaaacaaccaaacaagtatgactgtgctccaagaaaactatgaacacagagattggaatttcatacaatttcatatcatgaaatattatttttattttttattttttcccccaactttaaaaaggtcaaaccattttaagctcacaggctgaccttggtttgccaacccgaccccggtctgaaggaagcaagagggttgggaaggaagtccagctgcactctgaaggcctcctctctcctgccctgcgtttccactgcatgcctgggctgggcatgcagcccacaaagcaaggaccacttctgggtcaaaggggagtgaccccggagctgcttcaccagccgctgcccagggcatgccgggagcccagaagccactagttcttttttgtgccttgcagaagttgggctggtcctggtggagtggttttctcttagtacgaggaacacgctagaaatcctaacagcatctcatcttccccctaggttccagaacgggaagttgcttccagagttttttatgtcccctctacggcggcagatgccgcagagttcggctcccgcatggggtccagccaccgtcctcagaggggcttccatgctggcgcccagctgcacggagctgacggccgcacatgagggtaagctgtctcattatacctgatcagttttacagatgcaaagttgaggcaaacagaatgaggttgccacgacagagaacttcataaaacgttatccggggatgatggagaagcaggcggggccgtgtcgaggtccctccgactgtttctggcctccccagcctttagctcctctctaaccacctccgcccctagcagattgtcttccccagctacccttcatctctgctacctctgttgagagctggggaaaacattggcttgcacagctctttgcaccttgctggctcaaacaatgatcacacatctactctgccctaaccctgccatacggaaagaaaggtctgcgacaacatgctggagctcttaatcataaagcacagctctgtccctacccccttgggtaaggtctatctgcatggtggatctggagggaagggcccccacatcacctcctcctgggaccctaccagtagtgattcattcattcctttaggtgaagcctcaaggaatatgcaaccttctaccttttaccttggctctggccacactccttcagacccatcctgagagaaaagtgccctctgcttagcctagagcctgtggaaggagatcaaaaagggagtcctcttcagaatctttaaattaacggcacagggaagggatttatgggagcacccttctgtagatgcacaagctgtttcttctagagctattagggaggccgttttcctggaggcgaggaagcacagtgcgggggagaaggagctgtaaggcagagaactgttctcccagcctgtgcagggggagacggagccggccctccccttctccattacctccttgcttggtgcaggctcccagcaggttaaccacgttcagatggtggccaatgtgggtcaagatttttagctcagtcatcagagctttgtactcgctggccgtggccccctctgtgtgagaagcaaggaagagtcagggcgacaggacaatggggctccttccgccggaggcggcattcttgccctccttgtttgtcaatgctcagccggttgcttcactaacttccccacattctgcagaaaggccaagtctccagactgttttcattactcccaccctcctgagccaacatccttttgattacagtaaggcccagcacagtagtggggttagtcactggacatttcctcttggtggacctagttctcttcagcaatgcgctgactcagagctgggcacctcgtgaaagtgccttccaaaggcttcccttctgtcagaaccaggtgcagcaagaacccaccaggcagggagtacacctccacgtcccctcttctcaccttctccctttggggagtcacagagaaggagcacaaggggcctgccagggcagaatggctactgttgtaaacatctttgcaatgtgttattttctccctgtaaccctgtcctctctggagttcacagggttatcttgggttgtgaggatccatagcatctgacttcaacttcagtctcagagataagcattatcagtccaagaattagcagagtctaaagcctaaattgagtttgttctgtttgttcttattagttaatatgcaaggcatttaaaaattttaaattatttttagaaatataaaaatcaaataatctttctgtaaaatatttcaacaatatgagttggaataaaatgttctagataaaaagcaaaagccactccgacccacttgccttcttagaagcagccatggttaatagtttggtgttcagacctttttctatgcatttataaatattcaatcagaggtcctatatatatatatatatatcatatatatatgatatatatgactatatatagtctatttaaaaaatctatttccccccttttaataaatcagagactttttctcttctttttatttctttttattttttatttttattttttttgagacagagtctccctctgtcgcccaggctggcgtgcattggtgcgatctcggctccctgcaacctccacctcctgggttcaagcgattctcatgcctcagcctcccgagtagctgggattacaggtgtgtgccacaatgcttggctaatttttgtatttttagtagagacagggtttcaccatgctcctgacttgaggtgatccacctgccttggcctcccaaactgctgggattacaggcgtgagccaccacacccagcaggttaaccacgttaatggtggccagtgtgagcccattctttttaattgattaatggtgtccctgacatttagagtgtctatagtctttttgctattacaaataatactgtgatagtctgtgtgtaatctctgtgcacacatgcaagtgtttctgtaggacagtgtcctggaagtgggttagaggtatgtgcatttaacattgtggtagataccaacatggtatttcataagcacaaatcatttttaataataactagataaactccaaatcctgtgcatggggttagggctggctcacagtagatgctcaacaaatattttggaataaataaacacaattactcttctcatttcaggcatgggtgtaaggcccaaaaagattaatatttttgctcaaggacactttgaaagagcttttgacttatggcctttgtttcactttatgcttttgttttgagacggagtctcgctctgtcacccaggctggagtgcagtggcgtgatcttagcttactgcaacctccaactcctgggttcaagcgattctcctgcctcagcctctcaagtagctgggactacaggtgcccaccaccacgcccggctaatttttgtattttttattagagatgggattttgccatattggccaggccggtctcgaacgcctgacctcatgatctgccggcctcggcctcccaaagtgctggattacaggcatgagccatcacgccgggccatgccttttttctatctcccagaatcagatggccaattaatttaagcaagaaagctgaatgaaattttttaaaggaattttatagagtggatgatttggcagtcttttacaatcaatgctgatggctaaaaaaaaaaaataggcatttatgaagacactacacatgcaatctgtattacatagaagagattctctgagccttttaaaaaaatctcagctgggtgcagtggctcacgcctgtaatcccagcactttgggaggctgagacaggaggattgcttgagcccaggagtttgagaccagcctgggcaagatggcgatactgtctctacaaaaaaaaattttttgaattagctaggtgtgatggtgtgagcctctagtcccagctatttgagaggctgaggtggaaggactgcttgagcctgagaggcagaggctgcagtgaactatgatcatgctactgcactccagcctgggcgacagagtaaaaccctgtctcttagaagaaaaaaaaatctcaagtcagaatcttctttcaaactcattcatctccctataaccctttcctctttggaggaaaaaaaccaggtgctggttcagcttgctgtatttataggcagggccacaggtattatcttggacccacaacagactagtgtggatatcagagctgcctctcctagaggacaatgtgtggcagcaagcagagaaacgggactagctgaggaaacagttgcttccagatttagtttccacctatctctaggttggatactggattgcctccataaactaggccaggatcatcttcagggttttggagcagtgtgccaattccaggaggccaggtctctgcagcccctcttttgtggcacactggtatggaggaaagagcactgcattcaaagctggaagactttcgcacacaaacccttacttacgctgagcagctgtgtggccttgcagaggctatttaacctttcttggccatgtttcctcatctgcaaactgaggataataatgtctacctcacaaagctgttgagaggaaataagaaaaatggctgttttgtgtggttcagcctaataagtgaaagtatctagtctggtgctttcttacatagaagacatgttgatgcctcttctcttcagaatctggggttcttgcagggagggtgctagcatgcctctattttgacagaaatacctgccttcgtctgggaagtctaccccaaacaaaagttctgacttgtggataccaaactccttcccagactactttcagagcagaattggcaggttctttgcagagttttattagttttttcttgaggagtaaaccttttgaagttgaaaatatatttacatggggcttttgaaataatggagttattgctagaagattaagaactttgacgtctccctaagcaaacaaccctttctcctggagcctgtactaggtacccgtgtagttggactcacagcttgctgggcttcaaaatttcccagcagtatcctggagactttggaaagttaaaagctgctttttgagttttcagttctgttgagttgaagcatcataaaattccattacagatgaggaaatgaagtattttctacactgtaaaggacctgtgagtctttgagacatgtggtttacacagctttcactgattttcattttcaatctgtctttggtgttgggcataagtcactgtgtgatttggttctacctcccagtgcttcacagagtagtagtatctttcaacactagaaagataattcaggtttttaaactgctaaagaggaaatgttttatggctgaggtagttagtataaaatagtttagagttctgatcaactcaattgttctagctttatagttttactttatagtcaggtcaagcccaagcaaagccattgggatttagaatgtgctgctaagtttccattacaacatcacagtagatcatgccaaaatctgaacctgcagttacaatgggcttaagtcccttgttgtctacagtctgtgatgtgagatgagaaagacctttgaggtgacagagatcattttcctatggacagtgctggattgttccatttacaaggtttcttctgagctcgtgctggcctaatctaaaactcgtgagcaaagaggcctctagcagtagaagaaaattatgtgtccagagcagaaaagcttgtgtctgttcccaggctatatctaacttgtaccaacatttaggaaatgcaaaatggtgatgggtcagttgaaagccaaactacagcatacatacctttcagcattttcacagccacagtccggcacgtaggtgatttcttaatgccaaatgctgatgcttgaaccacttttccaaaagcccctcttccaagtgatttgcctgtaatgaagagaagacactggtttgtttgccgaggcaatagggtgagtttaagtctttttcaggaaggaaatgccttttcctatgtgtgcatgtgaggcatggaatctccagtgaactaaccctaaaagagacaaagtaagggacttatttctggagtctcttcctttcaactcttaactctgttcctgaggccccacatccttcaaagatagagtaagtccctagaaggcattcagtgaaggtagatgtccagtttcctttccacagcgttctcccgtaggagagatgggaccaagtcccgtgtagtttcttccattgtttaataacattatgaccaagaagacttccctgtgtggaacctaagctctttttctttttccatttacagtcatttttctctcatctgttttcagcaaaaagggagaaatagaaaatggtggttactactgtggattataataatgctcataactttaaaataatcactaagtcatttatccgacttccctaccaggcaaaatatttccagtctttctaatgtgtcttaggtgaagattacaaatcctcgtggttcagcacaggagcctggtcaaccactggtagtgatttgtttcaaccccagagaggtagttgctaaatgcaataactaagcaaggttcctttcatggtccccataatgctatgctataatgactgttaatatgtttctttccctatcctagaatgacccagggagtccttgcccccctttactctggggggcaaggaccatgtctgaatcttcccagaacctaacttggtgcctggtgctatctgttattactgaatattgctgcagaatggagagtggtgttcaggaatgtgtgggttgcccaaagcaagtctcctagtcataggtaactagaggggcccatgggatggagaccctgagattgatgccctttagggagggcactccctggagtacctaagctgccttttatatcagggaacctccttttgcacatcaggaaacagctcaatagaacccagagaaatggtgcacctccagcatgatatacccaaagaagagtaagtgaagtaagtcagtctttttttggcttttcttgggggaaggggaaatgacagaataccactggttggttaaaactattataaatcctggcagttagagtgttaatttaacacaacccctcctttcccaaccaagtgctctttcttagacccgtctgataatgtgccttcagttaatgaaccttctttcctcccttccttcctcattactccactccctttccccaaagggcatttttaaaaaattttcttgtagtttgtaatgaagctttgcttcttcctcatcatattagaacctttctacttttatgcccaactactcagtgacaaaaatgtctttaccttgctctgcttaatgtcttctactacccaccaccccaggtgtccagttaggatgtatgaaaatttcacttataccagtgtcatcattagggcctctgtgtggctgtctgcagggacatgctctgcattcagagagaacactggggagacgacacgtttctctttttgtgaaacatgctcccgtagtgattactaaatgacattcctcccagagcatgcaacacgggcagagctacagcctctgcttccttcttcgcataaaattgttgaagaaatagaccaggatggggaccctcgatttgaaataaaagagcctccagtggatcctgaaagtgctacatctgaaaatccggtgtgggaacagcgctggcagatgccttctctatactagtaaaaactggtgcattttggttggaggtttattccttgctttatttgggataaagtatcaatgtttttcttccacaatgccttccaccatctaaaaagaaaagtgtcctgagcctgagaaatatccagatcttttctccttacacacctaagacccttgcatgtttggggcaggtggcatcctttgcactttccatagtttcagcccccacatcccgtcttagccgtcacaacacactttgttttaacaagtgtttgggactttgcttcttatcattgagaataaactggctctcatttggcttccctcagccttttcatttattctcttggaagctgactgctgcctcataaaacagcatgaagctgttatgggctccttaatcatctgatgtgttggaatccttctgcagacccatggttccagtttcaggggagcccagttgcatcagacttgacctcacctgatctttcttttcccttaaaattctcctcagtgtttcctggaatgccactaactagctcggaagtgtgctaggtcattgccatacaatgcaaggatattggaatctcctccaagaatgtcctggactggccaggggccctggacacgctggggagagtgcatggcagcatgggttgggccgtctctggcattcagggctggtcttacaagaggcagcaccagcccaggcaccattcacttgccaaactcctgactccctgtattgtttgctgtattaggtaattctgacttttgattatttttcaatagaaagatgcagtgttgaacattattctaacttttttttttttttttttttttggagacggagtctcactctgttgcccaggccggagtgccgtggcgtgatcttggctcacggcaacctccacctcctgggttcaaatgattctcctggctcagcctcctgagtagctgggactacaggcacgcgccactacagctggctcatttttgtatttttagtagagacagggtttcgccatgttggccaggctggtctcgaactcctgacctcaggtgacccacccacctcagcctcccaaagcactgagattacaagcgtgagccaccacacccagcctattctaacttctataataaatatataggagctgaattatctcctaacttctgtgataaatttatagaagctgaattccctcccatgggttagtgaggaatcttttttttttttttaagattctttttgttcttggatttcaggaattttaatggtagcaacacctttgacccaacctccaactgcatccatctatcaggtactataaattccaatcccactcactagggctgctgatagtaaccaacaagtagatacagctgaaaccagatataaccttgtgtatttctctacatttacaaccccagtataactgccagttaaaacagccttttctctctatctggacataatctgggttattttcagttgctagacattacttcaaattactttgtcatttatttggcttaagaaataaacaagtcttgggcctccttgctcccacgttaatcaatcagaggagtgtacctcggggccttgcagccacactctgtattgaaagacaaagttagcagacttgacacactttctctcacccatcagagacactcaaatggacatcagccaaattctagcatgtggcaactctggaaaggaaaagagtgataagaatgatcttcaacaaggagactctcctgaaatgggattatttaaacccacagagccccaggggaattctggtagaaggattagcaatctgtgatgtggtgtggatcacaatgatactaggaaggaatgaagcgatgggacagaaagctcatgtgtcctatactggaagaagcatgtttgattatgactaataactctggaaagcaatgtgagctgagaatggctcgtgattgtgggaaaattatcccatatttcctgccaaggtcactgaggggttgggctagctgccatataatttagacttgcagaaggaactcttccagtgtgccacctgcccttaactactctaaatgtagttgattttttcctcctgtccacagccattgctggctttctcctgtctctccagcttttaactgatttccaagtttcctccccaagccaaatagaacatgctcctgaggccagtccttcctcagtgtaagcagaatcatttcaaggcccaagagaaaaacaaaagccattttcctctctctgccccctaaatccctcaccccagtatcatttgcatgtaaggagagggacgatactgttgaatttggaacaacaggctctccacaccgagagggacaagctccaagaacactggatccacaatctgttttcttagttccaactactaatgactctggcatacacaggagtgagtggaaaactttcagaagccacaatccaaacattttgggtaggagtaattgaggttccaattgttttgtagcaccagaggctggagattaatgggctttgtgacgtctgagctggaggaactggaaggtaggctgcgggaaagcacatttgcctgctgtttatagcatctgccctacctggaaaacaacagtctttgcttttcaaaagtgaaacttaaatgattcccctagggctttctactcggtctggacattcccaggaaaatcaaagtatgtaatttgtggatttgtgcagagggtttttttgatccatggccttgaagagcaccaactctttcaccgaatgtttgatttcactgttccttgccaccctcaattatgttctggatcacatatttctaatccctcaacagtttcattatgtaagcgtgcgtgtacttgtaatgcctctctctccgccgcccttcacttaccacttttgcacctatctccagactgagccctttgagggaagagatgcaagcacctttgtgtctccagggcttagaccagtgtctgctgctcagagaaggtgcctaataactgttgcaagaacaaacaggtgctgcgtgtcaccttgtactgttatctgagcattgcattggaattatttacttttgtgtccatctcccttgctagtctgtgagcagctggagggtagaatcccaggtctagtttactttcgcatctctcaaagcacagtgtttttcatgtaatatgtgctcagtataggtttatgaatctgttgaacaaatatcttacccagtttaagtctctcccgggcaaactcccacttgctggcatcataagggagccgctcacactgctcatccaaaggaacttcatctgggtccattataattgataggtagtcagtctttatttcagaagaagactgagaaataaagagatctcaaagtcatcgagaagaaaacaactttacaaatcctagatattccgttaacatccactgttttatttgggatcatttggttgaaactgtgtggccaggtgcagaaagtacttctccacattcacatacactcatcacacttaggtgtgcaatttctattaaacgactccttactattcccacactacatttctgtaatgtgagctctaccatcctatcttggataacatgcactcaaattctccagtgaccttatgtgttgtacttgatcttaaacaattatatgatggtcttgctaaaaaatgcaaagcatttttataaagtcattccaaacaatgactaaaaataacttcccatggccatcttgtataagcaggaatatatattacatatgggccaacagtggggcgcactgtggcttttctacatatataggaaaagcaagaagtggcaaagtaaacccaggatccctggggcactgaaaagcacatttcttatgaagtgtttaaactttcagaaggcctgacctcttagttgcttcagctatctggaaaggttgtagctgaatcctgagtgagactggaataaggtttaccttctgtaagaaatggaagttgaggctgtctatgtggtggcctgtaatcccagcactttaaaaggctgaggtgggtggatcacctgaggttaggagttcaagaccaggctggccaacatgatgaatccctgactctactaaaaatacaaaaattagctaggtgtggtggtacacacctgtagtcccagctacttgggaggctgaggcaggagagctgcttgaacccaggaggtggaggttgcagtgagccaagatggcaccactgcactccagcctgggcgacagagcgagactctgtcttaaaaaaaaaaaaaaaagattatttcaaaggccaaggagtaaatatggcataagacttatacacaagccacattctgacttcatttgtccattggtaggatgtcaagtgagtaaggcagacatctgccttgaagtgcttttttatcttggtaatgcaaatcaagcccagaaaatacccttcatttcagatcatagataagtggatttacatttaatgtcttagattcatatcagtgggtgtatttcctgttaatgggcaaatttctagaattgatgactgcatgtctgtgggcagactcttggataggatggaaaggaagcatgttttcccatataactcttggccagaagttatgtaaacttcatttaaatgagttttggggcccttccttttggtgcttttccctaaacgggatcagagttggaatggagaagacaacttctccatacacaccatttgacacccactcgcattcttcagcccttactcactctgttctgggctgtcacagctcacctcatccatcacttgaaatcattctccttctcacaaaaattatcactaaaatgtgtgacaaatagctcaaggcagaaaggtttgcttggcctccataaaggatgagaagcaaaaaacgatatggagcacgtttgtcacaaactgtggttgccattgggttagactatgagggcccggcctgccagacactctgtgaagagtatgaattcctataacagggtactaggtgcccattagagaaactgctgtagtagtaggttttatgactaaacttttcaatgtcctgtatacccgagccctgagaaacaatctccaatcctcacagagcataggatagctgaaacctcgcaagggacatcttgggctcatgcaggatgtgtggggaggctggcagtagtgttgacagaggcaggggaataggcggtggtaggcagtctcccacgtggcacctatggaattttatggtttgtctcaataaggcaggtgagaggagacaccaaacaaaccttaagtgagggctttgaggagactgtgatagtaaaatgttagttggcaaatatttattctttcaattgacattaacactgagcagctactaggtgcttggcatggagtctgcacagctaagtgcttcaaagcccaggcatgggggctgaatacctgggtttgaatcacaggtcaacttctgctcacccacacacataactgtggacaaactgccctctaaccttagttttcttatctgtaataatggtacttatctcatagggttgttgtgaatatcaaatgaaataatccatggaaagctattaagagcagagtctggtatgtagtaagcctccataaatgttggctataattataacaataaatgttagctatagttatgcagggtgaggataaaatataaaatgccatctttatcaatgaggaatttacattgtcgttagaggaaccacatggaaatattttgggatgtcttgttcctctttgcctcccccaatccctttcaaattttacaggcattctgtttttgagataatgatctcttgctctcattctttcttattaacatcaaaatttcacagaattttagaaatagaaggcacctcttcaatctagtcccaatgtacctttccagttttatttttgttattttttatattttttagatggagtctcactcttgtcgcctaggctggagtgcagcgatatgatctcagctcactgcaacctctgcctcccgggttcatgcgattctcctgcttcagcttcccgagtagctaggatcataggcgcctgccaccatgcccagctaatttttgtattcttagtagagacagggtttcaccatgttggccaggctggtctcaaactcctgacttcaaatgatctgcccgcctcggcctcccaaagttctgggattacaggcatgagccaccgtgcccggcccctttccagttttatttctactgtgctcctctatgctaagtaaccagactacttccccgctctggggagtaggaaggactagggcgggctgtttttctgcttctttccttccagctacagccttcaaagtctgtctcaagccttgctttctcggaagttttttctccccttctcctcctttgaactcctatagcctttgtacctcccttgcagatttggcaagttttgcttctgttagatgtatttccctatatggtgtatctcccctttcaaaactattgtgtgacctttgtttccttctcaagcagtggacttagttgtcatgtctcaaaatcagtcactccaaatggcaaaagcctgatgttaaacatttaccatagaggatggctgctggccttgtctctcataccagcactataaagtatatcttattggttgttaatatcaaatctaaggtcaaatagcctgggttcaaaactaaggtccaaccatagtgactttggatcagttaactttgtcttgctgagcctcagttgccctctctataaaatgggaataataatatatttaccttttcatatttttggaataatttattgacatactacataaagagcttcccataagacctggcatattaataagggctaatctctagaaattgagaaggccttctgatacttctcaagtcctactgattttacttcccaaatatccttgactctaatcatttagccagaggtaccataatttctttctttctttctctctctctctctctctctctttctttctttctttttctttcttttttgagacagagtctcactgtgtcacccaggctagaatgcagtggcatgatctcaactcactgcaacttctgcctcccgggttcaagtgattctcctgcttcagcctccctagtagctagctgaaactacaggcaagtgccatcacacccggcttatttttgtatttttagtagagacggggtttcaccatgttggccaggctggtcttgaactcctgacctcaggtgatccacccacctcagcctcccaaagtgttgggattacaggcgtgagccactgcgcccggctgccattataatttctttcttttcttttttttttttgagacggagtttcactcttgttgcccagacaggagtgcaatggggtgatctcggctcactgcaacctccgcccccgggtccaaaccattctcctgcctcagtctccccagtagctgagattacaggcgcctgccaccatgcccagctaattttttgtatttttagtagagacgggttttcaccatgttggctaggctggtcttgaacttctgacctcaggtgatccatccaccctgagtgccaggcgtcccaaagtgctcagattacaggtgtgggccaccacgcgcggcctgccaccaaaatttctcttcttttctttttttctttctttttttttttttctgagacagagtctcgctttgtagcccaggctggagtgcagtggtgtgatcttggcttactgcaagctccacctcccaggttcatgccattctcctgcctcagcctcccgagtagctgggactacaggcgccctccaccacgcccggctaattttttgtatttttagtagagacggggtttcatcctgttagccacgatggtctcgatctcctgatctcatgatccacctgcctcagcctcccaaagtgctgggattacaggcgtgagccaccgcgcccggcagccaccataatttcttacctggactaccaagaagtcttctaccaggtgcctctctattcactcttgccccccaccacccgggtccattcttctcacagtagccaaaataatttttccagacatatatctgtcacactaggtgccccactccccccattcctgccttagtctaacatagctttcttccccaaggcttcccattgcttttagaatacggaccaaattcctcaccatggcctacgagaccctgcctggccaggccttgccgctttcccttcccatttcttggcagcctcacctcataccttgttcctcctgttctccacgctgtagccctggccttctgtcagtctctcactgtgttccccctcccctgcccagcctcctaaatgctcttgcctctgcctacaacactccttcctctcttcttaaccttgacactcctcctacacatcttttaggcagctactctttcagctaactcagagttgcagtttgacatttgtgtggctgattaaagccaatctcccctgactgctccctccagcatctgccccactgtcaccagagggtcttgcacagggcctggcatgctgcactgagtgggtatgcagtaaatatttgaagcatgaatgaatgaatgaataaatgtaagctcttttcccactggatttcagagaagcagatcatattacagacctaagtatagaaatctgatgtcctgaatgccaacctggacctcacactctaaagaacttaattttgtggtgtgactcagaaagtatagaaaaagagtccacttatttttacttccaatatgttatgagagaagtcaaaggtggggcctttactttttttttttttttttttttttttttttttgagacagggtctcactctgtcgctcaggctgaagtgcagtggcatatgactcacttctcacttgacctcccaggctaaagtgattttcccacctcagcctcccgagtagctgggactacaggtgtgcaccaccatacctgcctaagttttaaaattttttgtagagtcagggtcttactatatcggacaggctggtcttgaactcttggcctcaagcgatcctcctgccttggtctcccaaagtgctgggattacagtcatgtaccaccgtgcccagtctcctttttatttcttagcagagagtgagcgttaggaaataaaggtttcacaggtcccacactgactttaaagactctattaacatattttgtatcaaaaataccttctgtccctgagaagtattcatcagttcattgttacggcttttcttttgaacacccccccttgtggctagagacattttgatgatttattttctttctgtgttcaccaggtcagagataggaatgagagggaagggaaagaaagagggtccaacatttgtttgcctactctagacatcagatcgggctttttagaatatatgtaaaaaggagcatagaacatcacctatgttcttacccttttcatttttcggataaagagggttaataggagccagaagagagtcgcagccacacaggtgcatgttagagtgatcagctccagattagacttgtccgaggttcctggagagaaaaaaaatcacaatagtggtgcaacaaagaaattcccaaactcagaatctttgtggttttataaaagaggctcagtttccctaaatggtttatcatagcgaacccaatctgctgccacaaaatcagtctctgggacagatctcttaccttctaagccaggcagtatacatgaactcacatagaaaaggcagtatacatgaactcacataatgaactcacatagaaaaggctttccagaaattttgctgtcaagtttgcaaactttgtaattccagaaacagctaagtaaaaatcagaggagaaattaaaaatgggaaaaaattaaggcaggaacaaaagcccattaaaatgctaaatctggaatatgttaaatctccctaatgagttttagaggaaattctaaaaaaaaaaaaaaaagacaaaataatgacataaaagggctactttgggactcacaaaattcttcaaagtagaatttaagaataaaaataaatccaggactgtcacagttgcctgtttgctccctttggaactgccagcccaaagcgcccacatcccactccctttgtctagggctctgtttctggcttcatcagccagattggggggcctgagatagaagaggcaattgctggacctgaatccttcccagtcaccttctctatcagaatcacagagatcaaaagctgagcactgttcctccaagaccaaaaggaaaagacttaaagtattcaagccatgcctccagagagggaactctggaatttgtaaagaaatgcctccatgggccagaacagtattgattcttgtgagcaatttcccaggaattctaaagtaatgcctttatcctttaacttaactacaatgagacagaagtggctgggcatggtggctcgcatctgtaatcctagcagtttgggaggctaaggagggaagattgctggagccccggagtttgagaccagcctgggcaacatagcaagatgccttctcttaaaaaaaaaaaaaatgtggtagcacacacttgtaatcccagctactctggaggctgaggcaggaggatcacttgagcccaggcgttccatgctgtagtgagctatgattgtgccactgaactcccgcttgggcaacagagcaagacctggtctcaaaagagagagggagagaaagagagagagacagacagatagatgtttatattaaggtgggcaaaggacaagtgaaattttctttttagaaataatgatgtggatgaggatctaatttgctgagcacttattatattctaagcatgcaaactatgaagtcaggggcagtaatactccagtttcatacatgagcacttcatcttgggggctctctgtttcaatgcaacaaagatgtattgagttgtactagaggcaaggttaggggccggaggagatagaaagattaatgagggacagttgccactctcaaggaccccattcaaacctaaccaagagacttaaggcaaatacaaagaaattagattttgaaagattcggctgctgagggaatctaatatatactactatctaatagtaatctaataatacttttttgaagaggtggcatttgacatgaattttaatctgcagagatgaaggcaggggagggcattataggcagaggaaacagtatgagtaaagacccagacctggccaagtgcgatggcacacgcctgtaatcctagcgctttgggaggccgagacgggcagatcacctgaggtcaggagttcaaaaccagcctggccaacatggtaaaaccctgtctctactaaaaatacaaaaaaaaaattagctgggtgtggtgggggggcacccagctcctcggtagtctgaagcaggagaatagcttgaacccaggaggcggaggttgcagtgagctgagatcgcaccactgcactccatcctgggtgacagagtgagactccatctcaaaaccaaaacaagacacaagacccagacctgggaaaagatagggcagtataatacaagatacaagacaggaccagaccatagaggattctgagcatctgtgtgatgggtttgatctaaaggctgcaggcagttggagccaaggtttcctgcccaaatcatagcaaatgcacaagctggaaacctgagataacaataactcattggcccttattgagtgctttctattctagggacttttctaaggaccaacatgtattcattcaccaaagactcacaaaaatactacaagctagattattcccattttatgaataaggaaattgagacacagagagattaagcctcttgcccaaagtcacacagcctgcaagtggtggagctgtgattttaacccagataatctgactgcacatgcttaaccacgaagcttccaagagtatgccacttcctcctctctgatccttccagcctttacaagcgcagattaatcacttcctattggccatagtccccgccacaaagttatcttttagtctggagtggaaactgatattttctctccatccaacccatcacaaagtcctgcccattctacttccttggatcattaaattatcagctctcctacccagctgtgactgcctaaaataaggccttatcagttctcaccaggactacctcattggccatggctccctccagtctgtcctccacctctgcagccagagtgatcttgccaaatcaccaatttaaaatcctattactcttctgtctaaattccgtcatctgttccctgtcaccatcaggataaaagtccaaatccttaaatcctttatgcccaaccttgcctctcttttcagcttcatctcctgctgtcctcccacttgcttcagtcacgccacagttcttatagtttcttaaatacaccaacccttcagaacatccatgctttggcttttgctatttctctgccaaaatgtgtgcttcctgatgactgagtccataacttattcaccctactcatcagcttgggcgaatgaatgtatatatatgttttgctttacctacctctaaagagtttcatgagggttttaaagagtttaggggccgggcgcggtggctcatgcctgtaatcccagcactttgggagcccgaggtaggcggatcatgaggtcaagagatcgagaccatcccggctaataccgtgaaaccccgtctctactaaaaatacaaaaaattagctgggcatggtggcaggcgcctgtagtcccagctactcaggaggctgaggcaggggaattgcttgaacgcgggaggcggaggttgcagtgagccgagatggtgccactgcgccactgcactccagcctgagctacagagcgagactccgtctcaaaaaaaaaaaaaaagagtttagggtcacgtctctgttcctgtgtattacttcataaaacatatagaccaccacctctgttgcagatatgttctaggtgctggtatacagttagaagagaaagggcatggttggagctcacagtctggtattcaactatgaactgatgagtgtgttataagttctgagtgaagcagcagaacgtagggctatggtcctcttcttcactgctacatttccagggttcagaatagtgcctggcatatagtagacatcctgaaaatagtggtcaaatgaatgaattggcttatttgctgctttgtcagctggtcttaagtttccctgaacctcatggggttgattgaaaataacttccttaaagaaatttctaagtgtgataaccttttctctcactacacatcctcacaatgggaagattgtaagctcaagttcatatgagtttggtttctttctccacagtgacagtgaggtttaatgcggccttgctgtacacacacacacacacacacacacacacacacacatgcgcacacgcacacacacacacacgcacacattcttgcttatgctgcaaataaattttgtggaatttgattgggattgggatcctctcaggacacagtggcctttggctgtcggagatgctgatagcatcttgagacattgcactgtctgcataaaacctctgcagatgcttcccgcatggaatgcactaagagaggcccccttgattgtgggaactttcctgctgcattctatgggacaggaagctgacccccaaagtctaattccacagtccttactcaagcaaaattcatttcagtggaccaaatgtgtttgtgtgcaaatacttacacatttaaggaatcagcccattaaaaaaatcttcaagatgaccatttatcgggaaggaaagatctatttaatattaataatgttcagtactgcttattgaaaaatattagaattttacagtatgtgctgtagtatcattgctctattgcatttgatggcttagtctctatctctgtttgaaaagcgactgttaggacagtcttatgctgggtgactgactgaagtgaacccttaggtgttttctcagcagtcaaacacactggcctgactaaacccagcttcaatttgctggtgacagctgatgagctaagtgcatgagataacccagcagcacacaggagtggaaagaggccagggaaatgtgggtgggatttgacagtaactaggagttagcactgggtctcagggacatggctcccgcatgatgtgcgtgaaaggccagcatcaggacacggtacaaggttatttttatttgggatactgacaagaatatagccaatttgaagagtgtatgttaactgtatctatgacagactgttgacctggttgcacagagcattccacgtcaagtactctcccaggctttataccatcccttttggaatagggaggggagatgccacaccagggatggtctgagttctgaaggggtgtgtatcttgcctgacgtctctgcagctgcgcagtgtcctgagctttcctgatagcaatagtagctctctgtacacacagcctgggctgcatggtctggcggcatcacaccagccctgatgtatggcactgtgtggcatcagactgcatgaatgggtaggcagcagagccagccaactcagctcatgcaatataaccagacagagtttcccaaggagttaaggaaacaccccaagcaaaagaccagagcaccttgtcccagggcctgccttgacttagggaccgaacacaggtttcatcgggaaagggcaggtactctgtgccccagtttcctcatccttacaaagtggagataacagccccttcctcacacgtgaattgtgttaacttagtgttagctattattttgaagcctgcttgcctgccttccttccttccctcctccctttcttccttccttctttccttccttccctccttccttccttctttcctttctctctctctccctctctccctccctctcccaccgtctctctgtttctccatctacaccccttactccaacccttttcttttttttttccttatcactttttggacctcaagtgcagagtaattttttttcattgaaacacattgcatgtattatttaatacaatttgccttttctttctgaaacaaatcagatttggacctaagtactcatcaatttctgcaaacaactggtccactacctccctgagaaatttgcctgatcctaaggttggtttaggtgttattctctggttctattgttattataatttgagtaactacttatgtgggtttattgcccattaacctgttaggacctcaagagaaggacatgtttcttgttcgctttgagtctccagcattgactcagaggaagtctcaataaagatttaggtatgaacgagaagaaaattactcagatgcactttgacctgactctcaagatccccgagcaacataagccactcaaccagtgccatctccttctatgtaaaacccagtcagcataatccaggtaaccttacttactatatggtttctctagagcctattgaaatgttaaaataggcctgcagacctttattactgtcgatgaagttttttaggaatctatgtacaccaatttggaaccactcctaaggacagtgatgtatggaaatgctgtattcccattatattttaagtacattttcaagagtactgttaagtaaggatatttaaattgctgttacgtgacgttagttctggaacacatttcttttttcacaagttaaatccttaagtcaaacaggaattctgtggcttagaacaccttttaggtgacccactggttaagtccaggaaaagtataatacagaaacttttgttgaaatggaatttggtatatcttattaacaaacggtaatgttagctaacacttacaaaatttttattatatgccagatgctgttttaaatgtgttaatccttacaacaagcctacaaagattggtataccatcattagcatgcccattttacaatgagagactggaagcaccaggaaggtaaggaacttggcaaaagttatgcagcccatgaagagtgaggcatctggcttcagaatgggtctttttaaccaccgtgctgtgctaccttagagttgaggtatagagcataaaacctatagagcaacagagcaggatggttgaacatggctacaattctcagctctgccatttccaagctgtgtaaccctggacaagtcacttaacctttttgagcctagattctcccttttaactaactgtacttccttgtacctgtaggattattgcaaaacttgagtaggattacggatgttatgtgcttaaaatagtgcactgcatgttctataagcgcaagatattaattacatggtcccaggccctcgcagagcccagcaccaagttccctaggcctaacacccacttctatgatacccaatgcagttttatgccagcctagtttctacggaaggaattaagatgaatatcttttgagtttgaattattttgcctcaagaactctctacaaacacctcaaatcagcctaactgaattccatcaccattttttaaaattcttcttgatcaaggccagctttatgtcactggttagatttgaagtataggcatgtgtatccctgtccctcagccctcctattgacattagtgcacaactggttcatctctgttttgagcactgctctctcctcgggaaacctttctaaatagccaacacccatgagaggtgtaacatcaatccccaacatattcatgcgaattagtttatcacatcctttctcagtgccaggatagtcataggagtgaatttgggggcaggattcaggaagagaggagctaacgtggagggaggtcagtcagggatcagaggagggtcaaaatggagaactgaaaactgatagctggccaagggcaatagaaagcagtgactgaagacccatggccatattgttttcagttttttctgttattgacttctgggatttaatttattagggaacatagtgtctactttctactggatgagtcctttctcaaacaagtgacaacgtgcaatcgtttgcaaatcagcctctaatgccatgaccagcatttaggctgcaggaccctcatgtagtccttttgtgcctttgggatttttgtatctgtcaatcatcttcgaaaaatgtttagaatgatagttattcttcttcaagttgtcttctcctatgtacttataaataatactgaaatatagtaaggcctaaatctgatataagagtatcagatttggctgggcgcggtggctcatgcctgtaatcccagcactttgggaggccgaggcgggtggattacctgaggtcaggagttcgagaccagcctggccaacgtggtgagaccccgtctctactaaaaatacaaaaattagccaggcgtggtggcacacgcctgtaatcccagctactcgggaggctgaggcagaagaattgcttgagctcaggaggcagagcttgtaatgagccaagatcatgccactgcactctagcctggctgacagaccaagactgtgtctcaaaaaaaaaaaaaaaaagaatgtttttatatatattgtggttatttgcattaataattataaagcatagcttaagtccttggatgaaattgtaacagccccattgagttccagggctactgagcgctatgttaatttcagaaatgattttagttactaacacttctgttgtcggttttgatatggaatttcccctttgagagcttcatgtgccctcgtgctggcactaggtccaaaccaaacaagacctgtgattatttaaagaaggtactttgactccacagttcattcatcctttacggatacaaaaataacacattgttttatctgtgagtataagaatcctttttcaaaggaaataaaaagagcagacagtttccttcctggctaattcaccaacctctttaaatctgttaaacatagccacagacacaacttgttcacttggtttcatttcctaaactcaatttgacaagataggtcagtgtgagggtccatatgcatctaacaggaaataaagtctaaatctagggaatgtttcatagctaccagggtggtaagaacaatgactctagaagaagagtcccatttcaattataaaattaatgagcaggtaccgtattcagctgttgtgaacagcatcctaggatcaaattttaatccagtgaatccaaactccttccattcaagatactgcatctgactcacacatgcaggcctttctaaggtccacatactattaacattcaaaatttcttcctgtgcaaagttatattcttatatagacttgaaacctgcctcttggaaatttcactaccatctcccttccttggttctagttatcttttctggtgtgtcaaagaatgagttaaatgcctcttctgtcagaaagctcctaaactatttcaagaaaacaatcttgttacccccatgttgtctcttttttggactaagtatcctcattttctggcactattctattcctatccaggatatagcgctacttatttgtttcttttataaatgggcacaatatttcaggtgtggctggatgattgccaatcatgtaatctatattttcagctaactactttttttaagcaaaaaaggttggatatagccatcacttttataaaagagagcaaaggagaaggccaaaaaactacaaaaagcagacacaagagttcaaaaagcatggcagttgggggcaataatgaacaaaataatggaatatataaatatatattccattatatatgccatatattatatatatgtggcaacccatatgggcaattcaagtgaaaataacctccacttttcacaagagtaaatgatatggctaacagaaaggtttagaaattatcagtaatgcagtattcttaacatctgacttttcagaaaagcataacattaatgggaaaaggaatcagcataggaagtctagaggcatgtaaacatgagagaaatggagaaaataaaaataacaggatcactgaaagagtgcttttgctcaattttatcctaagtccttgcagacaacttcctaaggcacctcaggaatgagaagagcagaggaagggcggaaatattctgaggtatacgtggactcaagtctcagcctcaccacatagtcattgtgcgactttgggcaagttgtttaacttgagtttccatcttcccatctgtagattgaagatactactattgacttctttagattcttacaaggttaataggattaagtatgtcacaagtccagcacagcgcctgcacataaaggtcctaaataaatatttcgtgctaagtgctgggcatgtgtacaggatacaaagatatgtcagacagtactgtctcaaagtttataattcggtagggaagagaagcatatcaacgccaaaataataataaaaggcagaataaaataagtactgactaatgattccagaagcggggattgagagagcagagaatgagtatctgcctcagctgttcatcccggagtacattccagggcagaaagcatttcagctggcctgagaggataagaaggatttggctggaatagggaatggagcctactccaggatgcactaacatcacaaacagaggccacgcttggcgttatgtggcaagtccggctcactaatggccaaacgactgactctaatccaatctggaaggccccacggtgctgctgatctggcctggagcagtgaaagaataacagcaggcctcctgcagagcagactgctggcgaacagaagggtggtcgttctgaaggtggggagaagaaactcacagatgtcgtaaatgcacagttttaagcacactggcttctgagaaacccacatcaacctggcagaaaaaggaaggaagtcaagactttggggagacctacaaacacgcaaaaacgtcactgcttcatacccaggctcctcccaggccataagagtccagccattgctgccccatattccctggtggaggggtggggacaggggaatgcagtcatggggtgaggggaggggagtctgagaaaagttcagttttctcctctggtctgccatgactagactgtgtgagttgggtgagtcagttcagacctctctggaggtttatcactgctctgtgtttctcatggggttgttgggaggatatgggggaaatgacgtttgctctgaggattagtgaggtctccttgctctctgtgttccctggcccggcacggccattcctgagggctatatgtctggggtgcctgttaaaagacagattagcagctatctggggaagaaggtgttaaacagagatgctaataaattgtttctgtatgagcgagcagaaaagtgaacataatattttagaacaaggattatttgggagacaaaaccattactaaaggtatttggggaatgctaccctctcactttttctgaaagtataaatttgtggtagagtagtttcagactttcagggggctctttaaaatcatctccttgtgaaagaataaagatgatgttctgttttaaaggggtttgaattctcagagttaaaatatttaagcaatgtaagtttcagggggaaaaaaactgaagtacgttgccttcttcctagttcctccccgcaaaatacttgcatattctgaagtcgactggttagcatttggaaataggctactgaacaaataccatcttttcacgtaaaacctcaatatgccatagatatttacatctaagaggtgccaatctgatattttatgatgttgtaaattttatgttttggatgattcttagcattagagaattgaaactgaggtcgaaactgttttccaaatgtaagccacatggccatagccagggtaggattaggcctctttgtattttgctgctgagcaaactgtctgagacctataaagaggaagcacttggaatatttttcttaaatgtcatctgttgattacatgttgcttctttctgataatatattacagcccacttcattttaaaagccagcttataaaagcatttggaatagcagcatatgtctaactcctgggaattagaaaaggaaaacaaatgaacaattttaagtgtgcgagttccccctcctcacctacccccctcccttttcttccattttggacatctctctcacaggtgtggactactctggccactctctgtggcagggcgtaataacacagtcagaactgggtttcctttcttctgggaacgacttctcccgcagacactgtgttcggattttgggctctcgaggatggccagccagtgtcttcaccttctgctttgccagacagaaccagacagtcccttcccggagtggcagggagaggggagaaggaggtcagggaaaggaacagactggagcaggcagcaggagactgggaggtggaaagttaaacaaacagggaaatagatgtctgaccaatttcttgttgctttcttaagcagctgtttaccttgaacagtgaggtatgctgaactttccacagagcccttctggttggtggctttgcagtgatagacaccttcatcctcttctgtgactctttcaataaacagcgtgctgcttcctggtcctaaaataattcctgaggggtgagagatgtttagattagtgggcctggatgacaaacaaaaaacagctacttctgtaacacagccttcttcctatcattatgcattcagacaaggaaatccgagctctagtgaacctggggcagggttgcttatttgttttctctgggtccaggctttctttttcttttctttcctttttttttttttttttttttctgcaggctttctaatagcaccttcaccacccagcagagctgtgatccccagcttcggagatgcaaatccacccaccctgtagaaagaaatgtgaggcagctgccatgcccaacttgaaagttgaagatatcaagaaggcagcatatctaataataacaactatcattgactcaacgccctctgtgtgctcggcactatgtgacacactttcataccttgacatttacaaccagcctgtcagctaatattgtcttccttttacaaatgaggaaactgagattctgtgagattaagtaacttcaccaagagcatgcagtttgactgaaagcacatttgtgacatatgggtcaaaggaactaatatttcatttgtcataaggcctggtgagtcaatatagcctagtgatgaagagtttgcctgggctgtgttttaatccatgccttagcgcttcaagctttgtcacttaggcaagttacttgatctttctaagtttcagtttccttaatcttaagataaaaatgaaagtaattcttactctatagtaaatggcaagcccatggtacatagtaagtgctcagtaaatgtaagcttaaggattactacagagcacagtgtagtggaaggagtcccaagaattttcagacccctgaaaggcttcaagaccttgaagcttcaataccttgtactatcaccaagggtctgttgagtatttactctgccatcagttcgtgttacaaaacaaacagcaggctaagatgtgggcaggctaagacatggtatctgttgagaaggaaaaattaattcctaccaaacacacacatttacattctctctctcccacacatgctcaacacatacactcacacacacaagccaacaaatagaaaatgtttaatgaatgagaatgagtgaatacagcacagtatacctaattaagtggaaggtctggcacagggaaggagatcagtaaggaagggtgtacttggggaaggctgcatagaagaggtgggcctcgagttgaggtctgaaggattgtcagaggtgaaatgagaaacggaagcatgagaaatggcatgatgtggaaataaacaggaattgagtacttgttccagaatagtgataaaacaggcctggccagactataggctgtatttcattagtttaaatagtttgtatttctcttatgaaagatgtactcaatatagaaaagttgagaaatatttgaaagcttaaaaaaagaaaatgtaatattataaagctatgataatcaaaacagcatggtactgttataaaaacagatccatcaaccaatggaataggcaagggcccagaaatcaacccaaacatctatggtcaactgatttttgacaaggtgccaagaacacacaatggggaaaggacagtctccttaataagtggtgttgggaaaactggatatctacatacagaaaaatgaaaatggacccttctctcatcccttatataaaaatgaactcaatatggattaaaaacttaaatgtaagaccagaaactataaaactactagaagaaaatgtgggggaaaaactccacgatattggtctgggaagagatttcttggatatgaccccaaaagcacaggcaacgaaagcaaaaataggcaaatgggattgcatcaaactaaaaaccttttgcacagcaaaggaaacaattaatagagtgaagagacaacctacagattgggaaaaagtatttgcaaatcatacatcagataaggagccaatatccaaaatatacaaggaactcaaactactcaataacaaggaaaccaataatcctatttaaaaatgggcaaagaaatcaaatagacatttttcaaaagaagacagatggccaacagttatatgaaaaaaatactcaccatctccaatcacaaaaatgtaaatcaaaaccaaatgaggccaggtgcagtggctcatgcctgtaatcccagcactttgggaggccgaggtgggcagatcatctgaggtcaagagttcaagaccagcctcgccaacatgatgaaacccagtctctactaaaaatacaaaaattagcggggtgtggtggcgaatgcctgtaatcctaactacttgggaggctgcagcaggagaatcacttgaactggggaggcagaggttgcagtgagcgagatcgtgccactgcactccggcctgggtgacagagcgagactttgtctcaaaaaacaagaaaaaaaccaaatgagatagcacctcacacctattagattagctattattaaaaagataaaagatcacaagtgttgatgaggatgtggaaagaagggaacccttatacacggttggtggcattataaattgttacggccattttggaaaaccatatggagcctctcaaacaactaaaaagaaaactgctatatgatctagcaatcccactactgggtatctacccaaagaaattgaaatcaaggatgctgaagagatgtctgcattcccatgtttattgcagcattattcacaatagccaagatatggaggcaacctatgtgtccatcaatggatgaatagatttttaaaatttggtgtatatatacaatggaatactacagccttaaaaaataacaggaaattctgtcatttatgacaatatggatgaacctagaggacattatgttgagcgaaataagccaggcactgagagacaaatgctgcatgatttcacttatatgtggaatctaaaaaagttgaactcatagatgtagagagtagagtgatggttaccacaggctggggtggggagagttggatacggacagggaagatattggtcactgggtacaaagttacagttagataagaggaatatgttctggcattctattacacagcaaagtgacaacagctaaaaataatgcacatttcaaaatagctaaaagaggattttaagtgttcccaccacaaagaaatgatatttgagctgatgggtatgctaatcaggcttatttgatccttcccattgtatacatgtattaatattaaaacatcacactgtaccccatgcatatatataattattattatttgccaattaaagaaatggaaaaggccgggcacggtggctcatgcctgtaatcccagcacttgtgggaggccgaggtgggtggatcatgaggtctaggaattcgagaccagcctatccaatatggtgacaccccgtctctactaaaaatacaaaaattagccgggcgtggtggctcatgccggtagtcccagctactcgggaggctgaggcagaagaattgcttgaagccgggaggcagagcttggagtgagccaagatggtgcccctgcactccagcctgggtgacagagcaagactccatctcaaaaaacaaaaaaaaaagaaatgtaaaaaacacacaaactccaaacacctacaatctcacctcccagatgttgtttctttagtctttctaaagtgtactttctgaaaacacagtttgttcatttatataacaaatattttttgagctcctactacgtactagacactattctagatactggtgatacactatcaagcagaagaaatccttgcctacaaattctagttttggagaattacaaagtgagtatcaacagattaaggtattagagaaaccagaggagacaacaatgaattaagtatgaacaaaagatctgagggatggagacaaattataagggtaataacttgcttatttttgtaagaaaggaaataaatagcaagagtggaggatgagcagtatcgtctaaaaaattaaaaacacaaaactttgctgatttgatagatgaaaatgattgttttaatttgtatttctttgaacattttttcatgtgtgtattagccatttttatttcaaaagacctgttttgagtaggtgactggaaaaggtgaattcagattaaggagagctttgaaatcttggttgaggagtttcaattccatgtagaaggaaagagaatcacaaagatttttgagcatagtgaaagcgacatttaaggacgttcagtctagaaggagaatacagctggactggaatgaggaaagcatagcatctgcaagtcctgctcatcagttgtaattcaggcaaggaatgatgaggtctcaaatctggatggtgggaaaggaagtagagaggaagaaatggaaacagatactttgtagaaacaacctataggaattggtgctttactggatacagcaatagaaaaagagagagatgagtccaaggtgattccaatattttaaacccagataacagggaaaaaatgacagctcttccccataaccttggctaagtcacttaatctttttggggcaagttccttacctgtaaaatgagaataatacctgctccacctatttcatgatcaattgagatagcttaaatggaagcattgaagctttgagaagtataagatatagtacaagtggcaatcacagaaaataaaagtgtggctgtacagttgctccgggtcaatgaacatttataagagcagctatcttgctacctacaatcattacaataatctccattgcagcagatctgaaactcagccaattttctatcactcaaatcccaactcaaggatagcatcatgggctgggcacagtggctcatgcctataatcccagcacttttggaggccgaggtgggcagatcgcttgagcctaggagttcgagaccagcctgggcaacataatgagactccatctccactaaaacttggaaaaaacaacaacaacaaaaaacaggctggcaccatgagtaaataaagttaaaggacttggatttcactcaaggagagtgtgtaattatgaaaggtgagagatggtagccaggatgctcatgagctaacatcatctggcacagattcctctttctagcccaaggaggagaggagatggggtgagaaggtgtccaaattcaacaggcaaagctcttctttctgatatgccctctattgtactataacaaatgacacagagacattgatgcttccccatcagataggccactcagacgctcagaactgtcatcaggcccttgctcatcctccactcttgcatttatttcccttcttacgaaaataagcatgttattacccctataatttgtctccattcttcagatcttttgttcatacttaattcattgttgtctccccaggtttctctaataccttaatctgttgatactcactttatatgacccaaatcgtaggatacaggctctgttctgctgaggaaaatacatttttaaagtggttctatttttagtttaattttaatttttttgactgtgagcactttcaaaaatgttaaagtgcagaaaaagtataactcatgtatctaccattaagatgatcagaggtcaacatcttgccatatttgctttaggcagacccatttctgtctttaatatgaaatgagatttatagatactttatcccttcctttaccctctctctccagaggtacctgaaattgtactttttctacatagtacatgtttttgtactttttccacatgcatgtttttgtactttttctacataggtatatatctgtacagaatacagaatattattttgtgtgcttaaaaattctaaataacaggtattatagattatatatccttttcaacttgattgttttcccattcagcaatgcttttatatttatcctttttttttttgagacggagtgttgctgtcgcccaggctggagtgcagtggtgcaatctcggttcactgcaacctttgcctcctgggttcaagtgattctcctctctcagcctcccaagtagctgggattataggcgcccaccactgcatctggctaatttttgtatttttgtagagacagggtttcaccatgttggctggtcttgaactcctgacctcaagcgatctgctggccttggtctcccaaagtgctgggattacaggggtgaaccactgctcccagctcatgctttttaattgatggcaaaatgattgatgtgaaatggtatcttgctgtggttttaatctacatttccctgattactagctaggtgaaatatttttattggccattcaggtttctctttgtgtgaactgcctgtttctatcctttgcccatttttctgttgtcctatttgtctttttgtcaacgattttagggttctttatatgtttgggatgctaattctttgttggcttaatacgtttcaagtcttccttcattgtatgaacagtcttttaaatttcacttatggtaaatttttattttatttatttacttatttattgagatgaggtctctttctattgcccaggctggactgcagtggcaagatcatagctcactgcagccttgaactcttgggctcaagtgatcctccagcctcagcctcctgagtagttgggattataggcgtaagccacagtccctgccatggtgaatttttaatacaaagctttaaattttttaacataatcaaatttgtcagtattttttattaactttttgtgctttttgttatttaagaactcttttcctaccctgatatcataaagaaagtatactttcttcataaaatctgtttaagagattcatttactattttgtgttttcttatttaggtttttaattgacctagattttcttttggggaggggtatgtgtatggtgtgaagtaaggacctaatttttaccatataaatagccaatgatcccagcatcatttattgaataagatcttcttttaccactaagtcgttgtgccagctctgttcagatactatctgaattttttatgttgaagctcccatgtatttgtgtatttgtggttctgtttctaggctctttatttattcacagtgacctatttatctatccctgtaccacataagttaaattatgattgcttgataacacatcttgatatctggtatggcctcaccagatagttttcaaaatggtcttgactattcttggccctttatacttcaatactttatacttcagattttgcttgtcaaattctgtaaaaagcacaattggaatgtttattggaattccactgagttcatattatattataatttgggggaaatggtcatatttatttttaggtggaaccatatggaattgccaatactttgacgtacaaaaatggcaatatggttctaccaataagtgtttttatagaagaatattgagtatctttgagttatttaggttttcttttatgtcatttaatagttttatgattttctctttaaatatcatgcttttctttagttatatttattcctagatagattttaattttgttgttatgcaaaatagtattgaggtctttgagaggtcactgtatttgaattttctctttcctttttgggtattagtctttagaactaacatgtagaactccctttttttttttgaggcggagtcttgctctgtcgcccaggctagagtgaagtggtgcaatctcggctcactgcaacctctgctcccggactcaagggattctcctgcctcagcctccctagtagctgggattacaggtgtgcaccaccaagcctggctaatttttgtatttttagtagagatggggttccaccatgttggccaggctggtctcgaactcctgacctcaagtgattcgccaaccttggcctcccaaaatgctgggattacaggcgtgagccaccgtgctcagccagaactcacttataaacatgatactctgctttgtgtttctgagatagtttaattgtaggcctgcttgcttgcttctaaaggatagcctaagtcattaccatgtgcttgtttgtgtatttccttggcttctgacactaaatacagattctttaaccactgaagccataacaattcccatggaaattcattatttatttctctttactctaagaagctgtatcagatggaccaacagggcatagagtagcatttgcaaacatagatgtcttcaggagccaggcacgtaatataaatgagttggggataaaataatggaagggggactatgtctctggagaatagaaagcctgtctcccacctaaaagcagaagcctttgcttagctccaacctattgagaatttggggatttgagtctggtgttgtcttctgagttttagaaagaaggcagaaatttgaattttttttttaatgttaaagctcatgattcttaaatgttggcaaccagatcaacttatatagatctactgtgaaggccaataaaaacatggatgcaagatatatttgatgtaacttagagtatgtacatggggataagcttttatgttgttactaagcaaggaccttcatgatctggccccttcctatcttcccagctttgctgcctgctgcatccctacatgtgtctttggtatgagccatgctaatctatttgcagtttgttctaagcctcagtgactctgcacacgtggttcccttgatgcctggttaacatttgcttgttctttaatattcagctcaggattagctactctggaaagcatttttttttttttcgagatggagttttgctcttgttatccaggctggagtgaaatggcacgatctcggctcactgcaacctccgcctcctgggttcaagagattctcttgcctcagcctcctgagtagctgggattacaggcgcctgccaccacgcccggctaattttttgtatttttagtagtggtggggtttcaacatgttggccatgcaggtcttgaactcctgacctcaggtaatccacctgcctgggcctcctaaagtgctaggattacaggcgtgagccaccacgcccagtggaaagcatcttctgatgctcttggaccccatctctgttactcctgcatcaccctgtgaatgcccctactctggcacttacctttttgtcataaaattgctgactttcttatctgcccactccactgtgggctcctggagaatggtaactctaacttattcattcttgagtccccagtgtctagtgcaggccgatagacagctgaccttcagtaactgaggaaaatgaccacataaatgaagacaatggaaaatgtcatgtagagggtggaggaggggagtgagctttgcaatatttgcggaatatgatgaagctaagctagttattagtgctaactccctgggtggtagcatagactgatgacctgcagcatgccaagctcacctcagaatttataaaattctgtcagttaattttgtcatcttaaggttcaaaaagcctcagttcctggagcttagaatgcaaactctggtggttttatgcgtttgctaaagcattagccccaaaaggacaagtaaaactttacactgggctgtttttgtagaaacgtgtggtgtcctctaaagtatctgacgatgaaactcagtgtgaggatttgaattacttattatgttggttgctaatggaggatgtggataagtttttgaccatgatggcctaatttattcatgggatgtggtctaaattttcaagatgtccaactgtcaattttaaaggtgtaattttcaagggactctgtagatagctttatttcttcccattataccttaaggtgaaggacaatcttggcattttatgtgtgagcaccatattgcccagggaagagcatggaatataattttaatccaattcaccattgagtaaataaatctgtagagcttttgaattcacctatttgattacataaatgcaggccatgtgtttgcctcctgttcccccccacacacaaaagtggcttgttgctctcctaaatgggcctactagtctgaccagcaacttctgttttgttgctcagttgactatatgtattgttgacttagagaacattatattcatccactttggccaaactaatattcgtcatcaaaactctcttttttattcatcaaagtccaattcagatgacatctcctccatgaaatctcccctgattagtcatcagaagtgctaatttttatctgatgttattttataccactcacattgcacatttatgaactgactttgtacctattatgtttgtttttcaaaggtgaggattatgtgttgcttattttcattttctctagaatataataaaggatcaggctcagagtaggcaattaatgcatgtatgttaagtttaatagaataaaaagtgaattttgtctgtttatttatttatttatttatttgttttttgagacggagtttcgctcttgttgcccaggctggagtgcagtacacgatctcggctccctgcaacctctgcctcctgggttcaagtgattctcctgtctcagcctcccgagtagctggcattacaggcatgagccaccatgcctggctaattttgtatttttaatagagacagcatttcaccatcttggtcaggctggtcttgaactcctgacctcaaatgatccacctgccttggcctcccaaagtgctgggattacaggcgtgagccaccatgcccggccatttgttattgttatgattgtcttggctctccaactaaaggataagttctttgaagttgacacataatagttttcaataaatggtagctatgatgatgatgatgatgatgatgataatgatgatagctatgatgatgatgatgatgacgatgatgatgatgatgacaatggtgatgatgacgatgacgatggtgacgttgatgtatacagttctaggtacacagtaaataatcatatctttagattggcagcttttttttttttttttttgagacagagttttgctcttgttgcccaggctggagtgcaatggtgcaatctctgcgcactgcaatctccaccttccgggttcaagcgattcttctgcctcagcctcctgagtagctgggattacaggtgcccaccaccatacccggctaatttttgtgtttttagttgagatggggtttcaccacgttggccaggctggtctccaactcctgacctcaggtgatccaccagcctcagcctcccaaagtgctgggattacaggtgtgagccactgtgcctggctagattggcagcctttaattgattagctaagagcagtgtccgaactaagaaccagaagagccaaaatatagaaatggctaaaagtgacccaggaaagctagaggcaagatgtcagattgactttccacaaaggagattttatatatccagtcaaactttggatttttggaaaactatgtctgaggaacataaattcaagttgagtaaaatggcaaaggctgacaaaattggaaaatgaaggccaggcacggtggctcacgcttatagttccaacactttgggaggccaagggggtcggatcacctgaggtcaggaattcaagaccagcctggccaacatggtgaaactctgtctctactaaaactacaaaaattagccaggcgtggtggtgggcacctgtaatcccagctactcacgaggctgaggcaggagaattgcttgaacccaggagatggaggtcgcagtgagccaagatcatgccactgtactccagcatggatgacagaacgagactccatctccaaaaaagaaaaggaaaatgaaaaacgattaatccataaatgacactaaaaagatgagtgatttcagtgcttctgaatggtgaccatgtggtttcttctttattgagaatttcaccctaagatcaagcctcatggcaaagcctttgtgaatgtaaaaaagaaaaaaagttgacgtatgggataatttgagacacagtgaaaagcagccttgcaataatatgttaagctggaagagaatatgagaatgttgcaaaacatagcgtctaaaggagacttgatggcagtgtaagccctgataagacgatttacgctttagccatgaaaaagacagagaaagaacaggaacacttagaaaagaataagactggggacagtgatgaaaaatgccatataggccgggtgcagtggctcatgcctgtaattccaacactttgggaggtagaggcaggaggacagcttgagcccaggagttcaggaccagcctgggcaacacagtgagactactgtctctataaaaaataaaaaaaattagcccggcatggtggcatgtgcctgtagttccagctacttggggaggtgggagagttgggaggaggctgcagtgagccatggtgacgccactgccttccagcctgggccacagagcaagaccctgtctcaaaaagaaaaaaaaaaaagctgtataatattcttctcactgtaacctctgaataagggaaacaccatagacaaaggtcctttcatttgggataatgtctattccttcactactttaacttacaaaatagagttatgatggggggagaggggaaggatagcattaggagatatacctaatgttaaatgacgagttaatgggtgcagcacaccaacatggcacatgtatacatatgtaacaaacctgcacggtgtgcacatgtaccctaaaacttaaagtataataaaaaaatggagttatgatagcagaatagtttctaaaagccttgaagaggctatagttaaaatgaatcctttgaaacggtgccaaaaacacacgtatttctaaatatttaaaatgaaagcatctttgtgcgctttcactgtgaactttgctcttgttctaataaagcatttcaggatgattcaggcacttaaaaatgtgtcaaatggtcctaactctatggttattatctatataaccttagctatcagctatgtttatttgtaaactgtgaacacatgcatgtaagtttgtgcgcacacccacacactcctgtcccaattaatccttgtgctatgttcagattggccatagcctatccacaaggttggatccattagtcccgaagaagatggccagtcacctacagggctttttttgtgtgtgatgaagtagcgactctaatgaccattttaagacaggaaaatcagtactattgcactccataagaacttagtcaagaaagtgtttttctctcaatagaggagtagttacataagttatgggaatacaaatcatattacagtgtatgcctgctaaaaagagtggggtagaacaatacgttttgacatagaaagacctccaagatatatcaagtaataaaagcaagtcttaaaatgacatatggtgtgaccttaactcaaattttatctcggaaatgctgggtttcccatataagcccactaccagtcactcactgtaatccattatcttattttattttcatcataacagtgatgaccatcagaacttataccatatgcttatatagtagtccccctgtatctgtggttttagtttaccaacgtgcaaaaatattaaatggaaaattccataaataaacaatttataagttttaaattgtacaccattctgagaagcatgatgaagtctctcgctgtctcactctgtccctcccaggatgtgaaccttccctttgtcccgcacgcatctccacgctgtagctgctacccatctatgaatcccttaggagctggctggcctaccagatagatggtcccagtatcacagtgcttgtgttcacagaacacttattttcctcaataatgtgctccaaagcacacgaatagtgatgaagctgtgaagtacttccttttagttaaaaggtgaaagttctcaacttaataagaaaacaaaaaaatcatatgctgaggttggctaagatctatggtaagaatgaaccttctatccatgaaattggaaagaaggaaaaagaaacctgaaaaggcatttaagtttgtgggtagaaggcatgaacagagcgtgttctgatggacagcaattggtataatctgaggtgtcaggcatcctcttggggtcttggaacaggtcccctgtggataaggggacatgacagtagttttgtttgttaaatttgttgcctgtattttcccattagaatgtaaattcaaggtccctgttttgttcccagcacctaatatgcctgtcacaaggttgactgtcagtgaatatctattgaatgaataaatcattggtgtgtgtgtgtgtgtgtgtgtgtgtgtgtatatatatatatatatatatatatatatttttttttttttttttttttttgagacagagtctcgctctctttcccaagctgaactgcagtggagccatcttggctcactgcaacctctgcctcctgggttcaagcaatcctcctagctcagtctcctgagtagctgagactacaggcacttgacaccatgcctggctaatttttgtatttttagtagagatagagtttcactatgttggccaagctggtcttgaactcctgacctcaggcaatctgcctgcctcagcctcccaaagtgctgggggattacaggcatgagccactgcatccggccatatatttttaaagcccacatttgtacatatgcacacgtataggttaaaaaatggaaaaaacattgacaagatacatatcaaacagttaatatgtattacctctccataagggaaatttgtatagcttactctatttctgtacagtggaaatgtattcatatattcctcgtttaaataaaatgtatatatatatatatatatatatatatatatatatagctgggtgcagtggctcatgcctgtaatcccagcactttgggaggccaaggtgggcagatcacgaggtcaagagattgagaccatcctggccaacatggtgaaaccccgtctctactaaaaatacaaaagttagctgggcatggtggtgcgggcctgtagtctcagctacttggaaggctgaggcaggagaatcgcttgaacccaggaggcggagcttgcagtgagcagagatcatgccactgcactccagcttggcaacagagtgagactctgtctcaaaaataaataaataaataaaataaaaatgaaacattaagacatgaaactgtagccctttttacctctttctcagtggcaaagagccattaaatgaaaagtttaaaagctatatgagttcaaatacttaaacattgcaaaactttgtaatattgactatgttagaatgagtgagtgaatgtttttgaggcaagaaaagtcgatttatattttatgacaatttacaattttagattaaggcaataaaaggacaaatcaaaacccattcagtcagaagactgtcccaccgtgtggaggtgggggagggaacgtgatatagagtatgttttctgcacttcattttgtttctcagtgatgctcagtttaattatgactgagttgtatgagatggctacttaaactaatatacagtcttgattgtttaagtctccttggtagcaggagattatataaaaatcaggtttatcatttgaatggggaggtgaactttcttgactttgatttttttcagcagcaatttagagtcgtggactgagttcactgactagttatctgagagtatatttgtttgcatattttccttaattgaattgggcatagtggtgaccccagttgcattgctgtgtatgtgccactttaggtcctgattaaactgtctgaagtttatgcttgaggggaggagagatttccatgcagattctagacatgtaaaatggaaaaagtccatctaattattttgcaaaaacatgaaagcatgaaagcatgtttaagggagtgtatgagttttccttctgtagtcatccaatctttagtgtagggaggaatttgttgattagggattgagatccctctcactctaagagcccaggcactggctcttagttttggggttagtgtctttggacagagtacagcctctgagagatctctgggatgactgctgggagagtttaccacccccactaacccctcgatgtccccaaatctctttgtatctcttctctttgtttttcttcatgccccatttctttttcccagccattgactgctcttcagacaaaatttgctgctgatcttggccatgttcaaagtacatttccgtgtgttgcaagaggtcacagagagaatcaaaagaggaggttaattcatagtcaaaaaaggagaagctttaatgggcatgggatttccgattggggttatgaaaaagttctgtaactagatagtggtgatggttttgcaacattgtaaatgtacttagtgccacttaattgtacactttaaaatggttaaaatgataaaatttatgttatgtgcattttgccacaatttaaaaaaatgaggcctgggcaacatagaaagaccaccatctctacaaaagaaaaaaaaatagctgggtatggtggcatgtgactatagtcccagctatgcaggaggctgaggtgagaggatcacctgagcccgggaggttgaggctgcagtgagccacgatcatgtcactgcactccagcctgggaaacagagcaagaccatgtctcaaaaaacaaacaaaaaacaaaacaaaatataaagaaaaaacccaaaaaaaccctttttctaaagtgatgcccacatttacaagttctctcctatttcttttcttttttttttattgagatggagtctcgctctgtcgcccaggctggagtacagtggcgcgatcttggctcactgcaacctccacctcccaggttcatgccattctcctgcctcagcctcccgagtagctgcgactacaggcgcccactaccatgcccagctaattttttctgtatttttagtagagacagggtttcaccgtgttagccaggatggtctcgatctcctgaccttgtgatccgcccacctcggcctcccaaagtgctgagattacagttgtgagccaccgtgcccggccctcctatttcttatgtcctaaatttttcatttaaaaatttaataggacctaacacacacaaacaaacacacacacaccccaccaccactaccaccaccactaaacttaaacaactagcagggggccctgctattcatacgaatagatgtttgtgttgaccaatgcatgatccctcagttggaccttactgtggccagcagctttcaggaggcttttctgggctgaatagagatgaggatgttatgctgtaaaatgcatccaggaaattttctttaggcaaagctttaggataggatatattgctatgtatgtgtgtgtatacctatgcatgtaggtgcaagacctaaatcacctgaatcttgccaataaaaagagatactttggggctgactgattcttcataaatagcttctattgctttccaattcaaaatggaactttactcatggattactttacttttctgaatataaattatagaactctaccactgtacttttcaatctcattgaactagccaaacattaacaagtaattgcagaattgcagaaagcgcataaagcaacattttcaatttttttttttttgccatgatagggctgtgttaaagtcaggttccctctgttggctgagatgagtgttgtaggtctgaactttggcaatgtcaacaggttagttttcgcatgctgttaccccactacctctcttacttcattactctcctttcttctacctcctaaaagaactttatccttggaaaagaactgagccttgattctgcaacatagtcctggcagggaagaagagctacttgcatatcagcagtgaagcttggttttccttgatctggatgtagagagcccctgaccttaatgacacatattgaagagacagggctagcgagaacagctgcttagctaatcacaccagcagatcagctctggtctcaggggtgctaagtagagcagccagctcaccctcacaggcactgctctgcgcacaccctggatatcttgttcacatttcttttctgcaataatagttcttcattcattgtgtaccgtaaggatagatttcatgagaaggaaaaggcaactacaactcaagttttgcaaaagatatttgacatttctgaatttcattaaggaatttgattaaggaatcaagcaaaactgctgattctagtagcctgagcgtgacagatggtcagtttttcatccctgggtattaacagcctcattcctctctctcttctaaggttccttaagatctttcctggatctagtcaaatcacttgataattcagaggtgattctgtcctcttaggtactaggatctgaatatggtgcctacagatgcagacatttggtgtcagtgatatagtgtgacaggaaagatgtcctctaacagttagataaacacttagtcctagtgatcaagaagatttcatttaagaaggagtattaatcattgggttagagtgattctctcctgctccaccctcagtctgtttaagacagaatttactctttctgaactctttgttgttctaatactactgctttaaccttaaaatattctaaaaatgttttgctatcataaaaatttagcttaaataatagtttgatgatggtttattggttcaggcaggctttactaagaacatctaagatcaagattgccttctgttttctcaaatatttccagagagggagggtttgttacttttttcagccttttaatgactctttcagagcacaatcacttgtgagatggtttgtgcctgtgtcagtgcaaacctaaactagataggccttctgccatatattcttggccaacttatgttacttccttacagtgccactgtgaagagggttgccagtagcccctcttgcagcacctgctcagcaatgtcataacttgaaatattttacgacctcattggagaacctgggaagagggtaaggtagaaaggagactttttgattattttggagagctgccagtcctttaggcgggtggcctgaagagggagtaaagacactcagggtcaagggttctccaaggtgacactgtaccattgttccaagtctggtttgcaaaccttaaatatttttagcccaacagaaagaaatgtttctaaaaggagctttgctgtccatgtacccctaggaatcagaccatactcaaagcaactactgtcaaacaggattcatctctgactttgaactcttgtgtggtgcttcttggtattagtcccttcacactgcattttcctctcttatctctggctctctgtattatattcacttcagcttgtctactctcttttcacctgcctcttcaaagtaaataggtcttaaattaccttcatctttcaacactttgcaccacatcagtcccttctaagagttcccagttgcttctttactcagttctaatttggagcccctactaatttccccttatctcttcctcctttctgtatatacagctaacaacaattgagaacttattgtatgcacagcatgaacataggaaaattaaagcacaaagggtgtatcttttcagctatccaatgtattaaagatattttgataccatgattgagccatagaatttttctgattgcccatttattaatttgccttattccatttttagaccaattgacacgataatagcgaataaggcaggacacacagggttgttgcttgaagaagcgtatttcaggtaaatacatgcatcacttaattactctagatttttggttcttcagatttcagttttcttgttcactgctgtatttgcagagcctagcgcagtgccagacacaaagcagtgacttataaatatttgttaaataagtaaatatatgagtattaggctgataggacatgcattctggacctttacaacttaaaagtaacacccaatctgagttcaaaataattttaaactttatacatgtctagttttttaaaaatgctttatgtgtttttaatatgctttaaaaatgtttcaaaacatgctttaaagaaaccaaagtcttcaagagacttaatctttaatttaccttatatcttaaaagtaacccccaatctgggttcagaataatgtttacctttatacatggcatgtctagtttttaaaaaaaatgctttatgtgattttaatatgcttttaaaatgtttcaaaacatgctttaaataaactgaagtcttcaagagacttaatctttttttttttttttttgagttggagtcttgctctgttgccaggctggagtgcagtggcgtgatctcggctcactgcaaccttcgcctcccgggttcaagagattctcctgcctcaggctcctgagtagctggggctatcagcatgcgccaccatgcccaactaatttttgtatttttagtagagacgaggtttcaccatgttggccaggatggtctcgatctcttgacctcatgatcagcctgcctcagcctcccaaagtgctgggattacaggcatgagccagcgtgcctgaccgagacttaatctttaagggctgagaatgagcagatattcattgttttaaatacatgtttattggtgcccactatatcatttaaaactgatgctcatttgttctcttgtgagtgaggtgagctaacatttagttatgctcaatgctaaatgcccatatgttcagtgtgcagagtgcaggcttcagagtcaaattcttctggtctgaaccttggagggctactcactaactctatgacctgggaccagttatttttcctctctatgtctcagcttcctcatccattagtctgtaaaacggtcagaatcattcagcaaacctcacagaattgtaatgaaaagcaaacaaattagcattaggtaagttctaaagcagcagcagaaacctcgcaggtgcttgttaagtaaaacagatctgtggaatgtatctaataatgtccctacctcaaaggatagttgtgaaaattaaatgagttatctccaaaacacttaacacggtgccttggtacctggtaaacgctcaataaatcttatattgctatgtttaatagagaagacatattaagatattataaaataaacacatgtaacaccagagaacaatgaagtgatgtgctcaatgacatgagttgtaaataaacctagacatcagaaaaaaggaagaatcacttccctggaaggtgagagaagatctttcacgacatcaagaattagtggggctgggcgtgttggctctcacctgtaatcccagcactttgggaggctgaggcaggcagatcacttgaggtcaggagttcaagaccagcctggccaacatggtgaaaccctgtttctactaaaaatgcaaaaattagcctggcgttgtggcatgcacctgcaatcccagctattcaggaggctgaagcaccagaacctgggaggcggagtttgcagtgagccaagattgtgccactgcactccagcttgagcgacagcgcaagactccatctcaaaaaaaacaaaacaaaacaaaaaagcattagtgggaggagaataacgtagtgagaggaaagagaatttttcaggcaagaactgaaggcagcccatggcccagaggaccgaagggagaagaggagaaaggaaaaagtgaggaagagtggtgtcagggcgcagcaggaagttagtgctaacgagctggatggggccaagcaatcgaagccctgagaagcctgacagcggtgctgggagttgggcacgcgcagcagacagcatgccaaccccgaggtactcaggcagtgtggtgtgcaaggccctgtctcttcttgtttgggttgccctggccaagattgtctcttgcaatccgttcacatgcgttccagggcctgcatgcttaagatcccttttattcctgcttgatgccctttggctcaagaatttactactcagcttttataacactttcttaaaactgcctttcttctggtgaatggctgtgccccactgacagttttttcctgaaaggaaatgataagggaggaaaaagctccaactaccccaagtaggcattttataggcgcttgtacaaagcttgagcccttgtgtgtgcctcacttcctctctaatattttctttggaatgggagcaagtcatcatttaaaaaataacaatgataatggactggatcctatcaatgatccaaggtcactaaaattctcttgctatatcaatcctttttgagctgccaggcttcatctaaaaggtgcacctcaagtatctaaaggacacacagtttattttcagggttttaaaactcagtcaagctggctaaaggctgagtatataacaaactacttttcagtctttgcaggccatgatcttaatactcttccatttcagttttgcaacaattggcgaatcagggattatcactttggttacctttattcataggtttacaaaaagaaatagtcataaaagagttggcagttttgaagatactcatatatacaaacataagggtcatcgtcatggagcatattgcattggctattgcatttgctcctgaaatgggaatattacgtatggaactttacagaaactatatacatggggaagattatctccagaaaattaagaaagccctttcctaaaggctatagtggttttacagagtgaataaaaggaagcgagagaaagaaaattgctgacttggtatagctgaacttaataagtgctaaattgctaaatagtagcatcctagaatgatatttatagaatattttgtgtaagactttatatgacctgtttttagatattattcttttggtttggccctcagaagatcagagaaagctgggtggtggaggggtggtggggggagaatctgtattattttgttttagggttgtttgacatttgagcttattaattaactctgatgccttccagtgaattctgccaactcactggacaatttctgtataaatgaggtgggtcagaaggcagcattgaacaagccaagactatgggccagcttacgttaactcatttaaaccttaccatatccctgtgtggtcagaattatcccaattttataaataggggaaaaagggctccgagagtaaggaataatgagttgcccaaattcttatatgactcatgagggccatgctaggactcaagccctgatctccccagcacactggactctttttttgcatgtggtagctgctgagacacattctcttgccttgtctctcctctagtctcataatggttctaagcttcccaaatcattttaactctgattctttaacccacttccaaattataaaaactgaacttatttcacatttacttctttcaaagaatcactcaacatcctacactaatctttcataaaatggattttgtgatcaagtaagtttgaggaatacagaacttagcacagttggccctgtgcggtgggtcacacctgtaatcccagcaatttgggaggtcaaggtgggtggatcacttgaggtcaggagtttgagaccagcttggccaacatggtgaaacccccatctctactaaaaatacaaaaaattaaccaggcatggtggcagatgtctgtaatcccagctactcagaaggctgagtcaggagaatcacttgaacacaggagatggaggttgcagtgagccaagatcatgccactgcactccagcctgggcgacagagcaagactccatctcaaaaacaaacaaacaaacaaaacaaaaacaaaaaaacttagtacagtttaccaatttctttcacaagctatttattcatgtatttattcatccttttattctgggagaacctctcaagggactagctttccacaaaactacccatcttggtagtgtgtcatcttaggcaaatcactttacctctttgagcctaagttttccattctacatgttagactaaagatactctaaaggtcccttgagctttaaaacttccatgatatgggccccacccccatgccaaatcgaggcttttgtgctaccactatgagtttgctaaggatagcctaagattttctgaaaaccatttattcattcattcatggaacatttatttattaattgtcaagtactgtgttaggttctgaagatgaaaagacaagacataaataagacaaataagataaactatctatctgccctctggaggggagacatatatgaactggtgatttaaaaaaatacataagagaggagtagaaatatgcataggtaatactgacacacatgaactgatgatttttaaaagtctcagcaagagagaagtagaaacagttataagtaataaagactcacggaggatctgcctcctatttgtgggagttgtgtaaggcctagttggagagagaacacccaatctgggtcttaagggatgcgacaaaggaagggaaggtactccaggcggagagtaaacaggaaccaaagaaagcatagggagtttaaacagcataatgtctgcagtgatctaccagagtttggcactgctggaatataaagttataaaattcaagtcaggcgactctgagcataacgtcgtaggagtaggcaggggctagatattgagggcattctctgtcagattcttgaacttcatcgaagtgtgttagggttgaagagttggagccggtggaagacttgaagcagggaagtgacatgttcacagctgcattttatactgttgtgttgaaagtagatgcaaagagagatagggagacaagtttggagaccactgaaggtgttcagaggctaggtaatgagtgtctggaccgagagaataatggggaagcagagaaaggaatggatttgagaaatatttagtatttagtaggtgtaatctgctcagtctggtgattgattagatgaagagggcaaaggagagaccatcaccttctagtttggatgattaaatatttgatgtcagtataagaggaggtgctactttatggagaaaaatgaagtgatgtgattggttttgaacctgctgagtgtaaggtctctctaagacatttgcagatatcttaaaatttggagttgttataccacaaccccattctgtgcatcaaactcaaatggaggtttcattttgtgtagaggacttacatttaaggactactccatattgctgtttatttgatttagattgttggaatattggaaataaatggcaattttatttttaataaaatatgaatatcaattaaaatcataaataatttcattgtactcttatttaaccacagatttatgaagcaggcaatagacagtgtttatacttattggtttaagtctcgttgtttttaagagtacagtcagcccacagcgagactccatctcaaaaaaaaaaagtacagtcagccttctgtatatgtggatctgcatctgtgaattcaacaaaaaaattccacaagttccaaaaaccaaagaacttttcacgcaccaagtactacattgagttcacatgaaatgatgtgtaggtattgtatcaggtattaaaagtaacctagagccgggtgtggtggctcatgcctgtaatcccagcactttgggaggctgaggcaggcggatcacaaggtcaggagatcaagaccatcctggccaacatgatgaaaccccatctctactaaaaatacaaaaaattagccaggcgtggtggcgggcacctgtagtcccagctactcgggaggctgagtcaggagaatggcgtgacctgggtggtagagcttgcagtgagctgagagcgcaccactgcactccagcctgggcgacagagcgagactctgtctcaatttaaaaaaaaaaaaattagctgggtgtggcggcgggcacctgtaatcccagccacttgagaggccgaggcatgacaatcgcttgaacccaggaggtggaggctgcagtgagctgagtgagatcgtgccactgcactccagcctggtgacagagtgagactgtctcaaaaaacaaacaaacaaacaaaaaaagtaacctagagatgattaaagtatgcaggaaggtatgtgtaggttatatgcaaataccatgtcataccattttatataaggaacttgagcatcagtgcattttggaatctgcagaaggtgctggaaccaatttcccacggatcccatggcactatatgtattgttgaaagaaaataaacctatacccactggtgtagatttatgttttttactagtatgatcaaacacaatttaaaaagttttctttttaccaaatccttaacatctgcgtagatgaatttaaaagattataaactggccagacgcagtggcatgcgcctataatcccagcactttgggaggccaaggcaggtggattacctgaggtcaggagtttgagaccagcctggccaacatggtgaaaccttgtctctattaaaaatacaaaaattagcctggcatggtgacagcacatgcctgtagtcccaactacttgcccagctacttggatggttgaggtaggagaatagcttgaacccaggaggaggaggttgcagtgagccaagatggtgtcactgtactccagcctggttgacagagtgagactccatctcaaaaaaaaaaaaaaaaaaaagaaagaaagaaaacgagattataaatctacttttctgaacttcacatatgccaggtgttccaagttctacaatacctcaaagccaagaaactaactgctcactttcccagccgtcatggtgaactgaatcattttctacatggctcttctcatttctttctgaatgcactatttaaagacttccagctgaatagattctgcaggatctttctatgggttaggaatatggtctgcataggaactggcccaaatattcctcactggacattgctatcagcatgaaccagatcccagtgtttggggctctatcagcaagtaggtctatacatactggaagcaggtgacgggactgttaagggaaaggggggctgatgaaagatgagaaataataaatggaagaaaaaaaagtctcttaccaggctcttgttgtattttgtggttgtttttaaaccaagtgatctgaggctcggggacaccattagcatgacagtctaaagtggtggaactgctgatggccactgtgtgatcactgaggtttcgcaggaggtatggtgcttcctgatctagtgaagaaagaaagggagctgtgattactcgtcaactttattcttgtattgtctatgcatatcaacatttaaaatatacagagaaacagcaaaactcaactattaggtttcattttcatttgttcactttctcttcaatcattaacctgctgcttctactttaataagatgctacgataaattgaaatttattacaacacagtgaaatcaaggactagattttgtatttttagatttcaatacaaaggcttttgcctagctagctagtttccttcctttttttgagaggagcttttctaaaactcaaggattttgcataatagtttagaagctataaatcaaaaacatgattttgtgtatagtcttgtaatgatttttatataaatatatagtgctgtagtgataggctaatataattttgtgtgagttttgattgatgtatttgtgggggcgtgtttgtgttactcaactgtcagtaacctaagttgtaaggcagcagaccaaacaggagaatttcttgaactttgaaagctttattggttctttcctttctccattcccttcccaaatgcaagcaaccaaagaattaattcaagaggcagaggcacagatttgtagtttttgcactatataatagtacaaatattgtattttatattattttctcttaaaacatacaaatatgatacaatacaatttattttaataaaatgccaaccaatatagtacaacaaaatgaattcaatacattaagatgcaatacattacaacattaaaatcccacataagaacagcagtacccccaaggcccccaatgagtacagtatatctctaatgaagtagtcagtcagtcctgctgatgtgtatacattctagttaggagggtactggattggtagctaaagcttccaaggtaaaaaataaaaacaactcctaatgtctttcccaccctcccaagtcattcctttcccctcttgttggaaatcctggaacagaaatcaaaagagttttggcataactgacacgttctctgtcactgtcttcaattatacagtatgagctttctctgcccattttcgatttcctcatcttagtgtactaaaactgtgaaggcagcttaggagtgatgacaatgctacaaagatgatacattgcaatggccttaattccatgtccctgcagggttctgccacgtcccaaaacctttcccttttgagtcctgcagggcaactctcaggattagcatttgttaaagcaatttagaaatcccaggttaaaatgtatattatcacataaattttataacattgttgaagtagtatatcatggcagggttactatctgttaggagaaacagatttctcaataaattttgatttctacagtttatcattagtcttctcattttataaaaaatgaaatctgaaggcaaaaaagtgtgctgaaggaagtgctctgatgtacaaaaacttcttcaaactagtgtagaatgaatgatagcaatgattcttttgcctctttgagcatgtctttcctatcttatcttgcccactaagcagaacgttacgatatttctgtttttgcattggatgctatctgccaaacagcttttcctaattgaaaatgcagtcctgtttaaaacctttgatttacgactacttgtacatgcttgctcattacaattttgacattttttacatagtgaagaccccaaacatatcagtgaaacatgacaagatcataaagaacagtatcatattattatttagtcgcttttacagtggcaagccaattttgaaatatctcatttaaaactcagacccaattcactgagttatacttttaatagcttcctcagcacactatttcccatgcattaaatatgataaaataatctatcactgcccatcggtcttgtaaaaaggaagtctgaatacagagcccacaacactaaaattgtttttctagctacaaagtatagcatcatcaacacagacacgatttggactccctgacaggtggattggaaaacggtgtttaaagagaagagaacattttaacataaatgtcattaagaatcccaaaggccttatttgtactacacaaacttcagatgatagaagcagcaaaaaggctgcagaacgtacatgggactctcaattaaatacaaggttcacataaacactctgaaatatacagtaatatgcatttttctttgtacccatttctgaaaaatgttctacattaaaagtctcacttttggctagtttctaaatgaccaatcaacccaagaatcatattttgtcaattcttactttatacattataataatctattttgacattttgaataagggaggtgcgttgaacccatatttcgaaacctaagttacttgatggaagtaggtagtggctttccaaaatttaacagtgtagctgatcccttcaaattgagaaaatcagaattaacagacatttctgctggttatcagtagccaaagatagctgcccaccaggttctttcacttttcagtgttatggccccagagatctgccaggtcacataaatacacagcttctatcctccgtttggaatggggactgaggaaccagcctcacaccccctgttccatttcaattattccccattttaggctccttttttctccttttttttttctcccccctccgttatcttcacctcccttcataccccagggtaacatacccctagggtaactaataaaaaacaaaacccacccaaaagtttctttaaaaaaaaaaaaaaagactctccggaaggattaattacacagtgaacaactaatactctatggaattcttaaactcatctcttggaagttcttaaaatcatcttttgtaaatactaacatcctcccctccccacaaaaattgcaaacaggggaaggaaatggtaggttctgcatgtccaattcaccattttgttttcataaggatccctcaatcattctgtttgcttttttaatgttagcaactattaaggcccccatgttctatggtattaaggcattgtttcctgaaggaacacactaacttataatgaacaaagaagccaggccaaagagccataggtaaaatttcaagatacaattgatttttctttcctttgggctgacaacttccaggttactaattgttttcagagcatttggggctccataaaactggcattctggggaaatgctattgtttactctttcacgtttgacaaaagcaattcccacgtgaaagacaagtttagccgtgggacagaatctgttacctaaaggaggaaacagtctggtgagttcccaagcttgagaagttgtcatattgtcacctcctattgaactgcccagccactgtgtttctcagccatggctattttggtcattatagtttttttttttaaatagtttatgcaagtcacatataatgatcaatcataaataaaaacaacagaacaatgcatattaaattggtgaaaaagtcattttccctcaaacgcaagcttaaaacaagagattacaacttctcttgatttaaaactggtgtgtattttttaaattactttgaattctgcttctgtagttttgccgcttcttaatccccataaaaatcctattaacatttgcatatggggaaagtggacttttttaaagggcaaattttaaatttacatttagaagaatgcattaaatctctggttacaatagcctttatttccttgataaattgattgtggtacacctttgaatgctgtcattttaacatgatgaagttccttaaaataataaccagaggacaggaatatttaaaattaaggcatgatccactttctttcagctgccatcaatagctgtgtggtgcagtcagagacagcaaggagcaaaccctttgctaggctagtctactgtggcactaactgcataattacctggatcgcatgagaggagggaggggacgttgatttggatggactcttataattcacactgcgataaacctttactatctctgaattacaccaacatcttgcacccctggggcccattttagaagctccagttcaagataaatgtgcttaacgtaaaaaaaaaaaaagcattttcaaataaataagcattataacttgctatccaggtgctatttacaaatcaagagcagatgaaatagtcccaaataaaaccaggcagaagtccgacagagtctcaaattcaactgtactcattctgagctggaaaattaacttattcgtgtccatctttggcagaaaccagcatttgtttaaattattcagtttgtgcagcttcaacacttaaaaataaaaagaggttggcatcaaaatggaaggaaaggatcatcccaagttgttgtttatcaggcaggagaaaacagcaagagcaacaaacacagagaaggcagtgcagggatcctccaaatccaaacgtgcaccaagtcggccccccggagcagccccctcggcctgaatggggggcccagagctggggcccgggggtctcattattactgctatcatctccgaactcattttgggaggagcatctcctccgagcctgaaagttagcaacagtgacaataaatcaagatgatatgagacaactgttactttttaatgagtcctttaatgttttacattactttgtgtggtacaatcattccttgtgcttttaaatttggagatccgagagaaaacagcctttttgttgcagtgctcacctctgattgtaatttctttcttctggaggatttcttcccctgtgtatacattcctggctctgcaggcataggtgcctgaatcttgcagggaaacattcatgatggtaagattaagagtgatggagtgctccttagtgatggccattttttgcttgctaatactgtagtgcattgttctgttattaactgtccgcagtaaaatccaagtaacgtctctgtataagaacttgttaactgtgcaagacagtttcaggtcctctccttccgtcggcattttttccaagttaacatgaaacccatttggcacatctataaaataagaataaagaacttcagttcacagaaaaatcagtgtcttttaatgagatattcaaagatcttaagaattgttcgtgcacaaattatctcagtatccacattaaaaaggatgagtatttggggtaaatgagcaaacacagcaggtgggaatcaactaagttcattccatcagaagtgaggtaggaaatgcaaaacagaatagttattaggatggcattttctcctgattcacgtgaagttgctcttcaaagtggcatattttctccaacttggttgttaactttatttccctttttttttgaatcagggtcttgctatgttgcccaggctggagtgctgtggcatgatctcagctcactgcaacctccacctccagggttcaagcgattctcctgcctcagcttctagagtagctggaattacaggcgtgcatcaccacgctgggctaatttttgtactttttggtgggggtgatatttcaccatgttggccaggctgatctcgaattactggcctcaggtgatccatgctcctcggcctcccaaagtgctgggattacaggcatgagccactgcacctggcctcatttcctatttttaaaatcatgtacagtattcctactggcaagtgacactggcaagtgggcaaaatagtgaagtaacataagagcaattcatcctaaaaaccaaaggcacacttacggtcaaacttatccaaaatagtttgcgaacaagtgagaataggaagtcctaggtaaagtgccaatcaattccactttagtcctagacttttgcagtgagaagcaactgttattcactatcctcctcctgctcctgtcccagattacttgccctggtccagcaaagaccacagtgggccagtggcacagtgggccagagaggagcccgctgacttactcaggacttcttttatggggatggttctattcagacctgagagagcaaagatttcttctgaaaatgcggacaactaatctggaagagttgccagattctaaaatgggggtgatagaggggtaaagagaataattttaaaaatcaaatttactctctaacatattttaaacatgttctgaaggtggctatgtcattaaaagccattttctccaatgtcgattcccagctaatctttgttataagaaaataagtcttgggaccccaaaatcactaagctaaagggaaaagtcaagttgagaactgcttacgacaaacctgcctcccattctcttcaaagtcatccctctgctctctgagacaaatgcataccttattgcctcctttggaaaggctaatcagaaactcaaaagaatgcaaccgtttttctctcacctatctatgacctggaagccccctccccacttcgagttgtcctgcctttccaggcggaaccagtgtacatcttacatatattgattgatgtctcatgtctccttgaaatgtataaaaccaagctgtacctcaatcgccaccttgggcacatgttgtcaggacctcctgaggctgtgtcacagacatgtgtccttaactttggcaaaataaacttcctaaattgactgagacctgtctcagatattttgggcaccttcatctccatctcccaggtgtctctgtcaacaccccatgagctcttcccctccgcatgcctaacctgggccatcagttcactttggggctgagaatttcttagtatcattttggcccagtctcacgggaggattttaaaaagtctgccggccctgaactgacccgctctcaaaaccttcccattgcttattactagtggtgtatctgcatttgagcaaagaatttgggccaacatcttacaaagtgctttgaagatgaaaagcattatgttatgctattattattattatactttgcacacaaagctataaagaaacctttaaacgttaaggggacaatagtccaaaattagatatcatatcaactctttcctaaatctcactttgcttgtttttctgatttttctgagctttggctttattataaagtgtcacgtctgaagaaatgccaaagtattcatttggaacctgggagcagggcgtaacagtggcttacgaagccgtcagtggctgaggagagaggataccagtggaggttttcctgcttttaaaatgaaaatctaagaatgtgccagaagatgcaggaggggcagctgacagtcacttttaagataacaataaggtgtcagaaatagttgctctaattcagcatctttttatatttgggccattttccaagcatgaggagtaaaacatcagccatcaacttttacacagatagtagagcagaggtattgtgcactggttgcaatcaactcttacaagaccacagactttccatttatgagctctcatcctggtagttagaacccaagtgagcccaagtaacaccattgagatcgtgtagagagtttctatttactttagtgatttgaaacttcctgtggaaatagctcacaggtttcctgatggaagattttgtttatctttgccaagcaccaccaggaatctcaaaataaaatgcatttagtgacattgggaaaccagggagataaggcagtgctgttcctgtttcaccctcagtaattgctaacacacccatagtcatgctgagtgccagcaaaacagcaaaaacacacacataggaaaagcaaagaaccaaattcgttttgaggcctgtttcttatataggggacatggtcactgaagctaatttgttatgttatcagacagccttttagaaatgactatttctcagtctcacccctttggtattctcttttgatccatggaagatgataaataaaaatcccagagggatttttctccttaattcatgttgacttttttttttagtctgagtacaaaaacagacccaagaaagaattgccttctaaccctcaaagtgaaaacaagaaatcttcccacacttaagtatctgtggcgaattcagcacagtcatcatcattaccaaataatactcatccatctaacatattatcacatccatggcatcttatgaggtgtcatggagaagaatcaacccttgctcagaagaggcattcaacccagggttagacgaaagtgtcatctatttataaaggtgcatacttgggggtagatatttcaactcaattggatcaggcatgtgcattaagttcatgaaagggacaagcataggaatttaaaaggacgccagggatgtcatttgttgggtaaaaataaagaaggctctactgccaccgaagagtggaaatattacttaaaaagagagtgaatggttaccaggaagttctgcttgtttcaagtggatgctatgtacaagtgtgtgccaaagtttggagtcgaagcggtcaaggattctaatggccacagtttaccattttcatcaatttggaaggcaactcaaaaaaatttttgtgtttgtttttgttgttgttgttgttttgaggcaggctctcgctctgacactcaggctggagcatggtggtgccatcatggctcactgcagcctcgacctcctgggctcaagtgatcttcccacctcagcctcccaagtaggtgggaatacaggcacgtgccagcaggcctagctagtttttgtattttttgtagagacaggattttgccatgtttcccaggctggtctcaaactcttgtgctcaagcaatcttcccatctcagcctcccaaagtgctgggatgacaggcgtgagccattgtgcttggccccaagtaactgtattttaaagaaggggcaacaggattgaaatgaggaccagtaaagatccaaatctagataagaagagcgttaaaattttagacaggcacttttaaagcattaccctcactgagtcaagtataaacactgaacaaatatatgttcatttttttcaaaaaataaacatatgaggtacaacattcatgagtctttactctcatctctagtgacaaagatttgagtgagagaaagataataattatttaaaaactaataatgaacgtaagcaagttaacctaatatcacaatcaaaaccagaacttttcaggactggtagaaaaggattaagggaaagtatattccaggcaatgagggcttggttgactggacttgtgtcagttttaaagttaaagctcttggatttctagaggaaaagaactgtgagcttcaagtaggtatgtctgaatcgaattctcattttgtatggataagccttgggatctagaagaggtttccaccccgccatggttatacattgtacaatatggtgagaggtaggagggaatttctgcctgaattcagcaggagatcacctttatcaacttgggccctttcagcaacaacaccatgggtagaaatatgatgcagcgatgagactctgggctagccagaggttggtgctgtgactaatgctaggcatcagttagctttcattgggaacagtgattaataaggaagtgagcatgatgttccccttttctcttagcacatcctcttccagtactgccctcagacccaggcaagaaggatccctgtcgcagctctgttctggtcgcagctcttcccacaatgtgaagagtttatggggccaagtgagcatgcctaccgacagcctgtgtcactccattcctatatcatgatccaggtccctgggatctcagaattccctataaggctgatttaaatctgcttctaggttggctcttccctaggtctggcctcctgagatcagactgcttgtcagtattcacacctttgggtctgtccaggcagtggccaaaggagactatctgtgaggggcatggggagagcttagatgtgtgggctgggagacaccacacatggtgcatggccccttgcagtgtggacagggtaaggggcggagaggggaggtgggtgatttagtttttctgcacggccaggtgctgccacaatctgctctggaatctgagtagtctcagagctctaaattgatcctgacctctcaggtcatcatgaaagtatatttgtccatagggggctaaaaggtatttaatggcttgtttgcttgatgtagaacttgtcagtagttagacgtatggtttgtgggcctccactggtactcttgtcttggctctgaaaatgtcagggcaagtctgttttcttctctccacctattcaaatcccaccttctctcttcctgttcaggtcctgcttccttctcagaggcttacagctgcactgtccaatatggtaactgtgagccacatgtggcttttgagcacttgaaatgtggctactgtgtcagaggaactgaagcatattcagtttatttgattttatttaaattgatttaagtgtaaaaactgaagcagtgtaatatttttaaaaaatactgattacatattgaaatcacaatagtttggatatattgggttaaataaaattaattttacttttaaaaaaacgtggttactagaaagttttaaatggtatttgtggcttatattatatctctattggacagtggtggctttagaaagcaagctcacctgtcacattacctctgcacataaattttgatactaggatatatgtaatttgacatttcttgtttgtttccttggtgttagaaacctgttcctagaaagacaggacttcattgatgttcctccaagtgctcagtagagttgaactgtaccatttaacagtgctgattaaactgttacaaagttattgaatgttcagaacaaaacaggaatttttcagtcttttgtattctaaatcagacatactacgactatgggttgagacagtaacttgtttccaaccaaatataaaggacagtgcaaacctttgtatttaattagtccaaatcccatttgctcatctggaaaatacaagagctatgatgcagaatagcctctagaatccctgacagccctgacgttctatgagaatctactcagggatatctcccatggcacagcttctctggggcttggctaacttgccagaggcccctgtgatctgacaacacatatgtgtcatggaattggacatgtctatttctttctggagaacttttggcaatttctgcagcctgccccgggcagtgagaagtttccagaaagttggcttactgcccatgtttcctcagaaattgggggagtgtggagccaggcaattgtttttatactttgagctacttacttccttcctgtacccattgagggacatagggagtgccatttgtgtaccttggaggtttttaagatttgcagagaccatcatatttaaggctaaaaattcttaaatgctatcaaaaaatagcacattaactattgttaataaagctctgtttcagattgctacagagcctcattccccaaaaagtctaaattacctaagttgtaaaaaaattaaccttttggttaaaacaaaaacaaaaccaaaaacgatgtcatcatattatatgcattataattggtttccttgattggtattgaactgctatgtaccagaccctgtgctaggtactgaagggaatgaaaaaatgagcatacaagattcccaattcataatccagtctgggagggagacaaacacaaataactctaaaagagaatacagggaaataactccttacgagatccgatgaggtagaattctattcctgagagcaaggatgaaggcactcaaagtttgacaattctatggaattaaaaaaaaatcactcaagctataaatgcactaaaagcaaacaagactgaagagagaatgaagtcaccaggctgtctctggttataggatgtgtggcttacctgtgatataaaagcttatgtttcttcccacagtcccaactttattggaagctatgcaaatgtagattccagaaattctagagtcagccacaaccaaggtgctagccatctgcaaaagaaaaggaaactttagctagcaacaggacaaataactaattgaacaccccaagctacttctgaggttgaaatgattcagctactccattcattctgcaaagagagtattgcataggtggtggttaccagaaggctctccccttgccgagccccaacaagaatggaaaaataacaggaaagcaggtcctcaggagaccggggcctatgacatccgactcatatgagggtttcaggcttatttatctcgtgctgctggcgtaacaattacagacctgaagctgagatgtgggactgcacgtcctaccctatgaggtggtcagttccacatcaatgagaggaacaggtgaggctgaggccttcccttttgtttgggtgacctgagagcatagatgccagttataacaggagccttctctgctgtttggttctataacaggcatgttaagtgagcaaggacagaagataatgtttggctgaaacttttttttttttaagaaatggggtcttgctatgttgcccaggctggccttgaacttctgggctcaagcagttttcccgcttttgtctcccaagtagctgggacaacaggcacatgccactgtacctggcttgaaactttttttctatgctcaaataatgtggcatgcagcactggatggtcctgaaggagaccgtgtgtgtgtgtgtgtgtgtgtgtgtgtgtgtgtgtgtgtgtgtaaattacctaatttctcttaataaattaagtatctattcctaatctagaagatgaaaatttaaattatgaattaatgcaattatattgttccactagactttagtgctattatttgacaacttagtccctaaagaaacattagcagtcaaaattgcatgaacttgaaagcactttccaaattctgatgtctaaaaagtaatgaaacaaaattttagacaacttaaagacttgcattcttccaaagaaaaaaaattggcaatatgaaacaaattgttaaacattcttaaatttaacccaagcttgcattaaaaagtagtgtataatctatatgaaaaaaatgagaaagctagtttctcatacttaaaattatggaaaagaaaagttagtccagttacttataaatctttgcagcctatgtcctaggacaaaaataactggttatgggctttgaaattgcagaggctgtgcaaatgattccagactaatagagtgtccttgctgaagtataatgacaagtgacttacaggctaaagtaatgtaaggctgaaatgtgacagctgactttccaaggtggtggacatactctacaagtggtttggctgtaggagagagtcctaacattttcttgagtttctaagtaatgtgctaggcactttagttgtgttctcttatcccatctaataaattaaggtatttctgtctttaatctacagatcaggaagacttaaacacatgttcctcatgtttttagccagcaaattcattggtccaaattctctacaattttcactgtggtatagtgagtagtacacagtgctttctcttctgtttgttggaaggatctgcttaattacacctacccatatactccctgtgtattattgaaattattggtaatgaaagtgtctgcaatatgtggcagacaatttagcagacatttattgagtgattatcaaggcattgcccagatgttgtaagagagacagagatgaatatgacacaatccctcccttaacattatcattctttaaggtgatagagaagaatttccctccttgaagatcatacaaaaattattctctcttttgcaaggaaagcgcatatgaaggcaaataatccatgggaaagtgtacgaaagagagctcaggtgtcccttttcttattttgatgatgaatctttttaagaggtgggacataaaaaattctgaatagccatttccttgtaattgttgtacccacccgtttagagtcacggaaggaaatggaagtagttggaagagaagcttgtaggtggcaacatgaaagaactgttagctggtggaagctggaagacaggagagatcgtcaaatacgactctgactcccttacattgtctcaggaagcttagacccttcaaagcagtatgcaaaaaattcagaaacaaggagctcagatgaagcctttttaagctggggtgtcagctccagcactgttttttttatgaagttagttctcaagtgtttatcctaatgggcctcaggagaaacttacttagattctcagattaattgttgctcagtaagtaagtgaaaaacccatttctgttggcttgggagtgtttgaaattatggacagcatttatctgcatctatgagtcatgtttgggtttttatttaaaagattttgatttcattgaacttagagcaaccgagaacaagaactgggtttcgtggcaagggaaaatcaagtcagatgtatacatttgccacatttaagacctgtgtaggtaacctgggaatggccgtggccattttacaagtccccaacaaatagtcaaataggtccaaatttatgtataatcagagaataaaactgaggtgccccgaagtgaaatgaatccgggtcacaagatggagacagaaatgtattgaatttttcttcttttgtgtgaatgacaccttccaaacaagacacattactcgtagtcaagcctgccccagaaatcatgtctccaaagcttctattaaaatagaagcagaaaacaacgttgatgggagtttacattatttctttgtttctgcgaacctttatgtatgccttacaatgcaccaggcagcatgcaaggcactttacaggaattgtctcatttaatcctccccaaaaccctgtgagatgggtatattaccctattctacaggtaggacaactgaggttccgagagattagatgattcacccaaagatgcaaaggaccacagacaggcctgggcagaatttatgctcaggtgtgtctgcctccgcgcctatgctcctaatctctacaccagattgcttctcgccttgagactctttaagttgaataacacagatctattggcaaaattctgtctacacctttaattgaatttttccttgagaatacttcctttaatccgcagagatgggtaacataaattaaatactactactatttacagaaatactagttggcttctctgatgacattttacataagctgcaagctgctcttcaactgttgttatgtggtttgaaaatatatttgataaatacaatggttatcactaaagaagaaaagttaaaaataaggtgaaacatatcctatgatcagttttattaaaatttatctcatttctagagtacttctctttcaggggatatatttttaaattataaattcaaacattttctcattaaaaataaaattatttgacaattaaaatttaaactttatagggccagagaaaggagctcaggtgcaaattgtagatcagtgtagtctggctggactagaaggcagctttgcatgagacagtgagtttcaatgtctgagtcttctgaataaaggaaaaaatctgttcctcagtccttatatccaaatactatggtgttaagggaaaaaaacgaaaatagcatcacagttagggcatgcaatatcaactaaatactttcaaagagaaagtaaccaagaatttgagttgtgcgtttgaaattataatcatttattctataaggtatgcaaaaataaattcttaaggatatctacttgtattagtgctataattagttttcattttccacaattgaaaataaatgaaagaggactgaggaagagaaaaaagcagaagtgctgaaataaaattagactattaggcctgatgcggcggctcaggcctgtaatcccagcactttggaaggcagaggtgagtggatcacctgaggtcaggagttcaagatcagcctggctaacaagacgaaaccctgtctctactataaatacaaaaattagctgggcatggtggcaggcgcctgtagtcccagctacttgggaggttgaggcaggagaatcgcttgaacatgagaagcagaggttgcagtgagccgagatcatgccaaaatacataaataaataaataaataaataaaattagactatcaaattttatattagtcttaaaggactcatgctttctactcttcatttttactgcttttgctttttgtggtgcttccagttgcctggcctggccctcaaggatttacatgttagagacagatccttcaagcccattctctaggctctttggtatgacccaggaatgctcataaaactatcagcaagtactgtaagtttggagtttttcatgttccttccttccttccccttcactaagcattagtaattcgttactacaatgttgtttgaacctcactgaatagaatggatgggctgatgtgtcattcagcctaattccagcactcgttttttaaacatctatatatggaacactgattttaatctcgggatgtttctaatatagcttcctttcaagtgtttcactgagaaataaaagtagatgtgtaaaggtcatggaagaatctaaaattaacacagggtggcacatttgagccaactgatgggaaaacagaacgtgagatttagaaaaaattggggtgtgtgtgggaactgaaacacaagctgtaattctgtggttaggattcttgctcctgtcatggatttgtctcatacaggacacatttctcaaggtacactcagaaggatttcaatggaaatattgctaacacattaaaatggtaatgattctccaaccttacagaattaatgctgtgataacgtatttcctgtgtgttttttctaacacggggttccttctacttcctactccatatctacaaacctaacagtttggcaacaccacttagacaatacgaaagtgcacatttgctactagcaactccagttgatgactcacttttcacaaatctgggccaaaactcgccaataaggaaactaaattttattgtcctctatacccttccttaagttaaacaaaaaaatacaacaaaacaaagaaaaaaaatccaaggtgctccagcgtgagtgtgatcgctgccccactgatctgtggagtagcattgctgggcaggctaccatgtgacggtggataaagggatcaccgcagtctaagctgggactttaatttgctttctaaaaatgtatagaaaataaaaacagttttaattgtgaaggaaaaagcactgcatataattcagaaacagcaaaacttccattttgtcaccatcatatgacagatacattttttcacacccacaaaaagatatattagtagatgctaaaagtaaaattactaaattctcctaaattcaagatatgaactcaatcattttatttaaagtctaatatattacaattacaactgctaatgggatatgtaccatatatatagatataaaatatatctatatatatagagagagagactttgtttagtgtgagtattaaaagttttttcagtgcaaacaattgtttaacaaagtcttcattgtatatgatcacaatcagtttagggaattgcataagggtacatatgacattcactttactaaagtagtacttgtatagggctttctcattatgttatgttatgttactttacgttacgttacgttatgttatttatttatttactttttgagacagagtctcactctgtcacccaggctggagtgcagtggcacagtgttggctcactgcaacctccacctcctgagttcaagcgattcttgtgcctcagccttccgagtagctgggattaccactacgcccggctaatttttgtattgctagtagagacggggttttgccatattggccaggctggtattgaactcctgacctcaggtgatccgcccgccactttggtaggtgatcggcttaccaaagtgttgggattacaggcatgaggcactgcgtctggccttcattatgttatttcatttcatccttgtaacaggaagtactagctaaggcaagtatcattagttctgttttttttggaggaaagaactcaagctgagagaggtgagctggtttgtatgtggttatacagagaggaagtgtcgtagtttgactccagggctcctgatggcaggttgggtagcacaagtgcagaggtctatatttaaaatcttctgcgtaactgtaaaattaccagacaataaatttgttttaaaccttcatggagaaaatcttgggacgttcttttatcatgggcatgttttgatactccacctccactgatttttataggtttttacattatatatggagtcaagttgccacttcatggtttgggttagccagaaacttcacctagctttctcatttttcatttcatttcctattgtatatttttgtggataggataccaaaatagcactagaagttaccactgaaattaagcttataaattcttgtgttaatatccggcagttaacagtacatcctcctgacatggtcaggaaaaagcaaaatgaattgacacaaccaatgaatggcatcttgacatttttctagtactttgtgacaactaatttgctgttcactgctaataaactgaggtagtttccttattaaaaatatctgaaggccgggtgtggtggctcatgcctgtaatcccagaactttgggaagccaaggcaggcggatcacagggtcaggagttctagatcagcctggccaacatggtgaaactccgtctctactagaaatacaaaacttagccaggagtgatggcgtgtgcctgtaatcccagctacttgggaggctgaggcacaggaatcacttgaacccgggaggcagacgttgccgtgagctgagattgggccactgcactccagcctgagcaacagagtgagactctttgtctcaaaaaaaaaaaaaagaaagaaagaaagaaagaacaaattaaactttcaagtttatataacttcctctaagtatttcattaaactgctctcttatcaatagctatacatcacggactgttttaaagtactgcttatttctgtcagagaaaaagagttgtaaaccacctacagctactgctatagttataaaaacttcctaagtgtttaataagagactattggtgttatcatataagctattgccactctgactaatttctacagtggcttacttggctataagggcattaggttttgcaaaggaaagactttggtttgagtctctcatttatacttttaagctgtctttgggttaatcatcttatcttccctgttttatctttaaaatagagataaccactctcatctgccaaagaatgatggtgacattagcatatgtcaaaaagtttcacataatgaaaattatagatgttatttgttgttactgttaaatcatacatgaggaacgatgccatctactttgtcatcttcaagtgcaaagtgtacggctgaatagatgacataagcatacccacactcaagcaggcagtggaatctgtattaacagtctctactccaaatcaagaaatatatatgtaaacagacatgtcagcaaggggatacttgatatgttttttctttttaaaagaatcatggctgggtgcagtgactcacgcctgtaatctcagcactttgggaggccgaggcaggtggatcacctgaggtcaggagtttgagaccaacctggccaatatggtgaaaccctgtctctactaaaaatacaaaaattagccaggtgtgatggcaggtgcctgtaatcccagctacttgggaggctgagacaggagaatcacttgaatccaggaggcagaggttgcagtgagccgagatcacgccatcgcactccagcctgggtgacagagtgagactccatctcaaaaaaaaaaaaaaaaagaaaagaaaagaatcactatccctgtgccagacaatagcagatttttaagtgtattctttactaattcaacaggaaaaagccactaggtctgagatccactgagacttgcctagctgacaggcttgttagctattgccaagcttcagtgggggttaggggagtataaaatgaatagtgcgctgatgaggtcaaggaatcttgatagattgtgtgtgtttgcatatccccctcaactcaggctttgctcttgcagacagagggaaatacatgatatttcacaaaatagaaacattcagttttagctctaagtcttgcactagcttttgcttactgggatcccactttatgtacatcagtgattctcaatccccgttaggtactggaatcacctgggaagattttacgagccctaggctgcactccggagatttggatataataataattggtagagtattctaataggcagccaggactgtgaaccaccaatgtggaccagtttgatgttcaagtggacagtgccatctctaccattaggaatgagtactcattatgttggaactggtagcttgagtagtctctgtgtgtatctccatgaagacatagctcagatattgtctttcttctctctgaatttttgtttgaacatttaaattacttctggtgccaataaacctagaattgggagctgagagtgtatttgtggaataaatatcccagtgcgcatttttacaaacaataccttattctttccttctattattgccatgcgctgagtgatgctctcaattctgtttcccatgttgctgtcagcatccaggataaaggactcttcattattggaacaaaagtcacacctattaaaaaaaaaagttgtcacaatgtggctttacagcatggttcagtcaatggggacaggtgaaatgaaaacttggtgtaagtcctcagataacaaagtcacaaattttatgtgtgatcttcttttccttagattttttcctatattcatcctcaaaacttaaaaatagcaaatatatttggctgatacttgaaaaaagccccacactagtgtgtcaccatacatccttttcgttgtaaatgttaatattaaataaaaatgcataaattagaaaatttagtatctagattttagtttttagtggaagtaacattcaaacacggaaaaaatgaagttatgttaatgaataaaaaactcaaggaaatcataccattttatatctataaaaggctggcttttaatcagaatatgcagttggatggctaagtttttccagggctaattaagtgcatatggaaatcaacatcatgaaacagttattaaattcagtctctctctgctcaagttttggggaactgttcaagctctcaggcctcaagtgtttaattataaaataaaggtgttgatgttatttatctttgaggtccatgaattctctctctgttttaaacatttcaccattttgcattctgactttctggactagaatttttttgagcagaaagcttgctggtctctaatttgcacatgtcttgggcagattctacagattttttaaaccaagaggaattttattattattattattattattattattaatattagagacagggtctcactctgtcacctaggctaatgtgcagtggtgcaatcataggtcactgcagcctcgaacctctgggttcaagcaatcctgccgcttcagcctgtagctgggattataggctaagtgaaattttcaagcttcatttccagaaaaaaatgagtggttcatctttagcagccaagagcaggaatgacttatgtgagaggaaaatgagaggctaaagtcagtgagaaaaaggggaagacagaagggaatgtggtcagaaaaacgttccgttactattcctccctggtccttgagctgagaaggaactccagagtgttaaactatcgcatctgcaggggtactggccctgtaacgtcctcctgcagagtactcaccaccttttaagtgctgacttaatggttctgagtccccgctgggccaacagctacaggaggacaggggacaaatcgacgtattcactctgtccccatagctaagcagggcccgagcatgccgtcggcgccccataaacatttgcacacatgcagacaggcacaaggtacccgaagttgtttttgctaagagtttctactttctttaattgtttattattatcaaacacaccgataagtagagagaatagtgtgatacacccccatatacccgccacccagatttcacagttatcaagattttgtcacattggtttcatctaccccttttttttcttctgtattttatttatttatttattttaaaatttttctagcctggccaaatgaaggatttctgtgttttaaaacaaatctcaggcatcttgtcattttagccctatgtacttcagtgcatctctctaaaaaatgagcaaatttttccaatataaccacaacactacttttatacctaagagaattagcaataattccgtggtggtgtttgcacctaaaccgtatatcagatttccccaaatgtttttaaagatgtctgtcttacagttagattacaagatttaaaatttaaaaagaatgaataaaaggtgaccattcctcaaggaatttctgcagtttttaccaggtataaccttataataatcatgaggtaaaataaatgaacattttaatgcttattgataagtagagtaaactgagccaaagagaaattatgtactttctcctttattagaaacatcttaatgacaaagtttaaaagtcattatatgagagtcactttgccttattttttcattatcatattctccattttctagactataacatccccatgttaatcttgcgttagacttgctatctttcacacactcgtattacaggtatgagtgtatataatgtgcacatatacacatgtgtatacctagattagacatttgcatatgtacttgggattgtgacatcaaacagctaaagttctcttgtatctggaagacaagcttttagattgtattccttttcccccaaagcaaggaaaaagatcggggataccttagtcaaagatcttaatttcatactcttgggctttaggaaatgcaaagaaatatgttagagtaaggcaagcctgggtgtttctcaagggaaatacagtctgctatctgagttcacttggggctgttgacctctgacaccccacacctcccccatcccacacccatgactctgagggcagttactaagggcacaagccctagtatggaaactataggccagacttattgccagctcttccacataaaaaggacagattctgtggctattttctaatttaggggctgttatttttccctctttgtaattggggctataaaaatagaatgtcatttagaagccttactatataacagcacttgaaaagagatttagggggaggggaatgtgcctaagccttaagaatacatcaagctcttaaggaagtagattgtgccatgtttgaagatgcaaagataatcactgtgctgggaactgtcttgaggggggaggaagccgaacaacaagaggaaagcagcgttcgctcctgatttcgcacaggaagtccacagcacctcctgccaaagcgagataagaaagctcccatgcactattctggacaaggccactgttatcagcctcagctcggcgctgtcctctctttgctccaagcctccgtccctttcctaatgagctatatgactcctacctccatttgcatacagcatgccaagtacaatggcagggaggtatttataacccctgaaaggaaaaaaaaaattatgggctaagagtgtactccatgtcatctctgctgattgctctggacctgaaacaacttaatttcggactagagattgatataaataaattaaaagaaagcagccaattatgtttccaacacatggagctaggacctcatgtgtgatatgtcagccttctacattccaagtgggagccatctgtggaactccccatctggtctaagttactagtcttcttctcttgacacattatgggaaactgccaccctctatatatgcagatgacactactgacctacatgctttgggttgattttcttgtaacagtgatgaatttgccctcttcccaccacactcaaaagtatttggcttctctgtgaccaaagacagatgaaggcagtctggggccacagaaaaaggcaaagccaacagaggtcaaacctacgatctttctttctttctttttttttttttttctgtcacccaggctggagtgcagtggagcaatcttggcttattacagccttgacctcctgggctcaactgaccctccaacttcagccttccgagtagctgggactacatgtgtgtgccatcatgcgaggataatttttgtatttttagtggagatggggtttaaccatgttgcccaggctggtctcgaactcctgggctcaagcaatctgcctgcctcagcctcccaaggtactgagattacaggtgtgagccaatgctcctggccaaacctaccatcttgacagtattgactgctggcagaatttgtactcagttctggatcatttcagaacctgtgcacttgaccccaacaccataagtaacatgatatccatgtactaccatcatgtgacaagaaattattatgcttcagtacttcttggacatagtaagaaaagacatctcaaatattcagtacacaaataccattactatgttgaggattccatggctttttttttttttagctacttttgcataacatggtcagtctctttccaaaatttgctaaacatctctcatctcacacaaccaaaatatgttgaatgaccagtgcatgcacagtctgcaattacagtttatattacagtttctatgagagctcactttgtcaccctgcagttcctgaattcaagacaggttccattcacctttacaaatccaacactcaatgaagtataatgcacaatgcacacccaaaggtacccctttgtgttcacctgtgctttttcttaattgctggtttttaacaattcttatttttagattttcttcactcctcctgccttcctctcccctccccctacttaaagctcagagctggtactttctttcctttagaggatagattgtcacatctggtggaatcagaagggaaagcccagctgggtgagcgttagctactgatagtaagtattgtgttttctttgaagtggttctcttgtgaggaaatgatcgattctcttggagaattgggtgggatggttcaacacttcatttagcctttctagaaattgcccatctgtttagtgcctgttatggtacccaagactcctatagcaatccagtataaaattctcatttcataaatgatttcctgccagtctaataaccacattgattctagaaggtctgctctacagccttagtcttaagacacacagatttttttaaaaggatcctctttcaataaatgatattaagctggcatttcaaatctctgttgtgccaatatctgattcttggctgcttgaagggaaacaagttttgtgagctgctactatgtgctactaaagcttgggctagaagcaatacacattttgcctcaattagttctcacagtcaccctatgaagcaagcattatgatccttatttcataaatccttttatcaataaggaaactgagactcagaaaaatcaaatgctttgctcaagttcacagggaaaggagcagaattaggatcagaacccagactctcctaactcttcactatcccagagctctgtgcatcacgtagggtgacttctgatcccaagaaacctccccagacctttcccaccatgggagaagtctggctcagagtcacctgttacagaggaaaactctggggggcctctaaattcaaactagcacaaagtcagacaccaggaaaattaaatttatgtttttaagagggagaaagaagatgtgcctgtctatcggtggacaaggacaggggcaaggggcagaagactactttatagttacatttttggcataaattctagttcgttttggtcataaacatgctttgatggtgaaattataggaactctttaccttctactggctgatacattttatcattaaaaaaaaaatctggccaggcgctgtgactcacacctgtaaatcccagcactttgggaggccgaggcaggtggatcacctgaggttgggagttcgagaccagcctgaccaatatggagaaaccctgtctctactaaaaatacaaaaattagctaggtgtggtggcctgcagtccagctactggggaggctgaggcaggagaatcgcttgaacctgggaggtggagtttgcagtgagccaagatcatgccattgcgctccagcctggtcaagaagagcgaaactccatctcaaaaaaaaaaaaaaaaaaaaaacttacaacaaaataaaaccatccaatatttatcacaatttttttctctccttggtaacatatttttgtctgcatgctcagtgagcatgttctgggatgaagctggcctgttttattacaaactccaacactagaatgagtggcccggggacaggagtgtgggtgagtggtgatttgagtacccaacacccgatggctgcctatttgagccagagccattgtctgggaatgaatgtttatataaatgtataatgaaagcacatttaatttggcaacaaagagggtccagaaagttctacaaagtctcaagacagataataatctccttctctttttttcttttttggatgatgaaatctgaggacttgtgtgaactctgcttatctgtttaatgagattgtactgcacgtgctaactgtgattagaatctgtttgtaaagaatattgaatcatttcaagctaggaaacaaaaggatagaggagtaatgaaaagcaaattgaagctgtaaaatgtcttttaaaaaaataggaaggaaaaaaaagcccatctggaaccctgccagagggcacaaccggggctggcccccattatggcggccatcctgtagcagggcctgatgtaaacattcctctgctactgtgggtgtcgtgtcaaaacattagcgattgtgtgtctgagccatcagattaacagaatctgcaaacactatctttcccccttctctttctttttctctttctctttctttctttctttctttcttttctttctttctttctttctctttctttctttctttctttctttctttctttctttctttctttctttctttctttcttctctttctctctctctttctttcttttttgagacggggtctcactgtgttcctcaggctggagtgcagtggcaccatcctggctcactgcaacctccgcctcccaggttcaagcgattctcctgcctcagcctccagagtggctgggattacaggcttgtgccaccacgtctggctaatttttgtatttttagtagagacgggttttgccatgttggccaggctggtctcgaactcctgacctcaagtgatccacccgccttggcctcccaaagtgctggggttacaggagtgaggcaacatcccaggcccctcacgttcttttttttttttttttttttttttgagacggagtctctctctgtcgcccaggctggagtgcagtggcgcgatctcggctcactgcaacctctgcctcccaggattacaggccagagccaccacggccggccacgttctcttaaaacagatgaaacaatataggagagtggatgctggcagaaaaaggcgtagcattggaaggagtgtttagacagaatggttcctgctcctcttgctccaggaaaagggcctgggccttcagggtggtcacagggtcaggctgaggagatcctggaggagtgactttcttgtgcagtgagagaccttgtgacgccttggagctcatactgaaaattacttcttgcctcaatggagaagggggagtggagaagagtttcgggggttgtgggctttgggtcggctccctggacaatggtggaggggatccagcgtcctgggccacctctgtttagataagagcttttccgtgagcgtcttggctcatgctgcttcctgctctcgagggccctgtggtccattcacactcagaacatggcccttcttcccagcctctgcttttccttcctcctggctccttctgctggcttctagagtgagtgccagcaatctccccgccctccaccccccaagccagacactctctccctcccagctccccactctccttcacacagtcttttccagggccaggggatcctcgtggccccgcactggggtaactgaaaggctaaaagagtgggtgtttacttggctacacccagataggagcctcacaggatacctattttgttcattcacttttcttcttagtgaaggactagttggtgaggaagggtgatttgagaaataagaaatctttaaaaaaatattaggagtgcctacaaaaaatatcctttaacacattcaagaaggaggcttaaaatagtagctgcattcactcagtggagaatattttaagctatcattatattttgttctcacaaaaaggaagagaacagcttacttcttatttagtggtcaatactgaaacatccagaaagcttttgggagtggaggtagggaatcacaggttagcataagaaacatagatgttagagctagtcagacctgaggtgaaatcatggttttataacatcctagttatgtaactgtggatgtcaaaaacctgactttgagaatcgtagtcacagaagattgctcagagggcttaccagtcttgttgatttcttgtatcattctaaaattttgtccttagatcacaccagcccacaaaatcacttttaataaattctgctttggtgctatgtcattggccaacattgagggatgttagttaccagagctgacactcactgtggaagaagtgtggtcagggagtttgcctactattagtgtcccgcagcgtatgagagaagaaatcatttctcttggatctcagttctctgaaaggtatcttatgagccccttaattttgcaaatgtttgtttcacttcttctcgctcttgacaactggaaagtaaagcctgtgggccgtaactccatactagtcttacacattttttgacttcaccaaggctgcttagttatgtattgtcctttttgtgaactacctcaaattctttgggaatggatgtgttcttagcatagccaactcaaaaaagcaaccccatgctaccatgtcttactagttttattacaggcactaaaaatgcacacataagggaaataatttaaataaagaattgaaagaagattggtttgacatcagcaaatattagggtgatacttaatgtgtaacacacttagcacagtgcctggcacacaggaaacaaatcattaatgttagttgtcagtttattatctgatttcatcgagagctacttacgtatggacagggactatattttgttcatcattatagctttggtgcctggcccaatcacttgggaaacagtgggtgagcaacacttgtcttttgctcagttaactccctgatgaaagagtggatcctgccaaagaatggccagatgagatgtggacccaatcacacatcagatgtcaaccctacctcacatcagatgtcaaccctgccatctacacttcaatcaagtgtgctgaaaaaggggctctagtgactgtcaaatgacctcacatacacccctgacctaagcactatgtcaccaccatcagcacctctccatttgcaatgatgaatattaatggatacatgggatctgccagggccctggctaacctcagcacagcagtgtcagcacctgacaaacccatagtcatggacagtttcaactcaggcaaggatgctgacatgcaaagcagtgtcatccagtctaatggcaaataggaaactgactggcaatggcctcctcttcttgcctatcttcaaagataggcacaaatattggcttgtcaataatagcaccactttgcccgggtgcggtggctcatgcctgtaatcccagcactttgggaggccaaggcagacggaccacctgaggttgggagttcgagaccagcctgaccaacatggagaaaccctgtctctactaaaaatacaaaaaattagccaggcgtggtggcgcatgcctgtaatcccagctacctgggaggctgaggtaggataattgcttgaacccgggaggcagaggttgcagtgagccaagatcgcgccactgcactccagcctgggcaacaacagcaaaactccatcttaataataataataataataatagcaccattttattcaactaaaacagagtttgctcactcctatctcatgtaagatgtaaaatcacaccccttgcaagaattagatgatttaattccttctgttatttagaaacatatatgtttattgaagagacaagtcaaattcatggaaacatatcagaatacaattgagcacaggcaagtaaaatgacaaaagcccatatactactataggctgaacaagacttgggtgattgaccatttgaatagctgaggtagaattcaccaatgagagtagatccttggatactgtaactcctttgatttcctaaataatctgaaacagccaccatttctggtcccattctgatttctttggaataaacagtcagaggacctgtcccaagatgcaaatatatttcctgggagaacattaacctaatagcatggatcatcttgtcaggacattagtgtgtatatgatgccacttcagagggaagtggctttgcagtgggcagccccagagctgcctaaaagtactagaagtaccaggtacctttcagcaaacaaacttagcactcgcaatgtaccagccactgtgctgagtacttcacacctattatgacatttaacttcctcaaacaaccttatgatgtcagtgctgttaactccatttgtagatgaggaaacccagactcagagaggtggtttattttgcccagaatcatacagccaatggatgccagtaggtggcagagccaggactcaggcaacagagcccacgtccttaaactctaaactatgttgcatctcttgatgtcaccacactggttttcaggattgtgagcttttgatgtcaccctactggttttcaggatcgtgagcttttgactaaaaatgactcattttaatgtctaagtagttgtgacacaaccaatcctggtagtgacaaatgatatgctttcaattgcctggttgatgttgtgctggaaagctgctcactttcaggctctttgacatgttaaccaggactagtgtcctaataagatactcaaactctctacctgatctggaaaatggtaataattctagcatttctcttagagaagttctgtgataattaaatgagatgatgcatataaagcacatatccagcacttaacaccacataggtaaatgcttaataacttagctataaagaaaataaaaataggaaccccaggctatacagcctctatcagccaccatcttctattatatttggctctagatggtctttaagtaccaatttttgttttcctcatcctacgtgttcaagtacttttttcatactcacaagggctgatttgtcaataaggtagcaatcagtgatcatcttatataattttcaatgatgatgacaaggcaaatggaacattaaagacctaagaaattggaataacatgcacccatgtaatgttttttaaaagggtgagtgaaaacccaagactttgattttcaggcatggagggtagagtttctgagatacagtgcgcatactgcaggctgaaggagtgccacaggtagaagaccaccaataataagtctgtgaaagtccatcagcctggaaggagggacaaagtgggcttctggccaatagatagcagaacatccaggcactagccaggtagtgactgcctgcctcaaccattcagcctctactgaaaaaatttcacatcaggtccaaaattacctttccaattttggtttttattttttctcaaccaaatctgatgaaccaaccacattcatctctggcaagttcttttcaactttccaacccgtttgtatgcctgtgttactgcatcacatctttgtccctctccccttccatttaactttccaagatctacccatcctcttcagggcccggatcccacctcctccttggtgcggcctctaaactgcaacattcaccatctaccacccatggtcggctcgtttggccagattataagcacctcccatggagactcaatacagtgttatggtggaaataatagtaaacaggaaatcagagacatgcatctagtcccgagcttgccattaagtagctgtgagatgagataactatttatctttgagccacaatttctcacctataaaacaatctctttttaaaaattaaatctttaacattccttaattccgtttttttttttttgagatgggggtcctgctatgttgcccagggctcctgggttcaaacaatcctcccacatagctaggattacaagagcacgccactgtgcctggctcaacattcttcaatgctgagtgaattaatcgtttgaagtgactaggtcaaggcatgccgaggctgaaattagcagcctctatgtccccatttcattccctcatcaactacaaaccctcatgtttcctccttcattttcttttgacccctccttttcatctcctttaattgctctcctgactaaatagccatgagttttgtgaggcccactgagggctgagtgcttgctgaatcctaatccaggacattaattctgaacaataaatgagagaatggggcttccctgccctgcaagagatcaaatacccctggatggtgggaaaatcacagaaaaggacaatacgaataggggaaagtgccacaataagcaggcccattaactgttagttagacttgccaccctcctgaggctggtcttatttagacctgctcatcccactggagtttatactccagtttctactcccaactgcagatctggggcccaagacagctgtaggtcatcactggttctcaaagatatcatgaaatttgagcccaattcacctatttgctgctcgtctttttctcctttcctctcccatcctctgctcaactctaactcaacagatgggtcagctctaactcacgacagacaagagcaaacctaccaggttaggcaggcgccctcccaaacctattccctgcagacttcagctctttcctctgggaatccacagggatgtcctctgaggagtcctatgggacaccagggaaaaataaccttctggaagaccaatctatctagccccttgtattttatttatttatttatttaagacagggtctcactctgtctcccaggctggagttcagtgacgactgcagcctcaacctcccgggctcaagccttcctcccgtctcagcctcctgagtagctggaaccataggcgcatgtcaccatgcccagctaattttttttatttttatctttttgtagagatggggcctctctatgttgcccagaccggtctctgcaactcctgggctcaactgatcctctcacctcagcctcccaagtgctgggattatagtcatgagccactgtacccagccctccccctttataccataatctgaaaacacctgagaaataactccctgagcttcagttttacttatgggaaaatagggcaagtaatcaccattccgtaaaactgttgttcagattagagataatgtgtgtaaagggatgaacatggcttttggcaccaaaaatgacttattgattaagtctatcacagctattataatgaagtagaccattgcattcaaggtggcaaaacgtcctaggaggcttctagagaaagtatgaagaaacaagggctagtgattagaagctcattaaaaggcactgtcagggccagagtctaaatccatcatgccctttccatcttatcaatccaacaggttctgctttgtcacctaaaagggcactgattttacattaaagtcacatagataccatattttaagaaacaatctaccaagtcagtgaagatatactaaaatgtagatccccaggcagaagtgcatgttttataagtgatttgttctacttatctatcacctaaagatcttgtgtcaggacattagtttctagattcaataataaaaatgctcattcaatttttaaaaatctgtaaatttggccaaagacaatctgagaggttctgccaatcttcttaaggaatcttcacaaattttgtgtcactatcttctggtaacctgagaagctacactgaatcttgctgaaaagatcactataaaaaccatccagcggccgggtgcggtggctcatgcctgtaatcccagcactttgggaggccgaggcggatggatcacgaggtcaggggatcgagaccattctcgctaacatggcgaaaccgcgtctctactaaaattacaaaaaattagccaggtgttgtggcacgcgcctgtagtcccagctacttgggaggctgaggcaggagaatcacttgaacccaggaggcggaggttgcagtgagccgagatcgtgccactgcactccagcttgggcgacagagcaagactccgtctcaaaacaaaaaacaaaaaacatcccgcatagatttcctgtgactcagccttttagtttaatttaaaacacataatgaaatgtttgatagcaattacaggagacagttaactcattagaaacaattattcatcatattcactgtattactaagaagagtgggaaaaggaggaaaatctcacaaagcagagaaaagtggcaaaggggcctttggcaaaagaactcatgctctgttctcaggactttgtatgaaatattaataagggctgttgtccgaacagtcacattaagcagcatgcacttcctcgtccagtaattatataacagaatgcaagaagtttctcattagtaagtgaacattcacttttggcttgtgatgaaagcctcctgtataagatggccagttttatttggctgtttgttcaagctcaaagtcctgctaaagtggtctttggtcaagtggtcttctttaaagtcctcattttgattcaaggttttgtttgtggtaaattaaaattctctgtagcatggctgaattgaggctgcatacccagacacacactgcatagaatatatgttgagacacatggatggatacaaattgtatgtgtacttaggaagaatgtgatcaatattaaaacatgaggtatgtgaccgtatttccaaaagaagaggtcttaaattatagcttccctcagacatctgacctacattttgcccccaggaaatgttgactttttcaatttttatagtgttaaaactttcattgtgtaggtggaaaataaaatatgggacataaaactgttacagcataaaaataatagacattcatgttggcagtcaattaaatttgggtctttgagtacatttctaattaactaccattaacaattgtcttgtttctgtcctgttaattttacataccccactgatgcgccaaactatgtttcccccaaatgatctatccctaacacatccctaatgactcaggccctcctttctttgccaatttgctgacgtaaacaatagagaaatgcaattaggcaagcccctctcggaagcccttctcagagttcctagatgcctctgcttttctgtgatattgtaggccaccccaccccccatccccggatggaaggcagtaaaccacccttactcttagagtggtcagctttctcttgacaccatccaccccagccccccatagtactctactgctggtgcacacgaagagtgtttcagacatgagatgtcacattgtcattgagaatggcgggaaacattattttctagttaacttctaaagcatgtaactattttagactccagtcctgacctacttttagagttttgcaagcggttccttgagagtccatgcatgtctactagatttttcttagaaaaccccccattttatctaagaaagccaaaagaataatgttctccctcaaccttccatgagttgagaacccaacatttttcacaccctgaagggactcatctgcagaagagcaaataaagcaggcaaagctttagagctaactgggcagagaatgagcatgccttcatttgtttgggctggatcgaggctggcaaggtggtccaggttggcactgcggaaaatacggcttggccccaatggtggaggagctgctgcacttttttttttccttactgggcccttattaacattataatcacagagtcagttttgtatcacagagtttgtacctccatttaagacttttctgacagccattctactttcataagttgaaattttctgttaatttgttaccgatcctcagagttaatggtcaaattgccttacagtttacaagaaacagaagggaaacatcagtgtgcaaacactgggaaatactttcaagcccttttgaaggaagaaaatataatttacagtgattttctaagttaactcattcatagctgtgtatgataggaaaggggaagcacgaccattgccatttacagaaggggaaatagaaacacagattaaagaactggccaaggtcacacagaagtcagggacggtgccaagaatagaacttgcttccttgattcccaattctctatccttgggaggatgtagtagatattttacagatacatatatagatccaataagtaatcaccaaatatgtttaatcttgtataatgcaaacataaatgctaaagacaagtggtattacctttatgttttacacgtggttggtgcctaataaatatttgtgtgatgagcagatggttgacagtatatttagattgaatatcagtgacgtgccaagttgctttgtaagatgtcagcaatattaatgcaatgtagacagaaatgtttctctacatattttgactagttatcacagatagcttataaagaaaacgagttttttcacaaagaacccgatgttacctaagtttttttcccatgagtggggaataacttagtacgtggtacaactctgtctattataatcaatcagtgttacttcttcctttgaaactatgatttgtgataattatatagggagagagaattaaactggactgtgatctaaagaatgtgtgctctcaaaacaaaactgcagtaatcaaaggctgcaggcattgaacctccctagaataaagacccaaacacattcaacattttagaaacagatctttgttttagaaagaagaaaagacaatccagaaacaaccaggtggactctagacacccatggaggaggtgatcagagctcatgagagtaccaggaaggagatcagcagaagccccccaccatcccgtttgtggggaacagatgagcgcaaagacccattcaggccacacaattgtccagtcagctacccgagggtctccttggtattcaagcacacgtaaagaaaagtagactttcaacatcttagattcttcctgagaaaacagtgatctgcagcacaaactgattatgccaagactgtccttgccctatcctctcctgggttcctgaaatccaccctttccattccacagagaaggtccccttccctccagtcctgtattattattgttcctttagaaaccaaccaacctccttgccatggacaatcttatctaaatagtatctcctgtgaggctgcatcagtactctggcagagttcatggaggactgtaagatcaagcggagctcagtccttggggggtttactcgtactacttagttgttcaaaatgcaggcggaacgtgaagttctagaaattgaaagtggactggctgagcaggcatcagctcccccacatgcccagtcagcccaccccagcctcagccaacccacagggcagaaccacttcctctcatgacaggaaaccaatgaatggggcaggccacacgaactgggagaattacttcattccctcatgacacccttccatttactcttccttttacttttgtctaactcttctgtagttccttaatttttcttcttctgaaaagtcatattttcctgaattccacagccaccctccaccccagacctactaaattactattcttaaagcacaacaaaactgcattttacattccataatttgcattcatttcttagaaatgtttggcaaaactgctcactgttgtcaaactagctctatagtaggcagaaatatcctttaagttcattaaaggttctcaggtcttatttaaagaaatgtaccccaatgctagcaatgattacaaccttgcaaatctgtggtgctctgtaactttctaaatacattacctcattcgatcctcatagtctctctatgaagtgtatatcattatctttactttatatgagcagaggctgcaagctatagacatgtggaaggcactatatgcttaacatccttatgatgctctctggctttttgctcagactcatgggagcaggtttaggaatatctatttagaagtctacctgttggctgaggatgagaaaaataaaatattccaccttattcagtgttgataacttattttggtgttattaatattcaaaagagatatcacagttttattatcacttttcttttctttctttttcttttttttctgaagcggagtttcgctcttgttgcccaggctggagtgcagtggtgcgatctcagctcattgcaacctccacctcccaggttcaagcaattgtccctgagcagctggaattataggtgcctgccaccgctcctggctaatttttgtattttaagtagtggcggggtttcattatgttgcccaggctggtctcaaactcccgacctcaggtgatcctcctgccttggcctcccaaggtgttgggattacaggtatgagccactgcacctggccccactttcctttttttaattaaaaaaaaaactaaaaagggaaagattctgctttatttcttcttggttcattacctgtatgagtttaaaagtaatcatcctttccctcctctcttttattcctaatgttttataagaacaaattctaggcaaaacgaaagccacaatattactcagtcaaaacttagctcgccttcatagcatattttactactttttttttaaagggtgacattttcagttgaactatcggtagttataataacttaacatatttacatatttattagactctaagacactaaataatttgagttaggtctgaacctctttctatagtagatacattaactgtctggccatattaaaccaattaatagttttgagctccttaaacaagtacattctgtcctcaaactaagcgaatgctttggccgtggatatacatagatacgccctttcactagagcctaaaatttaaatgccaggaattattctacgtatttgagagtaatgtgcatatattagtcacccaatctcttttgatgatcatgtatagacaccagtatgcaaatatgttaccatataactcaaaataagtgcaatggagcatttcttactcatgtgttactaaaattcctgtctacaactgaatctaagttagtctaagtgtatataaatatgtttatataaagacatatttgagaacttttggtaattaaagagggtttcatttatctataaattttagcttcatctctctgagagggtgaaagagtggttctgtttattttctggtgtacaaagtttctacatatatttctgaaacacctctaagttaactgtactgatttaaccaccaagcaccaaatctgggcctcacacaggtaggctactcaattagtacctgctgactaatgtacatcgagctgtcattcttgtacatcaaagatgtgtacgtttttggcagataatttcaagcagcaacgtattaaagaaataaagcatatgcaaccttaaacttccatttgtgatcagtcttgtaagtagtgaaaaaaaatgccttgaacagagaataattcaaatggccaacaaacatttaaggtaatgctctgagtcttgagaccattctgaaaggaataagacatgttttcaggccttggcgaacttattccatcacacagaagagagatcccttacaccacaaagaaattggaaagaaagctaatgtttacaaagttccattcgaggtggcctcattccccaaaccatattttattagcatcacttaaacccaaatttataaatattatgttctatcaccataattgttattttctaacatagttactagttctaatcctagatagaatagaaattttagatttaatattgccaaaacaaaatttaaatatatttagaaaaggctctgttattccagaaaaattcaactctacacttttatccgaatctaatagcttcaattatttagttttttttttatttatttgcatgttaggttggcacatatgtcaagaccctaaacggatgggtcgataaatattgatgcataccccaaatttgcaaaatagtatagaatttcagtagatctcactgtcttatgtgttaaacattcacagtggtaaagaagatatttaagatttgtaagtcttctctatttctattcttagaaaatgacagtcaaatgagaaatcagatgtgtggaaaacagctacttcccaggaattccatagctcaccagtaactttccactctgagagtaatacaccctaagcaaaacgagttggaattgtgggaagaatctagaaaatcaaatagccacttctatctgtttatgttaggattatgctttgtttacttttcctgtcaatctttttttttttttttttttgaataacaatcctcctgaacactctgcaagtggagttaaaagtaataaggaaaatagtttggcataatgataatccttgggcagtttcaataatatcttattgttgcacctatcaagtctattcctgttcttcaaattagctcccataaactatccttagtatcatccctctagactaaacaaaaagaggaaaaagcaaacaaggctcagtcatcaacaggatgcaaggaaatgctgcacaattagcagagggtagggatgtattcatttagcaaatatacactaagtatctactgtgtgccagccttggcccagcctaaagacacaagggtgctctcaatcagctcttagcttagagagagacaaacctttgcgcatcgagtgatgtaacaagggcgtgaacaaagtgctgttcatactgagggggaagaagtgattctgaatgaggcagtgaggagagttcacagagaaggtgacgtaagagctgagccatggggtttgataaataaagccctcttaggaggcaggcaatgggtggaggtgcatttcagacagatggaagagcaaagcccaaaagtaggaaacatagtgatcactggtgttgggaagaacttggatcataaccaaagaatacaaaatgaaaaatgggaatgctaatgcaactgacatagtggtattgccaaagtctagggatcttcagttgagaaacaggagaccagagttccaacctgagctcatgtcacagctcatgggaggaccttagttttgtgcttgtgcttctaaaactgtaaactagagagaaaaattatgaaattgttagccagtgatagggtatattcagtaagaaagaagagtagctgttgcccacctttttccaaggcagggagagcctttgcctcaaatatacagtacatcccacatgcagattcccatctgcgtccattaaaaaatcttaattccaggtgtcaaaaagtatttgaaagttagtaaaaaaactgactgtccctaccttgcttcggaatgattatggttacaggggtgccagaaccacttgattgtaggttgagggataccatatgcggtacaagtcaggatttgtctgctgcccagtgggtagagagccgggtctggaaacgatgacacggccttttcgtaaatctggggtttcactggaaaggagatgaagaacgggacagaagtcaagagcagttctaatgactttctcctgggccacacatgaaggaccacattctcactggctttgatgtcagggaaacaaacaagaaacaaaaaaacaaataaaccctcctatttgtcaagaaaatgcagatttttaaaagtagtagcagggttttgagattattaataatttgattccatggtatgtacattgtgattacagtgataaaagatcatgccgcctatggaatacaacaaacaaacacgagattgttaagatgggaacttaacgttaagtgttttttcaaatgattatttgaaattttgctatctttgatgttgttacgctgatttttgaattcataaatgttcactaatttgttgcctaccagaaccagaagaaagtatgaacagcaaacttaccattgacaattagagtggcagtgaggtttttaaacacatttgactgttttatgctcagcaagattgtataattccctgcatcctcttcagttacgtccttgataattaacgagtagccacgagtcaaatagcgagcagatttctcagtcgcaggtaacccatcttttaacctgtggttaaaaacatgatcagtaagtcatttcacacggcctctcaatatcactttgataacacggtcattgaagtttttgagctcaagttgaccaatttcaaacctttgatcatcagtgttgatttttaaaatgtaggcattaacttttgagtaaaggcagatatgatttttagactgggtaacacttcatatttattggcaaggaagaagaaataaagcgagcgaagatagaaaagcagtagcttagtgtgcccacaggcatactggtggccactgtgacttaagtattaacccagaagcaggggctctgattccatccgagatgtttttcagagttttccacgaggctccatcagcagtataagggccattgtaagtcagatcaagtagatcacttctccagataaaaataaaaatagacttttctattgtggtctcatgtggagttcttattagttttataaatggtcacaccagttgtccctttcataaactagagtgaaatcaagactatcaagatttttcctctgaggaagaacagttaaggcacagaaaaaaaaaaaacagaaagcataaacttaaagaaattttaaaaacgtattaaatactgaatcgatgcattgatatcactctgttgcacacagaactgagagtcagaggcttgggtgcttgacctggctctgctactcactgcaggctgctgcaaatgtgactaaccagtttgggctccaattttctcaaattttctagaggttctcaaagtttccttataactctaaaattctatgatttcattaaaatgcatggttctttaaataggcagttttaatccattaggagtttcttgtgttctgtataaaggtttaatattgggaacttagttcattatcatgcatgattataaagtcctacaaacaaattcccattactagtgtgtctcagatccaaagtaattaaaatgaggatgctacactttgtgattacaaatattgtcttggtattactttaaattatttcctacaacaagtcagcatttttgacggtggattgaatttttttttaatgcccttgctacttagttactgaagaaatcaacactaacagatgagcgtgccctcagacactggaagagtgaatgtacctcctggagtcatcagattactattcaatttactattaaacctaaaaatttactactaaacgtttttgatattctgaagcaaaaaagatcatttttctactgcaatggcatgaagacatagcacaaagttaaaattttctctttaattccctattaagtatttgagggaactgcaaacaaacactgccctcatatgacattgaaagccaaatcagctctggttagggagattctaaaatggcgccacatccctattgtatggattgttttgctaatcagttttgtactataccctttgtttaaaatgtaatgacttgagccaaagatattggcatttaacagtaattttgtaaaatgattgcagatcataaacagattacattgttttacatcaggtgttgtaccagtgttttaaaaaacaactgctgaaggaggttttgaatatgtatctttctagccaaaaaaaacttaattagttcaaataggccccatcgtccccctcttcaaatgagtaagtcttgtctctattaatgtttgtttaattttaaaacaggactggaactttcaacccagctgtatataaaagaattattttcagcattctcattacaagagcccacttcttcagggttaatagagcatgttacatattcaaaatgcttcctagtcattgctcaacacatcccattcaaagaatgttgacatcataggaaggtttagagatgcagaaagttagccacagtaagagactagactgaagcgagcactcaaacaaacctcatctctcgcttaccttgctacattatttccttttccccagcccttctcacctccaccacccaagaatctacagagttctgagctctctggggctgtctgaggaacgtctcttggtattttgtcaggaattcgagtcattaggctcttgcagcttcccacttacaaagtatgtcttaaactgttatggaaataaggatggtcctaccatacaacttccggcgagggaaatgccttcactttcatagagagccggtaagaccgcttgccagctacggtttcaagcacctgctgttttcgatgtttcacagtgatgaatgctttatctttgaaaggagaagtgatacatacattagaaaagaataatttccataaacaaaaccttagggcctcattcagggagggtgtaatcaatgagtaaataaacagagctgaattatgatagagcctatcaatgagcccaaatgttgatcatgaataggatactttaaaagcactgtaattggtgaacgcctttcaaatcaaatggtatcacgtcctagccacataaaacagtggcagagcaacagaaagtgaaacaccttaaatatctctatcacaataacaaagaagtgggaagatatttctaaaaatctacctggccactataagcaaggtgagaaaaagttgctctgtacaccctaaaacaaccaatttgatatcaaaaatcaactggagaaagacaaaaggaaataaaggctactgatagaattgttccatagtttctgccctccacactgtttccttttcagcaatggaaataaggtctttaagcattttctttatagaatttgcatactgaaattaagcaacagcattaggattccttgagagtaaaagcaggaataaaatagcattaattctaaatgatttagcataccatatttttatttctctaattcatggtagtacctgagaaatttttcttagataataaagataaaactcatcatctttttctgttttgtttatacagaacactaagaatttcataaatatattaggttctaaccgaattattagccataataagcatctaaagaaaggactctctgttcaattcaaaagtattaaatgtaaagagtacttaatgtggtttgctttttgacagggggaggagggaaccatggccaagctgtattcattcatgataatgtaactcttggccaacagaaaactgacttatttagagaacacagacatctacaatgattagaaagcatagcatgagttggcaacgctgaactatgcttaccatatatatgcactgaggtgttaacagatttgaatgatggtccactccttacacgacaagtataaagtcctttgtctttgttctgcattttgtcaatagtaagaacactgtagaatatgttggcatgggaattgctttggtcaattcgtcgccttacggaagctctcttatttttctagaaagaaaatgtataacaaatgtagaaggagtgagtgttcatgcttaaagttatataggattttaacatttcttagatcattagttcgacaacagcttctgttttatactaagaatcatgtcaaatccacctagagcgtaatgtttggaaactacatctgtgtctagaggtgcttcaaatatgtagcatagcaggatttatttagcacttaattttcttcaaatacactttcacatatactatctcaattgtttgtcccaacaacctaatgagattggcaggctgactgcccttttagtgatgaaaaaactgaaggaagtgataccctggcccaagttggctaggaactgaagttgtttgagcataaatctagtgtccttcctctggcacacacacctctctacacagtaacctgttccctaggcatagatatcgcacacaaacgtggacaatcataagccttagttagtgtctggcttaatgacagtgcttctctcaccaaatcaccatgtgagtttccttttttgtccctacgagatatgaaggaaaatataatgagtcttggctgtacttactaaggtggaataatgctatagtttcattatttcactatttgaacagtgcttgcccatgtcagctaaatcacagtaaatggatctttaaccaagacttggaaggtgctgtcccaggtttgtctcagagaagatcaagaattagccttaggctctgcaatctgacctggccacaatgacagtcctgctcactgttttgagaagacaagatcacattgccgtctccttttttttttaagcactatattttataactaataagttatttccacctctcaatccttccccatagtcatagggggcggaggggaggagcatggaaaaatgtctttgggagctgtccagaactgatttttggatcttgagcttagttctcctctgtgccacgtttaatacacttctacccacctgtccttttacttccccattggaacagacagacacatgttgaggccattttcttcattctcagcaataaccagagagaaaagtcaattgccactatcaaaagtcagagaactagtcccctaacgtaacagactgagggagctttctgcagctctatttatacaggtactacttcctttgccaagctgagtaacactggtattgcttctgacttgggaaagaactcatcctgtgttttagaattgcttcgcccagtactgcagccaccagccacgtgtggctattaaaattaaatgaaatcaaaaattcatttcctcagtcacactagtcacatttcaagtgctcatctgccatatgtggctagtggcacagtactggagcacaaatacgggatatttccatcacagaaagttctgctggacagtgctgttttagaagattattagcatttaatagatgtgttgtagatactcttacttacagcagcaatgctagcaggataaaagtttcttccctcttggcacttacggagaatatttgatttctattaaaacccagaaaatattgctacaagccatagcatttttatttaaatgaaacaatacctctcctagagaatagtttatgactgataagtccttaatgtgtccctacagggcactcgttacacgtttttgttgctaagttattccatttccatggcgagaaatgtcgatgaaaaacaacactagcttgaggctgatgcattaatctttcatacataatttaatcataaattgactttgtaattgggcaatctgaacgacataacaaatgattgtacttgagatatgccgcataaatcatgctgacacacaagaaatgggggctagaactactgtcaaaatttccgtaacagtttatcatagtttccccatctatacatttttaaaacaattattgtttgcaaggatgttcgatttgaataagggaacccaacgcaggcttcattcttctcatttttctgaaggacagaattgctcccctgacacttaacaaatggaatattggatggctgggttgtaatatcttttccaaacatgctccaatcaggtgcctgactgtctgccagtatcttaaatgaatgcgctgacagagacagcctcctggaaagttgttgttgttgttacaaaaggcagtccctgcctggcatttggtgataaatttctctctcatctctaaatcctacagagtagtttccaagaatgaaacaatcccttttcttccacctagaatcatgcaatagaaataccagtctacactcttcaaaacaaaacccccagacatcaaaagacagtatctatgcatatcacactcatgaaatgccaggcaaagaaagcactcaaaccaaacccaaagcttctttattgactaacactgccacaggagtcaggattttctgatttttcccatctcaaaacccctgcgggatttcacttgcttaaaatactgtcctgcagaagaaatagaaaaatgggtcactcacttcatcagggtaactccaggtcatttgaactctcgtgttcaagggagtggtagcagtacaattgaggacaagagtatggcctctaagtaatttgactgggcgtggtgtgcttatttggacatctatgattgtattggctgcaagcataagagagaaattttttaaaattaagatttcattacacagataaaaatacagagcacttcggcttatgttcatgcctttgaagcatcacttactttgtcgatgtgtgagatagtttgtcttatacaaatgcccattgactgttgcttcacaggtcagaagccctatttctttgtacgttgcatttgatatgatgaagccctttctactgtcccagattatgcgttttccatcagggatcaaagtgtcaagtggaaactgaaaaggaagaggcatgcattaacaaggtcctattagcactggttggcaatactgtttcaccagcagtttgtgaaaacatgatttttcatctaaaatgaaaatagtaaaactttgtagtttgcttataacaaactaggttaaaaactctagtttgttataattggttcttgagtttttttgcatatagcaaaagatatttgcattatgataaattatagtaattatgataatttactatcagccttggcaacaagtggcatctacccaggatagacctacttgtcatgtcagactttcagttggagcccataactctttggcctccgggaatcttcataataagctggtcagacactcaatagacaaaccaattaagaggccgggcgtggtggctcacgcctgtaattccagtactttgggaggccgaggtgggcggatcacctgaggttagcagttagagaccagcctggccaacatggtgaaaccccgtctctactagaaatacaaaaattagctgggcattgtggcaggcgcctgtaatcccagcctctcgggaggctgaggcaggagaatcgcttgaacccgggaggcagaggttgcagtgagctgagatcacaccactgcactccagcctgggtgatagaacgagactctgtctcaaaaacagagagagaaaccaattagcattttttttctaccggggctgccagattattctcatttgttttcatcatccagcgcttttaacaagccatagtttttcctcccattttgcatagtttactgaagaagtggctgtcttcaaaagagtgtaaataattccaggtcctccaagattcataacattaactcagcactcactggggctgtcattctgacgatcctgctgtgtcacaaggaaggcatcagctctgcctctggaaaggaaactcccagaagctgaagctgctgatggtgaaggcagcctcggaggccagagactctgcaatgaatgaagtgctctctaatgctcagaagtattcccaagcacggtgagtccaaacagaagaaaataatccatgatctgactttctccttatgccttcttctgacatcaagaatgtaacatttaaagactacaagataaacactctgccttgggattaaactttatttataaagggtcattgctccataaagtggcccagccaaattcccctgatgccaggttgccagcccaatttcagtggtggtagactcccaactaccactattccttattcccagttgaaaaagggggaaaaaaatcaaattaccttcccccaacagattataaaggaaataccaaacagccacaaagaagctcgaaaccttttctatcgccttttaaaaagtacacctggcatccctcgctctatccagttatcatttatttctattgcttgctgaaggcgctgatctggatttgtgatcctatggcagagatttctagtccagaagccactagtgcctctcttccagggactatgcctacatcggaatgtattaccggtgttccttgggtttgaaattaattacatcctgtttatgaagaactgaaagcaattaaaggattcgctttcatgtttcagtaaatcaaggtgctacctgtaaactcaggaatgcagtcggtgggaaaaaaagaaccttctcttctaatttagtgcaagcaaaggaaaaacccagaaaaatttaagtcagggactgaaatctatggtactttacaaataagtgaaaacaagcatgtgctgaatctaaaagaaaggattgctgacagacgtcctcagtacaacttaaaaatacactaaaatttcctccgaagtgtttctcttactctcatctatccattacggctgttagtagcattccattgacaaagtaactttacatttagctgacaagatctaaagcagtcaaagactgtagcccatcagctgtggccaccaccgcatgtgtaagaatgaaggcagatgggcaggtggatctcagcctcgaaaggaagccctgggcagcaaggcctgtctgcagctgaccatggctccgacaaagcaggcatgtgaaaaggagagggaggggacagaaaattagaagaaaagggacaataagagaaatgaaagggaaagatattaacttcatgtcagcagaaatacgtcataggttagaatatttccagtatatatgtgccaaaccaaaatccctgtgaaaattttacacttctctttctctctttttaaattgtgcactccagatcgtaggcagaaaaaacagtaaatagactcccaccagccccagatttttatatgggaattttggaatgctcctgatgaccaaacaacccatctgcattagcgctcccatgaaagagaacgtttccctctccacgtggtgttttccatattaatcatacagcaataattatctcagactaatgggagtaatgccatgctattgaaaacatgacttggtaatataccaagtacagtattgggtgttaaactgttaaataatgctaaagctaacccttgaatagggctgatcttgtacttagatactgttctaagtgctttccatatatcacctgacttaagttttctaacagcaatgtgaggtggtactattgtcattacccccttcctcagatggggagagtgaggtggagagaggtttgataactcattagtttgcccagtgacaagtgcagtatgttcagagtgcaggcaatgtggcaccagcctctgctcttaaccacacttgtcttcctcctatatgaactagaccattcaagaaggatggcaggaacactgaatgagaaggcaaggtattggctcaaatgcccagtatgacctgcgaagttcctgacactctggaaaccagggtgtttttatcttgaccaactgaggagttcaactcctctggcgtttccagctctgctgtataatgactttctatttcctggcgatggcacacaaatgtagtggaggccaaaacctgtctctgatggactatgttgaaggcctacgtgagtaacaacccaggagagtgaatgcaaggaaagaggataaggagaatcctccaccacatttcaggactcagggttgatgggtgagactgaacatcattctctgaacttttccagcctaactgccacagctaccagcaccaaacacttcctgagtgcctgctctgtgatgcactgtgcgaggtgctgctctggggcggacttgactttctctcttaaagttctaagctctcagaacttagcacagttttccgtttggggagcttttatccagttctgagtcctggtatactcctaactcttactgctgattaattagctagaatgtcataggtttagtttttgtctttattagattctaccctaaatcttttacctttccatatgtacaatttacaatatagtatgaagaaaagtttcacgtatggccttctttcctccctttttccctaagagatgaagtttgggtgctcagcaggagacaggccttttatcacaaggaacttgccaattcaaaccaaacgtgctggctccttatgcatgaagccagaacatatcgatgcctggagaactgggcaccctgctgacattctgtcttctctgcagtaatctggataatccactctctgcaaagttattaatttgtgtaagcagcagaattgatttttctcacatttgcacacagttgggtttgtggcaatacataacatttttcacgatttcagttctttcattattcacatcgatttatgcttaagacaccatcattttattctatttaaccacatgcatggacataacttctagcactattccttatagtaaaaggatgttacaggaaagtccactgagaagcccaggtgtttgtaaggaaattattccagaaagatagaacgagtaaaacttcattatgcttatttgcagtgaaagtatgctgagaatagcggtgttcaaatttaccttttttaaagtaacagtgatgttaggtgacgtaacccggcagggaatgacgagctcccttccttcagtcatgtgtataatttcggggatttcactgtacatctctacgaaaggtctacctgtatctgaatgagaagaaaatgaaaaaaatatatacataaatgattgacatgcaagcatctagacactgtagctagtgtggtatggtaggcattgccacagtcacgtcattctcccttaatgtaatccatacattcacatctttgtctctgaatttggccctctgtgtttctacccagaaaaagaaagcttccctaataaaacctaatttcatatctgttgttggcctctgatcagattgccccaataccttaatatgcaatgtggtatggggggaccactgtgggaaaaagcctaaaagtgcagtaggagagaaaggagaaaattctgcatagacttctcaccacagctatgctaagtgcctcaggaagcgccctccagagcctttgtaagtgctcaaagggcatagatgcagtggcgaaggtcaactctctttggagaattcaaggtgatgcagaagtctagcaagttgaggagaggattatcatttgaatgacagaagcatgacttaaaggttttctagacttttcctcggaggctaataataatgaatgagaaggtctgagctgcttagggggaggcggacaggccggagaagctgtgttgaatgctgcatttatttcatatgtatattaggcttatttctttagtatgcgctacttacctgctaatagcaaagtctgtgcaagtgcctgcagagaagtctggaaaagactttaagcaccaatacttccttaaaaagcgtggcatttggccagtctcagaggcaaggaggattcaaacacctgttcagcttccctgtaactcctcagggaaccagaatgagtccaagatccttttagaaacattctcagtctaccctgcccttgccctcgggaatctattgacatcctcaggcaacgatctcttcgggagtcattgtgttctgatcgtcccgcatttgttccagccttatatactaaatggaaagaagtcctgtgtgaactctctccatttggacctgaaagaaccaaccaggcccccacctgcttgctggtcctgcctcaggtttgtggattacgaagctaattcaggatgctgaatggagaaggaattggagagaaacaaaagcagtaagcaggcaatggttgcccagactagatggtggctacagtgatcattatggtagaactgtgtccccaccaaaacgatatgctgaagtcctaacccccctgtacttctgaatgtaacctcatttgaaaacaggattgttgcaaatgtaattgcttaagctaagtaagggagggctcctcatccaatgtgattagcatccttgtaagaaggcagtcatgtgaagacagacagggtgtgcagactcgcactatgtgcagatggaggcagagacaggtgtgatgcagcggcaagccaaagaatgccaaggattgcgggcaaccaccagcatgtaggaagaggcgagggagggttcttctgcaggtttcagaaggggcatggcccagatgatttgatttcagacttagagtttccagaactgtgagataatacatttctgtagttttaagccaaaaaagaaaaaaaagtgggccattgctgtagcctgctgaagatgggatagttttctgcacagcagtgtggaatggaggcacagatgtgagctctagagagaccctttcaccacagcccatcttgtgtggtccctggcacctatatgttaattattcccactcatcctccgggaagccttgctagcccccttccttcctgcacccttctccaccctagcccacattagggactttcccagtgttcccattgattctgttacaacacggtccacagaaccagcagtttttttctctgggtactccttggatgctacattcctagaggagaggaaatggattgtattcatgtctgtctcatgtgtactgaatgaatgagtgaacgggtatccaaccccgtccttttacagatgagaaaagaggcacaaacaggtgaaatgagttgtctagatgggcacagccaggcctgtaggccagttacttctgcctccaatctagagccccttccctggcggcaccctgaaggctgaacctctggctacgttctcttgaaggcccccatagaaagggctgccagcaggtgacaatggtttttcagagatgaaggctgatttccacacattcagtgggaaagtaagtgcctcatggtactgcatagtgttggagaaattctgaaaaagggctgaacaccaaggcatggtgtgtgagagcaggctttggggcaggctttgagtcggagggaggtggttcagagtacgcctcaaagcctgggtttaatcctggctgtggtcctgtgtaactgtgagaccttggggaaatcattataccctctgtgcctcatttgtaaaatctaagtgaaagggctatgatgaggattacatgaattaatatatgtaaagcacttagaatgatgcctggcaaatagttagctgttaattttcttattattattatgactcatttgaacttatgaacaaagtgttagagttggcagttaggcagacatgagtgggacaggagagtgcccctcctcccaagaatgtcaggtgaccatcaggtgatggtcaggtggttattaaactgtctttctaaaataataattagtcacagctggcaccagagaccgtctcccaacagataggaaacacctgaagctggtgatcagcagcttcctgataagatctcagaagttgggggagcaggctcaagcatgcacactcaaaggcaaaatggcacagtttaaccggtatatgactttcctctgtgaatgctcaactggtaagggaaaaacacctcaagtgagcacaaacacaacttcagtaaacacagtgcgcatgtggctcctcccaggtgctggcaggccactgtgcatgtggacagcccatcccaaaggaaaaatcaggggaaaataaacacaaacccttgaatctctccagttgcctgcttggccctctgccaagtgtagtttgcttcctctcattcctgctctaaaactgtttaataaactctcgctcctgctctaaaatttgcctcagtctctccctctgccttacacctactaatgcccttggctgaattccttcctccaaggaggcaaggatcaagttgctgtagacccatacagattcgctgctggtaccagtaggtagatatgaaaatcacaaattatactcatcatcttaactatcaaaaatataaatatatattgatatagtggcataggaaaaaggattggaaacaaacatactaaaattttaagagccaggtgcagtggctcacacctgtagtctcagcactttgggaggctgaggcaggaggatcacttgaggccaagagtttgagaccagcctgggcaacatagcaagatcccttctctgcccaaaaaaagttaaaaatgattatctttgggtgttggctttatggattattgttgttcttatttaccttcttctatatttgtcagtctttctagaatgatcatgcattattttatagtaatatttttaattattaaagttaaaactcaaatgataaagctccatccatttttgcttaaggaaaactataaattttgcatttgatttacctgagtttcatcctctataatagaatgagacattaactgtcacagttaataaacttatgtgtttattaggaaatctcagtgggtgtagtaacatatgcagagagaaaaagttaatcagatagacacaagggtttcttatcagaattaaattcttcctttaaataaagttgctgagctagacattcagccatggactattgggatttgatcattcctttccttcctcttgtgagtctatatttttgtctcttttgtgcatcccaaggtaaacacaaacactaagaaatggtttaattcatttaactaaattgtaaatccttcatatttaatttactgtctccttaagcaactgttttcaacaaaggacactggcacaaaaagttcctacaggagataataaaatcagtgtagtcatttctagactaatgaataccaatcccaaatgaaaatagaaaaggttaattcaacatatctttgaatttcttctttccctttggtactgtggatccccaaaaaacttaaattttactacagctattggcctctaaaagccaataccaatttcagcactgggtccactgaaattctatccgaagatatcagaacttcagtgatttgtgtccctccaaacactatgcaaaacacattatttgtgtgacagtcaaaagtggcattataaatccactgtgtttgcaaatgagcatatgactgtagatacacacacacacacacacacacacacacacacgaacacacgaacaatactctctgggcttattaatagtatatttcctctgcaatttacttcaaggaagggctaagaatgaatttgcctgacatataataatacaaacatattttgttttgtaggaccatagatatagaagaggtcacggttccattaatatcaccagtaaaaccacttactactcccgtaggacacatctgtctttgtcacaaaattaaaaatgacttccaatcccagccagcactgcagagtgatttcctgagaccaaattggctggttgttgaaagagtgaggaagagctgctccaaagactgccggtgtactggcagctcagacacactgtcaccagggactcatgccaacactcagctaggtggaggtcacactgccctcacctctctgaactcttagagctcaaagcagtgacaggaaactggcatagaatatgaggttttctcacccactgggagtatctgggctgtcacctatccttcaggacaacaagtgggctcagacacagagaaagatcaaacagggacccttgctcagaatggaacgatgtctattttttaaatgtgttttttccttttgaaatctgtaatcatgctggcacattgaagcatacagacatagtggcccctgcatgttatcctcaatggattccatttccaactggcatcacctgggagctctgctgtgttcagagcaagtaaacaatgttcaaaatttaggacttgtgacttgaagaggagttcaagagtaaacacattgttttctagcacatgtacatatttatggtttttacaaagtttttcctggttgcctttcttttaattgcatttttatcctggtcatgaggacatctagtcattttaaaggagggtatgattttcatttactgaagatgaaggggagaggataaaaaatgaattaaccaatcccatgaaaagggttctatctagacataagagttttcacatcacacagatcttcatattgtggaccgtaagtaatactcaaggagaatgtactgattggtaaaatattttatttgaaatatgagcaagaaaagaaaacaggcaggttcttccatgacttacactgcctatcaaagccactgacaactcaaaacagagctttggagcaaccacaagaaagttggagtagttatactaacatcagacaaaatagacttttaaataagaaattattagtgaggaaatggttagtgaagatagagaggggtgtttgataatattaagagggtcaatccttgaggaagatataacaattaaaaacatatatgtacctaataacagagcactaacacacaggaagcaaaacctgacagaatcaaagggagaaatagacagttcaacaataacaggtgaagatttcaataccccactttcaatagtagatagtgggctaggcatagtggctcatgtctgtaatcccagcactttgggaggccaaggcaggtggatcacttgaggtcaggaattcaagaccagcctggtcaacatggcgaaaccccatctccactaaaaatacacaagttagccagtgtggtgatgcacgcctgaagtctcaactactcgggaggctgaggcaggagactggcttgaacccaggaggcagatgttgcagtgagctgagatcacaccactgcactccagcctgggcgacacagcaagactccacttaaaaaaaaaagtggatagaagaactggacagaagattttaaaaagctagtagaacaccagaacaacactactaaccaactatacccaacgacatctatagaacacttcacccatcacagcagggtatatattttcctcaagtgcacatgaaacattctccaagatagaccatatgctagaccataaaacaaacctcaataaatttaaaaggatagaaataatacaaagtatgttgtctgaatacagtggaatgcaattaaaaatcaataacagaaataaatttgaaaaattcacaaatatgtggaaattgacacatccctaaataatcaatgggtcaaagaagaaatttaaaaagaaattagaaaatactttggtatgaatgtaaatgaagacacagcatactaaaatttaaaatttacgggatgaagctaaaacagtgtttagaggggaatttatagctataaatgcttatattgataaagaagaaacatctcaaatcaataacctaaacttccaccttagaacattgagtaaagaacagaaaactaaacctagagaaagcataagggagaaaataataaagattatagtagaaattaaagagaatgcaaaacaacagaataaattagtttcattaattttctaaaccaaaagctggttctttgaaaagacaaacacaactaataaaccttaagccagacaagccaagaaaaaaagagacaagactcaaattactagattcagaaatgaaacagggccaggtgcagtggctcatgcccgtaatcccagcactttgggaggctgagacgggtggattatctgaggcaagggttcaagaccagcctggccaacatggtgaaaacccatctctactaaaaatacaaaaattagccaggcatgatggtggactcctgtaatcccagctactcaggaggctaaggcaggagaatcgcttgaacccaggtggcagaggttgcaggagccgagattgtgccactgcactccagcctgggtgacagagctagactaaaaagaaatgaaacagtggacattactattaaaattataaattaaaaagcattatgaaggaatattataattatatgccattacattagatcacagatgaaatggataaatgccgggaaagacacaaactactgaaacaagctcaacaagaattagacaacccaagcagacttttaacaagagattgaattgtaacaacaacaacaacaacaacaacaagctgctcacgagggaaagtcagggcccagatggcaagtcaattctaccaaacataaagaactaataccaatttttcacaaacttttccaaaaaatagaagagaagagaaaactttccaactcattctaggaggctagttttactctgatatcaaaatcaaagacatcacaagaaaatgacaaaccaatatctattacgaatatagctgcaaaaaactcaataaagtactagcaaactgaattcagaaacatataaaaagaattatatacaatgcccaagtgggatttttttcaggaatgcaagattggtttaacatccaaaaaccaatgtaattactatatcatgtcaatagaataaacatcaaaacccacatgactatcttaaaatggcagaagaaggatttgacaaaaatccaagctcctttcgtgatgaaaacactcaggaaaatgggaattgcactgaatttcctcaacctaataaatggcatctagaaaaaaccctacgtctaacatcatatttaatggtgaagcactggaagtttccccctaagatcaggaataagacatcgttgtccaccctcaccgcttctattcaatagtgtactagaggttccagacagagcaattgggcaagaaaaataaatccagattgggaagatcaaaatggtacaggtattttggaaaacagtctctgttttcagatgacatgatcttacaaaatgctaaggaatccactaaaaaactactagaattaataaatgagttcagcaagattgcaggatacaatgtacaaaatgaattatattcctatacatttgcgatgaacaatctgaatgtgaaattaagaaaacaattccatttataacagcatcaaaaagaataatgtgtttaggaatatatttaacaaaagaaatgtacaacttatactttgaaaactataagacattgtggaaagaaattaaagaagatctactaagtgggaaacatctcatgttcatggattagaagacttaatattgttaagatgttaatgtcccccaaattgatctacagattaaatgcaataactgtaagaatcccagatgacttcacagaaattgacaaggtgattctaaaattcatatgaaattgcaagagacccagaatagacaaaacaatcttgaaaagcaaaaacaatcttggaagaccgcactccacatttcttgatttcagatgaaaactacaatgatcaagacagtgtggtgctggcacaatggattagtggaatagaattgagactccagagatgaacccatgtgtctatggccacttgattttcaaggagaccattcagtggggaaagaataatcttttcaacaaatggtgctggaacagctccacatgcaaaagaatggagttgtactcttatatcacaccatatacaaatattaaccaaaaactgctaactataaaaaatatatattttatagttatataatataatatataatatattatatattttatatatatttgcaaaagggtctcacttttctaggctgaagtgcagtggcaggaccatggctcactgcagcttcaacatcccaggcgcaagtgatgcccccacctcagcctcctgagtagctcagactataggaatgtgccaccacacccagctaatttttttttaaaaatttttttgtagagataagggtttcactatgttgccagggctggtctcaaactcctgggctcaagcagtcctcctgccccggtctcccaaagtgctgggattgcaggcatgagccaccacacctggcctaatacaatattctcagaagaaaccagaggtaaatcttcatgatctcaaatatggcattggattcttatatatgataccaaaagcacaagcaacacaagaaaaaataaactgaactttattaaaatttgaaacttgcatgcttcaaagaacactgtgtagaaagtgaaaaggtaacccaaagaatgggagaaaacatttgcaaattatatatctcataagggacttaaatctggaatgtataaaatatatttttatatgcctcaaatatatttttaaaatctacatatataatatataaacatatgtttagaatacataaaaatctagatatattatgtatctatatattatatctctagaacatataaaatatattataatatacaattgtatgaaataataaaaagttgaagaactcttacaactcagtaataaagacaagctaattaaaaatgggaaaaggatctgaactgacatttacccaaagaagataaacaagcagggaataaacaaatgaaaagatacttaacatcataagccatcatggaaataccaatcaaaaccacaatgagattcactgcatacccactaaaatggctataataaaaaagacataattacaagtgttggcaaggatgtggagcaactggaactctcatccactgctggtgggaatgtgaagtagtgcacccactttggaaagcagtctggcagttcctcaaattgttaaacatagagttaccagatgacccagcaattccacccctaggtatctacccaagtgaatgaaaacttgtgtccacacaaaagcttgtacacaaatgtttactgtagcactattcataataggcaaaaggtggaagcaactcaaatgtccatcagttgattgatggatagctaaaatgtgatatgtccatacaatggaatattactcagaaatagaaagaaatcaagtgctgatacatgcatgatacatgaaagaacctcaaaaatattatgctgagtgaaagaaattagtcacaaaagactacaaattatgtattctatttatataaaatatccatgagacaaatctatgggaacagaaagtagataagtggttgtttagggctggggggataaggggtgatagctaaaggctatggagtttattttgagacaatgacatattctaaaattgaccgtgatgatgatggttgcatatatctgtcaatatgctacaaaccactgaatcatcattttaaatgggtgtggtatgtaaattatatctcaataaaacttattttgaattaaaacagaggtttagtctctttcttagaaatgatgatccactgtttcctgagctggctgagctggaatggttcccagagatctcccagggtaaactcctcaccttatgagtctttgcagcatttctctcccattcccctcctgcatccagtttaggccactcacaaaaaataaaattttcccctgtgatagaaccatcatgatttaaatatgtctttcaaggttgggtgcgatggctcacacttgtaattccagcactttgggagcccaagacagaagcattgtttgaggctaggagtttgagatcagccagggcaacacagtgagaccccatgtctacaaaaaaattttaaaaattagctgggcatggtggtacacacctatagtcccagctactctggaggctaagataggaggatcaatcgaagcccaggaattcaaggctgcagtgtcactgcactctggcctgggcgacagagcaagaccctgtctctaagaaaaaaaaatgtccttcagttccttgttggcagtccctggtgggcaggtggcataatgaaacatctctgccttcacatagatgggaatacttgcctggtgtgtgtgggtattatagtccacatggaatgcgcaatttaatatctcctagtaagctatcctgattatccaaatgaatatcttaagaacctcaactataatttatcagctaaaaatataacaactgtcgccactattggtggattcatatacaaattcaaaggtgataaaaaatctcactgagactggcttaggaatatcagaaaatcagttgctagtttctgccatccagacagacacttacatgttacacaaatatttctatttgagcagggtaaacttagagaaaagtcattgtgtttcagactcaagatgccattctgaaatgaaacatttaaaaatgtattatttgtgtggtaaaaaataagaagtgcctctttctaaaaaagagctctttgcctactacctgcctttcctcagaagaaagacattgctttttgttttgttttgttttgtttgttttgcattgcttcacttataacagcagatcgaacagcaagagcagagcaaaggagaagaattagaaaggaggaacaggagtggtggttccttttctccttcctctggcttcgcctaagccccctgggatgctctttggaatgtgggtgtctagcggcaggggatcaggaaaaccgattcccctcaatccaatgtccagcagaggcggacacatggcacactgtcaacagatgtttatggagaagatataagattgaagcaagcaagaaaggtgaaatcaggacgtattatgtacccagcactgtgcacacggacagtccctggactccagtcctcagagtctagctgagcagacacacacacacctcacacacaagaatgctcatgttgattagaggaaacagtactgatacctgccttgaagggaagtagggacctcattttaaaaatttacagctaagatctgagtaagtgagttgaagatctcagtgagagtggaatgctggctagatttaagcttgatggactgtaagattaagaatgtctcagctttctgtgctctctgggttttcacactaagctggctggcggtttctaggttctgttaaccagatgactgacctcagtcagagatcttcatcttgatcagttgagacatctcagaagaaaaagagaaagggagaagggaaggagggaggaaaggagggagagagggagaaaagaaggaaggagagaggaagggagggagggaaatgaaaaagaaaaagcaaggaactctaatggattactataaatctttcttctactgctaagatttttggccatgtcccaagtcctattatttattcccagctctgcctctgaatcataacattataaaactgtcaaaggacttttaagatgccctaattctgcctatcatgttacagatgagaaaactgaggcccagagaggagagactgtcccacaagcacaggaatacaattaatggctgagcaaaaactgaatttacgcttcctgatctgaggctagtctccctccaccacaccaaaatctggccctgacactcctcaatgactcaagcgtgacaattacatcttcaaatatccacactcagtgggagaaatgagggcccagaaacaggggtagcatggggccttctgacggggactagaaatgggaagcaacggactgatgaagactcaccgcggaaaccaagcttcagtcattggaccctctgcttagctctctgctgtaaggtgctgaggactttttaggagatggtgaggacaacctcagaaccaacagttggccaggcacggtggctgacgcctgtcatcctagcactttgggaggccgaggtgggaggactgcctgagctcaggagttcgagaccagcctggacaacacggtgaaaccccgcctctactaaaatacaaaaaattagctagacgtggcggcaggcacctgtagtcccagctactcgggaggctgaggtggaagaatcgcttcaacctgggagacagaggttgcagtgagctgagatcgtgccactgccctccagcccgggtgacagaacgagacttcgtctcaaaacaaaaacaaaacaaaacaaaaaccaacagtcacaccagagcaagccctgttttctggagcctggggaggaaattccctctcaggggcagaggatgcctggtcagactcctctccagcagggacactggggacagtgggttttccgagaggacagccccgatgcattccatcagcatagctgtgtgcggggcggcgggggaggggagcgggtcggggtggaggagggcagttgaggggaggcaggagtcaggggaggagtcgggctgtgtcgaagtgctgcgctgatgacctgcgccaccacgggactctctagggctcagcttcctcatctggaatgtgggacaggcactttcctgttcctaaactcgcgatttgttatgcattcatttgaaatgttcacactgggcgtagcacactgacatccctccgggggccagacacacgagtggaggaactggaggtgggacaggaggtgttgtggcagctgggaacgtgagcccatgcctgaaggggccgtccctgcttgctgcagtccattgttgccaagtggaaatatgcgccagtgtggctagtgtttccagtttttaaagataagtaggaaatgaaatttttacgtgaactcttctagctattaagcattggcagctaaaagtgctgtgtctgccaatcaaaacatgtgtgccagctgaatccagcctgcatacttccagtttgcaaccctgcatgcactcctgtcccttctctcccattttataatgcacacaaagttctgagggagttggggtgggagcccaggcaaggacacgttagaaagaccgggggctttggagtcaaccagacttgagcccaaagctttgacaggataatttacgaagtatgcagccttaaacatggtattgaatttctttaacttttctgtaaaggaatttctcttattgggttgtttcgaggatgaaatgagatgatgtatgtattaataacaagcctgagccggacattaataaacgatagtgacctacaccaggtgcttaatgaatcccagcagaggaaaggtcctgaggcctcatctgatctggtcccatcaagtgagtgtctgcttcctagatgcgtggggactaatcactcccaagacattccttccttccactttgggacagctttgcatgtcagaaagtgtttccttaagtcaagctgaaattcttagatagttgttctgccatctaggattataaagacgaagcttaatctctttttcacataagagaactttgaatgagactgtcactcatgtctcctattttcccacccagttctttatatttttagattaaatatttaagtcctttcaattgcttcttgccaatgaaaataataaaatcatcaaattacttcatgctcacaaccctatgaggcaggcacccattttaaagatgatgacaatgaagtgtaaagggattaataatttgcttgaaattcctatttttaatgtccctcttgaggtgtaaactaaacagcaagtctggcaccacctaagtctggcactacctttattcctggtgctatatatttcttcctttcctcccctccccctccccctcccctttcctttcctttcctttcctttcctttcctttcctttcctttcctttcctttcctttcctttcctttcctttcctttcctttcctttcctttcctttcctttcctttcctttctgacagagtttcactcttgttgcccaggctggagtgcaatgctgccatctcagctcactgcaagctttacctcctgggttcaagtgattctcctgcctcagcctcccaagaagctgggattacaggcatgtgccaccacaccgggctaattttgtatttttagtagagatggggtttcaccatgttggtcaggctggtctcaaactcctgacctcaagtgatctacctgcctcggcctccccaagtgttgggactacaggcgtaagccaccacgcctggcagggtgctacatatttcttaatgtatcccaaggttggatacattctcttggtaaatatggagtcaactgaaagtctgaagtcttttgcatgtgtgctgtctcagcaatggcttcccccatccagtactagggtagttagtgggttttgcaagccaaatacaggcctttacatgtattcctgttaaatctcattttgctaatccctgttcactgctctagtttgttggaaaattttgggatcgtgatttagtcacatgacatgattttgacccccacatttgtctcattttctcaatgtgccctcaatttcctttttaaagtcaaggaagtcaggtaagactaatatacttaaaaatcccatgtttctttcatttaacaaagatttactgagcaccttctgtgtactataccctgtgctgggtcctggggctatcatggtaagcaggacgaactcagtcctgtccgtagagcttgtgagaggtgagtcctgtgtgaaaggtcagtaggagcaccatcccgagtttgggggtgcctagggtgcttcccagaggggggatatttaacttgagacctgaaaagtgaggaagagtgagctgttacagaagagctgggtggggggagtggggaagggtggaatgtcccaggcagagcacccccagtccacacccctcttactgctctttccccagtatggttaattgtaactcattttctttgacctaccaaactgcaggccccttaaaagttgttggtatcatctttgtacttcctactgtgtccagcacggtgtttttcacacacagggattactaccaatcactactgcctcctaagtgttaggcagtctgtattgtctcatgtagtctcctaatagcccctgaagtaatactcttctcattttacagttgagaaaaccaagctcaaaaaatggtaataatgagtggtagtattaataataataaactcgtatatagtgcatactatacaccaaacaccgtcctaaatgttttgcacatatgcactcttgattatgggaggtggttataggcaagaactttgttgccatctctgccatacactagttatataaccttgaaaaagctacttaacctttctgagaaataaatggagatgactgtgataatactttcagactaagatcaggatcaaggcaaggatcttccctctcactactactttccaacatcacactggaagtcttaactcatgcaataagacaagaaagggaaatagaaggtatacagattggaaaagaaaaaataaaattgcctttgttcacagatgatgtgatcatctgtatagaaaatcaaaaagaatcaacaaaaatacccctggaactagtaaaagattatagcaagcttgcaggacacaaagttaaattcaaaagtcagttgctttcctatatacaagcaatgaaaactagtagagttgaaatgaaaaacacaataccatttgcattagcacccccaaaagtgaaacacctagacataagtctatcaaaatatatataagaatctatatgtatgaggaaaactacaaaactatgatgaacaaaactgaagaaaaactaaatgaatggagagatatttcatcttggataaaaaggttcaatattgttaaaatgtcagttcttcccaacttgatctgcagattcaatgcaatcccaatcaaaatcccagaagttactttgtggatatggacaaactgatcctaaagtttatatggagaggcaaaagacccagaatagccaatataatattgaagaagagcaaagttggaagactgacactacctaacttcaagacttactacaaagctatagtaatcaagacagtgtgatattggcaaaaggatagacaaataggtcagtggaacagaatatagagcccagaaataggctcacataaatacagtcaactgatctttgacaaaggagcaaaaatcatcttgtcaataaatggtgctgaaaaactgggcatctgcatacaaacaaacaaacaaaaaatgaggctagacacagaccttacactctttagaaaaatcaacacaaaatggatcatagagacctaaatgtaaaatgcgaaactataaaactcctagaatataacaggagaaaacctagatgaacttcggtatgacaatgactttttagatgcaacactaaaggcatgatctacaaaacaattgataagctggatttcattaaaattcaaaactcctgctctgcaaaagacaacatcaagagaatgagaagacagggcacagactgggagaaaatatttgcaaaagatacagctgaaaaaagaattgttttccaaaacatacaaagaattcttaaaactcatcagtaagaaaacaaacaactctgtttaaaatgggtcatttcaccaaagaagacctacagatggcaaataagcatatgaaaaggtgctccacgtcatgtcattgggaaaatgcaaactaaaataacaatgagagaccattacatacttattagagcagccaaaatccagaacactgccaacagcaaatgttggcaaggaggcagagtgataggaattgtcatttgctgctggtgggaatgcaacacgagacagccactttggaagacggtttggcagtttcttacaaaactagcctttctattgccctaaaattgagcaatcatgttccttggtatttgcccaaaggacctgaagaattacatccacccaaaacctgcacatggatgtttatagcagctttattcattattgctaaaacttggaagcagccaagatgtcctttggtaggtgaatgggtaaataaactatgaatataattatataatgaatttatataatgaatataaaaatatataaactatgaatataaaaatatttatatgatggaatattattcagcaataaaaagaaattagatattaagccatggaaagacatggaggaactttaaatgcatattacaaaatgaaggaagccaatctgaaaaggctacatactgtatgattccaactacatgaattctggaaaaggcaaaactatggaaacagtaagaaagataagtgtttgccggccgggcacagtggctcatgcctgtaatcccagcactttaggaggcggaggtgggtggatcacgaggtcaggagctcgagaccagcctggccaacatggtgaaaccctgtctctactaaaaatacaaaaattagctgggtgtggtggtgggcacctgtaatcccagctacttgggaggctgaggcaggagaatcgtttgaaccctggaggcagaggttgcagtgagctgagattgcaccactgccctccagcctgggcaacaggatgagactccctctcaaaaaaaaaaaaagaaagaaaaataaggataggtgtttgccaggggttgggattaaggaaaggatgactaagtagagcacagtagattttagggcagtgaaaatactctgtatggtactataatagtggatacatgtcattgtatgtttctccaatccatagaatgtccaacaccaagggtgaaccctcatgtacactttgcacttgggtgattatgatgtctcactgtaggttcattaattgaaacaaatgtaccattctggtggggaatgttgataatgaagactatgcatgtggggacaaggggtatataggaaatctctgtaccttcctctcaattttgctgtgagcctgaaactgctctaggaaaaaaaaaaatcatacacacacacacacacatagacatgcacacacatctaatttttaaaatgagagcactacttcacagggttgttgtaaggataaaatctgttaatgaatgcaaagtgcttaggatggcacccagcatggattaagacccacctaaatgttaaccattctccttattaagcaatttgtccaaagtcaaagacctagtgagtatccgaacagggatttgaaagcagtctgaagcctggatcatgttgtttcaactgtagcttattaattgacatttgatgaaggaaggaaggaagggaggggtgtttactgctttagtaagctacctattttgaacaacacaatcagctagccaacataattcagcaaaaatacatcaaatgacacacaacaaatattttaaatagttaaaggaaaaactgtagaatattagaactggaaggaccataaagataaaaacagatcacctcctcatctccaagcaaggcaagcatttcattatcattgttgaagttatgaaatgccagaaacttaaagccttttcagcttaaggggatttcttctgaaaaagtcccttgcttatttttcttaaaagatcacttgagggagagtttttaaaatccttaaaaccataaagttttgatcaattgtttttcacacttcttgattgtaggggaaaaatgagagaatatggtcaattttattacctttggacttcattgccatctttagatttcttttccttttttctttccttttctttttttttttttttttttgtgatggagtcttgctctatcgcccaggctggagtgcagtggcgcaatcttggctcactgcaacctccacctcctgggttcaagcgattctcctgcctcagcctcccgagtagctgggactatacacatgcgccatcacacctggctaatttttttgtacttttagtagagacggggtttcaccatgtccgtcaggctggtgaccccaagtcatctgcccacttcagcctcccaaatactgggattacaggcatgggccaccacacccggcccatctttagatttcataattccaccacagtcatcaacttttcaaagccttaaattgtgtccaagtggcttattcaggactatgttcattctgattatttttgagtacttatatagttctactaaatgcctgatgatgtataactgcgtcgttgctagtaagtcttagcaatgtggctctagagggatggcatgccaaattttttctggtatggattttagagagccccagaaattgttttctctctgagggaatggcctgaacattttacatgtccacacaccaagtgctaaggatgaaattattaggacatcctaggagaatacagggtctggggcaggggccaaagagagaagatgcatttgttcctgactgccagcaagtctaccaatgtgagtggcttctgtcccaatcatatatcagggtcttctatagtcaagctcccttagtgtttaatgacagaaatgtttttagaagggaaatgtgacatgtcagggcttaaagatatcaagaatgtcttccatccaatttccacgtagctggaaaggaaaatggttaagagttaagttactgttctctaaactctcaccatgtggtcctaatcagctgtctgccagtgatggatagaatgaataatctccttcatacttcagccctagaaggagtgcacagccaggatgtagaggggtctatttcccaagaaaaaaactgcgattgcaaacaacatcatcagtgtgtattttaaaccctagaaatatctgtttcccctctttcacatctttatcaaaatgaaaaaataaatccagcaaaacctgaccttgcactaggtttttgatgaagatgtgtgcagatgggccagaaaattcctaggagttctttagagaatttgaaggataattctgcagatgcacgtcagtctcaggttgctgccattttaggaatctcacctgggtttccagacatgtcatccagagactgagagtcctacctttgttcaccccaacatgttcacctgtctcctgagcaaatgcatccagtagggatgtgagaggaaaaacaggatccatcacccaacctgtctgcacttgtggcctcctggtaatgcagggactcaagcgactctatggtgggaaccctagacaattcctgatcaaaactttggaaaccagttcctactggaagattagtgttagaagaaacacacatttcagaaaatacatggaaggagccacatgttagggatagaggtgagatgagtaagggagggaagctctttggatgggcaggtggaggagagaatgaggccatgtggaaaatggaaatttaaaaccagagaagactctagacattaaccaagcaatattagataacgtcatggatttcctaagaaatctatgcctaaaaaattcaaccaactagtgtggctatgagtttgggttttattttgggcgctttcttgttttcttcctgcaaaatgtaaactgtttttgcctattttcccttggaggagaattttgatgaatagaaacaatattttctctttaaagtttctctcatgaaattatagtgattccattgacatatttttgaagctttggcaatctgttcagccatgtgctgctctctgcccaacacagtgctgacctgcatgaaagcgtgaacaccttctttcggtctggggatgaagggcccacattcctggtgcatttccatcttacaagggtccttctgatccccacagggggaaagtggaggcggcaaggctcggcgatgaagcctgcagattgctactctgttgatgtccctgctggttccatggagatgtttattggacttgccataccagtctggcagattgggcaacaaacaccatctgcccaaccatcacccagctgggcagtgttgactgagccttctgtgtgtgccaaattgtgtcagatctgggaagggatctaaaggcaggcagtgctggagcaacagccacgcctcacagaacatgaatagggctccccattaggggctattaacagagccctcttcactccttagagacccacttctgaacaatagttattctctaaaaaataaaactcatgctttaaaaaatacttacaaatctgtgagctatggtcctagagagtaactgggggacttcacaattgcaggattctgtgactttgctttttatgtctctcacagatcaaacaacagggccttgtgtggagtaggtatgtaatcaacatctgcagacagattcctgttggtggaaactcctgggccaagcctccgagtgggaaaactcagttcaggagtgaaatgagtggattgcacagaaccaccaaaagcagtggacccaaatcagctaaaggagagggcttctttccactgccacattttctccagacctctgtttcagtactggtgtgcccctccccccaccccacccccccaaaaaatcacagtgcttacaattggcactgcttacctaaataatagatatggtctatcctggtaacttttaaacttattatgctaactttcacaaaaagaaatacattttacgtcagacccattacacacacacacacacacacacacacacacacgcacgtatgtactttacatttatgagggtaaaatggatatatgaatgtataaaattgaaacaaaaatagttttactaaacaacacttacccttactctttgcaatttacttggatattttcttttctattctgggttggtttttcttttttgagacagggtttcactacgttgcccaggctggagtacagtggctattcacaggtgcaatcacagctcactgcagcctcaaatcctgagctcaagtgatcctcttgtcccagcctcctaaatagctgagactacaggtggatgccccagctcctagcttttttttttttaatgcaggttgaaacccattcatttgattccatagcccattaatgaatttggaggcacatttttaaaagccctgctcaacttagtaaatttttcctttaaagaaaaagaataaatttgagattacaaaattttaataactgtataatctatgttcttaacaattaaaacaacaactagctcgtagtttgatgtcaagagctgcaactccagtacaggggaaatagacctaacctagctggatcctcatcctggtttctcaatgtatgagctctgtccagctcatgcaagtcactgaggttgttttctcatatataacatggaagaaataccaactccctttctctcagagataattaagtaaaagctcttaaggaaatctgaagttcagtacaaatgagttcattgaatcctcctcagaatcgccactgcactccagcctgggcgacaaagcaagactatctcaaaaaataaaagtaaaaataagaataaaaaaagaatcctcagaatatctgcactggtaggatttctacttgctcaaggtttcatagccaggtagagcctttttttcccccgctaaacacatttatataaaagcataattattattctctcccagaatatctaagttgttagaaattctactgctttcagttatatacccaatgtgtccgataatgtttctacctcagattatgccgctgtgcaaatctcatgagttttatgcatatgggaaaatcaactgcggaaaaatttcttataaaaatgctccaacccattgactttaatagagccaaagaggaaaataatcaagtaaagagaaacagaagagaagagatgagtttcttttacagggatgaactagaagggatccacccagccccatcattttgcttttcgattgtaatttttcaagaggagatattatatttaaataggccctagaagcttacggctggtgagagagagatataagctaacttcacagtgtggggagctcaacaccctaagtttaaggtcttgctaactaaattaaagatactgacaagtgttaactacttcagagatgccattaaaaaactcgtctggtcagttttcttactttacagtcataactcatatattacaataatattttcaatgaaatcctctaactgtgagaaaaggctgacctggagcccatttcctgtgtacaccagagtgtcagaaaagaagtgcaaaagtgctcctttctctctccaaggggatgaagttcacttaaatggccccaacattactgttcttctagaaattaatagaagaattgtactctattgtaattaggaggtgctttgtaatttgtttttgtttatgacctggtgtttcgtagctataattagattcaattcatttttaacaaagcaatttttacaaatgcatatcatattttccactattatgattcaaaagccataccaagggtatatccagagagaatgatgataatgatggtgcctttgcatcaaggtaatttagtgtggcaaacctccacctggctgtgggaccaagtggccccttccaggattctgagtgtcacattgattcccctctttccctcagccactcaacctctgatcaccaaggccaacgaatcccccaattctgtcaactctccttccccaccacgaccaaagtgaactcaggacaccaccttccacctgctttgatgcacagagcaggcccctatctggccttcctgcctcagtcttgccccttccgacctcctcctgccactgagaatgtgaagggaaaacctgaccaccttattccagtgcgagcactttcccatgactccccacagagccctaatgtgaagtgaattcttggtcctttgcttgtaaaatgaagagaacgatgcttcattggatggttgtgaggattaaatggcatcaagtaaatgaaaccatttgtttaagtgaaaagaaacaaatgtaagaaattattatattagcggaaatttaaatttactagataattcggtaattaagtaaagtagttaaatataattacttgggtacttaaattgatttaatacattatgctagaggtttggtggatttatacaagctggaatgataaagtgctgatattgatttttctgtacattacatatcagatgttacatcctaatcagtgctcaggtgggaacagcgcctgttacacagcaggcaatcaataatgcctaagtaagagtttgttcataatttacatgctgggttttgtgacatgtagacagagctatactcctgattctttttcttaaaaccctattagactacaaatctaccttttcaaaagatgtgtttacatagggttactcatccttagagaaaaataaaatgaaatcccaataatctgcagatgcttattggggctgaaatcccccaaacatattctaaagtaaatattcaacaataataaatacatgataaccaagttaatatctagcgagtaatcacagctgtatattaggaaatggttggagttttattaatgccagagacaatgctctgagtcatcagagataagttttgtgctcctgaactaaaataaacctgtcatggaagtgttcggtaacaatggaagcagaagatcaaattttctcagaaagagagttaataaaataatgagagagagacataaaatattagactcctcggaaaagttatgattgtttaatggattatatcacagctaccttggactttaataaggtgtgattatgagaccaatatcaccctaacaggaaacaaataacaaaatagatgttactgttcatagtagtacagttacaggctcatagtaactgtttcctaaatatttgctgattaaattaattagcaaacaagattcagaaggctcttctatggttaccattattgattccaatatcttttagtatcagtgctatttaaaaatagtggtctcataatattatcataacaatttttccaccaagctcatataatattcgtagtatatgtatgtatgtatatgtgtgtattccataataatctatgaaatacaacgcatttcacaatccttccttatccaaaaacaatctaagtgatagataatttcctaatgtccaacaaattatgcaagtgttttatgatattggaacttgtaattttctgcgaatggttgtggactattacaggaaggcagacatgataaatacatgacctaacggccactgctccccgacaatcccacaagagacatcaataatcaatcatggcactttttcccactaagcctggaatttatcctcaatgtcaattttaacatagtattccacaaagcacctgttaatccattcatttattcatttagcaattattatggatttcctaatatgtgcaaggcactgtaccagggaggcacattgcagataaaagtaaccaggacagacatggaccgtgccatcacagggcttagattaacaatggatttgacactcaaagtcatgattgtttgccagatctgctctgttgtatagttgaaatggaactaattctaaatagcagtgtctctcctttgtgatagtaggggactgagtggagaggcttgcactccctggcttcataaagccatgatgtctattgaatagtttaggagttaaaggtgaaaatagctgaacactatttattagaaaaaaagagatggttttctttttattcatttaagtgttcaatttgcaagtcagactgataaacctataggagaaagttttatgaaaatattagaatgaataaatttttctcccactcccctatagagacaggggcagtctgtgactcactgcagtgttttcctttctccacagatgtcggaaagaacacaatatgctacgtggaattagagaaagagaacagatggctgagtacatggctttttccaccactatcaagcgtgttgtctttccccctcagctgcaaaattacctctctgaaagtctctgctcttaatgctgcaccttctctacccttcctcattcctgcctaccatcctttcatccctgctttagaagtgggctgacttccccaagcaaaattccccggcctacctcccactcatatgtggaagtgagctgattgcatcccttgacggcaaactgcttggatggttagtcccttacagttatctaccccctggacaagcacaaaatgtcaaaacagaatttggaggatcggggacatgaaagtggctcagtcaaaatcaggctgatagcagctacaaagaggttactgtcaataacaggcaactgttctgctgtctcctaagactaatcctgaatttggatatgtacatgttatgctcagggaaaaacactgtctagttgccttatttcacaaattaaaaaaaatctcatggccaggcacggtagctcatgcctgtaatcccaacactttgggaggccgaggcaggtggatcacctgaggtcaggagttcgagaccagcctgaccaacatggtgaaacccagtctctactaaaaatacaaaaattagccaggagtggtggcagacgcctgtaatcctagctacgcaggaggctgaggcaggagtaatcgcttgcccctgggaggcagaagttgcagtgagctgccattgcactccagcatgggtgagagatcaagactccatctcaaaaaaacaaacaaacaacaacgaaaaagaactgcctcactaaaatgttagttctattgtactacctccaatgcaaagacccagttcctgacctcaccagaaggtagacccacaatgtatatttagctattgatgctgatggttggttgttttcttttgttttttttaaacctgattctgtgcctgaagtgcctactaatattgctttgtgttctctacagccttgtttgtgtgtgtgcgtttttttctttaatcccctcaagatttgaaaattggaactaaacaaggaagaagaaagtgacaggccatttttattattctttctcagggttccaattttactgtgagtttctacttcttaaaagattttgcatttctcccctttgaatgttacttcatttgttcattctctaaggaaggaagaacagtatcataaaaattatgaatgaatgaaaatgatttttttacgagtaccataaaaaatgaatcaaacatgattcatttttgccctttgccctttgcactgtatcttggtcagtgccagttctcatgtcattatagtagttcctcagtgaacatgaaataatacaacattgtccattggaaccagttatataacactcgagataacagcaacattgcgtttattaatttagtagaaacaacagtattttacagttccaacatataagagaatgcagctgtgttaaatgacaaaaatcatgtattctattttgggcttctcaataactaagaaatagaactaaaatccttttattcacttattcatccaactatgggccacatactgtgctaggagctgtgggtacagaggtgacctatacagaccagtctctctctttgtggagcacatagtgactaactgggccttgacaattctggttaaaattgacatccacgaaagtgtctacaactaggatggaatctctttcctaacccgtttctttcatactcactaggaaagcaacctttccaatggatcagggtagatttatgactcatttgcaaagcaaaagcaaacagaatgtagaaaatggaagtcttaccactaataaatatatagattgcagattctgtttccttcttctttgaagtaggtacagctagatatttgcagctgtagaagccagtgtggtttgcttgagctgtgttcaaggttaaagtactgcagaattgtttgccatttcttccacaggcagatttagttatgctcagcctttcgctttccttactcaccatttcaggcaaagaccatttatgggctgcttcccccctgcaatcacagataagaaaacaaaacatatttatggctgggccctaggctcagcaccagttcctcagcattcattttattaggaagcggaggtcctctcttaagtgtagtcatcttcctctttacgggaaagcaacacattcagaaaagctgtagaacaatactcagaataaagatgcagaactatttgggcatcccttcccccatttccctgagtgagtaatgctctcccttccccatgaatcccctttcatgggaagctggatgcctatggtttgcactttgcagatcacaggagatcactgaggtccctacctttttactctgccagggaatgattttgccttaggcatggcaactagattattcccaaaccaacacagccacttacctgcattggagatgcagtgtctggcctgcttgcatgatgtgctgggtgccttttaaactcagttcaggatcttttaattttgaacctgaactagatcctgaaaaacaaatttttaaaatgtattatttgtaaattgtcttcttacctttttttaagttatctttccatgaaggtgagtttttcatttttaatttatttacatctttaatttacttgtatctttaatttataagcaaaagatacactaatacaaatttctcttaattcacaaattttttctagctctacccttgctcataaatattatatatccttttataccaaatgacctaaataacatccaaaagcctatttatgtagaatggtaatggattcatataggttcaatgaaattatattaaaatatataactagttataatattcaaatatgcaataacttagtaaaaactctcaagaataaatgtcagtgtcatccaaaatatattttcaatactgaactttttccagtgtgggtcatctagtcctataggcctgtctcatctttttttctgaataaaaagtacagaaattttcctgggctctgaatttcatgcaatcattagttgagcaatgatatttttggccaatcatttccctttctgaaccagtttcctcatttggaaaactaattatagaatcaaaatcagttttagaagacatttggtttgtcttacgtaatctatgagttccctctacaatggtacagtcaaaagggaactgttcacacgcttacgtgacattcgacaaacatctcggaggattgttgtgaggcaataaagtgaggtggtgaaagtgctttaaaatctacacatctccatatgatgcaataatgacatccattttagtgactagctgtatcaccctagacaagtcatctctctttccagatctcagttatcttatctgtaaaaaagagattggactagacgaccttgaaatctctgaccttccatttctcacagtcccagcctgatatagcttggatgctgaccctccaattctgatggtgaattgtaatcctcaatgttggaggtggggcctgatgggaggtgtttgggtcgtgggggtggatccctcatgcatggcatggtgctgttgtttagatctgattatctgaaagtgtgtggcacctccccccttctcttgttcctgctgccaccatgtgatacacctgctcctgttttgcctttgacatgagtaagggctccctgaggcctcactggaaggcaagcagatgctagcaccatgcttgtacagcctggagaactgtgagtcaattatacctcttaataaattaccaagcctcagatatttctttacagcaatgtaagaacagcctaacagacagcctcatgattttttgaaccataggtgctacagaggctgagcctcccttgaagctattactgaccaatcagaatactatcactaaggatctctctcgcctccttcctcccctcatccctcagtctctcttctccttctccctcttcttcaccagcctcctcctcctcccctcttcccaggcagctgcaatgcctccgaaaggcagggaatgaggggcccaggattagcgttccttaggcgggaatagaagttagcaggagagaggaaagaaattcttggagggaggaaaacttagtatttggcaccaatctcagggtatagttttctttaaaaaatcagtttaaacagtggaagcaaaggtagaagctctaagtgaatggtcatggagggtttaccattaggtcacagatctgtgagatgatgtgtgtgtcaaataccctggttatgcccagcagtcctctccagcgtttctcttggatttgactatctcaaaaactggattcagttagaagatctgcgtttgaggcttagcttttccacctactgactgcatgaccttggcatcacttaattggctgctcctcaggctcctcgtgagtggaactggaaagcctacgagccacctcacaggcagggtgtgtgcattcggtgctgtgctgtggaagaggctggcttgctgcctggcacgtggcagatgcccactatcaccaacatctaggggaatcacttcccctccccctgcttctgtcagaatattttgctgggtatataatttcaaagatactaaattaacatatgcttttctggtattgctgatgatataaattaatatcttttaaatttttattttattttatttttgagacagagtttcactttgtttcccaggctggagtgccttggtgcgatcttgactcactctgcaacctctgcctgccaggttcaagcgattctcgtgcctcagcctcctgagtagctgggactacaggtgcgcatcatcagcgtggctaattttttgtatttttagtagagatggggtttcgtcatgtttgccaggctggtcttgaactcctgacctcaggtgatccacctgcctcggcctcccaaagtgttgagattagaggcatgagcccagcctaaattaatatattaaaagtaatttttacagacagtagatcccggtatcaaagtactcctaaataaaatggctgaatattaactaaattaaaatccctgtttcatatggatcccattggtctatcaaacaacctcctagatcaagtcaaccccttcaggtacctaggaatgtattttaactcatacttatctttatgagtttcttgaggcaacatgtggcccaaaatcagggatctgtggaaacgccagacttttctaaagccacagccagcaatggataacacctgccctgagaaacttccatgccagaatagtttctgcccttctttatggcatggaactctggggatttaattgagcaattgttcatgtgctggaaaagatccatcgaagcttcctgtggaaacttctggcattacttgtagttatctctgtggtctgtctggagatgctgagcgctcccgtccaggaaaagaagcagttcccctgtttgtgacatcccactgcctacatcttggtttccagaccacatgaatctttctttatcagcaacttagaacaccagtactcctgaccctcatcagaggaaaccgctaacttcaaagaaccacccaaagcccagctgagagaagtgctatttatttatttatttacttatttttgagatggagttttgctcttgtcgcccaggctggagtgcaatggcacaatctcagctcactgcagcctccgcctcctgggttcaagcgattctcctgcctcagccttccaagtagctgtgattacaggcgcctgccaccacacccagctaatttttatatttttagtagagacggggttttgccatgttggccaggttggtctcaaactcctgacctcaggtgatccgcccacctcggcttcccaaagtgctaggattacagacgtgagccaccgcgccgcgcaagaagtgctatttagagaagatctcttagacagtgtgccctctacttgttcgtgtccacactccccatgctgtcccccaaccagaagacaacataactgagtggttaaaagacactgacaaaaatggggttattctaaaaaaaagcgttgccacataatttgtctccagtaacatcagtgtattttgcacctggaatgaggaagctagataaaaaacagttaaccaaaacacaggtaaacagaagtataaggaacaaatttccaagtaactggtgactttgagtgcatcactatccttcagttaataggaaactagaatctcataaaggttattggaggtgtcaagattatagtttaacaggaaaacgaataagaaaaagggaaagtgaaaatatttatttcttgaatgttttgaattcacattattaggccttaacacatttctttgaggcagtttcatgtccatgtacctatctgagtaacaaagattcaacatttgttttagcatctactgcatgctagacacttgcccatcttattagtgatttatataaagatagatgtgtatgtacgtacccataaacacatgcatagtcatagcatggggaagtcagcttgatcgtctcagtagctcagagtcatgttgcccatttacataacaaacctacaggctatttcattttcaagggtggagtgctataatttagcaatgaatctcagatgcagatgagaactttctaatgcttcacatggcagcctagaaatctgatttaaaagaatgatttttgtcctcccaataaatgatcttgtcccttctgtgaactactgttttcatcaaagtcaattacaatataatcataagaggcatacagatctccttacatcacgaaaacatttaaataaaataaaacaaaaaaactcaacatagagcatgaaaatgggctttatcccatgctactttgttagaaaaactgttaaggtcaagcagtgtaggctaatagcattaaaaaaccaacatgtgaacgtggacttatttgaacactgacactttgtattgatcttatctgagtcttttcttcattgtttttctgttctgtattatctggcaggtggaacagaactttatgactctttgacacaaatcccttctctcctttcgcacatgctagacctcacatagaaagcctatacgtagagtgttctaaaatgccacccctaattccccaccttagtttcattaggcaaaatggaatgttttctttgacttcattgggaagagtgaatacatatccaagtaaatgatggctttattttgcaactaaatccaaagcccagatgattgaggctctttcttcaaatgctcttcaaagctgccatgatggatactaaaagagccaactcccactggaggtcattatgaaccagacagccttgaggtcacttgtaaaactcaagactctcaatgtaaagtctgtaaagtctgactaagagtatgtttagaaaactgctatttttactaatctaaataaacagtgttctagctggtcgaacccaacttcaagacaaatcccctggtttctctcccaccagatgccaccttggcaccccttattctgttgaagtcttagggttattctctgtaagaaaggagctttatttgaatataattcatgaaacatctgtgtttttccattttttattatgagtcattaatctccctagctctgccatttgtgagttctgttgtggccatgggcgggccacattaagcctccgattcttcatctgtcaacacaggagattagggttcggtttttaggatcctttccagctaaaaattctgatcctggggtcacagtaattgataacaatgtataagttagaaatcacattttagaaatacttatggttagtaaaaagacaacagcctaattttaaagatcaaccaaggctctgaatagacaccttcccaaagaagatatataaatgaccaataagcccatgaaaagataaaggacatcattattcatcaggaacatgcaaataaaaaacacagggagacaccacttcatgccgactgggaaagcttaaataaaaaagacagataagaacaagtgttggtgagaatgtggagaaactggaaccctcttacatcgcaggtaggacttttaaacggtgcaacccactttggcaagcagtatggcaattcctcgatggttaaacataagagttgatcataatttaaacacatgactcagcaattgcactcctaggtatctacccaagacagatgaaaacatccatccacataaaaacttacacacaaatgtccacagcagtattacctataacagccaaaaagaaacaacccaggcccagcgcagtggctcacgcctgtaaccccagcactttgggaggctgaggagggtggatcacctgaggtcaggagttcgaggccagcctggccaacatggtgaaaccccgtctctactaaaaatacaaaaattagccaggcatggtggtgcgcgcctgtagtcccagctacttgggaggctgaggcaggagaatggcttaaacccgggaggcggagattgcagtgagccaagactgcgcaattgcactccagcctgggtgacagagcaagactatatctcaaaagaaagaaagaaagaaagaaagaaagagagagagagagagagagagaaagaaaagaaagaaagaaagaaagaaagaaagaaagaaggaaggaaggaaggaaggaaggaaggaaggaaggaaggaaggaaggaaagaaagaaagaaagaaagaaagaaagaaagaaagaaagaaagaaagaaagaaagaaaggaagaaagaaagaaagaaagaaagaacccaatgtccatcatctgatgaatgggtaaataaaatatggcagatccttacaatgtggtattatttggcaataaaaaggaatgctgatatgtgctgccacatagatgatcttgaaaacattatgctggcccacagagaaaacgtcatgtaagcacacaaggagaaagcagctatttgcaagccacagagagatgcctcaggagaaaccagacctgccagcaccttgatctccttgatctcaagcttccagcttccagaattatgagaaaataaattcctctagttttattgttaaaaaacaaaaaacaggccgggcatggtggcttatgcctgtaatcccagcattttaggaggctgaggcagctgtatcacctgaggtcaggagttcgagaccagtttgaacaacatggtgaaatcctgtctttaccaaaaatacaaaaattagccaggtgtggtggcatgcacctgtaatcccagctacctgggaggctgaggcatgagaatcacttgaacctggaggaggagatttcagtgagctgagattgcaccactgcactccagccctgggcgacagaaactctgtctcaaaaacaaaacaaaacaaaacaaaacaaccacagacacacacacacacacacacacacacacacacacacacaaaccccacaaatcattgtgctaagtaaaagaagccagtcacaaatggccacatattgtatgattccatttatatgaaatgttcagagcaggcaaatcctggagacaggaaggtagattagtggttgccagggcttgcggggaggggatggagggtgactgataatcagtattgggtttcttttgggggtgatgaaaatgttctaaaattagattaatggtgatggttgcacaactcttgaatggaccaaaaaccactgaattatatactttaatattcttgtctcttacagtcatattttggggtgtcatattctggtctcctatagtatgtgagatttacctcaataaagctgctatttttaaaaacccagcaactgatgactaaagtaatcacagagttatgttgaaggcctagaatatccagttattttgaaatttgttgccacatattaccccatcagtgtgagattttacactagttgtttttccagcttaaaactttagaaggctgattttagagacctaattttcccttaatgttctgtaacatcactacctaatagtagaagtttacaaacatgttgcaaaaaacttgctgttccctcccccgttacaatcttttcaatttaatttagtgttagttttaaatcactcctaattgcatattttgaattttccctatttaaatggaaatttttaacaaattatgtcactaggactctgaataaatctggtgtttccttttatatcaattttttatttctaatttatttgtttttaacttaaagctctgtatattccgtttatttgaaatgaaatgcatctgtctttgattttgcatactgtgttttcagtagtacataatcctgaatgataaatggcctctttatctaaatagagatccctaagtatcatgtttctaaaatttgaatttaagatcatgagccttttacaaaggttgttcgaggttaattaagcataattcacaataagagaaaatattctttccttaagatgtagcttattaaaggccgaaatctcatagactaaatctcatagaatctttggggttggtggcaaggatgggagaagggttaagaatgcaattgcaaatttccggacgctaccaacatttttatttgcgatgcttattcttatagggctctgaaacttaataaaaaaaagttaactcttagttcttaacctctgtgtcatatctctatccaagtatttatcagataatatgaagtgggcattataagtgaatgcctagattaaagtaaccacattaaatggagactacactaccagctatgctgacagggcccatgctttgatgaagagcattataatgtcccatctcctctcacttccagaatgatggagaaaggccagagagttcatattccatccaccaacagactaaatagaagatgtgaaagtcatggggattcgtatgaactgaaagcatattttttcagtcccacagttagcaatgatactaatttttaaaatgtcaggtttgtcttccaaaacaattggccttaaatcaagaaagaatgtaaagaaatgaaagaatgtgcacataaatacacacacacatgcacacacacacacacgcttgctgacacgcatgcatacacttttctctccatgagaacgtcaagtttgtttgagtggtggtggggaggttgatgtagaactagaagaggtttttggtgtgtgctttaattacatttttcattcagcttaggctcagggaaagctctttctaggcggggatttagaaattgacttgaatgtggcaagagtatgaagctgtgactcactgctgactaatcccttatgcagataagattatttgtgacttttacatgggcaactttacaaatatgtaatattttattttagagtaattgtgttattggtctttaaggtccacaataggactgaatgtttaggcagctgctgtccagcaacattatatttagtttgtagaaagtttctaatcctaggaacctgctttttcctttaaatctttatagtatattaaacgcactattttaccacactgatttcttgctttagaggttttgccattctaagtaatcctcaaactattagattcaatatgtgaagtctctgatctcaaagtctgaatagaaaattcaaaatagtcacgtatatagcatttatgtcttgaatccaggtgtcaaaaaataaatcaagaaattacctaaatgtttaacaccagcaactggaattggcacttctccgcaattatgttcatttcaataattctgctctggtttgttcattttaaggctgtcttacaattcatattttaattgtctgtcaatgaaactcatagataggttttgtagctcttggcacaaaagacatcacagtgttagccactgaagtggccaaagtctaaaatcatcaaaacttggacagttttcatcccatccatacatgggtcattgactttactcatttttccttaagcttcagaaaagttatttacacggaaaaaaatctgtgtggtttaaaatgtttaccaggaaaaaatgctctaataacgtcaacattcctactgtctatgtttatgagggaaacatgtcttccgcatgcctctctgagctttttacttgacactgccttctttgagggtcacagtttaacagggcacattcattgatcattaggcctgtcaccaggctaccatcagggacctacccttccaatgacctatagccatgcacaactccttttcatgtgacatcagagttaattaaggttggtttgggagaaatctcctgctgaccaaggagttaccttttcccaaaaaatgctctactcctacaccgctggtctgttattaaatgagttcaaaaaccacctccatagagctgtctaacaatatgtcatttcagtttaccatacgatgtcatgaaagttatctgagctgcctagggcaaaggtcaagatctggttgacagggcacgagacataactcgtaaaatactcggtagagaagtctggtagaccttcgtctggttatgcaaatggacacgaacagagaaaacactctttacaccctaaaaatgcatacaggaacgttttgtctgttaggaagggcttggacacatctctgttttctctatcagtggcaggacacttttacatttgaagcatactccccacgggcttatgttcttatccaatgtcactgtttagaggtctgagaggaaactgagctctgacgtcacgtcttatagaatggatcataattgccagtagtgttatgctactcagaagttgtttcaggctgaaatatacacattttcagattgtgaacacctggaagagacatgacaactgattgctcagtggagatgccatttcaataaacacactcaatgtatgtgagactaaatatacaggtggcttagtgaaagtaactgagtttttaaattagtttgttaattttttatcaatttgtgcatcctctttagaatcatagtgtctgatcagtgacaaaatgcttttagctgcaagagcatttgcatagagttgtattattaagactagtagtactaataacatgcttgaactgccttaactttagatttctaatctctaaattatttaggattgcaaatttcagttctgccaaaggcatcctccgtgttctctttaaataaacaattaccagtttggaagcatagcatggaatgcatgtgactcgcaatctaaaatggaaagttttctgttttacatagcatcaggattacagtttggtctatgtccagatattttaccaaatactctgctttcattactgttcagtgtcaaagttccaggcatctatagagatgatgacagcatgtttcaatgttatggatttgtcatttatgtggatccctgtgggttcccttagaaggaaagtctcacagaaaagatctgggagatatttgatcaattccgtataggagcttgccatgtaacagtttaagtataaaagcgggaattggaacttttaaattttattcaactacgtcttataacctgtcatgtgacataatcttcagatccacacacagttccttctggaaaaaaatgaatatgtcatggagctgtaatgtgatgctgttaaactaccataaaatgcatattgttccagtttctattttgattcccaaatagtgccttcacatttttgtataataaaatgaataagaaaggctggcaaacaggcagacagacaagtgtgcaccttagcactgtagctgttcatgccagaaaagccaaaaatgttattatagcaatacaaagccttatctattctcctcatgcagactttcagcttcagaatcgattacaaataatgacagaataccatttgctttgtatataaaaatggaggagagatgaaatgagattggaaggccgaatgtgataaagttctgatgttaattttcagcttactttgatacagtttatgaagtccaaattatatagaaaacatctttctggagtcctttagactgttcataaagggtattctttaaattcacccactaacaggaaagttgagaagatctctatctttgcaaccaataatatatacaaaccctctgacctttgagatttaaatggccaagagtgtgcaataaagttatccatcataggggaattgagtttttgaaagctacattagcaaatttctaagactcattaaacacattcttgatgattgtgttttctattgtcataatcagtttccttctaagttaaacaatttgaaatataattgcctttcattacacatattttggagattaatcatgcttcggaaatggggtggacatgttgattaaactgttattttttattctgggtttttctaatttcacattttcttaagatatccttcacgtagtaagtatttgtaagagctgtgctttcctaagatttcaaaaacttaaaaaaatcttatcttagatggaattcatgttatacaagttttgctgagagtcaaatttctggaaggaaaagtaatccattaaaagtagtacattttcaccagcagtatctgaatttttaaaagaaataatttaccgaatgtttttcactcatttcggcatgtgatattaaggccttccttacaaatacccatagaagactttagcgttgtttgtattcaatgcctggggaatgctggttttcattctcaggggatatatacccatacaccttcattactctatctagaactttatttctagaaattagcttttttaaaaatatcatccaagacattatatctctgatagaagaaaaacaacaatttctgttatcagttggccaccaacccaacagctttaaaataacttatgaatcagctcattctgtaggacaaaaccaaaaccaaagtagaagttacataaaaccaaaaggaacagctctgtggagaggtagtaaggtgcccaatgccgaagctgctcccatgaaattaagccaccacctcctttggatgagactgatgaactgagttaagggttggactcttaggtgcaatcccaggagtctgggaactccatcctcatttagctatgcttcttatctctcttttactgccaccaatcctggtttttcccctcactacattctctatatgacccctttctctcactcccttaccttgtttatttttccatctttaacctcaacatttattctttcatttaattttttgaacgtataccgatagagatacaacaataaacaagacaaacgaggttgcttcctttacagtgtttatagcttagcatggacaacagataaataagtatatatagatatatatgtaatgatgcataaaaataatttctgcttaaagaaatagaaaattacattatatttgtgtgttatcatggggaagtgccaggtgtggaggtacctcactcagcccagggagtgagagtcttctattagaataaagttggaggtgagacctgaagaatcaatgtgtatttgctaaaagaaatagcagggtctctttctccttcaaagacttccacatctttccaccctctaagcttcatctttccttttaaacaagtgttttcttctaacagtttcacatacatttccttgtttcttagaactcttgttttcctcagcctctgtgctgggaggagaaagctctatcatcttctttcaatgctgtggttcgcatattttttgtctggggtctacctgacttcacctgccactaggaaaaaagccacaagtaatcatactttagatacatacccaggtcacgttgtgcttgttaaaacagagcaccacggaagacgaccggggtggagactcagcaatgagggaatgaatgaggactgtcagatgtgatgcgttagccaggacttcatgttcttaacgtgtccttccttttggcaggtcacctagccagtaccacacatgacccagagccaagaggaaataattttcaaccaaaatgttctcattccaggtgacaaaacaatggcagcaatagtaacattacctagtgactcgggctctgttggtgtacctagaaattaaaggttccaatcaactatcttctgtgctgtttgggaacctaagccagttaacagtctcccagcaggaaggctcatctcaaggaaaatatctcctgggaagcaattctctagaagatgggcagtgtagatcctcattctcaatcctgagtctacagtcgagtcaggagaacatggccagcttagccaaaaatgagaaaatggtcactggacctagaagataacccaaatggaaggaacagaatattgcctgtgtattgggagaattgttgccagctcctggccatatttctcctaacctcctccgcttatacacacacacacacacacacacacacacacacacacacacatacacgtacttagaaggtgaaccaatgaggaaccatgactcctagaagggcctcagacccagagaaatggctcaggatatgatttcagtcagttcagccagtatttattgagtgaccattatgtgccaggcactgtactggattcacaattgcaaagatgggtcagaaacatttcttcctcttgaaggtctttcagctctaagctggcctcttaggggctgtcatttagaagtagaataggtgaatactaagaaatatggaagataatctaagtcaacaaatagagatctcctgcaaactatgtacactatgtctttaaggaacacatcctttaatataggaagtcacacattcttcaccaacataagtgatttatcttagtaaaactcagttaaattcacaaaataagaacacttattcaatgataaacatgtaacacaatgaatacaaccatatctatacctcaaaataaaatataatggattacttgatgataatcccttgagcatcttttaaatgaatgtattaaaatgttataaaataaaaatcttctacacattcctgaactcagcttggaaatagggcatgaatctagaataatgactggctataaaatcgggatcaggagaattaaatttaatatggctcatgtttttcctcatgcagttgtgggagaaaatacagacctcgccgggtgtggtggctcacgcctgtaatcccaacactctgggaggccaaggcgggtgggagtttgagaccagcctgaccaacatgaagaaatcccatctctactaaaaatacaatattagcccagcgtggcggtgcatgcctgtaatcccagctattcaggaggctgaggcaggagaattgcttgaacccaggaggtggagattgcagtgagccgagatcactccagcctggacaacaaaagtgaaactccatctcaaaaaaaagcctggacaacaaaagtaaaactccatctcaaaataaataaataaataaataataataaagaaagaaaaagaaaaaaaaagaaaagaaaatacagccctccaaatcattggaagaggaatatttcttaaacctcccctcctaagtttgtatttaacattatcccaaaatggtgaatgaattactccagcaaggcaattccatgcccatcggtttggactataaagcgcatttaagaaataacaacaaccaagcaaactttatttctacagtttaggattttactccctctaagaaaagataatctggatatagaaccactaagtttaatgtcagtctcaaaaggctaaagtgaagtagaaattcctgaaaattcactcctgttagtttcctgaatttcccatttgccttctaagtgactttgcgtagcgaatactttgatagggtatttttcattgaccagttttgaagacagaggatgggatgggagcttgagtggctgaaccacttttagcttgtacatcaacaatgtgtgtcaaatatttcctaaccctcaagaagttacaggtactcaaagtccattccagggcactgcaattactctatttccacacatatatttttctctagttctaccagaagtccttatggagaggattctgaagccataaaaattttcaaagaacagcagtgaacaaaaatctgatctagcaggagacattaagtggaaaaagagagttaaacaatgttttccaaaaagaaaacaataccattaatcatagatgcagtgttgttgccagagtttacactgccttttaaaactgtttgtttgtaatcctctctagcatatccctgcctccccatctgtttacatacatttttggtttctctaatgccaacttagagaaagaaaacaatcataaaaatccaacagtggatttttacatacatagacaccatgcatatttttacatagtatatacaccattccgtataatttccatctaaagcatgtatccatttgaccaaacgttccagctttttctttggagtgaaagataaaactcctcaataggtggcaggataggatttttctcagcttctggtaacatgacagtattctggttgaaaaagtgtccttctccgagtaacaggtcaagaaagaagaaggaaaacgctattttctccttcttgacttcttgcaggtctatgttaaaggaatgatctaagaaggagggagagacacaggagctacggggcttaaagaaatgctccccgtgttgctcactgtacaaggactgccaatcaaacagggaaatcaaagtgactgacagtaacttgtttaagaaaaaggctcttggatggttgtcttttctcataaatatgacagtttttttattccaaaccctgaaaacaaaactcttgccttttttctttaattcctagatttaatcattcaagatactttgagtaaatgttggtggaaagagtccccgatttcaaaattaaaaagacctaggtttgaatcttggcttggctgttccataaatggatggccctcagcaagtcagcagggtttcctcagccttggggcttcaatccataaaacaaagttacaggtgtgcacagtaggtggctaggaagagacttgatggagttaacacagaaagtgccctgtgctgacatgttcacatttttttcccttccctgggggacagttaatgtcctcccctatccaattcatgtagcatctgccttcagggtcaaacacacttccaggtcgttctgtgaggtattttagtttcattctggaaaagctgtgagctttctggaatctgaaaggtgcagaggagcccacgttggattcctggaaaccatctgtgagagggcagtcccagctttttcctcggacctgcctgatatgagcttttctagaataaagtgctgtcctcatgctgttgtttgtcatctgaactggtttaaagccatatctaggagagcagtttggaagcccacataaaatcatgtccttgatggctttggggctccttttctgactaagttttttgggaggtccttgaatgcctacgataagaaaactcacatgattaaaattctgtcttattggagatgtgaacagtgtctgccacatacagcagtggaatctcccaaggccactttaagctggagtagcagtggcttctcacattctttggagatggccaaactccaaggacagaaggagggaaagactagcacagtccccttgatgctttttccttctcctcttttcatttaggcttgaaggcatggtaggaggatccctaaatgtcgggtttgcaagtctgatagactcagattcaaataattccaagtttacttaccacttctgtgatcttagggaaagtatttaatttacctaagcatcagtttttgcatggttaagaggaccgtacctctcgggactgagtaaaataatatatgtaactcctgttgtggtgtggggggaggggggagggatagcattaggagatatacctaatgttaaatgacgagttactgggtgcagcacaccaacatggcacatgtatacgtatgtaactaacctgcatgttgtgcacatgtaccctaaaacttaaagtataaaaaaagaaatatttgtctgtaatatttaaatgcctaataaatatataattgaaataaaaaatatatgtaaatcaattacatatattgattgtatagtcagtagggtttggttgcctcctttctcccttccccaaagcatgtctgtccctgcagtctcggcacctccagaaaaaggtgctaaatcagggcctctatgataagagccccaagaagctgcagagctgcctgcactcagaatcttggggtcagctgtcctcccttgctggtgtcatgttagtcatcagaggctgctgcccagcatgcctgtcaggtactcaaaacaaaatttgaattaagaatagaaagctcttctctggggcctgttttattttttatttatttatttatttatttttactcccagatactgtttagaagggtcaagacattatgtagcatttattgttatttactataataagttatttactgtattttcttggccaaactccagcttaatagctagactgaaaagcaaacatgaagtgttacacaatggtgtggtccattgtgaggctgtgctcctctccacgcagagaggcatctgcttcccacccctcgcatctgagctgggcttgctttgaccaatagaatgtggtagagcggtgttgtaggcgttccaaagcctaagcctcaatatgccttgcagcttccaccatcacactcttgcaacaccgctgcccccagggaaaggaagccccggccaggctactgaatgaggaaagatctcatgaagagggaggcccagcaccaaggacccagtggaaatgccaaggactatagatgcatgagaaacccaggtgagacccgaagggaaactactcagctgagcctagcccaaaggtctagaagaatcatgaagcataatgcattgttgtgttgggtgactaagttttggcacatctcgttatgtagaaatagatggcagatccaaatggctattgtgcctcagccttgtagaaacagtgactgtgtggtagttcaagtgtatgctctttctgtatttgaaaataaaagcaccaaagtggagctcacgcaatattaagaattacatgttgtacgggttaccctggatgcccccaggaagggggaagcagtttgaattcttggtgtttcacaagaagtgttcccaggaccgtggtttcacacgatgggaggccagctctgtctccaaccagcagtagcttttcacaacagtggggacagaaccctggcacatcatgaaagttaggaggccaccctgcctccaacagatagaattcagccacccaagtgggagccatactgatcccagcaccggaaatgcagatacggaggcccggatggagaggaaattttgcagtcatactggaggaaaccagggctggaccaaggcacgtgggtgcccgggacaggccaatagtatggtgtttgccaatatttacatagagaaaagactgagcactccacagcataaggcagaagcataaggcagagaaggaggaccattgttagtctagacgggcaattcacttctgcccctaacgtacgtacctcactcggcaaaacagtccccctctcctcagaaggcaatttaatctagactcattgattcaatgccctggcatttgatctaagtattctttcttgcacactctactagcacatactcttcctggcaggaattctcgtaaatagtttcttccaccttgtcgtatgtctagtgatgatttagtgccttttacagattggcatttgggcaggtgcctcccatgtggccaggcctctcaaactggcccctgggcagaggttctcaaagtgtgatctctggaccaggcacaacagcatcccctgggaacttgttagaaaagcaaattcttggccctatcccaggcctactgaatgagaaactctggggtggggcccagccagctagttttgcaagcccaccaggtgattctaatgtgtgatgaaatttgaggttcttaacctcagctgcccattggaatcacccaggagctttaaaattacctatgcctaggtccctctcaagagctcatgattaaattggtcagaggtacagccaagacccgaggatttttaaaagctctccagattattctaatgtagagcccaggctggggaccacggccctagagagaggcaaaggctttcatagacatcacttggcagactaattcctaattagggttttgctacaggtggccttgagtttaagtggttttatatttgtgtataataacagccaaggcttttcatttatgctaggttcacttcaggcctcttttaacaaaagaatctgataattgttgtagctctgcctgtgtagtccacatgggtggttcggtggcttgagaggaaatccatttgtgctccacccattaaatagaaggatagaagaccaggctgagaaaaagtgcctgtgagcaccgtgataatctgtgaaaaggtaaaagcatttgtcaagactggcaatgatgacaaggaagaatgttaagtgcaaatacattccatttcaagacagtaagaggcacatgaaatgtgtgatcggcagcggcacaatgcagcgagacaatgacacctccctgacaaccaaaaattctgcaggatacttaccgctgctggtttttgccaccaagtcattttctttcaaaagcaaaaggcttgtagaactttatggtgaaaacctggctatttaattgcatttttactattttccaccaaatccatattttccaagaccttgatctcgccacccatgatttggttaaccatggtattcttcaagaccacaacctctgtttactttgattacaagtctaagccaagtacaagattttgtaaagaattttggaggaggacaccgatgtcccagcagaaggcggcatgagaccaacgtgggagccagaagagagaggttcctggctggcccaggtctagtcccttagtcacacacgtcaaagttcatcactagggtgttagtgaagaggaaatgggaccaggcgcggtggcttacgcctgtaatctcagcactttgggagatcgaggcgggtggatcacttgaggccatgagttcaagaccagcctggccaatatggcaaaaccctgtctctacaaaaaacacaaaaaaattagctgagcatggtggtacatgcctgtaatcccagctacttgggaggctgaggcacaagaatcatttgaacctgggaggtggaggtggcagtgagccaggattgcaccaccgcactccagcctgggcagcagagcaagactccgtctcaaaaaaaaggaaatggaccctgacaccagaactgactttggatcctttactaaaatcaatgcttctcgatttttaatgaaaaaacaaacaaacaaaaccacgtggggattttattaaagtataggctctgagtcatcaagttcccaggggatgctgatgttgctggacctcggagcacacagagagaagcacgttttggagtatgatgtgggaatgtgcagtgtgggccgggatgggggtgaggatagggaggcaccagctcgagcccaagccatgggattccaatttttaagaacatgtctcgcacctagcagggtagtcctgccaggaacccatttatatgaagggttgaggaaacctcatcctaaagaaagaggaagttagacagaccagtgtggtcctgtaaccaaggcccctattaaaacagagttgattctgactgtggccagacctctgtcattcaggtatgcatctcagcccagcacccaaggacttgggtttaagagagggcaagaaagtcaaaccctaaaatttgaggactctgttctctctaaaaattgtataacacgctgcaggaaaaggctgaggtgcttagcacctcaccaacagaggctaacacaggacttctgcagtgaccagagcctggctttggtggctcacaggccccagcgaagcatcatgcccacacaggaggggaggacatgagacagtttctcaaagagttgaaaatcatagctgatctcatacatctcaatcgctcactgaagaggacaaatattatctgttgagaacagttactttaagtaatcccttgtaaatgaggccaaatgaacaggcaggagcacattactatactggaataaactcatggaataaatttgtgtctgagattgcttctgcgaaatgatagtgtggccacatattcattcatttactcattcgttccaacacttaccgagagtctctgtactaggctttatattaggtgccagcggtctaaggacagctaagacatggggtctctaccaaagagaaaggacacagacacataaaatcctgacaatgcaaagtgagaattactgaaggaggagtacacctcagggctacaggagagcagaagaaatggcaagtgctgtctgggagctacaaggaggagctcccagagatggtgattactgggctggatcttgccagcaggagaggaggagacacagagggagggaaaaggtcttgcaggcagacgagcagcatgaacagagtgatgaaagtgaaggcgcctctgaagaagggggaataatttgtttgactagggtagagtttgtgtagctggaacccagtgtgtgtgtggagagaagtggcgaaagacaaagctagtaccataagccacaagtatgtaagccacagctgttcaggaaaaggataccaagtgctcgtaaggaaagttaatcttctcatcaaatctcttggcatgctactaagcagccatcattttgattcttagtttaaaccccttatgtgcgttaagaaaatagaagaaaacttcatattaaaaagatgtcatttcgaaagaaattttagcactgtaataatgttagtcaataaatatttgaacatctgtcttccgtctggggaagaggaaatacaccagtgaagaagagatgttgtctgtagcaggaacatcaggttctgttcctaggcctgccgctagccagctgttgaccttgaaaaacagcactggcctcctctgggccggttttctcatctctggcatgagtagattgggtcaatgaggttccatctagctcttacaacgtgtgtgtgtatctgtgagacaagatcaagttcctcaaagagctcaaaattgaggaaaggagcagcaatcagaaacagctttcaggcatccagctttaccaagatggatgggaaatccccaggaattcttgacatctccccacatccgccccagcggcaatgcaggaaatctagtccactatcttcagcagactcaatgcaactgtttccttaatgaacccccctgcagccccgtgagctaagtcagaggctttcttttcaagccctccctcaaataccccattcctccaatttccttcccctccctcaatctggtataaaatccagcaatttaatcagcagcatgcaatttccacagcacccaagagtgtgaggaaccaccagtgatcctggaaagcatctggcaggagatcttgtcatttcttacaagcctctcctataaacgaaggccaatggagcagaatggactgttcggttctaccaaattgcttaaaccaaatgccacagatggtctatacttttaactactcacagtaatatatttttacttaaaaaaaagtctggtatgatttcaaatgcccttcctcccctacctgcaatgacaaatgcactgaaaaatgatgatatttacttgatacccaacacacccctaactgtgagatccaaaccaagaattagacacgcctggcctctactaacaccagcaggcttcgcatttaacattcacgtgccaagatagcttctctcactttttctccattcttatccccacccacatacacatatcagtttaaagcactacagaagctacttactctgttatttgttcttgtcttgcccaactgcccaagccaggtcaaatatcagccataactctgctgtgtagatctcaataggctgcataaccttcctcgaggacattacattattttggtcaatatgaaaccattttttggtaacacatcaccttcaacttccatattaaataaatttaaagtagacttagaaatgtctcgatcatttttggaaagaacaaagtaattacttggtttgtttcttaaaagtcacgtaaagtagactcaattttaaataaggggtttagtatccctgttaaaatctggaactttttttaaaagaataaagccattctgttaatcaaataagtgttagctttaaaaattcaagaaataaataggggtttaaaatgactgctatccttagaagagttaatgcaactagagttttgagggagcatctactttatagagttatacattctgctagtgaaaaaagcccaagataaagatgactgctggctcaggcatcctctaccagcccatctcttccaaaacagcctattcaaggccaaattgactggctgtttaggtacatgctactaaagaaaaagaaagtttaatgtgattagcaggggaaacccagttcatcctaacagccccagcatcatatggtttctcatccactctatatacaaatataaataaggtggggaagagaaaagagaaagacagacacggtgttcaggccatttcttggaatcattcattgaattttggagtcagaaaagggccttagaaatcaaccacctatactaacgtcttcattttacatacgaaaacaaagtacccacttggtgatcgttagaaaagaaaccagatagcctattatagaatgtccaacagggaaattttaaaaatgtaacaaagtgctaaaatagtaagcaacaatatttgaggaactggagtaagtagtcacctacagttcctttgtaacatgatgcttcagttggaaaactgtaggctgccaaagctcctaaataattaatatttcgaatatgcaatttagaccaaaaaaaagtgcagcttcataaaaccttggagaaaacaacaaaaattgttacaaaaaattaactttattataagagatttattacattcaatttgaaataggtattttcatgtgcactttgatttaatattattaatatggacttccttcacaaaattcacaatttcagtatttccacttagttatagtaaattgtaaatgttagctgttcaagaactcaagaaaaatgagggcaaagaaaaaggtctgtagctttcatccaggttgtgataccttaaaagtaagaaatgagactcagagctggagaaagaggactggtatcctttatagagaaagagcaatagagaggacttgaaagtatctgaattattggcatctttttatttcccagaatgtctggaagaggtaaataagcgctttagaggggaaaggcattatctttttgtaatactgagcctctggttattttacctctcaatgcatgtgcacaccaggcatgcacacacacagaatattaatagctgataagtattcaaagattacatagtacctgaaggaaggcagacccaggttcataatgacgcaagagaactctgcagtggggaaccgtggcttcttactagacattgcttcccggatatgcagcctctcagttgagcatgaaagccctgatgcggtttgtaaagtaggcggtagctgattgttttactgtgagatgcttgttaaccagacagagaaactatgagttttcaaaagcacccatgatgccgactgagctaacatgaactaacagagtgttctgttaactgttaggtaaagaggttctcagcttgccaatgttagtcctttcttcccaaaaaagtgcaaataaaaaaaaaaaagaaattcagagttgcaaaactgctgccccatttaagtaaattataatctaagaaaaatcacaagaggatcccactcacatttctgtaaagtttccactgatctaagatgcttccaattacaaagaaaacgatgcttcactaaagtcagcatgttttcaaaataaagatataattatgtgaagcagaaaatctaataaatcacgtacttttccctccgtaattttagattcatgtaatttagctagatttatctttacataatagtcgagtgaggtatttaaattctctaagcaattatattttaatacaagtgacttttcaaaacaaaaaatgtatttgtgaaatagaaaatacaacattttatttaatatagttatgttagcacctttcccaacctacagtgagttctcagaagttaccacttcgccctgtctccgggtttagtagtttctccaatctaattggaactattacttgttacttggaaactgacggtctagttagtcttcccactgagaaagaatatttaattattactgctttttgggtttaacaagctttttgttgttgttgttgttgtactacgctccatcctattgacttttcttcccgggaatcattgcaatgacttattttatattactatattttatttcatattttaccttttctccacgatgcttaaaagaaaggcgctccgaaatctggctctctgcgcccaggggaacgaggcacaaatctccgccactcagccccactgagcagagactgcgagtccgaaccctcaagttcctcggggctttgacccctcaatggcggcggtctaactgctggtaaaacccccggcccctgactgttccaccgcccgtctcccaaacgcccagcgaaggctgacttaggtggcgggcggacctcatcgattcctcaaaccacatcgtttggtcaaaatcgcccgccctctcttcgctcggattttaaaggctaggcttgtaagtcagtaagttaacggtatttgggccctgggctgcccttgtgggtcagggtcactgatgtccgcgacacggactggaccgcgcaccacgcctgctcccggcagaggccccacccgggtggctgagcgcagcgcactggggccccgcggtccgagagcggcggggaggagcgggcgctcgccgagcgttccccgggacagtccggcttggggactcaagcgggtcatgggatgccggcgctggccctctcctgagatcctcctgctcccccgcaggcacgagtcccctccaaatcggctcccctcctacactctcgtgacgcgaggtcgcggccagtgcccaatatcaccaaagtcccggcctcagcccagccccgggcagcctggcaggctttcaggagcctctgctcccggctccgggggaccctgcgtacctgccccaggtcctctgggaatgggctctgggtgccaggcaggtcccggtgcgtgctgctcctagtgcccagggcctcggcagtgagaccccaacccgacagctggataagggatcagcgatcctgtcgcaaacggacagccccagcgcggacccggtctgagcgctgatgctcgcgggtccaggccagccactcctcgaggcgctccctcggagaaagggcgcagcggccccaagcgtgcccgctgcaactagtgtcccaggttctcgccgtagccagcttctccgggctacagcctcgtctccccgcgtgcaccccgccctggcctcggaggctctgccctccggccgccccatcgcagcccgcctcaggccccggcccccagccgcgcctcacctgtgagaagcagacagctgagcagcgcgcacagcaggaccccggtgtcccagtagctgaccatggtgagcgcgacgcggcctgctcgcccggtgcccgcgctccccgcggccaacgacccggccgccagagtccgtcctctcgttcgccgccgccggccccgcgccctgagcgcccgtctcgcggctccagccaggagacaaccacttccccgggtaatcctcgccgccaggcgcccgctggccgctgcacccgagccccggagcccgctccgagccgccgccgctgccggggaggagccgagaggagtgtccgcctggcgcgctccgagcctcccgcggacctcgat

SEQ ID NO: 1179 - DNA, 84897 bp, Homo sapiens
gctaaaaccgtctcctacgaacaaatccagcacttggcactttattcgacggtcctaaaaatagagtcctaaatttagaaggcaaggtgctacttttagctcctcttctcggaggaaaacagcacgcaccgcgccaggccaaggtccacggggatttgatttagcatttgggtaactggccgctaatggaactgaagacagctgggcctaacaagtgcccaggtgactcaggtaagcgaggaaaccagatcgaggttctcttgcgtgggacaggttaaactctgaccaaaccacagctgagccgggacgccttcctgtctaaagtccaaagtccggacgtggttggcagggcgcaccggcgcgtgccccgcaggccatttttctgactggaatgacggcggcggctggcttctcggggctgccggggtctcccggggtacgccgccgtcaggacttctgcagggcgcagacagcaggctccagcgaggctgcggaaggaaagccttgggtgtcggggctgggcctggcgtcggcccctgggtcgggggggtgggggttgcgccgagacgcctctaggagaagtctcgccgccgccgccaccgcggccgcccgaggcgggtgcccttgggacatagccctggtctttggggttgtgcggctcacacgacagcgcggagtatgaggccgaatctcatcctctagtcccaagcctctccactaccagggctgggtggcttcgccaggtagagcgccggcccctttaagagcaaacgacccggacacgtctgcgaagcttgcgcgaagaaggggaagtttgcggctgtccgcgcctccccgccttctcgcggctgcccggccgaaaccaaaccgaggggtggggtggcgaggacagggtacgtcgcaggcttgtgcgggtcgggctcggacctgcgctgcctcgggatgtaaagtataacaagagggtcgggatgggcagcgtaggcctgtgaggcctgcgggtgcccctgtcccccagctccccccgcagccggctccgcagtggtccactccggttgccgggtgcggattcgggttccggaccgaaggctgtgtgttctccgccgtttattgtggccccgacaggccggggttactgtggcgaccacgagagcagctttggcgctatggaggagcccggggttacccctcaaccgtatttggggctgctcctggaggagctacgcagggtgagcccaggcgcgatgagtgttacgtggcccaggggtcgcgggagccgccgggggaaggaagcagtagaccggctttggggtctaagccgccgtggtcagaggtcccgaagccagtcctcgtctgctgcccggctcccgcccgtgttcgaggcagtagttaggctcgtagggcgcttgagtggtttttgtgtgatggaggaggacctggggctctgggaaggtgaagaaagcacttgcttagctggactttgcaaagatgtaaatgtttcccgattcctaaaactaattagcctttccgctatgttgtttattttgagcagagacacgtggttccttcgactgtgagaaacttgaggactgttcctttaaattagttacatttactgatgtaacttctcgttgaaccttgaaagaacacctgaggttgggcggggagttgaaattttgattctgcattttttttttttttggtaaagaatgaatgcccttttgagatgctctaccatgagtgagattgttcttcgcttctgtcttgttaatgtacagtctagagatagtaaactcccagtgttcaaattttgttttttatttttcaggtctagtttataatcaagttgtagagatttttctccttaagtgtttctaggtatctttgttgacatgtgtaggggcatttatgtcgccgtgtttttaaaaactggattaaatctttaaaaagaccacttaattattgaggcagttacgattatgttttcttgttaggtgaattaaaggtagtgttgccatggtgtttatgagttcatagtttgtctaatgcatacgcatatatatgtatttaatatgaaaagagcacctttatggagattctaaatggactaagacttagttttggccactagcatcatgttgtctgttaagagagagaagacaaaaaaaaaaatagtacaaagtagaaactgatgaagtgcttacctaagcatacacacacagtgcagggaactaggagctgtattacttagagtgtaaagtgggcttagggagtgatgggcaatgatgcttgccggagatgtaagtaggttccaagtgctgtaggtgttggagagctcttgaaggcttttccgtggttagacttgtggtttaaaatttaagctcttcttgatagtagcatgtagattagatgttagggaaacaaaacttgaaatagggattaagggagaggtgacagtagtaaggataggaaagagggtactgtgtggagaaatagcctctaagagctaaaatatgtttgactttattgattgcatgtgaagggtgagagagaaggaatctagaaggactcccaggtttctggctgtggtaacttattcatggaggtagggtttttagaaagagaagcatatttccctttcttcactaaaaacaataataatcaagatttagtttttataggactgccagtgtacatggagaaatgcagaaatacatggagaaatgcagccagattttgcagttttctctagtctggtgcgttgtatcttcacctgcacagtttttttttttttttttttttttttgctaaatgcgagtaccctggcctgggggctaggatggcacaacattgttccgctttaaattttttttttatttttaaaaattattttgtattgagatatattcacacaacataaaattcatccttttataatgtccatttcagtgctttttttgttaaattcactatgttatgcaactgtcagcacagttcctcaacatttttattaccccagaaaataaactctactgattagcagtcttaattcccacccctcatcccttgacaaccactaatctattttctgtctctatgaacatgtctattctgcatgtgtcatgtagtcatgctatatgtggccttttgtctggcttcttttacttagcatgttttcaaggcttatccatgttgtagcatgtaacagagcttcatttcttttttctttctttttttttttttgagacagggtctcatccctgtcacccaggggggagtgcagtggcttgatctcagctcactgcagcttagacctctctggctcaggtgatcctcccacctcagcctcctgaataggtgggaccacagcacatgccaccaggcctggctaatttttttgtattttttgtagagacagggtttctccatgttacccaggctggtcttgagctcctaggctcaagtgatctgcccacctaggcctccaaaaatgctgggattacaggcgtgagccacttcgcctggcccttcatttctttttatggtgaaaaaatattccgttgtgtgactatatcacatttatgtcatagttgatggacatatggattattaatactttttggctattatgaataatgctgctttgtgtataagtttttatatatgtttttagttctcctgggtaagtacctgggtggaatcgctgagtcatatttaccatatgtttaactttttgagaactgccaaattgttttccagaggtcacaccattttacatccccaccagcagtttatgagggtttcagttttctgcattctctccaacgcttgtgattttctgttttcttttgtttttaattgccacccttgtgggtgtacaggtgagtggtatttcactctgttgtggtttttttttttttttttttgagactgagtcttgctctgtcacccaggctggagtgcagtggcatgatctcggctcactgcagcctccacctcccaggttcaagtgattctcctgcctcagcctcctgtgtagctgggactataggcactaaccaccacacctggctgatttttgtatttttagtagagacaggtttcaccatgttggccaggatgatctcgatctcctgaccttgtgatccacccgcctcggcctcccaaagtgcagggattacaggtgtgagtccccccacccggctttactctgttttttgttgttgttgttgtttgtttgttttgttttttaagagatggggtcttgctttgttgcccaggctggagcgtagtggcgtgatcatagcccactgctgccttaaattcctggcctcaagggatcctcctgcctcagccttccagagtgctggtgttacagatgtgagccaccacaccaggccttgtggttgttttgatttgtattttcctagtaactaatgatgttgagcatgtgcttattgtttatatcttctttggggaaatgtctattgatttccttttgctcatttaaaaaatgggtggtctttttattgttgagttataagcattctttatacatttagggtgctaaatgcttaccagataaatgatttagaaagattttctctcattctgtgcattttcttttcaccttcttggtgtgtcctttgaagcgtaagcgttctaaattttgattaagtctaatttatcttttcttcctttggttgcttgtgcttttggtatcatagctaagaaaccgttgcttaagacaaggttacaaacatttacagttatgcttccttctaagagttttagctcttacgggaagttcttcgatccactttgagtgattttgtttccatatatgttatgaagaatgggtctagattcattccttggcatgtggatatttattggcttattctagtatgatttgtttgaaagaactgtttttttctcattgatttgtcttaatactgttgaaaataatttaccataaatttaagggtttatttctggactctgatttctatttcattggtctgtgtctgtccctatgccattactacattatctttaaaacatttttttacccaatgtcttgattattgtttctttgtagtaagatacagtagggaagtatgagtcccccagcgttgtttttgtttatccacgttctttttctttatcaatattgttttggctatgtggagtcccttgcatttctatataaattttaggaattcagttttaggaatttaggattcagtttgtccatttctgcaaaaaaggcagttggaattttaataggggttgcattgagtctgttgatcagtttagggagtattgctctcttaataatattaagtcttccaagctgggtgcagtggttcatgcttgtaatcccagcactttgggagaccaaggtgagcagatcatttgagcccaggacttcaagaccagcccgggcaacttggtgaaactgttgtggtctttctgctccttagctcagctaggtccaagttcttgtctcacaaccaagaagaattaggcatgcggaccccagagagtgagtggaatagaatttattaagtgaaaggaaagctctcagcaaagagggaatgcagggggtggttcccctaccagaaggcaggaaagtccccctgtgtggctgggtctgcggccttttgtggactcagaatggggagtgcatgctgattggtttgtgagtatgcaaaaaaggttaaagcaaagacaccacttagaggtgggcgtgacaatgtagacaactaattaggaggccgggtgcggtggctcatgcctgtaatcccagcactttgggaggctgatgggggtggatcacgaggtcaggagtttgagaccagcctggccaacatggtgaaacccttctctactaaagatacaaaaaattagctgagcatggtggtgtgcgtctgtaatcccagctactcaggaggctgaggcaggagaatcgcttgaacccgggaggcggaggttgccgtgagctgagattgcgccattgcactccatcctgggtgacagggcgagactccatcccaaaaaaaagaaaaagaaaacttattagtaaagggtaggtatatgtaaaataggtgaaagatggggatcaatcagaggaaagtgggccaaacaagaaggcaagttctcaatctggtccaaggatttaacttgtggcttggctttcaggctttaaactgtctttggcttgaagttggggtttcactagggacccgcccctatctgcctgggcatttggctgcctcctgccactctcaaaatcctgtctttaaaagaaatacaaaaattagttgggcaaggtggcatgtgcctgtagtcctgctgcttgaggctgaggtgggaggatcatctgagcctggggagggcaaggctgcagtgagccaagatcgcaccactgcactccagcctgggtgacagactcagtccctgtttcaaacaaagaagtcttccagcccatggacgtggattggctttacatttatttaagtcttccttcgttgctttccacaatattttgtagtttcagtgtgcacttcttttgttaaatgtattcctaataatcttattctttttgatgctattatagatggaaatgttttctttatttcattttcaggttgctcattgctgttgtatagaaattcaactgatttttctatgttgattttgtattctgcaactttgctgaacttaatagctctgatagtttttctataggttctttaggattttctctgtgtatagaatagcattatgtcatcttcaaacagtttttcttcttcctttccagtctggatgccttttatttatttttctttcctaattgctctggctagaacctccattacaatgttgaatacatgttgatagagcggacattattgttcctgatcttaggagaaaagctttttttttttttttttcctcatctttaagtatgatgttaactgtaggttttgcatagatgtttcttgtcaggttgaggaaattccctcaaatcgtactttgttgagtgtgttttgttttttttgttgtttgtttgggacagggcctcactctgttgcccaggctggagtgcagtggcatgatcatgattcactgccgtctcgacttcctgggcacaggtgattctcccacctcggccttctgagtagctgggaccacaggcatgtgccatcatgcttggctaatttttgttgaatgttttgactatgaaacggtgctagatatagtcaaatgctttttctgtgtctattgagatgatcatgcgttttttttttctcttcattttcttaatatggttcataagattattgtatgttaaaccaaccttgcatttctgggataaatcccacttggtcatggtacataatcctttttatatgttgctggatttggtttgtcaatatttttttgaggatttttgcatctggagtcataagatatattggtgtgtgattttcttttcttgtgtgatgtatttgtctggcttttagggtaaataccagcctcatagaataagttaggaagtatttcttcctcctctatgtttgggaagagtttgagagtgattggtgttaatgttttatcttggagaggtgtaccttcatggaactttgtgttatagtcaagtattcacagggtctgcatgttgacattctttttgttattagtatatatcatgtttgaagttagatgaaaaacaattttagtttattcttagtatattttgtcaacctgattaattgattttttttaaagctacttgatcttgaactcctttagtactcatgttttggaaatggaatagattttaagtgttctgtgattaatcactaccgtactttatggagggttactcttggaggggttacccatcaccctttaaatttcagtttatcagattacatgtaattctgtattatatttgttgatatttgagaaatttggttgttctttctatgtttttgtgagatagggtgttatgttgtagataaaatttaagggtgaaaaatctccttgagaaagccagaataatttagaccagagcaatgaatttgagatgaatcctttagaactcagtttctttttttctttttttctttttttttttttttgagatggagtctcactctgtcacccaggctggagtgcagtggcgtgttcttggctcactgtagcctcctcccgggttcaggcaattcttgtatctcagcctcccaagtagctgggattacaggcttacgccaccatgcccagctaatttttgtatttttggtagagatggggtttcaccacgttggccagactggtctcaaactcctgacctcaagtgatctgcccaccttggcctcccaaagtgctgggattacaggcctgagccaccgtgcgtggccaagactcagattctttgcttttctccagtctgccagatctaaccagctcaaggctttattttattttatttttttaaagttttttttttttgtaatcccagcactttgggaggccaaggcaggtggatcacctgaggtcaggagtttgagaccagtctggccaacatggtgaaaccctgtctctactaaaaatataaaaactagccgggcatggtggtgggcacctgtaatcccagctactcgggaggctgaggcaggagaattgcttgaacccaggagacggaggttgcagtaagcctacacggtgccgctgtactccagcctcggcaacagagtgagactccgtctcaaaaaaaaaaaaaaattttttttttttttaaattattccttaatttccatgtttccttaatcctttgtgtgtgtgtgtgtgtgtgtgtgtgtcagagtccagttttgttttgtcacccaggcttgagtgtagtggtgcgatctgcagcctttgcctcccaggttcaagtgattgtcccacctcagcctttctagtagctggaactacaggtgcctgccaccatgcctggctaatttttgtatttttagtagagacagggttttgccacgttggccaggctggtctcaaactcctggcctcatgtgatccgcctacgttggcttcccaaagtgctggcatgagccactgcgcccggccctagctcaatgctttaaactagaatttaccatgtccttttagaagagaagagctgataaaatgtgattgaatctaagaaatattattgtactaaaggtaattacgtgtttgatctgagagatgcttttggaattgccttttaaagtagagtgtcataggtcatattgattacacaatttttgagttagtgtgcgtcttatgtgttgaatacattagctaaaagtaagatgcttggaaaatgtgtaaactgtgaagaaaacttttcttcctggtattgtgtattgaatgccttttttcccccaatagcaaaaataatttttttttatcattaattgcttgtaatgatattagatttctgcgaactggtacctagggtaatgtagggagaggcagaagcagagatcagggtaaagggatattttttagaagtataatcaggtttgtttggtacaggttatgaagtatagatagtaccttggaaggagtacatatttggattagagttataaaagattttggagaggaaaataactattaaacactgttcttataggcagaaagggcctaaaaggaagatttgctgtagaggttttgggttaaagcctgaaaagaatcaaaccccatcatacttcagattgttcttaaaatggcatttttcttttttccccttacctttccccttttctttttgatcaagtaatatcttgggcctggtaacaaagagcagaataaccccattaggtaaggatgagtaatgagctgacccagagaaaggtgaaatatagaagcaacagcaaaagccttaggctgtgttgtgctgaaggtctgctgtggggagaagtaatgtggaaaggccatggtcagaagatcagggtctttggaggagataatataaataattacccttttttgagcacctgtctggcatgttcaaacagcattattctcattacacttaagagaagggacgcacagaggtagggtggggagattcaaactccaaacccaaatctctatcagtggtgttcaaaacttgtttttattttttgagacaggtcttactttgttgcccaggctggctttgaatcaaactttttatttttaaagctgcaaattgattttttcttcctgtagggaaattgtatattggggaactgattatactttacagataaaacctgaactggttgaaatcagggtaagagtacctgaaccctaggtcactcagtttctttctttggccttctcttattctcatccttggaaactttaagtcacctctgtagaactccagtttgaagataattgcatttcaccatactgctgttctttacttggcgatagtgattgaaagttgacaaaaaaatgtactctgatactttctgtttggtgttagtctggcagcccattttgtgttgaccacataaacttgtacctatgtttgtaatcaatatttttaccaaaagtacatttttaagaacttacttttctttatcttgaaggttgtggcagcactgcctgaaggtatgagaccagattctaatctttatggttttccatgggaattggtgatatgtgcagctgttgttggattttttgctgttctcttttttttgtggagaagttttagatcggtaagtaaccagtgctatactaagagaatgttcattttgtcactgggctgaacaaataatatgagaaacatatttgttattttaagtaaacaagttagaaactacatagggattcagaggtttttgttttttgttttttgttttttttaaaagagatgagggtcaggaatgagagtcaggcccagtgctgtggctcccacctctaatcccagcactttgggaggccaaggcagaaagatcacttgagcttaggggtttgtgaccagcctgggcaacacggtgagaccccatcactacaaaaaatacaaaaattagctggacatgaggacacccgtctgtggtcctggctactcaggaggctgaggtgggaggattgcctgatcctgggaagtcgatgctgcagtgagccatggttgtgacactgtactccagcctgggtgacagagagagaccctgtctcaaaaataaagagatgagggtcttgtgttgctcaggctggtctcaaactcctgggctcaagtgatcctcctgcctcggcctcccaaagtcttgggattacaggtttgagccaccatgctcaactggaatcttttaatgtaagatcttttatatatatatatatgtgtgtatatatatatatatatatatatgtgtgtatatatatatatatatatatatgtgtgtatatatatatatatatatatatatatatatatttatatttaaagagatggggtctcactatgttgcctaggttgtagtgcagttgctattcacagatgcaattatagtgcgcctacagcctacagcctcaaactcctgggcttaagcaatcctttctcagccttttgagtagttgggactacacaggtccatgtcactctgcccagcttcatcttttttttaattctgggaaattttatttgagacaggatttcactcctgtcacccgggctggagcgcagtggcatgatctcggctcactgcaatctctgcttcctgtgctgaagcaattctcctgcctcagcctcctgagtagctgggactacaggcgtgcactaccatgcctggctaatttttgtatttttttgtagagacgggtttcactgtgttgctcagaactcctggcctcaagtgatctgcctgccttggtctcccaaagttctgggattataggcattaatcaccacgcctggcctaattttgggaaatttttaatgcatttttgggactgctatttttcagatgttgccccttttacttctgacttccctatctcttaacttctatttttcaatttctttatggttttctataccttttgagagttccttaatctgaggaactgaaatctattcttcatctacactcattgtagagtatcttgtcttttaaaggttttcccttttatctctatccatattctgtagatgattgaagtcctcatttcttttctacttgtttgtgttacctcagccctaaggctgatccttttacaaatgaattcccgcctgcttcattatttgagagagaggttaaggaagaaaaaggtttggtttactgtttctttagtcagttcagatctatggccctatggtaacatttctcaggctgttttattttggatattggcatcaagggatatgataataggggcttcttgaaattatttttttagggtcaaatttgtttggggagcaatgggttaaatgaaattaaacaagtatctttagagtaaagttatttcagagtctttaatatgctaattcacaatgtgaatcttcaatagggagtctttaataagtagtatttaggctgggcatggtggttcatgcctgtaatcccagcactttgggggacccaggcaggtggatcacctgaggtcaggagttccagaccagcctggccaacatggtgaaacccggtctctactaaaaatatgaaaattggctaggcatggtggtgggcacctgtaatcccagctactcaggaggctgaggcagaggaattgcttgaacccaggaggtggaggttgcagtgagctgagatcgcgtcattgcactccagcctgggagacagagcaagactctgtctcaaaaaaaaaaaaaaaaaagcatttattttctcattggaaacagaatacttttggcttgtatttatacaaaggcaataagaaacctgtatttctaagttggcagtagacgttaaatgaattgatttacttgagagcgtatttgttttaatgtaatttttgttaaaaatttgtttcaggttaggagtcggctttatgtgggtaagttcttttttctgctttgactctcattgttgtgttgtaaaaacttataataatttactcatggtaatattgacttgacttttttaggacgagagaaaaagcttgctctaatgctttctggactaattgaagaaaaaagtaaactacttgaaaaatttagccttgttcaaaaagaggtaagatatttttgaaaataatattcatgttagagtcagagaactttatacttctcactgtaggtacttctgtgtaaatttaagattatgaatgctttgtttgcagagtatgagagttctctttgctcttcatattcaacacttaaccagtcttactaattttaaccattgtagtaggtgtacaatggtgtctccttgtgctttccttttgagttttcctgactgatgaggtcgagcacacaaacacatcctctgcatgtgcacatttctggtatctgttcgtgtatccaaatgttctcttttcgtaaagacaccagtcagattggattagggcccaccctaacaaccttattttattttgaccacctccaaaggccttgtctccaaatacagtcacattctgaggtactggggttggagcttcaacatgtgaatttgtggggacacaattcagtccataatagtctttgatccatttgaaatcagatctgtgatggtgcagttgagggtgtgtgtgtgtgtgtgtgaagattcattttttttcctgggcgtgtcgagttaatgccatttattggaaggaccatcttttctctgttgttctgtagtgtcatcttcttaagtcactgaatatatgtgagtctgtttctgttaaatcttctattttgttgggctttttgtttgttttttgccaataacatgctttttatagcctgtagttttataacaagccttagtatctggtatggttaatttacagttcttggctattgtgaataaagttactgtgaacattcttctacaagttttttttttgtgggcatgtattttcatttctcttcataagtagtagtggaattggtaagtcattagggcattagggcaggtatagtttaactgtgtaagataagaaaccggctgggcacggtggctcatgcttgtaatcccagcactttgggaggctgaggcgggcaaatcacgaggtcaggagatcgagactatcctggctaacatggtgaaaccccgtccctactaaaaatacaaaaaaattagccaagtgtggtggtgggtacctgtagtcccagctactcgggaggctgaggcaggagaatggcgtgaaccaggagacggagcttgcagtgagccgagattgtgccactgcactccagcctgggcaacagagtgagactccttctcaaaacaaacaaacaaacaaacaaacaaaaaaaccctactggctgtttttatcattttttcttggttttggctctcagcagtgttactatgatttgtctaggtgtggtttttttctatttgtccttattggggtttatgatgcttctagaatctgtggcttaatgtcttttattagtttagtttttttttttttttttttttttttgagacagcgtctctctctctctcttgtctaggctgcagtacagtggtgtgatcttggctcacttcaatctccacttcctggactcaggtgatcctcccacctcagcctcctgagtagctgggattacaggcatgcgccaccatgtccagctaattttttaaaatttcttgtagagatggggttttgccatgttgtccaggctggtctcgaactcctgggttcaagcaatcctcccgtcttggcttcccaaagtgctaggattacagctgtgagccaccgtgctctaccttttattagttttgaaacactcttgattgttacttttccacatattgtttttgcccttttttgttctttctttctgggactataaaaatgggtattttaactttttattatatctcatctgtctcttacgttcttttccagggtttccatctttttgtttgcccacacttcagtctagacataatcttctttaacttccatgttgccaatagttttcacttatgcctataatcatcttttaaaccatccattgagatcttaatttcatctcttgcctttttcagttctgcagttttattgtggctctttttgtagttctttttctctggtacaattctattttttaattccatttacacattatgctctcttatttttgttttgttttgttttggtttttttttttttttggagacggagtttcccctgttgcccaggctggagtggagtgcagtagcgcgacctcggctcactgcaacctctgcctcccaggttcaagtgattctcctgcctcagcctcccaagtagctgggactacaggcacacgctgccacgcctggctaattttttgtattttagtagggatgggtttcactgtgttgctcaggctggtctcaaactcctgagctcaggcaatccacctgccttggcctcccaaagtgctaggattacaggtgtgagccaccatgcctggcctatgctctcttattttatttatttatgtgttatttttattttctgattttcagaatatatgctgccgacaaatatgctttcttattttaatgactactgcattatccagtagtctatttctggtgctcattttttctcttgtttctcagtcaagtcttgtccgcttgaatgccaggttattttatatgaagtgtcagtgataatataataaaaattgtaaagataattttgaagctgtgggtgctgtcgtctctcttcagtgaggatttactgttgcttttcataggcagctaggctagggacattggaaatttcagataactttatgtatttgactttcttttatgtaaaataagttttattgtgtatatttaaggtatagaaatttcagataactttgattttgttttttgtaaaataagttttattgtatatatttaaggtataaacatgatgagatacgtgtatagtaaatggttactatagtgaaacaaattaacgtattctttctctctcatagttacccattccctgcccacccctccagggcagctataatgtactcatataacaaaaatcatgaatgcagtacactattattaactatggatctcatgttgtacatgagatcttttaacttgttcatcccatatattttcttttcttttattgagacagggtctcattctgtcacacaggctggggtgcagtggcatgatcttggctcattgcagcctctatctcctgggctcaagtaatcctcccacctcagactcctgagtaactgcggctacaggcacatgatacatgcttgcctgatttttaaattttttgtagagatggggtctccctatgttgccaaggatggtctcaaactccctggctcaggtgatcctctcgcctcagcctcccaaattgttgggattacaggcatgagccaccatacccggccatattttctgacctacatgtttcttccctcctacccaacactgctaaccactgttttgttctctatctctatatatttgacctttacaaaaattccgcatataagtgagatcatgcaatatttttctttctatatctggcttattttacttagcaaaatgtcttctaggtccgtccatgttgtagcaaatggcaggatctccacctttttatggctgagtaatattccattgtaaatatataccacagtttctttattcgtttgttcattgatagatacctaggttgtctccatactggctactgtgaataatgctgcagtgaacatgggcatgcagctgtgtgtagaaggtgccaatttcatttttttcggataaatatctggaagaaggtttgctggatatagtagctctattttaaatttctttaggagtctccatactactttctgtagtgactgtacccatctacatccctgccagtagtgtacagtaagccctcaatgtccttgatagatggttgaaaattgactttaagtgaaacagtgtatactgaattcagtttttttttctcatcaatgttataatgaaacaatgttgaagaaaacaatgttattcaaaggacaaaggacctgctctatgcctttctcttttcttgtctagaaaaagggttcccttttttttgtaacttttaagttcaggggtacaagtgcacatttgttacataggtaaacttgcgtcctgggggtttgttgtagagggttcccttttctccacaccttcacaaatacttgtcatctctcttgtctttttgataatagctattctaacagatacaaggtagtatctcattgtgtttttgatttgcatatccttgatgattggtgatattgaacaccatttcatatacctgttggccatttttatgtcatcttcagagaaatatctatttaagtcctttgcctgtttttaaatcaggttgtatgtttgcttgctgttgagttgtatgaggtcttttaaaatattgaatattaaccccttatctgatatattttttctcaatctgtaggttgcctttttattgtgtttacttgtgtatatttttattttttttaccttgcagcttcacctcaaaggaactttcattttattgtttcttttgctttgcaaaagctttttagtttgatgtagtcctgttcacttactttttgcttttgtagcctaagttgttgatgtgatagtcaataaattattgccaaggccagtgtcagggagctttttccctgtgttttcttctaggagttttgtagtttcaggttttatgtttaggtcttttatccactttgagttgatttctatgtgttgtataaagttaagagttcagtttcattcttttgcgtgtgaaatccagttttctcactaccatttattgatgagactattctttctgcattgtatattcttggtgccctattgaaaatttgaccatatttatttggatttatttctgggctctctattctgttccactggtctgtgtatttgtttttatactagtaccacgttgttttcgtgactacagctttggaatataatttaaaatgagttagtctgatgctgccaactctatttttctcagaattgctttgactatttgggatcttttgctattccatattaaatttagattaaaaaaatttctgtgaagaatgccattgagattttggctgcgtttccatttctttgtgtgctcctcaatttctttcatcaatgttttatacttttcagtgtgcagatctttcacctccttggttgaatttgttcctaggtattttattttttttgatgctatgtaaataggattgttttctttttttttcttttttttattttttttttattgatcattcttgggtgtttctcgcagagggggatttggcagggtcataggacaatagtggagggaaggtcagcagataaacaagtgaacaaaggtctctggttttcctaggcagaggaccctgcggtcttccgcagtgtttgtgtccctgggtacttgagattagggagtggtgatgactcttaacgagcatgctgccttcaagcatctgtttagcaaagcacatcttgcaccgcccttaatccattgttaaccctgagtggacacagcacatgtttcagagagcacagggttgggggtaaggtcatagatcaacagcatcccaaggcagaagaatttttcttagtacagaacaaaatgaagtctcccatgtctacttctttctacacatacacagcaacaatctgatttctctatcttttccccacctttcccccttttctattccacaaaaccgccatcgtcatcctggcccgttctcaatgagctgttgggtacacctcccagacggggtggtggctgggcagaagggctcctcacttcccagaaggggcagccgggcagaggcgcccccccacctcccggacggggcggcggccgggcgggggctgccccccacctccctcccggaaggggcggctggccgggcgggggctgacccccccaccttcctcccggacggggcggctggccgggcgggggctgaccccccacctccctcccggacggggcggctggccgggcgggggctgaccccccacctccctcccggacgggatggctggccgggcgggggctgaccccccgacctccctcccggacggggcggctggccgggcgggggctgccccccacctccctcccggatggggtggctggccgggctggggctgaccccccacctccctcccggtcggggtggctgccgggcggagacgctcctcacttcccagacggggcagctgccgggcggaggggctcctcacttctcagacggggcggctgccgggcggaggggctcctcacttctcagatggggcggccgggcagagacgctcctcacctcccagacggggtcgcggccgggcagaggtgctccccacatctcagacgatgggcggccgggcagagatgctcctcacttcctagacgggatggcggccgggaagaggcgctcctcacttcccagactgggcagccgggcagaggggctcctcacatcctagacgatgggcggccaggcagagacgctcttcacttcccagacggggtggcggctgggcagaggctgcaatctcagcactttgggaggccaaggcaggtggctgggaggtggaggttgtagctagccgagatcacaccactgcactccagcctgggcaacgttgagcactgagtgaacgagactccatctgcaatcccggcacctcgggaggccgaggctggcagatcactcttggttaggagctggagaccagcccggccaacacagtgaaaccccgtctccaccagaaaaatatgaaaaccagtcaggtgtggtggcgcgcgcctgcaattgcaggcactcggcaggctgaggcaggagaatcaggcagggaggttgcagtgagcggagatggcagcagtacagtccagctttggctcggcatcagagggagactgtggagaggggagaggggagagggagagggagattgttttctagatttcgtttttggctaggtcgttatttgtgtatagaaatgacatagttttgttttgatattatatcctgcatctttactgaattcagttattatatctgtatttttgatgacatcttttgggttttctacatataggatcatgtcatctgcgaacagataattttacttctctgatttggatatcttttctttccttatccttctcttccttccttcttactttttttttttttttgagacaggctctcactctgttgcccaggctggattgcagcagtgcaatctcagctcactgcaacctctgcctcccgggttcaagtgattctcccacctcagcctcccaaattgctgggattacagatgtgcactactgtgcctggctatttttctgtgtgtgtgtgtgtgtgtgtgtgtgtgtgtgtattttttggtagagacagggtttcaccatgttggacaggctggtctcgaacttctgacctcaagtgatctgcccaccttggcctcccaaagtgctggcattacaggcgtgagctaccatgccaggccttttatttctttttcttgtctaattgctttgatagtacttccagtactattttgtttttgttttttgagacaaggtctcactctgttgcccaggctggagtgcagtggcatggtcatggctcactgcagcctcagcctcccgggttcaggtgtttctcccaccttagcctcccaagtagctgggactacaggcgtgcaccaccacgcccagttaattttttgtattttttttgtagagatggtgtttggccaagttgcccaagctggtctcgaacttgggctcaagtgatccgcttatctcagcctcccaaagtgctgggattacaggtgtgagccaccgcacccagcccttccagtactgttttgaatagaagtggtggttgtgggcatccttgctttgtaccagatcttaatggaaaaggtttcagtttctccccactgatgatgatatttgctgtaagtttttcataaatggcttttgttatgttgaggaactttctttttattttttttcattattttaaaaattttattatttattatttatttatttttttgagatgaagtcttgctctttcactaggctggaatgcagtggcgtgatctcggctcactgcaactctgcctcctgggttcaagcaattctcctgcgtcagcctcctgagtagctgggactacagtcatgcgccaccatggctggctaattttttgtattttggtagagacggggtttcaccatgttggccaggatggtcttgatctcctgacctcatgatctgcccgcctcggcctcccaaagtgctgggattacaggcatgagccactatttagttttttgagacaaggtctcgctttgttgcccaggatggagtgcagtggcatgctcatggctcactgcagcctcaacctcctggggtcatgtgattctcccaccttagcctccctagagtagctgggactacaggtgtgtgccaccaagcctggctaatttgtctatctttggtagagatgtggttttgccatgttgcacaggctggtctcgaactcctcggacttcccaaagtgttgggattacaggcgtgagccaccacacctggccagaactttacttctatacttaaactgttaagggtttttatcaagagatgatgttgggctggacgtgagggtgtgtgcctatagtcccacctacttgggagcatgaggtgggaggatggcttgagcccaggaattcaagtccaacctgggcaacataggagaacctatctctcaaaagaaaaaaaaaatggatgttcaactttgttgaatgttttttctgtgtcaattggtatgatcatgtggtttttgtctttcagtctgtgaatgtgatgtatcacattaattgatttgagcgtgtatatattatacatatatatatatatatatatatatatatatatatatatatatatttttttttttttttttgagacggagtctggcgctgtcacccgggctggagtggaatggtgtgatctcagcacactgcaacctccgcctcccgggttcaagcgattctcctgcctcagccacctgagtatctaggactacaggtgcctggctaatttttgtatttttagtagagtcagggtttcaccatgttggctaggatggtctggaactcctgaccctgtgatctgtccgcctcggcctcccaaagtgctgggattacatgcgtgagccactgtgccggccaatttgcatatattaaaccggctttgcatgccagggataaataccacttgatcccaatgcataatctttttgatgcattgttaatttcaatttgctgatattttatttaggatttttgcatcagtgttcatcagagatattgacctgtaggtttgtttgtttgtttatttatttattttttgtggtttcttggtctggcttaggtatcaaggtgatgctggactcataaaatgtgttaggaaatattccctcctgttgtttttcttggaagagtttaagaagtcttggtaataattctactttgaaaatttggtaaaattcagccgtgaagccatctcttcctgggcttttctttgttgggaggtcagattactttaataacagattgagatatttggaagctgggcctcagttcagaggattagtctgtttttggtttcgactttgttgtaaggtaggcaggttttctttttttttttttgagacagtcttgctatgtcactcaggctggagtgcatgatctcgactcactgcaacttccgcctcatgggctcaagtgattcttgtgcctcagcctctcgaatagctgggattacgagtacacgtcaccacgctcggctaatttttgtatttttagtagagacagagtttcaccatgttggctaggctgttcttgaactcctgacctcatgatccctgtgatctggcctcctaaagtgctaggattacaggtgtgagccactgcgcccatccaaggtaccagttttggttggtaaggacattaatttccttttgctgctgtaacaaattagtgcaacctagtggtgtaaaacaacacacatttattctcttaaaattttgaaggtcagaagtctagaactgatcttttaaaaaatattttgttgtagagatgggatctcactatgttgcccaggctggccttgaactcttggcctcaagtgatcctcccacgttggcctcccaaaatgctgggattacagacatgagctaccatgcccagccttaaaaccaatcttgggggcaaaagttaagatagcagcaagtttgtttccttatgcatgttctaggagagaatctgtgtcttgtgtcttatatggagtctaccaacatttcttggctcataactatgtcaccccagtttctgcttctatcttatatcattcttttctaagtttggtcgtcttgcctcctccttttaaggacccttggcattatattgggcccaccaaaataattctggatgctttttccgtcttaagatcctttatcacacctggacattctggggagcagaacatagacatctttggacaggtcattgtttagccaagcacagggttcatctgacttggcaggtcctgaactccaagtgttttttctcagcttctgattctcctgaaatctctgcttagtttcttagcccatcagcctcttcttctagggggaatagaaatgtcaaatactagacttgcctttctggggattcccacttctctcacaaattctcactgttttgatagctctctgaggctttcagacagatatatatttttttttttggtattttttgtcaagcttttcttgttcttgccagaaaggtggatccagaacaacgtagtcttcaatttgatcactttttttgaataattgaagtgcattttgccaaatcttatagcattatatgttttattgttcattttttgatggttgttccctaccttttaaagatttttatattccccacctgctttatttgttgtatggtatggattaaaagtgaaaagttttgatggtcagttgctatatatttctctttaatgaataggcttaaagaagaggtttacttgtttggggcataattagacagcttacgtaaaaatacgctctttgagtaaatctttggataatctttagtacaatcttaccattagaatttttacttcatttttagtaaaagatgctaatatgagttatagtcctatgttctctgagaagcagactttactcttagaggtgaagttctggcatttgttgccagagctagtggtttgtgatgtgttagctgctctggcattgtttgttgtagtggtcagatttaaaaaacttaaagctaagtaaatccaagtaaatttaatgtattatgtggaaatggattctgtctgcttcttaggcatctatccagataagatttagaatacaattggtagagtttttacttgtgatgttgctttgtttcagtatgaaggctatgaagtagagtcatctttaaaggatgccagctttgagaaggaggcaacagaagcacaaagtttggaggtagaaaatcaaatggtataattttaaaagctggggaaaaaaatactaagtaacaaaaactttaaaaatgtatcttctgaaaactatttgaaaaaaatgtgaaagagcatctctggatgttaaaacttaaataagaaaattaatataggaaatgggacaataggaggtagcataaaatattataaaaatttaaaaatttgagcttttattgctaacttgttttgagtcaggcatgtttatgttcaaggaatcaggagctgtatagaaacttcgttctattattcctgggaaatgtattaaggtgatcgttccttttttgactcagtttgctctagaaaggagaaataagattcatttttacaaacttaggaatagttggcaacaataactttgtaaattatgacagtatttgctttattttcatcctgaggatattaagagctaactagaattaggccagaggtttacgttataagtaatggtgtatgttggtaaatgtttgacaactttttttttaaaaagcagccttatttgtagcatttgctgagttctgtagtatgaatacttccaccatggccagtttcaagctaccaacatgatgtcactgaatgaggagtcttggaagataatgcttaaagtaggctttcctgagccaagtgtgatttggttaattttaaggaaggaaagtatggtaatttgtaatttagctaaactaagacagattagggtaagtgatgggagtgccttactactgtttagatgtggacgtgttgtaaaaagcacagaagtgacaaaggatagcagaggacacctgcgtctgcagatactaaaacagaaaacagtagaccttgtacctttgataagcgtctagtacagtgtggcagttctcaatcactgctctccgtaatcatcagaaactctatgtgttatgattcagaattttctagtagagtccaaaggaagttataaattggattccaaataagtttcttaatgttttcttcatttgttgcctattactatcttcaagaacttgttgaaattatattttatttgctaaccctctgtcttaactacccttccattagtaatttatgtttgataaaaaaattttagaaggcatttgacatgctaacagaagagcaaaaagtaggtagcaaagacatttactcaagcttggtaatactgaggataaaatattacacatcaatttattttcaaggtaatgaattattataggagtaaaattagctgaatttttagctgcattcaacattttggaaatttttcttcaatttcagtaattttttagcatagtattttcagtaatagtaatcataattgaattcaaactataatgtgatgcaatttaaaaaaatatgatagctgaatctgtagataaaatcaaaccagtagagtaattttcattcgggtcagggaattcctagaatgaaatattcaaatttggggtaatatgtataaacaagtttttaaatcactgtaatgtagtatgtattttttttgcttttattttggcctgcattaaaatctttgaatcttttggtttatttttctttaacaagtttgttgaaggatcacaaatatcagaggtatgtttattatagtatttaaaatccatttggaataatccaataactaatcattttaaattaaaaaggtcatagaaaataggtcttaattcaatatggaatattatcatgaagcagccttgatttttttttagttgattttttatgtcatgcctttaattgtattaaattggctttatttctcatttttttctttatagtgcttttaagcagaggttggcaaactgtgcctaatgggctctccacttttttttgtaaaaaattgttttggaacacagccatgctcatttatgtaggtattgcttttgtttctcactgcagtggcatagttgagtaattgcaacaaagactgcatggcctacgagcctaaaatatttattctctggctctttacagaactttgctgaccactgctacaattgctgttattttgatattataaaaatgagcaaatgtataaatgaaagttatttaacttatagtacatattttttattatgctcgtctgatttccctaatgaaaaattcttatatctgtttaataaagttggctttctctcttaggcaacctgtgaaaagctgaacaggtccaattctgaacttgaggatgaaatactctgtctagaaaaagagttaaaagaagagaaatccaaacattctgaacaagatgaattggtaaggcttttttatttgaggagaatataagaaaaagaaagttactgagctttaaaaaattaatatgatactggttaaagtattacattattgtaaaaaatgtaaagaatacaggtggttgtagagagcaaaattttctagatccattcttttcacttcccccagatgttactgtgttaaatttcttgcatatttttatagaaattttctatatgcactatggaagtagctcatgtaaataaaaactgaataatcatgtccatagtgtatatttgtaattacttaacatgtatattaacattaaaactttttcttttgaaaaaacctgtcttaatgaaaatcttgatgtatgtgagattatttagtaaaacatgttagtggacttatcttgagcctatataacttaaatgttatgaaatattaaagttatgagatactattgttacgtaatgttcatataaaatcccttttagcatatggctaaataaactgagaaggtttcttaatttgagcttcacttatggagctaaagtgttaggttaacagtatatctaataaacatggcattttggaaactagagtttagtaaatattaattgcctgatactgtgtttctagatggcggatatttcaaaaaggatacagtctctagaagatgagtcaaaatccctcaaatcacaagtagctgaagtaagttgaattagtctagtaggtctgttgcttttggaaataattttagtttaattttttaaaattaagaaataagacacaatagtaggatttgagatataggggatcccagatatgtatttttttttttttaacaatacctaaatgaattagcatggctgtgttgcccaggctggagtatagcagcacgatcttggctcactgcaacctccacctcctgggttcaagcagttctcctgccttagcctcctgaatagctgggattacaggcatgtgccaccacacccggctaagttttgtatttttagtagaggcagggtttcaccatgatggccaggctggtcttgaactcctgagctcaagtgatcggcccacctcggcctcccaaagtgctgggattacaggcatgagccaccacacccagcttgtattttttttttttttacgtgaagtgcttcagaaaagttcatcttttcagtggacaagtgtttattgagctattactatatattgaggactggttgcttgacacttaacattaatagacaaaaaagtccccaggaagtttaaattttagtaggggaggcagaataaatagttatcaaaatttgctgcacagtacatagaaagttacaagaggtttgtccaaggtcacatcgtagcaagttagtgggaaaggcaggactagacctggattctagacaagccttttttctgctacaccatgctgcctctgctgttaatattggcatggttttgcctttgtttaattctgtgttctagggagtatgtgtaaagatgagctatgtattaaattaattgttacaaacttgacattttttgtttcacttaggccaaaatgaccttcaagatatttcaaatgaatgaagaacgactgaagatagcaataaaagatgctttgaatgaaaattctcaacttcaggaaagccagaaacaggtttgtgctccgtagggactcttcaacttgtgaatatgtaattatagatgttcttgtcatcctcatgactgacccatgctagggacaagtataggcttttccttgagagcatgagagcaggacagtctcccatacatatttcagtgtctgtctcttttgtatagtatacaaaagtgtatacttttggcaccctctaccccagggcagggaaagtaagccagggcatttagcattttggtaatcataaccaacttcttaaagccatgccgaaggggtacagagaatatgagtgaggattattgaagttatagatctggggtctaaagatagaaacaattctggtggcagatcacataaggatgtgacatttgccctctttctcccccacatacatagatactcccacgtatatttcttcttctcctttgccaatgtaattgtaacttttcagtgggaaaatttttcagtgattaaattattataattatccaaatattactcacaccagagccacatggtttgttcttttttttttattttttaattttttagacggagtctcactctgttgccaggctggagtgcagtggcgtgatctcggctcactgcgacctctgcctcccaggttcaagcaatttttctgcctcagcctcccgagtagctgggactacaggcgcgcgcctccacgcccagctaatttttgtatttttagtagagatagggtttcaccatattggccaggatggtctcaatctcttgacctcgtgatccgcctgcctcggcctcctaaagtgttgggattacaggcgtgagccactgcacctggcctcatggtttgttattacatattctgtcttattcaatattttccttagggttaataattgttttgtttcttgtatacttatccggttcatctgtatgctgtcttctagagatacagatatcttattcatgccttcaaatgctttgtttaatctgttaattgcattttttttttcttgaagcagttttttctttggcctcccttggtttcataagaacttattctgtaggtgtgtgttctgttctgtgtcctaagatttcacttcacccccatcctaaaggttcctcttgtctttctcctgtgttagatcttttattttccatatctgagcccttttgcggttaattcttttggttaattttctgaggaagaggtataggagataatttttttagaacttacatgcctggaaatgtcttgtttctcatacttgttgatattttggttgaatatattctgggttggcattttttttttcctcaaaattttgacactgtcactccattgtcttgactttccaatattgcttttaagaagtcagaagctattcagataattggtcatttttggaaatctgcttttttcctcctggaagcttttaatatctttttattgtttccccttctctgaaattacagatcattacacatctcttgacctcgtgatccacccgcctcggcctcccaaagtgctaggattacaggtgtgagccaccgcgcctggccacgggcggggttttcttttcttttctttttttttttttttaatttttatttttattattttttttttattatactctaagttttagggtacatgtgcacattgtgcaggttagttacatatgtatacatgtgccatgctggtgcgctgcacccactaatgtgtcatctagcattaggtatatcttttctttttgttgttttttttttgtttttgagatggagtcttgccttgttgatcaggctggagttcaatggcctgatcttggctcactgcaacctccacctcccgcgttcaagtgattctcgtgcctcagcctcccgagtagctgggattataggtgtctgccaccacgcccggctaattttttgtatttttaatagagacggagtttcaccatgttggccaggctggtcttgaactcctgacctgaggtgatccactcacctcggcctcccaaagtgctgagattacaagcgcgagccaccacgcccggctattggtgggcttttctataggatatatattttttttgtgacagagtctcactttgtcacccagtctggagttcatggcgctatctcagctcactataacctctgctgcccgggttcaagtgattctcctgcctcagcctcccgagtagctgggattgcaggcatgtaccaccatctgactaatttttatgtttttagtagagatggggtttcatcatgttggccaggttggtcttgaactcttgacctcaagtgatctgcttgcctcggcctcccaaagtgctgggattacacgcatgagccaccacgcctggccaggttagggtatttctaattggaggattctcagttgttggtatctgaagagcatttccacagggatgagtcctccacatttcccatttgggaggtgtaagcctgtttgccaacagtcttgcaacttaggtaaagaatgctggtgtctgactgttcagtagtcagtttcctcttaatacttttatgttttcagtatgttacttccaccttcacctggatagatgtcccagagtctcaggttccacctctccaaagaatgaccctgtagggttttgcgtgtgtgtgtgtgtgtgtgtgtgtgtgtgtgtttgtgtgtgtgaaagagacagagatagagaatgaatgagagagaatgagaataagaatgtgtatatatttatgtcatgggaggctttccaactgctttttatacagacttttggccagtcctccttttttccagtcctgcttatacccctggtatttgtgccttcaaatcatgaggctttctagggtatatcaaatcagcctacttttgggtgttcctaccttcaggcttagatttaagttctctctagttggttgagtctttttatcacacttccatttctttccattttctacttctacaattattttttgtctcatctcctattttcttttttccttgtgggtttatgcctttgaaaaaaaaatctgttttctgccattttaatagatttgagtagaaagtggtggtaaaccctgtgttaaatttgccatgttatgatcaaaagtggccttttccaccttggaaaatatttcacctagatcagtcttactctttacaactgttttcatctaactcccttgtaataatccaaattcttgaaacaaactgtattcactgatgccatgttctaatgcactccttctctaatgttttaatactgtatactgtgtacttaagtctctttactaactcatgagagatgacctaatcaccaaatgtgaattttttcttggattctcatttgtttttacctgtatcatctgattctgttttatatatatatatatatatatatatatataaagattagtttttcatgtgttcggaatacgctaatgaagccttagttttgcggagaaatccaataattactgtttggtagaacagagttttttttttttttttttttttttgtgagcaacatggctgtttatttcacctgggtgcgcaggcgggctgagtccgaaaagagtcagccagaacagagttttaaagactaaataaatttagactttttcatatatatgagccatttcttttgtgaattgcctgctcagtcttcttttttctttgcctattttttcttattgacatctaagagctctttgcttgctaaggttattaaccttttgctacaaatattatgagaattcctttcttggtggggtgcagtgggtaacacctgtaatctcagtgatttggaaggtccaggtgggaggatcacttgaggccaggagttcaagatcagtctgggcgacatagtaagaccttgactctacaaaaaataaaaataaaaaaattagcagagtatgtgacatgtgcttgtagtctagttgcttgggagggtgaggtgagagaatatcttgagcccagtagtttgagattgtggtccagcttggatgacagaatgagaccctccctgcctctaaaaaaaaaaaaaaaaaaaaaaaaaaaaagaaataattcctttctagttatttatctttaaatgtcatttgtgttatatttgatttgtgaagcttttaagctttatgtagtcaagtctaccttttataatgatctttactttttgtcatgttcagaaaggctttcctttcctgtaaaagtatatatagtagaatactgttgtggagaatctgatctgttctagattaatggtatttctttttttttttttttttttttgagacggagtctcgctctgttgccaggctggagtgcagtggtgcaatcttggctcactgcaacctctgcctcctgggttcaagcgattctcctgcctcaacttcctgagtagctgggactacaggcgcgtgccaccatgccaagctaatttttgtgttttagtagagacgaggtttcaccatgttggccaggatggtggtatttctaaaggttagttattttaagtacaaaattgcacaatgatttaaaaaataaattttaatgcaagtaaggtatgatattttatatgggatataaggaatggtaagaaatgatcaaatctaagatatgtatatctcaggaaacctttatttgatataaatatatgatataaactagttgaagaatgtgtgtgttattttacactaccccattttgaaagttctttgaaaataggagccatgtttttcttttttaagtagctacataatgccttcttggtatcttttaatgattcacttgtgtgatgagttgcatttttaaaattttcattttcagcttttgcaagaagctgaagtatggaaagaacaagtgagtgaacttaataaacagaaagtaacatttgaagactccaaagtacatgcagaacaagttctaaatgataaagaaagtcacatcaaggtaaatggctctactggttttagtgatcaagttggctagaattttacactaactctgaaatttgaaagctagtttttagcaacttttattttcacaacatattttcataacatatttggccagattttcaaatgtttcttgaagacttacagatttgtcatatgtacatacacatacacacacacatacttatatgaatattctgtgtgtccttttttcttctctgtattttagcctaggtatttaataaagaaataaaaataatggtttctaccatttctcttcaggatgctatctgctcctgttaggaggttggaagagtttgagaaattggatgtatagttatatatattaattgaatatctttaatgtaactggtgtatgtactttgatggagaggaatacttttaaaaaataaatttaattgaaacttgactccagtcataagaataaaaggattttttgattttttagatttttaagatttttaaaaatcttaatgctgataaatacagatactcaagtgtatcaaataatgatatgtaaaactaacgttctataatttacacagtgatgtggatgttgtcatattgaaagtgatgctctcactcataggtgggagttgaacaatgaggacacttggacacaggaagaggaacatcacacaccgggacctgttgtggggtggggggaggggggagggatagcattaggagatatacctaatgtaaatgacgagttaatgggtacagcacaccaacatggcacaggtatacatatgtaacaaacctgcacattgtgcacgtgtatcccagaacttaaaatataataaaaaatagtataaagaaagtgatacatttatgccagttatgttgctactaagaatattttcaaaattccagctttctgagttttattcagaatttggcatatatatatatacacacacatatatacatatatacacatacatatacacatatatacacatatatacatatatacacatatatacatatatacacatatatacacacatatatacatatacatacacacacacacacacacacacacacacacacacacacgagatggactttcaatcttgtcacctaggctggagtgcaatggcaccatctcggctcattgcaacctctgcctcgtgggttcaagtgattctgctgcctcagcctcctgagtagctgggactacaggcatgtgccactatgcctggctaattttttttgtatttttagtaaagacgcggtttcaccattttggccaggctagtcttggaactcctgacctcaggtgatccgcccaccttagcctcccaaagttttgggattacaggcgtgagccaccgcatctggctgtggcatattgttttatttattttttctaaacttcctctactaaaggctttgggattcttttaaagataacaagaatgagatgctaacctcaagctctgctcaaaggtataggccatgttatttgtgcctggaactctgaagagagggaggagatcgaagggtgaaaattgtagatcagtgcattatttttaggtgggtccctccagaggaatacatgacacgtcatttgattatctgtagtgttagaaaatatttctttaatcaacaaaattcaaaaagtacttttggaaaacctctaatgttccattcaaattctcttttataaatgtctttatctcagctaattgtttccttgaataaatcaactaaaaatctacgatctttttatacattatgtatctcactgcagatgtgtttggtgtcacacagaatttactctcatgttaattagggcactgttatttgtggcatgtgagaaatgtcatataaaaaatattttactactttttagttgcataatattaatatgtactatatttgatttgggaataactagttttggcttttacttgcagagtttaatagtcaataaatgttaccatttctcaagactacaatatcttaataagaggtggaaaataagagctcttgtgttgttatttatgtggactgatttttaaactataactgtacattcacaagttgtaaagctgttagcataaggcattaccctctctatttttcccctttgttcaatgtcaagactctgactgaacgcttgttaaagatgaaagattgggctgctatgcttggagaagacataacggatgatgataacttggaattagaaatgaacagtgaatcggaaaatggtgcttacttaggtattaagtcatgactcatctccttttgctaaaatggtgactagctcttctatttccttttcgttccctgtgtgcaccatgttctttatatgcttttactttggcacattctgtctgtctgtgacacactgtcctttctcaccatcccttatagtttttagcttcagctggagcactgccttttcagtaagtctttctccagctgctcagacacacttacagcctcctcccttttttttgtgtattatacatatctttattatagccattttcaaaattacatcataatcatttcaatgcctgtttttccctgtactgtaagctaatcaaatggatgaatgactagtttgaagaacaagtgttctataaatacttcaggatacttcttttgcttttgtcagaggttcagatggttacagtacttttaatgttagccattcaaattattattgccattgatggttgtgctctgaagttggcaaaagtggccaaatttagtttcactatagccccttaatgtattctcacaccaattcctttgacctaaaaaaaacctttttattttgaaatatggcatcataggaagttctaaaactagtacagaggtcccatgtacccctctctcattttaccccagtggcagttcttcagacttttatgtcatttttctgttctcttccccagcccctgcataattaacaaatttattatggaggaaaaagtgtgattaaaaatttttttcgtgacaacattaatatgttggaaaaaattacatccctaaaataagtatataaagttctgtttgtactttttcatttctactttattatatataaaataatcctttctctatttgagaaaactcatgcttgtttaatgttattttaacttgggttataattttactcatattttggatgctgtaagaatccaagaatagttaatgattgtggtctatatttagatgaatatagaatccttgttataactctgttcttggagttagagctgaagaaccttgttaaatggtatgacacttcagtgcttttattgtttagcttcctgggagcaggtccaaggccattctgctttataccaaattctttattgtagcaagaagagggattataagtttctggtttagtgaactgataaaatcattttgatgtctattgtcgtattgtactattttcccaaatcattgttgtgcttttgattttcactgtagataatcctccaaaaggagctttgaagaaactgattcatgctgctaaggtttgtgctattagatacttaaaaagaataaggaggaagaaagagaacgtggattactcatgtcccagtaaatgtttaaaaagtccattttattgttcccatataaatatatttacaaattatcagaattttcatcatcaattgctttttcctttcaattattaactttagaaatttatataatttttggaatttatcaaaataaaaaattccaagttctgtactcatttttcggataagactatatttaaaatgtttcctgtattttatcttgtagttccctcagtgcattctttttcttctagtctcagtattttcttaccccttctgccctatatcctattttaagtaaatactagatgcctttttttctggtttattccttctcttttccaccctagtagtgtggtatcctcatttttgctgatctatgtgaagtcttggtaatgtagtttgaaggctgctttaataaaaacttttgttgaaagtaaatagaatgaaaatagtcactttcttaagcagccagtgaaaagcattcactacttttccctgtcccttgttctgagacttacaagcattgacgactttgctggtttttttaagacggaagctgcattatggtttctgtattccaggtgataatttcatcaaaacgataaaatcacttaaaaagtgttaggggggtcatactgaggttttattttttatttttatttttttgtataactgattaatgttacttttttccttcttcccttctttaaagttaaatgcttctttaaaaaccttagaaggagaaagaaaccaaatttatattcagttgtctgaagttgataaaacaaaggaagagcttacaggtaggtcattgacatacatacttttaatgtttttctaagtaagtacatctcttggcagagaatggtaaaaatgaattgaattaactttgggaagatccaattttatttttttttaacttttgttcctgttgggtatttgtgaaacattagtcctggtttttgttgtcattgttgctaaaggcatatcgatttcctctgtatttatgtgaagttaaaataaggaaattttttaaaaaacatgtaaaaccgtatttatcttcgaattacagtgttatgtgtttgaatggttttagatgttaaaaagtagcaaattgaaacttaatgtttaaagtctttgttaattgaaaaattgatcttcaatagtggtactatttgcagtatgattcgttcctttaatgtacatacgtagtatattagtacatacgagagtgatgttagacctgtagaaatgaaggtgttgttttaattgaaaacatttatgtttattttgctgatagtgtttgtattttcaaaaagtaaacaagttctgtcaatatgtttgaaaatttttaaagttgagataaatagcatctcattttgtaaaaataaaaaatataaagatttaccatatgcgtttgcatcagaaaagactggaaggacatactcaaatgtcaacaatgattatctctgaatatgggattatgggcagatttttatattctttttacttatctgtattttcaaaaacttctacagtaagtgaactgcatttataatactgttttaaaagattgaaccaccaaagatagaggttattaaaaaattatatccctactcacatgattatagtaattggattatttttggatttcaagaaacattagtattagtttaagagaatgttgctatatgtaaagcattgtactaaaaactatgggagatatacagaaggaaaagatagcttactttcaaggaagctgtatttcaaaaaatgtgtgtagaaagtgccagagtggcaaggaaatttgctcaccagttatcccactccttaatacagtttcctggcaaatctttgtttctttcttagactaatacttggagacctatgtctccttgtactcttctttcaaatctaactttgtttttttaatggatcatgaaagataaatttctgtaattgatgttttattcatagcatgaagattttcctctaaactgtttcttccttttctggtaatcatttacagtggtctttatgttacaatttgaaacacagtagaagtacaaaaatatggccaggcgcggcggctcacgcctataatcccagcactttgggaggccaacgtgggtggatcacttgagctggggagttcaagaccagcttggtcaacatggtgaaaccctgtctctactaaaaatacgaaaattagtcgggcgtggtggcacatgcctgtaatcccagctgcttgggaggctgaggcacgagaatcgcttgaacatgggaggtggaggttgcagtgagccaaggttgcaccactgcactccagcctaggcaaccaagcgagactttgtctcaaaaaaaaaaaaaaaagtacataaatatattaaataattaagtgttgggttgtagttttcttgtttgttttacaatagggatgattaaattttaatagagataatacccaacgttaatttctttacgtgattgttcttggcaatggcttaaagcctaggtcaatgaatttttttttttctgatgtagattaaaaaatttctgtggaaagatagttacgtacaatttcctatacatttaatcatttaatgtttaggtatttatgtaaactgttcttttggtttgtatgtttaatgggttatattagtccgttctcacattgctgtaaagaactacctgaaactgagaagtttgtaaagaaaagaggtttaactggctcatggttttgcaggctgtacaggcttctgcttctggggaggtgtcaggaaattaacagtcatggtggaaggtgaaggggtagcttccttacatggtgggagcaggaggaagagagtgaagggggaggtgttacacactttaaaacaaccagatctcatgagaactctatcatctagggggagacagcgctaggaggatggtgataaaccattagaaaccacccccttggtccaatcacctcccatctggccccacctctaacattgggaattacaattcaacatgaaagttggatggggacacaaagccaaaccatatcatgagggttttagaataattaaataccattacatgtaattactaaaattttcatgcttgttaatactgtttccaaaacttccctctttaggcagagtgagttttgtcttttaagatttgtggtggtgattcatatacacgttacaggagatgatgccttccttcatcttagaggagttgaggttattatcttgataccttaatgttagagttgttcagagttggtacttcaattttagaggcgctcagagttgaggtaattatgttagaagagaaacgaggtttttaaaaaaattgatgcataaattataaagcattcataattatttagaatgattcatttttattttatagatttttttaaagatggcttagcggttgaaacaacgcttaaagttggtatttttctctctggtcttgatctgttttaaactaggagtatgtttgggcatttgttatgagaagatctagatttctggcttgacttatatgtcaaaattttagcttaaaagggagggctaggtagaatttaagtattattaagagagaaagtttttactagataaaaacaggcattattcatcacctggaaatagttttacggggaatgttgaactacaatatctccctttaaaactcttatctccaaaaccttcctgagaactttagtggcgtttagctctaaaattgaaaattagatgctagaattagaatgttgaaggtgttgggaatcctataaataataacaaaagttaaaagaattttttttttttttttttttttttttttggagacagggtctccctttgtcatccaggctggagtgcagtggcgtgatcttggctcactgcacgctctgcctcctaggttcaagcaattctccttcctcagcctcccaagtagctgggattgcaggcacgccccagcacgcctgactaatttttgtattttaagtagagatggttttgccatgttggccaggctggtcttgaactcctggcctcaagtgatccacccccttcggccttccaaagtgctgagatgtacaggcgtgagccaccgtgcccggccaaaattaaaacaatttatatagctccttaattcagatattaatgcactcaatggagcactattcagccatcaaaaaataatgggatcctgttttgtggcaacatgagtgagcctattttaagtgaaataagccacacgagaaagagaaatggctcatgttctcacttatatatgggagctaaaaaagttgatctcatacaagtaaagagtggaatagtaatagtaatatgagggtgggaagtatagagggtagggggttagggagaggttagttagcagatacaaaattataactagataggtggaacaatttctaatgttctatagcactgtagagtggttagttaagttgctgtatatttatatttctttttcttagatctactttatttgtcatattgttatttttgaatagctagaagagaggattttgaatgttcataacataaagaaatgacaaatgttagaggcgatggttatgctaattaccctgataggattattacacatcgaatacctatattgaaatatcacactgtaccacataaatatgtacaatttttatgtgtcaatcaactaataacaataaaagcatttaggtaaacagaatcccttatagattttctgttattggaaagagtttagtttattaataatttattatttttagtaatttttatctttctgaaatgttaatatgcaactcaaaatgtttctcctttaattatgacttaaaatttttatatagagcatattaaaaatcttcagactgaacaagcatctttgcagtcagaaaacacacattttgaaaatgagaatcagaagcttcaacagaaacttaaagtaatgactgaattatatcaagaaaatgaaatgaaactccacaggtaataaaaattatgttaactccattgaacagcaagtaaaatagctttagagatatatgttacatagttagctatagtgattattgaaagttctcaatttatgattagattgtatttcatcaacttatttttaagaaaggtatttgatctggagacactttttttcaacaaagaaaatattgtaagtgatgttggaatttccaagctagttaacagaatcctctttagctcctagtaagtagtcagcaacttattgccttaaacttcctaatactggcagggaatctgaatggacactcttgattaaactgcccattaattccatctctgatatatgtaaaactgatttttctgttctgtgcaaattgcttctgcccaggtgttccttggcttagtaaatggcagtgtcctttacttagttacttagggtggcacctcaagctgtttttgacttctctcttgcttttatatctcctatttattctgtcattaaatcctgtcagcttttttatagcctgaatctgaccactttttaccatcttccatattagtctagtccaagtcatcaacagttaatacccggcttattatagtagccttatgggtagtctccttctttccgccctttctcctgcactgtgttttctctgcaacatgcaggatgacccttaaaatgtgaattgtgagtatggtcactctcgtgctcaaaatccctgagtgcctttatatcacactcaacccacagcttttatatcttggcctacaagacagtacaggattggacccttggccacctctttaattttagcttattcatgttctttttcctctcagtaccctccatccagcactggcctttttgatgctcttcagcacattgaccttagggtcttttgtgcttgttccttctgcctggaatgatgtttccttatatatttgaatggctcagttcttcattttattaggcctgggttcaaatgttacctcaaagaatccttccctggctactctaactaaaataatacctgctactctttattcccttattttgcctcatggctcttattgtcctctgattgattgcttttctttcttttatcttccttatgttaaatacaagctctgagagaaaattattttcttcacttctgtattcccagtgcctaaagctacatgagacgtgtggtaactgttcagtacatgtttgttgaatatatgtacaaatatgttcagtgcctttatatattggagtgaaggagtgtgtgtgtgtacatgctgttgcctaaatgcctaagtacactgaagacccttgagatatctgaagactctagattttcaaatagtgccatggcatgtatttttttttttttttatcataaagggtaataaaatgtaacagactttcaggttcctttaggctcttaatgatagttattacagttgttccttattatttatagaatctgtatttgtgaattgacttactagctaaaatttatttgtaaatcagatcagtacatgcaaagcttttgtagccattcatggacatattcagaatgatgaaaaatttgagttgcccaatgtgcatgttcccagctgaggtcaaacaaggtgacactctgctttcttgtttcagctctcattctgtaaacaggtgtcctttttacagtatatttagtgcctcattttttacatttttatgctttttgctggtgatttagctgtttaaaatgccccctaagcatagtgctgaactgctatgtagtgtttttaagcacaagaatgctgtgatatgtgttatggagaaaatacatgtgttagataaactttgtttaggcatgaattacagtgcttttggctgtgagttcaatgtcaataaattaacaatatatattaaagaaagtatctttaaacagaagcacacaaaaaaacaaggttatatattgattggttgataaaattgttgtgaccagaggctgtagcaggaagctaaccctgtattacccttaggagcagtgatctagtatttgctaatttacgatgtatagtgactttatggaacaaaactagcacaaataatgagaatctactttatctatttggaaactggtagagagtactaatgcttctttgagatcaggatgctgggtagtgcttggctcattcactgccaagttctgtacttcagtcatgatttggattcagttcacagttaaaaagctgttatttgttatggccctttggccctttgggactgctcagggtatgcaagagactaaacgtgacaaaatggaagaattacagtataacttcagggtttttcagccagtatacctaggagtgggcccttctttttaggttagaatgaaaggtattaaagtaaaacttggatataaaagtgattgaggtgaaagaaatatttttgagtgtatcttttgaataaaaaaagtatatggttgattatagaattttgatgagtaatgtttaacatttcaaagaaaaggtattttctttagatttttaaaggaaggataggaaactgagtagtaccctagttgtgtgtgttgttcacaggatttcattcattagtttaaaattattttaaattcctaaaatattttacatttccttcttatatttaactagcaagtagtttatattactgaaattcaatgaattatgccattggcacttcttcagagtagaatattgagttgatagtaccagtgaagtgttaaatttatattcttgctgcatatagtataatttaagttcagtctggatgttggcttgatgtttttcatgactgatataccattttcccaaatttaataatggaaacaaatgaaatggtaggacctagaagcttgatgtgttgcttttttttttttttttttttttttttggtgagatgaagtcttgctgcgatgcccaggctggagtacaatggtgtgatcttggcttaccacaagctccgcctcccgggttcacgccattctccttcctcagcctcccgagtagctgggactacaggcgtgcgccaccactcctggcttatttatttatttttttttgtatttttagtagaggtggggtttcaccttgttggccaggctggtctcaaactcctgacctctagtgatctgcccaccttggcctttcaaagtgtggggattataggcatgagccactgtgcctggcccttgatgtgttactttaaatatatatgatggtttttgtgtgtgtgtgtttttttttttgagatagagtctagctctgtcgcccaggctggggtgcagtggcacgatctcggctcactgcaacctctgcctcctgggttcaagcaattctcctgcctcagactcccgagtagctgggattacaggtgcgcgccaccatgcctgcctaatttttgtatttttagtggagatggggtttcaccatgttagccaggctggtctcgaactcctgacctcatgatctgcccacctctgcctcccaaagtgctgggattataggcatgagccactgcacccgaccaagatatgatatttttaagtcatatcatcaggtctcctttcacagtgtaatttctattattaataggcccacccaaattcaatgggaaggtacataaacctcaccttttatcaggagaggtgtcaaagaatttctggctatcttcagtctacacagtctgtaaaaacacatctctcttccatatccatgcccgtcgcactttcgtgcttttcctaaggagatgacttattttcttataacatccatgaaagtgattgaccttagggaatgctttctaagcaataggtaatgtagtgtgtagaatacaaaatatttactgccatactgcaagacttcttcagtagtttgtcttgttcttctcaaagttcatgaagaagggaagatatccatttaggactccaaatgtgttttcctgtggtgttcaataaatatttcttgggtgaccaagatatattaatgatagtatgtgaaatgaaacaacatgggtattatagcataaaagagtcactgcttatgagctctaggctttggtttaattatttctctgtgcttcattgtcgtttttgtaagatgggataacagtaccacccttcttgtagagctgttgtggtaattaaataatacatgtagaagtctgagaacagtttttggcacatactaatggctcaataagttatctattattattattaatagaattagatgtagtaaataggactgctactactactgtttactttggtttcattgtaattataattgtgtgtgtgtgtgtgtgtgcgtgtgtgtttacttgcctggaagcctaatcactaaccaatataaaaattaacgaaacacattttattaattggtgacttcttactagcaaatgtaatgcttgtttatacagaaagacttgataagtgatagtcataatagtttttattaaatatatctttgatcctatttttaagataaatttatatagaaaactcttgaaactattagtagttctgtattagacacaatgctttacaatttcggtttataatattaaattcaacaccaggaatatttacacagatactttttttttccttgtaggtgatgttttcagtggtattttagaaatcatttgacaggaatcaccagttttttcacaattaaaaatatagaattgattatcttttgacatgtattaagagaattataacattttttgtttttaaggaaattaacagtagaggaaaattatcggttagagaaagaagagaaactttctaaagtagatgaaaagatcagccatgccactgaagagctggagacctataggtattaaatacatttttctggtttcttttttggaatgggaagagtatctaaaaaacttaatgccagaaaaataataaatcaaatgaaaatagaaaacattttaaaatctgacaggtggtacagacaaaaaaataatatatttttgtctcatcacttttcattcagatttcttggtcttgagcaattatacagaaaatataaagaggaaaaatgtttttctttcaggttgtgtgatttttaaaatctctcaaagttgaatatggacaattctattttatgttagtgtcaatatgaatagatattaattttaaggtccttcctcattggttcaaattgagaagaatgtatgtaatattagtgaatcaataggtgtgccacaaaaagaagagtgagccatagagcatttggaagtatttaaaagactataaatctagattttaccttggtttgatccttactagatcccaggaaatagaaaatatagagaaaaaaagattcagcagtatcccaaatagttgtgatacttcattttacctcagaaagagcaagcttgctttttatccaaaataagttatcttgttaatctcacaaaagtaccaagtaacattttacttcacagtggttgctaatttcctagaattctattaagactacccacatctggccgggcatggtggctcacgcctataatccctgtactttgggaggccaaggtgggtggatcatctgaggtcaggaattcgagcccagcctggtcaacatgatgaaaccccatctctactaaaaatacaaaaaattagttggtcgtggtggtaggtgcctgtaatcccagctactcaggagactggtgcaggagaatcatttgaaccctggaggtggaggttgcagtgagccgagattacgccactgcactgcatactgggcaacaagagcgacactctgtttaaaaaaaaaaaaaatgaccaacatctgaataaatcttctaggatcattcttcttaaaaataaaaaaaaaacaacacaatataccacgtaaatatttatgtgactttgggtttaggtaaactcaagtagtagtattaagttgtaatcaatgttaaaattagtttaggaaaaaatatactgtagaacctgtcagaggtgattatttcttaatgtggagttctggagtttttttttttttttttttcatgaagtagagcattctgggttttctaataaatatttttttagtagagagtatgttctgtcatttcatgttatatgttaatagtagaataattattcgttccatttagaaagcgagccaaagatcttgaagaagaattggagagaactattcattcttatcaagggcaggtatatatatatgtgtgtgtgtgtgtgtgtgtgtgtgtatatatatataatttaaaacaattctgatttctttgaattgatgcaggaatataattacttgaccagttgtatacctcttttgaggtgttgcatgtggctgtgggacatttcccaggagccaaagattctgagataagaaatcttatttaaaattgctgtattggctgggtgcagtggctcacaccagtaatcccagcactttgggaagccgaagtgggtggatcacttgaggtcaggagttcgagaccagcctggataacatggcaaaaccctgtctctactaaaaaaaaaaaaaaaaaaaaaaaaaatacaaaaatagccgggtatggtggcacatgcctgtaatctcagctacttgggaggctaaggcaggagaatcacttgaaccctggaggcagaggttgcagtgagctgagatcacgtcacttgcactccagcctgggtgacagagtgagactccgtctcaaaaaaaaaaaaaaataaaataaataaaattgccgtatctcctgctgctttgggaaggtagattgcatcacataaatgtgtatcaacagtggggtctcatactcagtcaggctagttatatgttaactggcaattcctgttgattattacataaagtaaaagtttaccaaacaaaaaatttaattgtctttacattcagtttttgttttaaaatataatagattatgtatacatgaaaatttgctttaaaaatgttgcctactcttcagagatgcttgggatagttttgagttgtgcactacatcatagtggtagatgtgaatgttttttacttaagaaaaataatggtcagtagcattttaattactttctttttcagattatttcccatgagaaaaaagcacatgataattgggtaagtttaaaatttccttaagtctcttttgtcaaattgtatgtttttttcagaagatacgttgtttatttaaattagatgaaaataaatatagtattctaaaaaatcagtttcttttaattttacaagtagtgaaattatgttccttgtgaactagtttgttccaacacagttattagaaaaatctgatttttccttctttgcttttatcacattgcttctttgaaaggagtttatactccatggggaaggtgatataatgttcatggactgattgttccagggcactggattgccactaattagttgtggacaagctacttaaaattctttgggcctatttcctcatttgtgtaacaatgggattagattaagtgatcttagaagccccttctagttctaaaagtcataaaattcagttacctgatcctcagtgttgaattactgggtacacattaagaaaagggtcatcatgagaaatagtgtatttgtgctccagaggaactaactgtgtgaggaagtgatgaggatgcagattttgactaattataagaaagacactgtaacatataggactgttgtagtagctggcctttggagtacttgtcactaggagtcttcagcagtaggcagtttgcacagtgggtgaatacatggagtttggaattaggctgtcttggctcatgtcctggcttcatcacctatcatcagttttcttacgtgtaagatagagatagcagtagtacctatttcatagggttattgtgatgattaaattcatgtaaggttgttgccaaatgcctgacacacagtatacattcagtgaatgttaactgttgttattgttgtagtgaagcttggtaggtatttcttagacatgttggagtggagattccagcctagggtgagagattaggtgtggtgaatgtctaggtcctcctcagttgtaagattctgtatgctttagtattgagggttcaaatgaaaatttgttactaaattaagctgggcttggagatgaatttagttaaccactgctcaccacttgtaaaatacttaggtgtagattactctttgaagatggagaggtccacacacagtcccagggtaagacggtaaccaggctgtttctggaagggcagcaggaacatcttacagatcttacagagacactgacttgtaaagattagaatgaaaaccacaaacaacaatggccaagaagggaatatgctgaggtccagaggtaacaattccacatccctccctcaccgctgcgtatttagtgaagtcttctaaggtagataaaggttatctcagatgacatgggtagaggctacaaagagacagttaagcagttggatataaagatcgggacagccagatgacacctaggatatatctgtcctcacgtgttctagagcacagggcaggcaggaaaacccaaggaaccacaggctaaagaattacatatcaggaaggtcacttgggagaagctccacagacaaggtgtgtttttagctgaattgggattggtagagggaatgaaagtgacactgagcagtagcttgtcacacgctccagagctgagctacccacaggagcagacgggtctgggcagaagacagttaataggagaggctcatattagtttctgaaaagtcacatggtaacagagtttaacttgttttttagggaaaaagtgttcatttcaatgaactaatcacccaatcagatagaacccaggctggctgagtttagagtccatgaggctctgaacgtttgaccccagggtggatggggacaaggacatggctcacactgtcaactttagagatttgagggtagggggataataaagtctcaactacacaaaaaggatgtttattaaaatctcttgtgtcctaggcactgtacttaaaggccttttacatacattacttgttcaatctactcagtaactgtaaagttggtactataatcccagatttatggatgaggaaacagccgaaggtcatggactagagggtaaagagtgggtatagaaattctgatctttcagagtctaagtcttacactttttcttacttcagtgattatgatttgtataccattgttgtgatatatatatatttttaagaaatttaatgaatgtttatattgacatatttatgcttattttttaagtttatataaatatatttttaaaatgtgttattttcttcaagttggcagctcggaatgctgaaagaaacctcaatgatttaaggaaagaaaatgctcacaacagacaaaagtaagtatcttagtgggaacatttaaaattagttattctgttatttcgttaattaggtaatacttttataaggttaagcaagaaaacttgcagtgaatccagcatatcttgtgagatatctattagttttactaggaatgtctagtttgttttgtctgttgaagtacttgtcttaggtcactgaagtggcacttggaggaaactgttaacagattattctgcaaaaagtataactagaattttttttaaaccagtgtagatggatggaggtaaaaatggatggaaagagaaggggtgaatctctctgacatagtaatgcccagaatatcagcctcttttaatggataagtagataggataatattcattaatttctctcatttcctggttttgtagtattgggtgacattgttttacaataataaaatgaaaggtagaataaaagtctacaatgtacaatagcagggaagaataagtgcttttctgtgaagatgataacagtcttcctagagtgttataatttcttgtcacaatgtactgttaacattatccaatattagtttttagtcctcttgcttgtcttttctagtctcagaaattaaaatcaaattattaaatgttttatatctcatgattaagaactagaaataagattcttttaaaatgtcacatttgtaggataaaaagtttacgagtaagatagtaggacaaattaatgggatttccagtgttgtaactggaatcatgagtgtcacgttacaatggaaagcatacatgactcaaagccaggaaccctgtgtcttaatccaggcactttcattgtgaataaatatttaaactcctagcctcagtttccttagttgtaaaatgatagactggttgaccttggaggactcttgtatttcaaaaatttggattctgtgatatagtactcatggtagtctagttttgaagaagaaataaaacaattgtaaggctccacataacatcactatctctagggcagcaagaaactgattaccctagttaataagcagtgggagataaaggtgttttggtcagaataattttagaggatctgtttgttctgtgtagatattaaaatagtgaagagcagcttgtagttggtagaggcattttttcttgtggtgcttctcttggatgagtaacttagagatgtttgttctttatttgcagattaactgaaacagagcttaaatttgaacttttagaaaaagatccttatgcactcgatgttccaaatacagcatttggcagaggtagtctttttttttttacccctcatttaaaatacatattttacatatatatatatattgcacatatagtttctattagtgtaagttaacactgttatttatataaatattttagattttagaaccaaggttctagactaagctttctcatagactcacaagcttctaggttttgtttcctgtgcagtaatgaaaattactgttgcttttatttctcagtgggattttgtaagatgatacatatttagtactttgagctccttgaaaagctaggtgcttggcacatagtaaggtactcattaacaattttctgtgagattgaatgaataaggagtgcttacatggactagcattgtgactgtttatatattaactatactttggaatttgcttgtttaataattaaaaaatagtttctaattatttaaaagtatcaatttaaaatgtgggaaaaactcagtctgaggtttgattgctttaattaccctcaagggaggaccaattttttttgtaagatatatttaatatttctgtccattgttgagttagggtctgcagtgatctcaaactattgcaaacagtttaaattttttcataataattttggttgaattggaattaagcttctaaggtactgaaaaatctatatataggtagaattccattttaataaccttggaaagttataaaaatcacttttgagagtaaaatttcattaaaatgaaagtctgtttctacatttaaaaaatattagattattacgaatttcaggtagtaacaaagtttggattggggtgaagtatatagaaggatttttttttgtctgaatccaacacaaaatttcaagaagggtaactaatgctttgatcttttcttgtagctggtttgaatattataccagctacactcatgttttaaatttaacatgttttaaaaatgttattttggtggtttttgtttgtattttgtttttgatttttgactttggaaacaaaaccattatttgagagtggtgaagtttgtaaagtggtaggtgtcttggctgtatagattatagataaagtgatttagttgataaattagtatttgtaagctgactttttactggtaatgaatcaaaagtaaattgtgatcttgcttcagagtattttatgcatttttctcctcttcataatctgagcattatttaaacaattcatggcccaatacagcctatctggccctgatttaaactgagtacttctatgttgcaactctcaccagctgaaatgtctgggtgcatactgccagtaaaaacaaaccaaaaaaaaatctaactttatgctcctataactctaagatatatctccaatatcctttgcttaatataaatgattatttatcatgatctttttattcccagttcgttgatgtttttattgcttaaagtgtctatttgatagacaaatatcgaaaacaccagggtctgtatttaattctgttctatattagcaaaatcaaaggatacattcaggacatagattaaacttaaattggcaataggatgacctgatggtaattgtcgaaatgggattctaactctgtagtgtagctaagtgaaactatgaatttaaatatgctgttttaattattccagagcattccccatatggtccctcaccattgggttggccttcatctgaaacaagagcttttctctctcctccaactttgttggagggtccactcagactctcacctttgcttccagggggaggaggaagaggtatattgtttaaacatctttattactctagatttcttccttactttatattttcatctcaacttaccttaaaaatgatctgtaaaatatttggaaaatacaggcattccttgcacttactgtagataacttttatttggaaaaggagctctatgacatctaattttgatgtatttttctcttagaaaccgtgctatattagataacattttgatcaaggacttgatgtgtatctttttatttatttttctttttaattttaatttttattttttgagatggagtcttgctctttcacccaggctggagtgcagtggcgcgatcttggctcattgcaggctccacctcccaggttcacgccattctcctgcctcagcctcccgagtagctgggactacaggcgcccgccaccatgcccggctaatttttttttgtatttttagtagagacggggtttcaccatgttagccaggatggtctcgatctcctgacctcgtgatccaccctcctcggcctcccaaagtgctgggattacaggcgtgagccaccacgcctagcctgataacgtatctttttaaaccatatttttgacttcttaaaaactatatattacatgatataatataaaattttgtaagactgcatgaaatataataacagtataacctagcataaaaattatctatgtgtatgtatatatatgtaatttttttttttttttggagactgttttcactcttgttgctcaggctggaatgcagtggcgcgatctcggctcactgcaacctctgcctcccaggtagcttggattctcctgcctcagcctcctgagtagctgggattacaggcacatgccaccacacctggctaatttttttttgtatttttagtagaaaatacaaaaggttgttttgccacattggctggccaggctggtctcgaactcctgaccttaggtgatccacccgcctcagcctcccaaagtgctgggattacaagtgtgaaacaccataaaattatattttgatgaagcattagaatttggaattaaaaaaatttacattagtatcatgatctttttattgtagaaaattagaaagtgaaataatctttttatagactcaaggaaatcagtagtgctcttgtaggcagatttttgatgggaacctttactgtggtctgcatcatttgttaacacactgggggctgggcgtggtggctcatgcctgtaatcccagtattttgggaggccgacgggggcagatcatgaggtcaagagatcaagaccatcctggccaacatggtgaaaccctgtctctactaaaaatacagaaatcagctgggtgtggtggtgggcgcctgtagtcccagctacttgggaggctgaagcaggagaattgcttgaacccgggggacggagattgcagtgagccgagatagtgccactgcactccagcctggcaacagagcgagactccgtctcaaaaaaaaaaaaaaaaaaaagtacattgggaaaccaagccacaattgtctgctgttacccccttataggtacctcaggcctaatcattagctattctacatttatctcatcagcatcaccctggtgttacaaaaggccctagtacctttgaaaactcctgtgtacctggagttttccttttttgatctctcaccatactttctttgtcaagttcctttaaagttttatcttaatttgtggcgaaattcaaagatatagggccttatttatttcaaaatcaaaagtcttacattttcagttccaagtatgtgttttataagagctgatggcattcttcaccagtgaaacattcccaccctttgtatcagtgattttaacagattgaatttgagataggaacataaagtaatgaatctaaataaaaacaccaaattaaatccaacaaatcaaagttcatatactcagatgggtattactcatctaaatagtatctcaggaagtctgtgtacttgttagttgaagctgccattactccacatatttttggaactcttcctttggaattgctttcaaataatatgagaaaatcaacttactactgtatggtcatgagatattctccctttgcccatatcctgtttgtatcctctttctccaccctcattttgcttcacttagaactgttcctgtccacctcccagtccccccagtagattgggccacagcctggggtccctacagagcctctgcttgtgttgattttgaactggaagctcctagggaaagggactgccctatagactgatacttagagccttagggaggctttgcattgagcacttcaggaaagagactgattttgacattgacatgtctgctgcaagcttatgacttagttctctaagtccacccccacccctccattttttaccttggcttacactaagaaatgtattttgtatcatgtcatattgtacactaacataaacatgattgaaatataattgaaaccgctacatgaaatagtacttgccattacagttttgatgctttctattcaattttatcccgtttcattaatttaatcttaattagcattattttttaaacttcacacatcacaaatgagtaggagctagcagtctgaaaaaacagtgccctagaaataagggtataattggctaaactgcaaatatgagtcactggaaattgaattacataagtcaaggattgcttgtagtcaattgaatatttggaatgattaaaatttacatttgatttctcctcttctatttcctctcctatttaatttaaagatacagtgtgtttagattatctgcaagggtgttttaccatttgtttaaaaagctacagaagttctaggtaagttgtcatcgggtcttacagagttgatccgaactaaaagtttctatgatccaccaaaggaggatggagagtacctgttatttttccttacttttattatctttttaatttgaagtttggatgagtggtatatttgaataatactgagtacaagtaaaacaatttcttcttagagtaaattgtatgtaactgggtttgaatagaaaactttaaccattagaacttttaggtttgtaatattcactgggtagtcagttggcctgtagctttggtcttctggaagtaagcaatcaggaaggaaagcctctgaatgtctcctttaaatctctgtgcttcattccagatgaactcagcctaaatgacgacttgcacattttctgctttcccagccttcttcttctaatgagctaattattaggatgaagaagcgagaaggaaagatttggggaacttaatagaatgtatactaataaggaaaaatgatagtttacctcctgatgtaaaagccagttgatctgattctactaaagggagtagatggaaaatttgttttaaagattactatatattaaatgtgaatgcttatgctgatttgtacaagttaccaagaaaagttaaaattaattttgttctcttaaaggaggtactgaaatagagtaagcatttttgttagacttcttttttttttattttttttttttgagatagtctcactgtgttgcccaggctggagtgcagtggcacgatctcggttcactgcaaccccttcctctcaggttcaaatgattcttgttccttagcttcccgagtagctgggattacaggcacgtgccactgtacccagctaatttttgtattttcagtagagatggggtttcaccatgttggccaggctggtttcgaactcctcacctcaggtgatccgcccacctcggcctcccagagtgctaggattacaggcatgagccatcacgcctggctattttagttaggcttctattgaaaaaaaattgttcactgggtgcagtggcttacaactataatcctagtactttgggaggtcaaggtggtgggattgtttgagcccaggagttcaagaccagcctgggcaacatggcaaaaccctgtatctacaaaaaatacaacaattaacaaagcgtggtggcacatgcctgttgtcccagctacttgtaaggctgaggtgggagaattgcttgagcctaggaggcggaggttgcagtgagctgagaatcgcaccactgcactccagtctgggtaacagagtgagtgagaccttgtctcaaaaaaaaaaatgtttttaaagctgttccttgagaataataagcttttgttttctggacaatataattttgagaagaccccccttttccctctcaatgacagataaatgaggtattaatatattttattgaatgttaaatttttttttttttttttttgagatggagtctcgctctatcccccagactggtgtgcagtggcatgatcttggctcactgcaacctcctcctcctgagttcaagccattcttctgcctcagcctcctgagtagctgggactacaggcgcctgccaccatgcccggctaattttttgtatttttagtagagatggggtttcaccttgttagccaggatggtctcgatctcctgaccttgtgacccgcccgccttgacctcccaaagtgctgggattacaggtgtgagccaccgcgcctggccaaaatttttttatatttgtcttttccattttagttgaatatgggttttgttttttgtttttttttgagatggagtctcactctgtcacccaggctggagtgcagtggcacgatcttggctcactgcaacctccacctcctgagttcaagccattcttctgcctcagcctccctagtagctgggattacaggcacctgccaccatgcctggctaacttttgtacttttagtagagacagggtttcaccatgttggccaggcttgtctcaaattcctgatctcaggtggtccaccctcctcgacctcccaaagtgctgggattacaggcatgggccactgcgtccagccctgtatatgggtttttaattaaggtactatcttttctgtggtcgtaagaagggaactttaaaattactcctgtttgtaaatgtaaatatactagattttcttatccaaaagaatgttagctcatttaaagtgattatttcaacagtgctgttgtttttgaaactatcgttttagacttgtcttcagaacttatgaattcttcttttgaatgtgaatttgatatttagaaatcactaaaagccatctagtgccagtttatctgttgtacataatgttttaaatcaggctatttaaaatcattttggggcagaagtatttatcttttttatcttctcattgactcgtaacactattcagtgaatttgggcagaagtagagagtcatgttttaactttgagatgcagttttttacatggctcttaagttaaactgagtacatttccaaaagagtttttctgaaaaatactttagtagcaaaattagtagaatagatatagaactgctaagatgactgttttaaaggaatcatgctcatttggactattgatatattagtttaagcaacaaaatcatttatgctttttatttaatcatttattatattttatatttattttaaatattttatatttattttatattatattttttatttaatcagttcttataattactttataattatcctgttacatcaggcataggaatcatagcaatttactttctacactgttatttttcagactttgtatttataatttatgatttaaccactgattttatgtgtaaaacaagtatataagactttttaagatgaaacagatttgtatgtttttttttctttaattaggctcacgaggcccagggaatcctctggaccatcagattaccaatgaaagaggagaatcaagctgtgataggttaaccgatcctcatagggctccctctgacactgggtctctgtcacctccatgggaccaggaccgtaggatgatgtttcctccgccaggtatgtaaagacaatagttattatttctctttgaaaggcagctgggatgtggaatacacaggaatggaagaagggaggagtatatgtttgttctctcttaagaaaaatcatcgtacatttttgaaaacaacaatgataaataatctaaacagaatgatttgagataattgttcatattatagaaagctgttttctccctaaatggaatgtttttattgtttttgttgcttgtagaggtaataatgcatgtttactttagaaaatccaaacaacacagaaatgtgtaaagaagtgaaaaatcccttttgtcatcttagcgtgtccttcccagaatttagttgtaggtatatatcttttagagatttttttgggtatacatttatacacatagctgttcaaattcttttaatcactctgtgcagttgtaccattcatcctcttttgtaattgtcttttttcactgaccattttatctcaccaaaataaatatatttaccagaagagtcacagcagaatatcttgaaataagataataactgccattcaacagctgcatcatctacattaggtgtttctcctaatgctatcctcccctggccccccacccccagagaggccccggtgtgtgatgttcccctccctgtgcccatatgttctcattattcaactcccacttatgagtgagaacatgcggtgtttggttttctgttcctgtgttagtttgctgagaatgatggtttccagcttcatccatgtaccttgcaaaggacatgaactcattcttttttatggctgcctagtattccatggtgtgtatgtgccacattttctttatgcagtctgacattgatgggcatttgggttggttccaagtctttactatcatgaacagtgccgcaataaatatacatgtgcatgtgtctttatagtagaatgatttataatcctttgggtatatacccagtaatgggatggctgggtcaaatggtatttctagttctagatgcttgaggaatcgccacactgtcttccacaatggttgaactaacttacactcccactaacagtgtaaagcgttcctatttcttcacatcctctgcagcatctgtagtttcctgactttttaatgatcaccattctgactggcgtgagatggtatctcattgtggttttgatttgcatttctctaatgaccagtgatggtgagctttttttcatatgtttgttggctgcataaatgtcttcttttgagaagtgtctgttcatatccttcgcccactttttgttggggttgtttgcttttttcttgtaaatttaagttgcttgtagattgtggatattagccctttgtcagatggatagattgcaaaaattttctcccattctgtaggttgcctgttcactctgatggtagtttcttttgctgtgcagaagctcttcagtttaattatatctcatgtgtcaattttggcttttgttgccattgcttttgttgttttagtcatgaagtctttgcctatgcctgtgtcctgaatggtattgcctaggttttcttgtagggtttttatggttttagttcttatatttaaatccttaatccatcttgagttgatttttgtataaggtgcagggaaggggtccagtttcagttctctgcataaggctagccatttttccgaacgcaatttattaaatagggaatcctttccccattggttgtttttgtcaggtttgtcaaagatcagttggttgtagatgtgttgtgttatttctgaggcctctgttttgttccattgttctatatgtctgtttttgtaccagtaccatgctgttttggctactgtagccttgtagtatagcttgaagtcaggtggtgtgatgtctccagctttgtattttttgcttaggattgtcttggatatatgggcttttttttgcttctatatgaaatttaaagtagttttttctaattctttgaagaaagtcagtggtagcttgatgggaatagcattgaatctataaattactttgggtagtatggccattttcacgatattgattcttcatatccatgagcatggaatgtttcttcttttgtttgtgtcctctcttatttccttgagcagtggtttgtagttctccttgaagaggtccttcacatcccttgtaagttgtattcctagatattttattctctttgtagtaattgcgaatgggagtttggtcatgatttggctctctgttattggtatataggaatgcttgtgatttttgcacattgattttgtatcctgagactttgctgaagttgcttattagcttaaggagtgtttgggctgagatgatggggttttctaaatatacaatcatgtcatctgcaaacagagacaacttgacttcctctcttcctatatgaataccctttatttatttctcttgcctgattgccctggccagaacttccaatactatgttgaataggggtggtgagagagggcatccttgtcttgtgctggttttcaaagggaattcttccagcttttgcccattcagtatgatattgcctgtgagtttgtcataaatagctcttattattttgagatatgttccatcactacctagtttattgagtttttttttttttttttagcatgaaggggtgttggattttatcaaaggccttttctgcatctattgagataatcatgtggtttttgtcattggttctgtttatgtgatgaattacgtttactaatttgcatatgttgaaccagccttgcatcccagggatgaagccaacttgatcgtggtgggtaagctttttaatgtgctgcttgatttggtttgccagtattttattgaggatttttgcatcaatgttcatcagagatattggcctgaaattttctttttttgttgtgtctctgccaggttttggtatcaggatgatgctgacctcataaaatgagctagggaggattccctctttttctgttgattggaatagtttcagaaggaatggtaccagctcctccttgtacctctggtagaatttggctgtgaatccatctggtcctggacttttttggttggtaggctattaattactacgtcaatttcagaacttgttactgatctattcaggaatttgacttcttcctggtttagtcttgtgagggtgtgtgtgtccaggaatttatccatttcttctagattttctagtttgttcacatggagttctttatagtattctctgatggtagtttgtatttctgtgggatcagtggtgatatcccctttatcatttttccttgcatctatttgattcttctctcttttcttccttattagtctggctagtggtctatttattttgttaatcttttcagaacaccagctcatggattttttgaagggttttttgtgtctttatctccttcagttctgccctcatcttagttatttcttgtcttctgctagatttttactttgtttgctcttacttctgtagttcttttaattgtgatgtttgggtgttgattttagatttttcccgcttgatctcctgtgggtattttagtgctgtaaatttccctctaaacactgctttagctgtgtcccagagattctggtatgttgtgtctttgttctcattggtttcaaataacttatttatttctgccttaattttgttatttacctagtagtcattcaggagcaggttgttcagtttccatgtagctgtgcggttttgagtgaatttcttaatcctgagttctaatttgattgcactgtggtgtgagggactgttatgatttccatccttttgcatttgctgaggagtgatttacttccaattatgtggttgattttagaataagtgctatgtggcactgagaaaaatgtatattttgttgatttggggtggagagttctgtagttgtctgttaggtccgcttggtccagagctgaattcaagtcctgaatattgttaattttctgtctcgttgatctgtctaatattgacagtggggtgtcaaagtctcccactattattgtgtgggagtctaagtctctttgtaggtctctaagaacttgctttatgaatctgcatgctcatgtattgggtgcatatataattagggtagttagctcttggtgttgcattgatccctttaccattatgtaatgcccttctttgactttttgatctttgttggtttcaagtcttttttatcagagactaggattacaaccctgcttttttttgctttccatttgcttggtaaatcttcctccatccctttattttgagcctatgtgtgtctatgcacatgagatgggtctcctgaatacagtacaccgatgggtcttgactctttatccaatttgccattctctgtcttttaattggggcatttagcccatttacatttaaggttaatattgttatgtgtgaatttgatcctgttattatgatgctagctggttattttgcccattagttgatgcagtttcttcatcacgttgatggtcttttacgttttgttgtgtttttgcagtggctggtagcggtttttcccttccatatttagtgcttccttcaggagcccttgtaaggcaggcctggtggagccaaaatccctaagcatttgcttttctgtaaaggattttatttttcctttacttataaagcttagtttggctggatatgaaattctgggttgaaaattctttaagaatattgcatattggcccccattctcttctggcttgtagggtttctgcagagagatccgctgttagtctgatgggcttccctttgtggttaacctgacctttctctctggctgcccttaacgttttttccttcatttcaatgttgctgaatctgacgattatgtatcttggggttgttcttctagaagagtgtctttgtatttcgtgaatttgaatgttggcctatcttgctaggttggggaagttctcctggctaatatcctgaagagagttttccaacttgattccattctcccgatcactttcaggtacaccaatcaaatataggtttggtcttttcacatagtcccatatttcttggaggctttgttcattccattttattcttgtttctctaatcttgtcttcacgctttattttagtaagttagtgttcaatctctgatatcctttcttccgactgatcaatttggctatattgatacttgtgtatgcttcatgaagttctcgtgttgtgttttttggctgcatcaggtcatttatgttcttctcgaaattggtttttccagtttgcaattcctctaaccttttatcaatgttcttagcttccttgcattaggttagaatatgctcctttagcttggcggagtttattactcaccttctgaagcctacttctgtccatttgtcgaactcattgtctgtccagttttgttcccttgctgccaaggagttgtgatcctttgaaagacgaggcatcctggtttttggaatttttagcctttttgcctggtttttcctcatcttcctggatttatttaccattggtctttgctgttgatgaccttcggatggagtttttgcttggtccttcacggcacagtccctcatggcttctcttggctaggggaggaaatttcctgaacgcttgtgcttcccaggtgaggtgacgcccaccctgcttctgcttgcagtccgtggactgcacccgctctctaaccagtcccagtgagatgaaccaggtacctcagttggaaatgaagacatcacccgccttctgctttggcctcactgggagctgaagaccggagctgttcctatttcgacgtcttgcctgggaatcaacaatttcttgtgatctatcttcaggtttactgactctttccttgtcatctccattctgttattaagcttatctagtaaaagttttattttagatatatttttcaggtctaaaattaccatttggttcctttttataatttgatttatctgctgagttttttatctttttattcattataagcattttttttaaaccattgagtatattagttttataataactgctttaaagtcattgtatggtaattctaacatcagggtcatcttgaggttggcctctagtgatgatattttcccttaaggatgggtcacattctctttcttgatgagtttgtattggatactagacattgtggcaattctggattctattctattcctctaagagtgttactggtcttgctgtagaagaccattaacttggatgggctcagactgcagccttttcccttctgtggtggggaacagctcaaatattagttcagttatttttgccttagctgaaaactgcttaaatttgccatacacatgtgttgctctggagtcagccatagacttgggcagagattgtacccagaatattgggctctacctttgcggctttctcctttctaggatatcccaatcccattgcctcaggcttgggctctgtgtacttgttcttcaggcaagaaagttttatcgagttttgactgctgtgtgctgcaactcactgtggtcttctatcaggctaaaacataaaaatggaaaactcaccccatacccggttgttactcctttcttcttccaagctctctcttcttttctaagtcctcctgcttttgttgatgcttaagcgcttcaggcagttatttttttgcatattgtctggagtttatacttatgtgtaggagagtcagtctgaatttactctaccatactagaaatggaacctggtctccgtacttttcaatcatttgtgagcttctaaattgataccttcatagaagagatatggtccattctacagagtatctccaaataatgaacctgatccctgtggtttgacagagggccaacctgtgtcaactataatctcaatgtcatagacaagggtaattctacagacacagtaaaggaattttcagtattgttccaaaatttatgatgagtgagaagggctaaatgactcctgaggctctagcatgaattagagtaatgctgataaatgtatttctcagttagcttcattcctacctaaagttaaaaaatattctatgtttgctcttggtatattggtacatgccatttaaatagtcactgaacaggccgggtgtggtggctcatgcctgtgatcccagcactttgggaggccaaggcaggtggatcacctgaggccaggagttcaagaccagcctggctaacatggcaaaaccctgttcctacaaaaaatacaaaaattagctgggtgtggtggcaggcgcctgtaatctcagctactcgggaggctgaggcaggagaattgcttgaacctgggagacagaggttgcagtgagccgagattgcgccactgcactctagtctggcaacagagagagactctctcaaaaaaaaaataaaaaaatggtcactgaacagatttcagggttcttttcttttatgttgtgtttcagttaacgaaatgataatgaatgaggggacttaggctttttttttttgaagtggagtttcacctttgtcatccaggctggggtgcaatggtgccatctcagctcactgcaacctctgcctcccgggttcaagcgattctcctgcctcatcctcccgagtacccgggattacagggcatgtgccaccatgcccagctaatatttgtatttttagtagagacggggtttcaccatgttggccaggcttgtctcgaactcctgacctcaggtgatccacctgccttggcctcccaaagtgctgtgattacaggtgtgagccaccacacctggcctaggctttttaaaccttatcattgctattacttttttgtgtaaccttgagcaataaattttacctgtcatggttttctctctttcaaaatatggtcttctggctgggtgcagtggctcatgcctgtaatcctagcactttgggaggatgaggtaggaggattgcttgaggccaggagttctggagcaagctggccaaaatagtgagattctgtctccacaaaaaaacaaacaaaatagtgacttctgtaaaacagagatggtgatattctaaagtaatctgcctctcttttatgtaaggttgacttattgggactcatgaagagtccttctcactaataattgtctttaagatttttcttaaattttaaaatattttagtttaaaatacttatgttaaaaaaatatgacaactaaaataactaagtttctgaagaatatggattctgcatttgagattatctgtcatttagtctgttaggcataatttataaaatgtatatattttcttaacatgtttctacttggaagaagtgttttagatttccattgacttaagatgagttagcagaaatgattttaaatagttccatatttacaaggaatcatttatttttgcaccgttaaatactttgaaaaaggagaaaactttacttagcttatatagtcagaaaaaactgctctaacttatctcttttctcatatgccctattccagacattcttttaaaaaatattttaataatgttatcttttatttgagattcacagggtacatgtgcaggtttgttacatgggtatattgcatgatactgaagtttggggcgtgactgaattcatcacccagaaagtgagcatagtacccacagtttttcagcccttgcctccctttgtctctcctcgctctactctggtagtccccagtgtctcttgttatcatctttatatccatgtgtacccagtgtttagctaccacttacaagtaagaatgtgttagttttatatttctgcattaattcacttaggataatggcttccagctgcatccatgttgttgcaaaggacataattttattctttcttatggctgtgtagtattctatggtgtatatgtactgcattttctttatccagtccaccgttggtgggtatctgggttgatttcatgtctttgctgttgtgaatagtgttacgataaacatgagtgcttgtgccttttttgtagaacgacttagtttcttttggatatatacccagtaatgggattgctgggtcaaatggtagttctgttttaagttctttgagaaatcttcaaactgatttccacagtggcctaataatttacattccctccaacagtgtataagcattcccttttctctacaaccttggcaacatctgttattttgactttttaatagtagccattctgactagtgtgaggtggaatctcattgtggttttgatccaaacattcttattacttaaaggttttattagcaagtatacacctagtttcttcaagtaatcaacactttattctcattattttcagtagcagactcaatcttataaactaataaggattttaaaacttttaagttttcttttaaaactctgtggttattaaaggttagtacacaaatttggctaccttattaggaaagagctaattctgctgaagcatagtatgtgtacaaagttttgtacagtgttgaacagtctacaatgtatctgttcatctaacattcttatatgtgcttttaattagtttgcatgtttagaacaagactggcttaggtgaaaaagcatttggactggaaatcaagaaatttgctttctggttttcactcctttatcttttagtgtgattttaaaaatttattaaaaaatttttttagagacaggttctcactttgtcacccagctagagtgctgtggtgtgattatagctcactgtagccttgaactcctgatctcaagcaatcctcccctctcagcctcccaagtaactgggactgtaagcacatgccacaatgcctgggtaatttttattttattttaaattgtttttggagacaggtttttgctgtgttacccagtctggtgtcaaactcttggcctcaggtggtcctccctcctcagcctcctgaatagtgggggattacaggcacgagccatcgtgcctggcttttagtgtgatttttaaaacttgtttcatttctttggaccttatatattatatagtgacataaccatataactccataagaaactcattcgaatataatagtataagtaggtggaaagtaaaaggatagaaaagatacaccatgcaaacattaatcgaaagaaaatgaggtcaagaagatatagcaaatgttaaatgtgtgtatgccaacagcagctacaaagtatgggaaacaaaaactgatagcactgagaggaacaaagacaaatccagttataattggagacttcaacacccctctctcggcaattgatggaacaactgaagagaaaattcagcaagtatatagaagaactgaacagtgccctcaaccaacaagacctaactgacatttatagaacaagttacccaacagcagcagaatacacgtgtttttaaagtagcagtggaacattttacaagacagattgtatcctgggccataaaacaaacctcaacacatttaaaagaagtgaaataatatacagtatgttctttgatcacaatggaatcaaactataaataataaactattgatacatgcaacaatttggatgtatctcaatggttgagtgaagaaaaccagtctcaaaagtttacatactgtgttattccatgtatataacattcttttttttttcgagatggagtctcactctgtcacccaggctggagtgctgtggtgtaatctcggctcactgcaacctctgcctcctgggttcaaactgtccttcagcctcagcctcctgagtagctgggacttcaggcacacaccaccatgcccggccaggctaattttaaaatttttagtagagacagggttttgccattttagccaggctggtctcgaacttctgacctcaagtgatccacccacctcggcctcccaaagtgctgggattacaggcgtgagccactgtgcccggccatatataacattcttgaaatgacggtatagaaacagaaaacagattggtggattcaagagtttgagacagtagtggggaggggagtgggtatgactgtaaaggggtggcacgagggaggtgtttttggtggcacaataattctgtatcttgagagtggtagtgattacataaatctacatatgctgtaaaatgtcatagaactagacacgagttgtaccaatgtcagttttctggctgttacaatacactatagttatgaaagacgtaaacattgagtaaagggtgtgcaggatctctctgtagtatttttgcatctttctgtgaatctattttaaaataaaaaagtaaaaatcttattgtatatcatacacatacagggaagtacaaatattaagcatataatgtgattttttttcacaatttgagcacagtgatataactaacactcagataaagggatagttttcagtttggtttttcataagtttaattagaaaacttatttataattttagcagaaaaaatgttcttgaataatgtaagtgagttgataatattcacatatcatatagtaatcacaattaaaattttaacagaaatatgtcctgggaataaccagttcattataaattctttataaatactaacctgcaacaaaaatttatcaatgtgacttaccttgctcagcgcttcagttgttaagaaaaaacacaaaagtgttttcatatttagaatgagaacattacagatcaaagagacttggtaagaaagtagtttaaattgtccatgtaattcttttgccagggttaactgtaacaaaggtgattctcataaaaactttcaagttgtatgtgttggcttgttttgtcttcacttttagaaatgaaagtgaggtatcataatttattaagtagataatgtcactatcctgtagatcagcagtccctaacctttttggcatcagggactggtttcatggagcccagtttttccatggaggttgcagggaggaggatggtttcgggatgaaagtgttcacttcagatcatcaggcattagttagattctcataaggaatgcacaggctagatccctcacatgcgcagttcacagtagggtttgcgcttctatgagaatagaatgcctcagctgacaggaggtggagcttaggtggtaatgctcgcttgccctcctcacctcctgctgtgcaaacagttcctaacagcccgcggaaaggtactggcccgcagcccaggggttagggacccctgctgtagatgactacatacatttatttatttatttccctgtcttatggtgctgattgataactacttctactgtagctcaggttgggatatatagtttgaaaattgttggcatatatttagatagagagatacagtgggttagtagctttcacaaggagaaggaattaaaatgttaactctatattttttgttctaaatatatttttaggatctatgtgctatagtttgtttcatttttacaagaatttctactgaacatcttattcaagatgttgggataaaagataaattattaaaaaggtgtagttatgtatttcaatgatgagttaatataatgaaatgaatgtaatactgaaacagatctttttctacaacagctctgtccaatagagctttctgtaataatagaaatgttttatatctatactgtccagtacagtagccactaggcacatgtggctagtaaatacctaatgtgtctagtacaacttgagaaacagaatttttaatcttattgaattttgtcagttaaaatttatttaattttctttattattttgttttgttttgagacagaatctcactctgtcatccaggctggagtgcagtggcatgaacacagcttactacagcctcgacctcctgggcccaagtgatcctcctgctttagcctcccaagtggctgggactataggcatgcaccactaatgcctaatttttaaattttctgtagagacggggcctcactatgttgcccaggcaggtttcgaaatccttggctcaagcaatcctcccaccttggcctcccaaagtgctgggattacagacgtgagccaccacgccctccttcgtacccttttgagctttagtattcctagttttcattgtttaaaagaacaaggagtgtgtatgtggtttctccttatttttgttggtgcttatcttttactgatttggataatatattttatgtaagcatagcaaagagactaagcaaccataccttggtggtgtaatcatgagttaagtgtggttgctagcctggcatgtttaaaaactctttttcttaaagagctgaacaaataagagacatatagtgtacagctaaattgatgagaacagttttgactctttccttgggaaacaaaagtgtgctaagcagatcaaaataccttggatagctttgaatgcataggcgtagatttttacttcactgactctgattcatagacatttatgctgaccattgtcctacattctgaacagttttttcagacaagactgatttagtagaattatagtttgtcttaaggctcattttgatctctttgatgaaaacttgtggtcttcccaaacttaataaggtgttctgaagtcgtggtatatatgcttttatcctctcagaggatgatatttacttaaagttgttcctaaattttaggctaccagttttttaggaatatatatatcttaatcacttatgtcttatataatgatcctttataaattctaatgattattcagttgataaattgccactgtatgtgtttttataaactttaaaaatctgtgtttaatttgtcagtcttcctgaagagactaggttgtggagagattaagatacagggacaaatgtaaacaactttttgaaaaatttcactttgaatgaaaaagagatggtagctggagggagaggtgttttggtttttaaagatggataatattggctgggcatggtggcttacgcttgtaattccagcactttgggaagctgaggcgggcagatcacctgaggtcagaagttcaagaccaacctggccaacatggtgaaactccgtctctactaaaaatacaaaaattagccgggtgtggtggcacgcgcctgtagtcccagctgctcgggaggctgaggcaggagaattgcttgaccctgggagggagagcttacagtgagctgagaccgcaccgttgcactccagcctgggcaacagagtgagactccctctcaaaaataaataaataaataaatgaataaataaataaataaatgatggataatataacatatttatttgctgatgggaataattcaggctagaaggggaaattaatgatgtttggagaaggtctggttataaaagtgaaaccctggaatattaagcacaaaagatgctatccagagtgtaattgcagaaattgtggtagctgggtcaatttatccattctaaaaagaaggaaggcagagcaagtgagtacagatgtagctgttgggtggagggtaagtggaggtgtccagttgtttcaattttcttgttgtggcaagatcatcagctgaagcaggtggtagaggagaggactgtcagatctgaagagaaaaaaaggtatgcagtagctatttaggagagtggaagaactcaaacattagtaaagtgtagtatgattatagggcattgttgagcatcagtttgaaatttatggtcataaatttgaatgaaaagcagtcaatactatatttttaatatagtttataatcataacaagcttaatttatcatcagatattgataaagctgtatatagaatgtatttgtgtcagactaaatgccttttattaatcattctaacactcttaagagtgttattctgttattcccattttacagatgaagaaacaaaaccacagaaaggttgggtaacttggtgaacaacacaaattgagatttaaaaaaaaaattttattatactctaagttttagggttcatgtgcacaacgtgcaggtttgttacatatgtatacatgtgccatgttggtgtgctacacccattaactagtcatttagcattaggtatctctcctaatgctatccctcccccctccccacaacagtccccggtgtgtgatgttccccttcctgtgtccatgtgttctcattgttcaattcccacctatgagtgagaacatgcagtgtttggttttttgtccttgcgatagtttgctgagaatgatggtttccagcttcatccatgtccctacaaaggacatgaactcatcattttttatggctgcatagtattccatggtgtatatgtgccacattttcttaatccagtctatcgttgttggacatttgggttggttccaagtctttgctattgtgaatagtgcctcaataaacatatgtgtgcatgtgtctttatagcagcatgatttataatcctttgggtatatacccagtaatgggatggctggatcaaatggtagttctagttctagatccctgaggaattgccacactgacttccacaatggttgaaacaaattgagatattatagcacaatcctggatatcacccttgagaatttacatattaatatttgcttcagatatatatgtgtttgtgtgcgtaaatgtgtaaataagacataaaaagaaaaagcacactatttacatgaattgaacactattgcatttcctttcctgggcatattaccttcctctcctagaagcagctattcatgagtttagcgtgtgtaaactttcagttctaataatgattaaaaaaaattaaagttctgttttatcagctttccttatcagccttacctacttgaattctttccatgttagtatatagagagtttatcaccttaattgtggtatggtatttcagtgtataagaaaccacaaaatgtttaaccatttcctgttggtgagcatttagagtgtctccaatatctcaccattactaacagtgctgcagctagcaccctttttgtacatatgttctttcaagattgtccaggaattggaattcctaggtaatagggtatgcacacttttgatcttattttcaatttttatttttttgggacaggatcttgctttgtcgctcaggctggggtgcagtggcgtgatcttggctgactgcaacctccgcctcctgggttcaagcgattcttgtgtctcagcctcccgagtagctgggatcgcaggcctgtgccaccacacctggctaatttttttgtgttttcagtagagatgggatttcaccatgttggccaggccgatcttgaactcttggcctcaagcagtccacctgccttggcctctcaaagtgctgggattacaggcatgagccaccatgcccggcctgtttttggttttaatagatatctccccatcgccctcaacagaagctgtgaatgaagtatatgagagtagctgatttctgcagtataattcttagtttgcaaaactgctttagaatgcccagtacacttattcccactccttattcatttttttcttatctttttttcttccattctttctttctaatcatgtcttctattataagcgtagaatactattatagaaaacaaaagtttgaaagcaaaaaagaaagggacctttcatgtccttactttctgtagttcagttcagtctttaattggtcatatgctttccacatagctgtatcttattatgtgtatatgtgtatgtgtatatgtgcatatgagggtgtgtgtatatgtgtgtatgtatgtgtgtatatgtatatgtgcatttgaccagaatacccttgattacttgttcatctttacttttctttcagggcaagctttactgcctctgactccatttctgattcctgcaatcagaaatagatagtctacctcttatattatgtatatttccttttattaagacattaatcacatggtgtttatgtgtttctatcagaattagactgtaaggacatggggtttatcaaggccaacattgtattgtttgtgcctgacacatactaggccttggtaagatttaaggaatgaattgcttttgccagtggagggcaacatagccatgtagtttataaagtagtaaatttataacaaaatttttttatttctgaggttgttgatgtgtggggatataatttagaagcaaaataatgatgtagtatctggagacctgattaaaaaagagttggtgttcaggtttccttattttatccccttgtccaactccaccatttaattaatcctttgtttgaagtagaaagggaaaactgagtttagatctcagtgattggtattgaccttttctttcattaggctaactcaaaccctttgaaacagctcctccctaggattttgaaagggagtgtaaatgagccttcaaactatttgtatctttctctcctcagtcacatctcccgaccattgggagctcattaaatataattctctttattgactctcgttgatgccaggtggtctctctggttttgtgtaggagagatgatgtgtcaataaggtcccctgtggcagagtcagatgaggagtgatatatccaacactgattctataaagtcaattagaggcaatttggggttgtttacgtatatctgtaataggataggggaaagttacacaattcaccttctttgtcgttctccttatttttggagttggacatatgcatgcctaatctagcagtctgacatcacctttcaagaatgagaaactacctatactttttcaagagtgatgagttccacaaggacccaggaattattaaaccgcaattacttttgcaccaacctaataccatattgtcatcataaatcacccctggggacaaagggtggctgtagaagcacttgagatagttggtgtccaaatttgtgtctctccagatgttcttcgtttcagcagtggtactcatctgttgagtcagagagagctttccatttagtttgttttttatttattttcatttatttatttatttattttgagatagagtcttgctctgtcacccaggttggagtgcagtggcatgatctcggctcactgcaacctctgccccactgggttcaggtgattcttctgcctcagtctcccgagtagctgggattacagactaccatgcctggctaatttttatatttttagtagagacagggtttcaccatgttggccaggctggtctggaactcccgaccttaggtgatccacccgcttcggcctctcaaagtgctggtattacaggtgtgagccaccatacccgtctctttccatttggtttggaatagatactaaattccaaaacgtcaatattactgaaagtttgacaatgatgacatctgaatgatactctttctgctttgatgacaaattatcacctgttctggtaaatttcttgctgtgcttacgttttttctctttactttttccttatgttagtagatgtttcctgggtcttttttgatacattgatgtatttacttccatccattattaaaatggaaagttaatttacatatatataaaactaaattctgttttcacatattctaatttacacatagtaattgaaattttcaaaatccaaagtagcagattatgcttgtgtttactataaaggttattgcctatagtaaaatatgcaattcttctgaaattgtctactgttgtcaaccaagaagatgatgagtttaagtgttagaatacaggtcaaaagtgtaagttcaatacgttaaacttaagtaaacttgatttatatttacattaatgaagacattttaaaaacttattttctaggacaatcatatcctgattcagcccttcctccacaaaggcaagacagattttgttctaattctggtagactgtctggaccagcagaactcagaagttttaatatgccttctttggataaaatgggtaagaagtactttgtgcttttcttctttaaaaattttggtggcacactaaagaactggaagttagaataaagaccaatataattgctatctctagtagttcctaaggccaaaatctctttcctgaaaatgtcctggttttatgtttcttgttatattgtacacagacatggcatccaaatatatgttggtgggttggtttgagcaccatggaaataggtttactccatatacctatgatgataaattttactctgttctatgactaattttctaatttttctagtccacttacatgtgttctgtttagtaatcagggaaataagccaggcaaatgtgaatggatacataaaaacccaccagaaaacaatttagatgcatgctctgttgatattgtaatcagttatattaaacatttcatgcttagatataactaacatgtactgagcaatctactatttgtcaggctgtcttttacttaaactacctcatagcaacccattaaagttgggaaatagatgtatgcagtgtatcaaccagaagtacacaacgttaagaaaataaaaattttttttaaagtcaagatttaaatgtattggtaaaaggtttcctcaggaaaggacatatatttatatattattaaatatatataataaataatgttatatatataattttaaaaatattgattttctgacatagtagactatataatatagctgggactacaggtgtgcaccaccacacatggctaattttttgtaaagatgaggtttcgacatgttgttgaggctggtcttgaactcctgggctcaagcaatccacctgccttggtctcccaaagtgctgggattacaagcatgagacaccttgctcagcctggaaagtcagtattttattttatttattttttaattattatttttgagacagagtctctgttgcccagactggagtgcagtggctccatctcggctccactgcaacctccgcctcctgggttaaagagaaacccaggaggtttcacttgtgtcaagcacaagtgaaaaatgaccagtaagacaaggacatttataactggctgaagtcatggactttggagtctagttagttggggaaggaagtgagggaggaaactcagtggtcagaagcatcagtgacttccaaggacagatgtagtgagaataaatgagaaagctacaagaggagaggtagttgtggtcagagaggattgcatttcttgatgataacaaagttcgggaacatttatttcggaacagtagctaaatttcagtagctagtctctcttacttaatggaggaataaggacggaaggaagaagaggaggaaggagaagaggataggaggcaaacataaaaggagggaggaggaaaagaaggaaggagggagatgcttcctcccagatgtcttcttagcattctgctccagcaggattgcttaggaactagccagagaaataattgccacatgccatcatagaactctgagtctgccagaatttctagggacctcaagctgttcttgtggccgcaatataggatattggtgtccagctggcttatgtgccaacaaggggagtgggaaaataccaattttgtgatctggagatactctaggaataaagtgataaatcatgtacttttcatggtttaacttttatgtctagatgggtcaatgccttcagaaatggaatccagtagaaatgataccaaagatgatcttggtgtaagtattgaaagagtggaattgtatgcatgtattcagaagccttctttttttttttttttttttttttatggagtttcactattgttgcccaagctggagtgcagtggcgctatctcggctcactgcaacctgggttcaagcaattctcctgcctcagcctcctgagtagctgggactacaggcgtgtgccaccacacccagctaatttttgtatatttagtagagacggagtttcaccctgttggcgaggctggtcttgaagtcctgacctcagatgatccactcgccttggcctcccaaagtgctggtattacaggtgtgagctgctgcgcctggccctgagccactgtgcctggcctgtgccttctaatctcatgctttactagaatagaaatatagctaataatctaggttttgatataaagctgattttctctttttgattaatatactttctacttagcgtgaaagctgtttcttttgtagatggtaacctatggtgataaaatacaatttgcagactaggagtttgagttagtttaagattttagttccctccccatccttggatttttatttgaatattttaaagtatatttttgtttattaagatattgatttttggaaaatataaacatagacattttgctttttctttttttccagtatatatttgatacaatagtatatattttagtgctcttgggttaaatttctgttttatctttagccagactgttactttgttggttaaagctgttttctgttgacttaataaaatatttatgataactaaaatgtgatagctgatacattactgtggaaagctgtttgaatctttctctagagctttctaagactatcatggaatgctttctgtctagatgatttcttctaagcctgagattttcgggaaaatgattgcaaatttactgttttagtgactgccatatgtcaatttgttgtagaatttaaatgtgcctgattcatctctccctgctgaaaatgaagccactggccctggctttgttcctccacctcttgctccaatcagaggtccattgtttccagtggatgcaagaggcccattcttgagaagaggacctcctttccccccacctcctccaggagccatgtttggagcttctcgagattattttccaccaggggatttcccaggtccaccacctgctccatttgcaagtatgcttttttaaactttttttttaaagctcaatatgtggtttattaatcggagatttaattttactatctgttaatgtagtaacacagtggaggaaagttttttctagcattctgtgaatctgaaaattctcattacttttccgaattgggaaggcagccagccataagtggactgcaatgaggtttcagcttgattcatcttaataatatagaattatttctgtattttggcagtcaagaaaataatggactttttgcaggtcttacgataaaactaaaattatctgtaccttatttggtagcaactggttattctgacagttagtgaaaataataacttatattctagcattaaaattactggctaagatattttttaaagtctttttcataagtagttctgatgcagtcctacttatttaaaacttaaaatgtatttattacgtttgaccgaatttttggatttattgaattcttttaaagcttcacataagaaaaagggaataatatgttgcttttatattcatactttactgttttgaactatagggttctgcagaataaatatgtggttaccaaatactaggctttgcctatgaatgtctcatatagtctttccttcccttgtttctcttctctttttaaagttaaaggtgaattaaaatgaattttgtttggggaaattttaaggtggcctttgatattactggaaatgttttagtataatatcaaattagaattgggaatcactaatacgaattttaagtttgttgaaaattatattacatgcagatgttttttgaggactttgataatgaaagaaaaaagtgatttacagtaagttttatatattttgaaataattcctcttttttaaaaaacaggtgttaagataggacaaaaattacataaaaattaatgatatttcctttaatcatctgtatttgaagaggtacgtttttctcaatgtaaaaattaatttgttagatcaagtaattatctagtgtcaattttcaaataaaagaataggtaatggaagttataaacttaatgatttattagggcacagtacaggttcttaaagttaaaaaatgtcttttaccaatctctttgaacagtgagaaatgtctatccaccgaggggttttcctccttaccttcccccaagacctggatttttccccccacccccacattctgaaggtagaagtgagttcccctcaggtttgattccaccttcaaatgagcctgctactgaacatccagaaccacagcaagaaacctgacaatatttttgctctcttcaaaagtaattttgactgatctcattttcagtttaagtaactgctgttacttaagtgattacacttttgctcaaattgaagcttaatggaattataattctcaggatagtattttgtaaataaagatgatttaaatatgaatcttatgagtaaattatttcaattttattttagacggtataactatttcaatttgattaatccactattatataaacaatagtgggagttttatatatgtaatctttcaggtggggaggctttaaattctgaagtctgtgtctttatgccaagaactgtatttactgtggttgtggacaaatgtgaaagtaactttatgcttaaataaattatagttgatttaaagatttgtttggcattgataataataaaatcagtagtttttctataactatggctctattaacttttttccttttaccaataactttgaggtgcaaaactcaaacttatgtgggtcttttgtgttcaattatgttatgacaaatgtgctctctttcttgtaaatagacatgagtggcccaaagcaacaaattaatacacttttaaaagtcaaaattgattatattttaaagataaccaggatattatctaatggtgaattgtagaattttgatcttcttattcactgagtttcttgcacggtttctttattgcttttttttccccgcctgttcttttgtaaggtatttactattttctgtggaggatattgagatgtactacaggataactgtagtgaatgatgtgtcatcattttgagctttggactcaatatctttagtgtttccctaaatcagatttgtaggtcatgttaagcttcttgcacattaatatgattatggaaggaaaggcagtgaagcataactaataaacatcataatacttaa

SEQ ID NO: 1180 - DNA, 84071 bp, Homo sapiens
gcgcctccccgccttctcgcggctgcccggccgaaaccaaaccgaggggtggggtggcgaggacagggtacgtcgcaggcttgtgcgggtcgggctcggacctgcgctgcctcgggatgtaaagtataacaagagggtcgggatgggcagcgtaggcctgtgaggcctgcgggtgcccctgtcccccagctccccccgcagccggctccgcagtggtccactccggttgccgggtgcggattcgggttccggaccgaaggctgtgtgttctccgccgtttattgtggccccgacaggccggggttactgtggcgaccacgagagcagctttggcgctatggaggagcccggggttacccctcaaccgtatttggggctgctcctggaggagctacgcagggtgagcccaggcgcgatgagtgttacgtggcccaggggtcgcgggagccgccgggggaaggaagcagtagaccggctttggggtctaagccgccgtggtcagaggtcccgaagccagtcctcgtctgctgcccggctcccgcccgtgttcgaggcagtagttaggctcgtagggcgcttgagtggtttttgtgtgatggaggaggacctggggctctgggaaggtgaagaaagcacttgcttagctggactttgcaaagatgtaaatgtttcccgattcctaaaactaattagcctttccgctatgttgtttattttgagcagagacacgtggttccttcgactgtgagaaacttgaggactgttcctttaaattagttacatttactgatgtaacttctcgttgaaccttgaaagaacacctgaggttgggcggggagttgaaattttgattctgcattttttttttttttggtaaagaatgaatgcccttttgagatgctctaccatgagtgagattgttcttcgcttctgtcttgttaatgtacagtctagagatagtaaactcccagtgttcaaattttgttttttatttttcaggtctagtttataatcaagttgtagagatttttctccttaagtgtttctaggtatctttgttgacatgtgtaggggcatttatgtcgccgtgtttttaaaaactggattaaatctttaaaaagaccacttaattattgaggcagttacgattatgttttcttgttaggtgaattaaaggtagtgttgccatggtgtttatgagttcatagtttgtctaatgcatacgcatatatatgtatttaatatgaaaagagcacctttatggagattctaaatggactaagacttagttttggccactagcatcatgttgtctgttaagagagagaagacaaaaaaaaaaatagtacaaagtagaaactgatgaagtgcttacctaagcatacacacacagtgcagggaactaggagctgtattacttagagtgtaaagtgggcttagggagtgatgggcaatgatgcttgccggagatgtaagtaggttccaagtgctgtaggtgttggagagctcttgaaggcttttccgtggttagacttgtggtttaaaatttaagctcttcttgatagtagcatgtagattagatgttagggaaacaaaacttgaaatagggattaagggagaggtgacagtagtaaggataggaaagagggtactgtgtggagaaatagcctctaagagctaaaatatgtttgactttattgattgcatgtgaagggtgagagagaaggaatctagaaggactcccaggtttctggctgtggtaacttattcatggaggtagggtttttagaaagagaagcatatttccctttcttcactaaaaacaataataatcaagatttagtttttataggactgccagtgtacatggagaaatgcagaaatacatggagaaatgcagccagattttgcagttttctctagtctggtgcgttgtatcttcacctgcacagtttttttttttttttttttttttttgctaaatgcgagtaccctggcctgggggctaggatggcacaacattgttccgctttaaattttttttttatttttaaaaattattttgtattgagatatattcacacaacataaaattcatccttttataatgtccatttcagtgctttttttgttaaattcactatgttatgcaactgtcagcacagttcctcaacatttttattaccccagaaaataaactctactgattagcagtcttaattcccacccctcatcccttgacaaccactaatctattttctgtctctatgaacatgtctattctgcatgtgtcatgtagtcatgctatatgtggccttttgtctggcttcttttacttagcatgttttcaaggcttatccatgttgtagcatgtaacagagcttcatttcttttttctttctttttttttttttgagacagggtctcatccctgtcacccaggggggagtgcagtggcttgatctcagctcactgcagcttagacctctctggctcaggtgatcctcccacctcagcctcctgaataggtgggaccacagcacatgccaccaggcctggctaatttttttgtattttttgtagagacagggtttctccatgttacccaggctggtcttgagctcctaggctcaagtgatctgcccacctaggcctccaaaaatgctgggattacaggcgtgagccacttcgcctggcccttcatttctttttatggtgaaaaaatattccgttgtgtgactatatcacatttatgtcatagttgatggacatatggattattaatactttttggctattatgaataatgctgctttgtgtataagtttttatatatgtttttagttctcctgggtaagtacctgggtggaatcgctgagtcatatttaccatatgtttaactttttgagaactgccaaattgttttccagaggtcacaccattttacatccccaccagcagtttatgagggtttcagttttctgcattctctccaacgcttgtgattttctgttttcttttgtttttaattgccacccttgtgggtgtacaggtgagtggtatttcactctgttgtggtttttttttttttttttttgagactgagtcttgctctgtcacccaggctggagtgcagtggcatgatctcggctcactgcagcctccacctcccaggttcaagtgattctcctgcctcagcctcctgtgtagctgggactataggcactaaccaccacacctggctgatttttgtatttttagtagagacaggtttcaccatgttggccaggatgatctcgatctcctgaccttgtgatccacccgcctcggcctcccaaagtgcagggattacaggtgtgagtccccccacccggctttactctgttttttgttgttgttgttgtttgtttgttttgttttttaagagatggggtcttgctttgttgcccaggctggagcgtagtggcgtgatcatagcccactgctgccttaaattcctggcctcaagggatcctcctgcctcagccttccagagtgctggtgttacagatgtgagccaccacaccaggccttgtggttgttttgatttgtattttcctagtaactaatgatgttgagcatgtgcttattgtttatatcttctttggggaaatgtctattgatttccttttgctcatttaaaaaatgggtggtctttttattgttgagttataagcattctttatacatttagggtgctaaatgcttaccagataaatgatttagaaagattttctctcattctgtgcattttcttttcaccttcttggtgtgtcctttgaagcgtaagcgttctaaattttgattaagtctaatttatcttttcttcctttggttgcttgtgcttttggtatcatagctaagaaaccgttgcttaagacaaggttacaaacatttacagttatgcttccttctaagagttttagctcttacgggaagttcttcgatccactttgagtgattttgtttccatatatgttatgaagaatgggtctagattcattccttggcatgtggatatttattggcttattctagtatgatttgtttgaaagaactgtttttttctcattgatttgtcttaatactgttgaaaataatttaccataaatttaagggtttatttctggactctgatttctatttcattggtctgtgtctgtccctatgccattactacattatctttaaaacatttttttacccaatgtcttgattattgtttctttgtagtaagatacagtagggaagtatgagtcccccagcgttgtttttgtttatccacgttctttttctttatcaatattgttttggctatgtggagtcccttgcatttctatataaattttaggaattcagttttaggaatttaggattcagtttgtccatttctgcaaaaaaggcagttggaattttaataggggttgcattgagtctgttgatcagtttagggagtattgctctcttaataatattaagtcttccaagctgggtgcagtggttcatgcttgtaatcccagcactttgggagaccaaggtgagcagatcatttgagcccaggacttcaagaccagcccgggcaacttggtgaaactgttgtggtctttctgctccttagctcagctaggtccaagttcttgtctcacaaccaagaagaattaggcatgcggaccccagagagtgagtggaatagaatttattaagtgaaaggaaagctctcagcaaagagggaatgcagggggtggttcccctaccagaaggcaggaaagtccccctgtgtggctgggtctgcggccttttgtggactcagaatggggagtgcatgctgattggtttgtgagtatgcaaaaaaggttaaagcaaagacaccacttagaggtgggcgtgacaatgtagacaactaattaggaggccgggtgcggtggctcatgcctgtaatcccagcactttgggaggctgatgggggtggatcacgaggtcaggagtttgagaccagcctggccaacatggtgaaacccttctctactaaagatacaaaaaattagctgagcatggtggtgtgcgtctgtaatcccagctactcaggaggctgaggcaggagaatcgcttgaacccgggaggcggaggttgccgtgagctgagattgcgccattgcactccatcctgggtgacagggcgagactccatcccaaaaaaaagaaaaagaaaacttattagtaaagggtaggtatatgtaaaataggtgaaagatggggatcaatcagaggaaagtgggccaaacaagaaggcaagttctcaatctggtccaaggatttaacttgtggcttggctttcaggctttaaactgtctttggcttgaagttggggtttcactagggacccgcccctatctgcctgggcatttggctgcctcctgccactctcaaaatcctgtctttaaaagaaatacaaaaattagttgggcaaggtggcatgtgcctgtagtcctgctgcttgaggctgaggtgggaggatcatctgagcctggggagggcaaggctgcagtgagccaagatcgcaccactgcactccagcctgggtgacagactcagtccctgtttcaaacaaagaagtcttccagcccatggacgtggattggctttacatttatttaagtcttccttcgttgctttccacaatattttgtagtttcagtgtgcacttcttttgttaaatgtattcctaataatcttattctttttgatgctattatagatggaaatgttttctttatttcattttcaggttgctcattgctgttgtatagaaattcaactgatttttctatgttgattttgtattctgcaactttgctgaacttaatagctctgatagtttttctataggttctttaggattttctctgtgtatagaatagcattatgtcatcttcaaacagtttttcttcttcctttccagtctggatgccttttatttatttttctttcctaattgctctggctagaacctccattacaatgttgaatacatgttgatagagcggacattattgttcctgatcttaggagaaaagctttttttttttttttttcctcatctttaagtatgatgttaactgtaggttttgcatagatgtttcttgtcaggttgaggaaattccctcaaatcgtactttgttgagtgtgttttgttttttttgttgtttgtttgggacagggcctcactctgttgcccaggctggagtgcagtggcatgatcatgattcactgccgtctcgacttcctgggcacaggtgattctcccacctcggccttctgagtagctgggaccacaggcatgtgccatcatgcttggctaatttttgttgaatgttttgactatgaaacggtgctagatatagtcaaatgctttttctgtgtctattgagatgatcatgcgttttttttttctcttcattttcttaatatggttcataagattattgtatgttaaaccaaccttgcatttctgggataaatcccacttggtcatggtacataatcctttttatatgttgctggatttggtttgtcaatatttttttgaggatttttgcatctggagtcataagatatattggtgtgtgattttcttttcttgtgtgatgtatttgtctggcttttagggtaaataccagcctcatagaataagttaggaagtatttcttcctcctctatgtttgggaagagtttgagagtgattggtgttaatgttttatcttggagaggtgtaccttcatggaactttgtgttatagtcaagtattcacagggtctgcatgttgacattctttttgttattagtatatatcatgtttgaagttagatgaaaaacaattttagtttattcttagtatattttgtcaacctgattaattgattttttttaaagctacttgatcttgaactcctttagtactcatgttttggaaatggaatagattttaagtgttctgtgattaatcactaccgtactttatggagggttactcttggaggggttacccatcaccctttaaatttcagtttatcagattacatgtaattctgtattatatttgttgatatttgagaaatttggttgttctttctatgtttttgtgagatagggtgttatgttgtagataaaatttaagggtgaaaaatctccttgagaaagccagaataatttagaccagagcaatgaatttgagatgaatcctttagaactcagtttctttttttctttttttctttttttttttttttgagatggagtctcactctgtcacccaggctggagtgcagtggcgtgttcttggctcactgtagcctcctcccgggttcaggcaattcttgtatctcagcctcccaagtagctgggattacaggcttacgccaccatgcccagctaatttttgtatttttggtagagatggggtttcaccacgttggccagactggtctcaaactcctgacctcaagtgatctgcccaccttggcctcccaaagtgctgggattacaggcctgagccaccgtgcgtggccaagactcagattctttgcttttctccagtctgccagatctaaccagctcaaggctttattttattttatttttttaaagttttttttttttgtaatcccagcactttgggaggccaaggcaggtggatcacctgaggtcaggagtttgagaccagtctggccaacatggtgaaaccctgtctctactaaaaatataaaaactagccgggcatggtggtgggcacctgtaatcccagctactcgggaggctgaggcaggagaattgcttgaacccaggagacggaggttgcagtaagcctacacggtgccgctgtactccagcctcggcaacagagtgagactccgtctcaaaaaaaaaaaaaaattttttttttttttaaattattccttaatttccatgtttccttaatcctttgtgtgtgtgtgtgtgtgtgtgtgtgtcagagtccagttttgttttgtcacccaggcttgagtgtagtggtgcgatctgcagcctttgcctcccaggttcaagtgattgtcccacctcagcctttctagtagctggaactacaggtgcctgccaccatgcctggctaatttttgtatttttagtagagacagggttttgccacgttggccaggctggtctcaaactcctggcctcatgtgatccgcctacgttggcttcccaaagtgctggcatgagccactgcgcccggccctagctcaatgctttaaactagaatttaccatgtccttttagaagagaagagctgataaaatgtgattgaatctaagaaatattattgtactaaaggtaattacgtgtttgatctgagagatgcttttggaattgccttttaaagtagagtgtcataggtcatattgattacacaatttttgagttagtgtgcgtcttatgtgttgaatacattagctaaaagtaagatgcttggaaaatgtgtaaactgtgaagaaaacttttcttcctggtattgtgtattgaatgccttttttcccccaatagcaaaaataatttttttttatcattaattgcttgtaatgatattagatttctgcgaactggtacctagggtaatgtagggagaggcagaagcagagatcagggtaaagggatattttttagaagtataatcaggtttgtttggtacaggttatgaagtatagatagtaccttggaaggagtacatatttggattagagttataaaagattttggagaggaaaataactattaaacactgttcttataggcagaaagggcctaaaaggaagatttgctgtagaggttttgggttaaagcctgaaaagaatcaaaccccatcatacttcagattgttcttaaaatggcatttttcttttttccccttacctttccccttttctttttgatcaagtaatatcttgggcctggtaacaaagagcagaataaccccattaggtaaggatgagtaatgagctgacccagagaaaggtgaaatatagaagcaacagcaaaagccttaggctgtgttgtgctgaaggtctgctgtggggagaagtaatgtggaaaggccatggtcagaagatcagggtctttggaggagataatataaataattacccttttttgagcacctgtctggcatgttcaaacagcattattctcattacacttaagagaagggacgcacagaggtagggtggggagattcaaactccaaacccaaatctctatcagtggtgttcaaaacttgtttttattttttgagacaggtcttactttgttgcccaggctggctttgaatcaaactttttatttttaaagctgcaaattgattttttcttcctgtagggaaattgtatattggggaactgattatactttacagataaaacctgaactggttgaaatcagggtaagagtacctgaaccctaggtcactcagtttctttctttggccttctcttattctcatccttggaaactttaagtcacctctgtagaactccagtttgaagataattgcatttcaccatactgctgttctttacttggcgatagtgattgaaagttgacaaaaaaatgtactctgatactttctgtttggtgttagtctggcagcccattttgtgttgaccacataaacttgtacctatgtttgtaatcaatatttttaccaaaagtacatttttaagaacttacttttctttatcttgaaggttgtggcagcactgcctgaaggtatgagaccagattctaatctttatggttttccatgggaattggtgatatgtgcagctgttgttggattttttgctgttctcttttttttgtggagaagttttagatcggtaagtaaccagtgctatactaagagaatgttcattttgtcactgggctgaacaaataatatgagaaacatatttgttattttaagtaaacaagttagaaactacatagggattcagaggtttttgttttttgttttttgttttttttaaaagagatgagggtcaggaatgagagtcaggcccagtgctgtggctcccacctctaatcccagcactttgggaggccaaggcagaaagatcacttgagcttaggggtttgtgaccagcctgggcaacacggtgagaccccatcactacaaaaaatacaaaaattagctggacatgaggacacccgtctgtggtcctggctactcaggaggctgaggtgggaggattgcctgatcctgggaagtcgatgctgcagtgagccatggttgtgacactgtactccagcctgggtgacagagagagaccctgtctcaaaaataaagagatgagggtcttgtgttgctcaggctggtctcaaactcctgggctcaagtgatcctcctgcctcggcctcccaaagtcttgggattacaggtttgagccaccatgctcaactggaatcttttaatgtaagatcttttatatatatatatatgtgtgtatatatatatatatatatatatgtgtgtatatatatatatatatatatatgtgtgtatatatatatatatatatatatatatatatatttatatttaaagagatggggtctcactatgttgcctaggttgtagtgcagttgctattcacagatgcaattatagtgcgcctacagcctacagcctcaaactcctgggcttaagcaatcctttctcagccttttgagtagttgggactacacaggtccatgtcactctgcccagcttcatcttttttttaattctgggaaattttatttgagacaggatttcactcctgtcacccgggctggagcgcagtggcatgatctcggctcactgcaatctctgcttcctgtgctgaagcaattctcctgcctcagcctcctgagtagctgggactacaggcgtgcactaccatgcctggctaatttttgtatttttttgtagagacgggtttcactgtgttgctcagaactcctggcctcaagtgatctgcctgccttggtctcccaaagttctgggattataggcattaatcaccacgcctggcctaattttgggaaatttttaatgcatttttgggactgctatttttcagatgttgccccttttacttctgacttccctatctcttaacttctatttttcaatttctttatggttttctataccttttgagagttccttaatctgaggaactgaaatctattcttcatctacactcattgtagagtatcttgtcttttaaaggttttcccttttatctctatccatattctgtagatgattgaagtcctcatttcttttctacttgtttgtgttacctcagccctaaggctgatccttttacaaatgaattcccgcctgcttcattatttgagagagaggttaaggaagaaaaaggtttggtttactgtttctttagtcagttcagatctatggccctatggtaacatttctcaggctgttttattttggatattggcatcaagggatatgataataggggcttcttgaaattatttttttagggtcaaatttgtttggggagcaatgggttaaatgaaattaaacaagtatctttagagtaaagttatttcagagtctttaatatgctaattcacaatgtgaatcttcaatagggagtctttaataagtagtatttaggctgggcatggtggttcatgcctgtaatcccagcactttgggggacccaggcaggtggatcacctgaggtcaggagttccagaccagcctggccaacatggtgaaacccggtctctactaaaaatatgaaaattggctaggcatggtggtgggcacctgtaatcccagctactcaggaggctgaggcagaggaattgcttgaacccaggaggtggaggttgcagtgagctgagatcgcgtcattgcactccagcctgggagacagagcaagactctgtctcaaaaaaaaaaaaaaaaaagcatttattttctcattggaaacagaatacttttggcttgtatttatacaaaggcaataagaaacctgtatttctaagttggcagtagacgttaaatgaattgatttacttgagagcgtatttgttttaatgtaatttttgttaaaaatttgtttcaggttaggagtcggctttatgtgggtaagttcttttttctgctttgactctcattgttgtgttgtaaaaacttataataatttactcatggtaatattgacttgacttttttaggacgagagaaaaagcttgctctaatgctttctggactaattgaagaaaaaagtaaactacttgaaaaatttagccttgttcaaaaagaggtaagatatttttgaaaataatattcatgttagagtcagagaactttatacttctcactgtaggtacttctgtgtaaatttaagattatgaatgctttgtttgcagagtatgagagttctctttgctcttcatattcaacacttaaccagtcttactaattttaaccattgtagtaggtgtacaatggtgtctccttgtgctttccttttgagttttcctgactgatgaggtcgagcacacaaacacatcctctgcatgtgcacatttctggtatctgttcgtgtatccaaatgttctcttttcgtaaagacaccagtcagattggattagggcccaccctaacaaccttattttattttgaccacctccaaaggccttgtctccaaatacagtcacattctgaggtactggggttggagcttcaacatgtgaatttgtggggacacaattcagtccataatagtctttgatccatttgaaatcagatctgtgatggtgcagttgagggtgtgtgtgtgtgtgtgtgaagattcattttttttcctgggcgtgtcgagttaatgccatttattggaaggaccatcttttctctgttgttctgtagtgtcatcttcttaagtcactgaatatatgtgagtctgtttctgttaaatcttctattttgttgggctttttgtttgttttttgccaataacatgctttttatagcctgtagttttataacaagccttagtatctggtatggttaatttacagttcttggctattgtgaataaagttactgtgaacattcttctacaagttttttttttgtgggcatgtattttcatttctcttcataagtagtagtggaattggtaagtcattagggcattagggcaggtatagtttaactgtgtaagataagaaaccggctgggcacggtggctcatgcttgtaatcccagcactttgggaggctgaggcgggcaaatcacgaggtcaggagatcgagactatcctggctaacatggtgaaaccccgtccctactaaaaatacaaaaaaattagccaagtgtggtggtgggtacctgtagtcccagctactcgggaggctgaggcaggagaatggcgtgaaccaggagacggagcttgcagtgagccgagattgtgccactgcactccagcctgggcaacagagtgagactccttctcaaaacaaacaaacaaacaaacaaacaaaaaaaccctactggctgtttttatcattttttcttggttttggctctcagcagtgttactatgatttgtctaggtgtggtttttttctatttgtccttattggggtttatgatgcttctagaatctgtggcttaatgtcttttattagtttagtttttttttttttttttttttttttgagacagcgtctctctctctctcttgtctaggctgcagtacagtggtgtgatcttggctcacttcaatctccacttcctggactcaggtgatcctcccacctcagcctcctgagtagctgggattacaggcatgcgccaccatgtccagctaattttttaaaatttcttgtagagatggggttttgccatgttgtccaggctggtctcgaactcctgggttcaagcaatcctcccgtcttggcttcccaaagtgctaggattacagctgtgagccaccgtgctctaccttttattagttttgaaacactcttgattgttacttttccacatattgtttttgcccttttttgttctttctttctgggactataaaaatgggtattttaactttttattatatctcatctgtctcttacgttcttttccagggtttccatctttttgtttgcccacacttcagtctagacataatcttctttaacttccatgttgccaatagttttcacttatgcctataatcatcttttaaaccatccattgagatcttaatttcatctcttgcctttttcagttctgcagttttattgtggctctttttgtagttctttttctctggtacaattctattttttaattccatttacacattatgctctcttatttttgttttgttttgttttggtttttttttttttttggagacggagtttcccctgttgcccaggctggagtggagtgcagtagcgcgacctcggctcactgcaacctctgcctcccaggttcaagtgattctcctgcctcagcctcccaagtagctgggactacaggcacacgctgccacgcctggctaattttttgtattttagtagggatgggtttcactgtgttgctcaggctggtctcaaactcctgagctcaggcaatccacctgccttggcctcccaaagtgctaggattacaggtgtgagccaccatgcctggcctatgctctcttattttatttatttatgtgttatttttattttctgattttcagaatatatgctgccgacaaatatgctttcttattttaatgactactgcattatccagtagtctatttctggtgctcattttttctcttgtttctcagtcaagtcttgtccgcttgaatgccaggttattttatatgaagtgtcagtgataatataataaaaattgtaaagataattttgaagctgtgggtgctgtcgtctctcttcagtgaggatttactgttgcttttcataggcagctaggctagggacattggaaatttcagataactttatgtatttgactttcttttatgtaaaataagttttattgtgtatatttaaggtatagaaatttcagataactttgattttgttttttgtaaaataagttttattgtatatatttaaggtataaacatgatgagatacgtgtatagtaaatggttactatagtgaaacaaattaacgtattctttctctctcatagttacccattccctgcccacccctccagggcagctataatgtactcatataacaaaaatcatgaatgcagtacactattattaactatggatctcatgttgtacatgagatcttttaacttgttcatcccatatattttcttttcttttattgagacagggtctcattctgtcacacaggctggggtgcagtggcatgatcttggctcattgcagcctctatctcctgggctcaagtaatcctcccacctcagactcctgagtaactgcggctacaggcacatgatacatgcttgcctgatttttaaattttttgtagagatggggtctccctatgttgccaaggatggtctcaaactccctggctcaggtgatcctctcgcctcagcctcccaaattgttgggattacaggcatgagccaccatacccggccatattttctgacctacatgtttcttccctcctacccaacactgctaaccactgttttgttctctatctctatatatttgacctttacaaaaattccgcatataagtgagatcatgcaatatttttctttctatatctggcttattttacttagcaaaatgtcttctaggtccgtccatgttgtagcaaatggcaggatctccacctttttatggctgagtaatattccattgtaaatatataccacagtttctttattcgtttgttcattgatagatacctaggttgtctccatactggctactgtgaataatgctgcagtgaacatgggcatgcagctgtgtgtagaaggtgccaatttcatttttttcggataaatatctggaagaaggtttgctggatatagtagctctattttaaatttctttaggagtctccatactactttctgtagtgactgtacccatctacatccctgccagtagtgtacagtaagccctcaatgtccttgatagatggttgaaaattgactttaagtgaaacagtgtatactgaattcagtttttttttctcatcaatgttataatgaaacaatgttgaagaaaacaatgttattcaaaggacaaaggacctgctctatgcctttctcttttcttgtctagaaaaagggttcccttttttttgtaacttttaagttcaggggtacaagtgcacatttgttacataggtaaacttgcgtcctgggggtttgttgtagagggttcccttttctccacaccttcacaaatacttgtcatctctcttgtctttttgataatagctattctaacagatacaaggtagtatctcattgtgtttttgatttgcatatccttgatgattggtgatattgaacaccatttcatatacctgttggccatttttatgtcatcttcagagaaatatctatttaagtcctttgcctgtttttaaatcaggttgtatgtttgcttgctgttgagttgtatgaggtcttttaaaatattgaatattaaccccttatctgatatattttttctcaatctgtaggttgcctttttattgtgtttacttgtgtatatttttattttttttaccttgcagcttcacctcaaaggaactttcattttattgtttcttttgctttgcaaaagctttttagtttgatgtagtcctgttcacttactttttgcttttgtagcctaagttgttgatgtgatagtcaataaattattgccaaggccagtgtcagggagctttttccctgtgttttcttctaggagttttgtagtttcaggttttatgtttaggtcttttatccactttgagttgatttctatgtgttgtataaagttaagagttcagtttcattcttttgcgtgtgaaatccagttttctcactaccatttattgatgagactattctttctgcattgtatattcttggtgccctattgaaaatttgaccatatttatttggatttatttctgggctctctattctgttccactggtctgtgtatttgtttttatactagtaccacgttgttttcgtgactacagctttggaatataatttaaaatgagttagtctgatgctgccaactctatttttctcagaattgctttgactatttgggatcttttgctattccatattaaatttagattaaaaaaatttctgtgaagaatgccattgagattttggctgcgtttccatttctttgtgtgctcctcaatttctttcatcaatgttttatacttttcagtgtgcagatctttcacctccttggttgaatttgttcctaggtattttattttttttgatgctatgtaaataggattgttttctttttttttcttttttttattttttttttattgatcattcttgggtgtttctcgcagagggggatttggcagggtcataggacaatagtggagggaaggtcagcagataaacaagtgaacaaaggtctctggttttcctaggcagaggaccctgcggtcttccgcagtgtttgtgtccctgggtacttgagattagggagtggtgatgactcttaacgagcatgctgccttcaagcatctgtttagcaaagcacatcttgcaccgcccttaatccattgttaaccctgagtggacacagcacatgtttcagagagcacagggttgggggtaaggtcatagatcaacagcatcccaaggcagaagaatttttcttagtacagaacaaaatgaagtctcccatgtctacttctttctacacatacacagcaacaatctgatttctctatcttttccccacctttcccccttttctattccacaaaaccgccatcgtcatcctggcccgttctcaatgagctgttgggtacacctcccagacggggtggtggctgggcagaagggctcctcacttcccagaaggggcagccgggcagaggcgcccccccacctcccggacggggcggcggccgggcgggggctgccccccacctccctcccggaaggggcggctggccgggcgggggctgacccccccaccttcctcccggacggggcggctggccgggcgggggctgaccccccacctccctcccggacggggcggctggccgggcgggggctgaccccccacctccctcccggacgggatggctggccgggcgggggctgaccccccgacctccctcccggacggggcggctggccgggcgggggctgccccccacctccctcccggatggggtggctggccgggctggggctgaccccccacctccctcccggtcggggtggctgccgggcggagacgctcctcacttcccagacggggcagctgccgggcggaggggctcctcacttctcagacggggcggctgccgggcggaggggctcctcacttctcagatggggcggccgggcagagacgctcctcacctcccagacggggtcgcggccgggcagaggtgctccccacatctcagacgatgggcggccgggcagagatgctcctcacttcctagacgggatggcggccgggaagaggcgctcctcacttcccagactgggcagccgggcagaggggctcctcacatcctagacgatgggcggccaggcagagacgctcttcacttcccagacggggtggcggctgggcagaggctgcaatctcagcactttgggaggccaaggcaggtggctgggaggtggaggttgtagctagccgagatcacaccactgcactccagcctgggcaacgttgagcactgagtgaacgagactccatctgcaatcccggcacctcgggaggccgaggctggcagatcactcttggttaggagctggagaccagcccggccaacacagtgaaaccccgtctccaccagaaaaatatgaaaaccagtcaggtgtggtggcgcgcgcctgcaattgcaggcactcggcaggctgaggcaggagaatcaggcagggaggttgcagtgagcggagatggcagcagtacagtccagctttggctcggcatcagagggagactgtggagaggggagaggggagagggagagggagattgttttctagatttcgtttttggctaggtcgttatttgtgtatagaaatgacatagttttgttttgatattatatcctgcatctttactgaattcagttattatatctgtatttttgatgacatcttttgggttttctacatataggatcatgtcatctgcgaacagataattttacttctctgatttggatatcttttctttccttatccttctcttccttccttcttactttttttttttttttgagacaggctctcactctgttgcccaggctggattgcagcagtgcaatctcagctcactgcaacctctgcctcccgggttcaagtgattctcccacctcagcctcccaaattgctgggattacagatgtgcactactgtgcctggctatttttctgtgtgtgtgtgtgtgtgtgtgtgtgtgtgtgtattttttggtagagacagggtttcaccatgttggacaggctggtctcgaacttctgacctcaagtgatctgcccaccttggcctcccaaagtgctggcattacaggcgtgagctaccatgccaggccttttatttctttttcttgtctaattgctttgatagtacttccagtactattttgtttttgttttttgagacaaggtctcactctgttgcccaggctggagtgcagtggcatggtcatggctcactgcagcctcagcctcccgggttcaggtgtttctcccaccttagcctcccaagtagctgggactacaggcgtgcaccaccacgcccagttaattttttgtattttttttgtagagatggtgtttggccaagttgcccaagctggtctcgaacttgggctcaagtgatccgcttatctcagcctcccaaagtgctgggattacaggtgtgagccaccgcacccagcccttccagtactgttttgaatagaagtggtggttgtgggcatccttgctttgtaccagatcttaatggaaaaggtttcagtttctccccactgatgatgatatttgctgtaagtttttcataaatggcttttgttatgttgaggaactttctttttattttttttcattattttaaaaattttattatttattatttatttatttttttgagatgaagtcttgctctttcactaggctggaatgcagtggcgtgatctcggctcactgcaactctgcctcctgggttcaagcaattctcctgcgtcagcctcctgagtagctgggactacagtcatgcgccaccatggctggctaattttttgtattttggtagagacggggtttcaccatgttggccaggatggtcttgatctcctgacctcatgatctgcccgcctcggcctcccaaagtgctgggattacaggcatgagccactatttagttttttgagacaaggtctcgctttgttgcccaggatggagtgcagtggcatgctcatggctcactgcagcctcaacctcctggggtcatgtgattctcccaccttagcctccctagagtagctgggactacaggtgtgtgccaccaagcctggctaatttgtctatctttggtagagatgtggttttgccatgttgcacaggctggtctcgaactcctcggacttcccaaagtgttgggattacaggcgtgagccaccacacctggccagaactttacttctatacttaaactgttaagggtttttatcaagagatgatgttgggctggacgtgagggtgtgtgcctatagtcccacctacttgggagcatgaggtgggaggatggcttgagcccaggaattcaagtccaacctgggcaacataggagaacctatctctcaaaagaaaaaaaaaatggatgttcaactttgttgaatgttttttctgtgtcaattggtatgatcatgtggtttttgtctttcagtctgtgaatgtgatgtatcacattaattgatttgagcgtgtatatattatacatatatatatatatatatatatatatatatatatatatatatatttttttttttttttttgagacggagtctggcgctgtcacccgggctggagtggaatggtgtgatctcagcacactgcaacctccgcctcccgggttcaagcgattctcctgcctcagccacctgagtatctaggactacaggtgcctggctaatttttgtatttttagtagagtcagggtttcaccatgttggctaggatggtctggaactcctgaccctgtgatctgtccgcctcggcctcccaaagtgctgggattacatgcgtgagccactgtgccggccaatttgcatatattaaaccggctttgcatgccagggataaataccacttgatcccaatgcataatctttttgatgcattgttaatttcaatttgctgatattttatttaggatttttgcatcagtgttcatcagagatattgacctgtaggtttgtttgtttgtttatttatttattttttgtggtttcttggtctggcttaggtatcaaggtgatgctggactcataaaatgtgttaggaaatattccctcctgttgtttttcttggaagagtttaagaagtcttggtaataattctactttgaaaatttggtaaaattcagccgtgaagccatctcttcctgggcttttctttgttgggaggtcagattactttaataacagattgagatatttggaagctgggcctcagttcagaggattagtctgtttttggtttcgactttgttgtaaggtaggcaggttttctttttttttttttgagacagtcttgctatgtcactcaggctggagtgcatgatctcgactcactgcaacttccgcctcatgggctcaagtgattcttgtgcctcagcctctcgaatagctgggattacgagtacacgtcaccacgctcggctaatttttgtatttttagtagagacagagtttcaccatgttggctaggctgttcttgaactcctgacctcatgatccctgtgatctggcctcctaaagtgctaggattacaggtgtgagccactgcgcccatccaaggtaccagttttggttggtaaggacattaatttccttttgctgctgtaacaaattagtgcaacctagtggtgtaaaacaacacacatttattctcttaaaattttgaaggtcagaagtctagaactgatcttttaaaaaatattttgttgtagagatgggatctcactatgttgcccaggctggccttgaactcttggcctcaagtgatcctcccacgttggcctcccaaaatgctgggattacagacatgagctaccatgcccagccttaaaaccaatcttgggggcaaaagttaagatagcagcaagtttgtttccttatgcatgttctaggagagaatctgtgtcttgtgtcttatatggagtctaccaacatttcttggctcataactatgtcaccccagtttctgcttctatcttatatcattcttttctaagtttggtcgtcttgcctcctccttttaaggacccttggcattatattgggcccaccaaaataattctggatgctttttccgtcttaagatcctttatcacacctggacattctggggagcagaacatagacatctttggacaggtcattgtttagccaagcacagggttcatctgacttggcaggtcctgaactccaagtgttttttctcagcttctgattctcctgaaatctctgcttagtttcttagcccatcagcctcttcttctagggggaatagaaatgtcaaatactagacttgcctttctggggattcccacttctctcacaaattctcactgttttgatagctctctgaggctttcagacagatatatatttttttttttggtattttttgtcaagcttttcttgttcttgccagaaaggtggatccagaacaacgtagtcttcaatttgatcactttttttgaataattgaagtgcattttgccaaatcttatagcattatatgttttattgttcattttttgatggttgttccctaccttttaaagatttttatattccccacctgctttatttgttgtatggtatggattaaaagtgaaaagttttgatggtcagttgctatatatttctctttaatgaataggcttaaagaagaggtttacttgtttggggcataattagacagcttacgtaaaaatacgctctttgagtaaatctttggataatctttagtacaatcttaccattagaatttttacttcatttttagtaaaagatgctaatatgagttatagtcctatgttctctgagaagcagactttactcttagaggtgaagttctggcatttgttgccagagctagtggtttgtgatgtgttagctgctctggcattgtttgttgtagtggtcagatttaaaaaacttaaagctaagtaaatccaagtaaatttaatgtattatgtggaaatggattctgtctgcttcttaggcatctatccagataagatttagaatacaattggtagagtttttacttgtgatgttgctttgtttcagtatgaaggctatgaagtagagtcatctttaaaggatgccagctttgagaaggaggcaacagaagcacaaagtttggaggtagaaaatcaaatggtataattttaaaagctggggaaaaaaatactaagtaacaaaaactttaaaaatgtatcttctgaaaactatttgaaaaaaatgtgaaagagcatctctggatgttaaaacttaaataagaaaattaatataggaaatgggacaataggaggtagcataaaatattataaaaatttaaaaatttgagcttttattgctaacttgttttgagtcaggcatgtttatgttcaaggaatcaggagctgtatagaaacttcgttctattattcctgggaaatgtattaaggtgatcgttccttttttgactcagtttgctctagaaaggagaaataagattcatttttacaaacttaggaatagttggcaacaataactttgtaaattatgacagtatttgctttattttcatcctgaggatattaagagctaactagaattaggccagaggtttacgttataagtaatggtgtatgttggtaaatgtttgacaactttttttttaaaaagcagccttatttgtagcatttgctgagttctgtagtatgaatacttccaccatggccagtttcaagctaccaacatgatgtcactgaatgaggagtcttggaagataatgcttaaagtaggctttcctgagccaagtgtgatttggttaattttaaggaaggaaagtatggtaatttgtaatttagctaaactaagacagattagggtaagtgatgggagtgccttactactgtttagatgtggacgtgttgtaaaaagcacagaagtgacaaaggatagcagaggacacctgcgtctgcagatactaaaacagaaaacagtagaccttgtacctttgataagcgtctagtacagtgtggcagttctcaatcactgctctccgtaatcatcagaaactctatgtgttatgattcagaattttctagtagagtccaaaggaagttataaattggattccaaataagtttcttaatgttttcttcatttgttgcctattactatcttcaagaacttgttgaaattatattttatttgctaaccctctgtcttaactacccttccattagtaatttatgtttgataaaaaaattttagaaggcatttgacatgctaacagaagagcaaaaagtaggtagcaaagacatttactcaagcttggtaatactgaggataaaatattacacatcaatttattttcaaggtaatgaattattataggagtaaaattagctgaatttttagctgcattcaacattttggaaatttttcttcaatttcagtaattttttagcatagtattttcagtaatagtaatcataattgaattcaaactataatgtgatgcaatttaaaaaaatatgatagctgaatctgtagataaaatcaaaccagtagagtaattttcattcgggtcagggaattcctagaatgaaatattcaaatttggggtaatatgtataaacaagtttttaaatcactgtaatgtagtatgtattttttttgcttttattttggcctgcattaaaatctttgaatcttttggtttatttttctttaacaagtttgttgaaggatcacaaatatcagaggtatgtttattatagtatttaaaatccatttggaataatccaataactaatcattttaaattaaaaaggtcatagaaaataggtcttaattcaatatggaatattatcatgaagcagccttgatttttttttagttgattttttatgtcatgcctttaattgtattaaattggctttatttctcatttttttctttatagtgcttttaagcagaggttggcaaactgtgcctaatgggctctccacttttttttgtaaaaaattgttttggaacacagccatgctcatttatgtaggtattgcttttgtttctcactgcagtggcatagttgagtaattgcaacaaagactgcatggcctacgagcctaaaatatttattctctggctctttacagaactttgctgaccactgctacaattgctgttattttgatattataaaaatgagcaaatgtataaatgaaagttatttaacttatagtacatattttttattatgctcgtctgatttccctaatgaaaaattcttatatctgtttaataaagttggctttctctcttaggcaacctgtgaaaagctgaacaggtccaattctgaacttgaggatgaaatactctgtctagaaaaagagttaaaagaagagaaatccaaacattctgaacaagatgaattggtaaggcttttttatttgaggagaatataagaaaaagaaagttactgagctttaaaaaattaatatgatactggttaaagtattacattattgtaaaaaatgtaaagaatacaggtggttgtagagagcaaaattttctagatccattcttttcacttcccccagatgttactgtgttaaatttcttgcatatttttatagaaattttctatatgcactatggaagtagctcatgtaaataaaaactgaataatcatgtccatagtgtatatttgtaattacttaacatgtatattaacattaaaactttttcttttgaaaaaacctgtcttaatgaaaatcttgatgtatgtgagattatttagtaaaacatgttagtggacttatcttgagcctatataacttaaatgttatgaaatattaaagttatgagatactattgttacgtaatgttcatataaaatcccttttagcatatggctaaataaactgagaaggtttcttaatttgagcttcacttatggagctaaagtgttaggttaacagtatatctaataaacatggcattttggaaactagagtttagtaaatattaattgcctgatactgtgtttctagatggcggatatttcaaaaaggatacagtctctagaagatgagtcaaaatccctcaaatcacaagtagctgaagtaagttgaattagtctagtaggtctgttgcttttggaaataattttagtttaattttttaaaattaagaaataagacacaatagtaggatttgagatataggggatcccagatatgtatttttttttttttaacaatacctaaatgaattagcatggctgtgttgcccaggctggagtatagcagcacgatcttggctcactgcaacctccacctcctgggttcaagcagttctcctgccttagcctcctgaatagctgggattacaggcatgtgccaccacacccggctaagttttgtatttttagtagaggcagggtttcaccatgatggccaggctggtcttgaactcctgagctcaagtgatcggcccacctcggcctcccaaagtgctgggattacaggcatgagccaccacacccagcttgtattttttttttttttacgtgaagtgcttcagaaaagttcatcttttcagtggacaagtgtttattgagctattactatatattgaggactggttgcttgacacttaacattaatagacaaaaaagtccccaggaagtttaaattttagtaggggaggcagaataaatagttatcaaaatttgctgcacagtacatagaaagttacaagaggtttgtccaaggtcacatcgtagcaagttagtgggaaaggcaggactagacctggattctagacaagccttttttctgctacaccatgctgcctctgctgttaatattggcatggttttgcctttgtttaattctgtgttctagggagtatgtgtaaagatgagctatgtattaaattaattgttacaaacttgacattttttgtttcacttaggccaaaatgaccttcaagatatttcaaatgaatgaagaacgactgaagatagcaataaaagatgctttgaatgaaaattctcaacttcaggaaagccagaaacaggtttgtgctccgtagggactcttcaacttgtgaatatgtaattatagatgttcttgtcatcctcatgactgacccatgctagggacaagtataggcttttccttgagagcatgagagcaggacagtctcccatacatatttcagtgtctgtctcttttgtatagtatacaaaagtgtatacttttggcaccctctaccccagggcagggaaagtaagccagggcatttagcattttggtaatcataaccaacttcttaaagccatgccgaaggggtacagagaatatgagtgaggattattgaagttatagatctggggtctaaagatagaaacaattctggtggcagatcacataaggatgtgacatttgccctctttctcccccacatacatagatactcccacgtatatttcttcttctcctttgccaatgtaattgtaacttttcagtgggaaaatttttcagtgattaaattattataattatccaaatattactcacaccagagccacatggtttgttcttttttttttattttttaattttttagacggagtctcactctgttgccaggctggagtgcagtggcgtgatctcggctcactgcgacctctgcctcccaggttcaagcaatttttctgcctcagcctcccgagtagctgggactacaggcgcgcgcctccacgcccagctaatttttgtatttttagtagagatagggtttcaccatattggccaggatggtctcaatctcttgacctcgtgatccgcctgcctcggcctcctaaagtgttgggattacaggcgtgagccactgcacctggcctcatggtttgttattacatattctgtcttattcaatattttccttagggttaataattgttttgtttcttgtatacttatccggttcatctgtatgctgtcttctagagatacagatatcttattcatgccttcaaatgctttgtttaatctgttaattgcattttttttttcttgaagcagttttttctttggcctcccttggtttcataagaacttattctgtaggtgtgtgttctgttctgtgtcctaagatttcacttcacccccatcctaaaggttcctcttgtctttctcctgtgttagatcttttattttccatatctgagcccttttgcggttaattcttttggttaattttctgaggaagaggtataggagataatttttttagaacttacatgcctggaaatgtcttgtttctcatacttgttgatattttggttgaatatattctgggttggcattttttttttcctcaaaattttgacactgtcactccattgtcttgactttccaatattgcttttaagaagtcagaagctattcagataattggtcatttttggaaatctgcttttttcctcctggaagcttttaatatctttttattgtttccccttctctgaaattacagatcattacacatctcttgacctcgtgatccacccgcctcggcctcccaaagtgctaggattacaggtgtgagccaccgcgcctggccacgggcggggttttcttttcttttctttttttttttttttaatttttatttttattattttttttttattatactctaagttttagggtacatgtgcacattgtgcaggttagttacatatgtatacatgtgccatgctggtgcgctgcacccactaatgtgtcatctagcattaggtatatcttttctttttgttgttttttttttgtttttgagatggagtcttgccttgttgatcaggctggagttcaatggcctgatcttggctcactgcaacctccacctcccgcgttcaagtgattctcgtgcctcagcctcccgagtagctgggattataggtgtctgccaccacgcccggctaattttttgtatttttaatagagacggagtttcaccatgttggccaggctggtcttgaactcctgacctgaggtgatccactcacctcggcctcccaaagtgctgagattacaagcgcgagccaccacgcccggctattggtgggcttttctataggatatatattttttttgtgacagagtctcactttgtcacccagtctggagttcatggcgctatctcagctcactataacctctgctgcccgggttcaagtgattctcctgcctcagcctcccgagtagctgggattgcaggcatgtaccaccatctgactaatttttatgtttttagtagagatggggtttcatcatgttggccaggttggtcttgaactcttgacctcaagtgatctgcttgcctcggcctcccaaagtgctgggattacacgcatgagccaccacgcctggccaggttagggtatttctaattggaggattctcagttgttggtatctgaagagcatttccacagggatgagtcctccacatttcccatttgggaggtgtaagcctgtttgccaacagtcttgcaacttaggtaaagaatgctggtgtctgactgttcagtagtcagtttcctcttaatacttttatgttttcagtatgttacttccaccttcacctggatagatgtcccagagtctcaggttccacctctccaaagaatgaccctgtagggttttgcgtgtgtgtgtgtgtgtgtgtgtgtgtgtgtgtttgtgtgtgtgaaagagacagagatagagaatgaatgagagagaatgagaataagaatgtgtatatatttatgtcatgggaggctttccaactgctttttatacagacttttggccagtcctccttttttccagtcctgcttatacccctggtatttgtgccttcaaatcatgaggctttctagggtatatcaaatcagcctacttttgggtgttcctaccttcaggcttagatttaagttctctctagttggttgagtctttttatcacacttccatttctttccattttctacttctacaattattttttgtctcatctcctattttcttttttccttgtgggtttatgcctttgaaaaaaaaatctgttttctgccattttaatagatttgagtagaaagtggtggtaaaccctgtgttaaatttgccatgttatgatcaaaagtggccttttccaccttggaaaatatttcacctagatcagtcttactctttacaactgttttcatctaactcccttgtaataatccaaattcttgaaacaaactgtattcactgatgccatgttctaatgcactccttctctaatgttttaatactgtatactgtgtacttaagtctctttactaactcatgagagatgacctaatcaccaaatgtgaattttttcttggattctcatttgtttttacctgtatcatctgattctgttttatatatatatatatatatatatatatataaagattagtttttcatgtgttcggaatacgctaatgaagccttagttttgcggagaaatccaataattactgtttggtagaacagagttttttttttttttttttttttttgtgagcaacatggctgtttatttcacctgggtgcgcaggcgggctgagtccgaaaagagtcagccagaacagagttttaaagactaaataaatttagactttttcatatatatgagccatttcttttgtgaattgcctgctcagtcttcttttttctttgcctattttttcttattgacatctaagagctctttgcttgctaaggttattaaccttttgctacaaatattatgagaattcctttcttggtggggtgcagtgggtaacacctgtaatctcagtgatttggaaggtccaggtgggaggatcacttgaggccaggagttcaagatcagtctgggcgacatagtaagaccttgactctacaaaaaataaaaataaaaaaattagcagagtatgtgacatgtgcttgtagtctagttgcttgggagggtgaggtgagagaatatcttgagcccagtagtttgagattgtggtccagcttggatgacagaatgagaccctccctgcctctaaaaaaaaaaaaaaaaaaaaaaaaaaaaagaaataattcctttctagttatttatctttaaatgtcatttgtgttatatttgatttgtgaagcttttaagctttatgtagtcaagtctaccttttataatgatctttactttttgtcatgttcagaaaggctttcctttcctgtaaaagtatatatagtagaatactgttgtggagaatctgatctgttctagattaatggtatttctttttttttttttttttttttgagacggagtctcgctctgttgccaggctggagtgcagtggtgcaatcttggctcactgcaacctctgcctcctgggttcaagcgattctcctgcctcaacttcctgagtagctgggactacaggcgcgtgccaccatgccaagctaatttttgtgttttagtagagacgaggtttcaccatgttggccaggatggtggtatttctaaaggttagttattttaagtacaaaattgcacaatgatttaaaaaataaattttaatgcaagtaaggtatgatattttatatgggatataaggaatggtaagaaatgatcaaatctaagatatgtatatctcaggaaacctttatttgatataaatatatgatataaactagttgaagaatgtgtgtgttattttacactaccccattttgaaagttctttgaaaataggagccatgtttttcttttttaagtagctacataatgccttcttggtatcttttaatgattcacttgtgtgatgagttgcatttttaaaattttcattttcagcttttgcaagaagctgaagtatggaaagaacaagtgagtgaacttaataaacagaaagtaacatttgaagactccaaagtacatgcagaacaagttctaaatgataaagaaagtcacatcaaggtaaatggctctactggttttagtgatcaagttggctagaattttacactaactctgaaatttgaaagctagtttttagcaacttttattttcacaacatattttcataacatatttggccagattttcaaatgtttcttgaagacttacagatttgtcatatgtacatacacatacacacacacatacttatatgaatattctgtgtgtccttttttcttctctgtattttagcctaggtatttaataaagaaataaaaataatggtttctaccatttctcttcaggatgctatctgctcctgttaggaggttggaagagtttgagaaattggatgtatagttatatatattaattgaatatctttaatgtaactggtgtatgtactttgatggagaggaatacttttaaaaaataaatttaattgaaacttgactccagtcataagaataaaaggattttttgattttttagatttttaagatttttaaaaatcttaatgctgataaatacagatactcaagtgtatcaaataatgatatgtaaaactaacgttctataatttacacagtgatgtggatgttgtcatattgaaagtgatgctctcactcataggtgggagttgaacaatgaggacacttggacacaggaagaggaacatcacacaccgggacctgttgtggggtggggggaggggggagggatagcattaggagatatacctaatgtaaatgacgagttaatgggtacagcacaccaacatggcacaggtatacatatgtaacaaacctgcacattgtgcacgtgtatcccagaacttaaaatataataaaaaatagtataaagaaagtgatacatttatgccagttatgttgctactaagaatattttcaaaattccagctttctgagttttattcagaatttggcatatatatatatacacacacatatatacatatatacacatacatatacacatatatacacatatatacatatatacacatatatacatatatacacatatatacacacatatatacatatacatacacacacacacacacacacacacacacacacacacacgagatggactttcaatcttgtcacctaggctggagtgcaatggcaccatctcggctcattgcaacctctgcctcgtgggttcaagtgattctgctgcctcagcctcctgagtagctgggactacaggcatgtgccactatgcctggctaattttttttgtatttttagtaaagacgcggtttcaccattttggccaggctagtcttggaactcctgacctcaggtgatccgcccaccttagcctcccaaagttttgggattacaggcgtgagccaccgcatctggctgtggcatattgttttatttattttttctaaacttcctctactaaaggctttgggattcttttaaagataacaagaatgagatgctaacctcaagctctgctcaaaggtataggccatgttatttgtgcctggaactctgaagagagggaggagatcgaagggtgaaaattgtagatcagtgcattatttttaggtgggtccctccagaggaatacatgacacgtcatttgattatctgtagtgttagaaaatatttctttaatcaacaaaattcaaaaagtacttttggaaaacctctaatgttccattcaaattctcttttataaatgtctttatctcagctaattgtttccttgaataaatcaactaaaaatctacgatctttttatacattatgtatctcactgcagatgtgtttggtgtcacacagaatttactctcatgttaattagggcactgttatttgtggcatgtgagaaatgtcatataaaaaatattttactactttttagttgcataatattaatatgtactatatttgatttgggaataactagttttggcttttacttgcagagtttaatagtcaataaatgttaccatttctcaagactacaatatcttaataagaggtggaaaataagagctcttgtgttgttatttatgtggactgatttttaaactataactgtacattcacaagttgtaaagctgttagcataaggcattaccctctctatttttcccctttgttcaatgtcaagactctgactgaacgcttgttaaagatgaaagattgggctgctatgcttggagaagacataacggatgatgataacttggaattagaaatgaacagtgaatcggaaaatggtgcttacttaggtattaagtcatgactcatctccttttgctaaaatggtgactagctcttctatttccttttcgttccctgtgtgcaccatgttctttatatgcttttactttggcacattctgtctgtctgtgacacactgtcctttctcaccatcccttatagtttttagcttcagctggagcactgccttttcagtaagtctttctccagctgctcagacacacttacagcctcctcccttttttttgtgtattatacatatctttattatagccattttcaaaattacatcataatcatttcaatgcctgtttttccctgtactgtaagctaatcaaatggatgaatgactagtttgaagaacaagtgttctataaatacttcaggatacttcttttgcttttgtcagaggttcagatggttacagtacttttaatgttagccattcaaattattattgccattgatggttgtgctctgaagttggcaaaagtggccaaatttagtttcactatagccccttaatgtattctcacaccaattcctttgacctaaaaaaaacctttttattttgaaatatggcatcataggaagttctaaaactagtacagaggtcccatgtacccctctctcattttaccccagtggcagttcttcagacttttatgtcatttttctgttctcttccccagcccctgcataattaacaaatttattatggaggaaaaagtgtgattaaaaatttttttcgtgacaacattaatatgttggaaaaaattacatccctaaaataagtatataaagttctgtttgtactttttcatttctactttattatatataaaataatcctttctctatttgagaaaactcatgcttgtttaatgttattttaacttgggttataattttactcatattttggatgctgtaagaatccaagaatagttaatgattgtggtctatatttagatgaatatagaatccttgttataactctgttcttggagttagagctgaagaaccttgttaaatggtatgacacttcagtgcttttattgtttagcttcctgggagcaggtccaaggccattctgctttataccaaattctttattgtagcaagaagagggattataagtttctggtttagtgaactgataaaatcattttgatgtctattgtcgtattgtactattttcccaaatcattgttgtgcttttgattttcactgtagataatcctccaaaaggagctttgaagaaactgattcatgctgctaaggtttgtgctattagatacttaaaaagaataaggaggaagaaagagaacgtggattactcatgtcccagtaaatgtttaaaaagtccattttattgttcccatataaatatatttacaaattatcagaattttcatcatcaattgctttttcctttcaattattaactttagaaatttatataatttttggaatttatcaaaataaaaaattccaagttctgtactcatttttcggataagactatatttaaaatgtttcctgtattttatcttgtagttccctcagtgcattctttttcttctagtctcagtattttcttaccccttctgccctatatcctattttaagtaaatactagatgcctttttttctggtttattccttctcttttccaccctagtagtgtggtatcctcatttttgctgatctatgtgaagtcttggtaatgtagtttgaaggctgctttaataaaaacttttgttgaaagtaaatagaatgaaaatagtcactttcttaagcagccagtgaaaagcattcactacttttccctgtcccttgttctgagacttacaagcattgacgactttgctggtttttttaagacggaagctgcattatggtttctgtattccaggtgataatttcatcaaaacgataaaatcacttaaaaagtgttaggggggtcatactgaggttttattttttatttttatttttttgtataactgattaatgttacttttttccttcttcccttctttaaagttaaatgcttctttaaaaaccttagaaggagaaagaaaccaaatttatattcagttgtctgaagttgataaaacaaaggaagagcttacaggtaggtcattgacatacatacttttaatgtttttctaagtaagtacatctcttggcagagaatggtaaaaatgaattgaattaactttgggaagatccaattttatttttttttaacttttgttcctgttgggtatttgtgaaacattagtcctggtttttgttgtcattgttgctaaaggcatatcgatttcctctgtatttatgtgaagttaaaataaggaaattttttaaaaaacatgtaaaaccgtatttatcttcgaattacagtgttatgtgtttgaatggttttagatgttaaaaagtagcaaattgaaacttaatgtttaaagtctttgttaattgaaaaattgatcttcaatagtggtactatttgcagtatgattcgttcctttaatgtacatacgtagtatattagtacatacgagagtgatgttagacctgtagaaatgaaggtgttgttttaattgaaaacatttatgtttattttgctgatagtgtttgtattttcaaaaagtaaacaagttctgtcaatatgtttgaaaatttttaaagttgagataaatagcatctcattttgtaaaaataaaaaatataaagatttaccatatgcgtttgcatcagaaaagactggaaggacatactcaaatgtcaacaatgattatctctgaatatgggattatgggcagatttttatattctttttacttatctgtattttcaaaaacttctacagtaagtgaactgcatttataatactgttttaaaagattgaaccaccaaagatagaggttattaaaaaattatatccctactcacatgattatagtaattggattatttttggatttcaagaaacattagtattagtttaagagaatgttgctatatgtaaagcattgtactaaaaactatgggagatatacagaaggaaaagatagcttactttcaaggaagctgtatttcaaaaaatgtgtgtagaaagtgccagagtggcaaggaaatttgctcaccagttatcccactccttaatacagtttcctggcaaatctttgtttctttcttagactaatacttggagacctatgtctccttgtactcttctttcaaatctaactttgtttttttaatggatcatgaaagataaatttctgtaattgatgttttattcatagcatgaagattttcctctaaactgtttcttccttttctggtaatcatttacagtggtctttatgttacaatttgaaacacagtagaagtacaaaaatatggccaggcgcggcggctcacgcctataatcccagcactttgggaggccaacgtgggtggatcacttgagctggggagttcaagaccagcttggtcaacatggtgaaaccctgtctctactaaaaatacgaaaattagtcgggcgtggtggcacatgcctgtaatcccagctgcttgggaggctgaggcacgagaatcgcttgaacatgggaggtggaggttgcagtgagccaaggttgcaccactgcactccagcctaggcaaccaagcgagactttgtctcaaaaaaaaaaaaaaaagtacataaatatattaaataattaagtgttgggttgtagttttcttgtttgttttacaatagggatgattaaattttaatagagataatacccaacgttaatttctttacgtgattgttcttggcaatggcttaaagcctaggtcaatgaatttttttttttctgatgtagattaaaaaatttctgtggaaagatagttacgtacaatttcctatacatttaatcatttaatgtttaggtatttatgtaaactgttcttttggtttgtatgtttaatgggttatattagtccgttctcacattgctgtaaagaactacctgaaactgagaagtttgtaaagaaaagaggtttaactggctcatggttttgcaggctgtacaggcttctgcttctggggaggtgtcaggaaattaacagtcatggtggaaggtgaaggggtagcttccttacatggtgggagcaggaggaagagagtgaagggggaggtgttacacactttaaaacaaccagatctcatgagaactctatcatctagggggagacagcgctaggaggatggtgataaaccattagaaaccacccccttggtccaatcacctcccatctggccccacctctaacattgggaattacaattcaacatgaaagttggatggggacacaaagccaaaccatatcatgagggttttagaataattaaataccattacatgtaattactaaaattttcatgcttgttaatactgtttccaaaacttccctctttaggcagagtgagttttgtcttttaagatttgtggtggtgattcatatacacgttacaggagatgatgccttccttcatcttagaggagttgaggttattatcttgataccttaatgttagagttgttcagagttggtacttcaattttagaggcgctcagagttgaggtaattatgttagaagagaaacgaggtttttaaaaaaattgatgcataaattataaagcattcataattatttagaatgattcatttttattttatagatttttttaaagatggcttagcggttgaaacaacgcttaaagttggtatttttctctctggtcttgatctgttttaaactaggagtatgtttgggcatttgttatgagaagatctagatttctggcttgacttatatgtcaaaattttagcttaaaagggagggctaggtagaatttaagtattattaagagagaaagtttttactagataaaaacaggcattattcatcacctggaaatagttttacggggaatgttgaactacaatatctccctttaaaactcttatctccaaaaccttcctgagaactttagtggcgtttagctctaaaattgaaaattagatgctagaattagaatgttgaaggtgttgggaatcctataaataataacaaaagttaaaagaattttttttttttttttttttttttttttggagacagggtctccctttgtcatccaggctggagtgcagtggcgtgatcttggctcactgcacgctctgcctcctaggttcaagcaattctccttcctcagcctcccaagtagctgggattgcaggcacgccccagcacgcctgactaatttttgtattttaagtagagatggttttgccatgttggccaggctggtcttgaactcctggcctcaagtgatccacccccttcggccttccaaagtgctgagatgtacaggcgtgagccaccgtgcccggccaaaattaaaacaatttatatagctccttaattcagatattaatgcactcaatggagcactattcagccatcaaaaaataatgggatcctgttttgtggcaacatgagtgagcctattttaagtgaaataagccacacgagaaagagaaatggctcatgttctcacttatatatgggagctaaaaaagttgatctcatacaagtaaagagtggaatagtaatagtaatatgagggtgggaagtatagagggtagggggttagggagaggttagttagcagatacaaaattataactagataggtggaacaatttctaatgttctatagcactgtagagtggttagttaagttgctgtatatttatatttctttttcttagatctactttatttgtcatattgttatttttgaatagctagaagagaggattttgaatgttcataacataaagaaatgacaaatgttagaggcgatggttatgctaattaccctgataggattattacacatcgaatacctatattgaaatatcacactgtaccacataaatatgtacaatttttatgtgtcaatcaactaataacaataaaagcatttaggtaaacagaatcccttatagattttctgttattggaaagagtttagtttattaataatttattatttttagtaatttttatctttctgaaatgttaatatgcaactcaaaatgtttctcctttaattatgacttaaaatttttatatagagcatattaaaaatcttcagactgaacaagcatctttgcagtcagaaaacacacattttgaaaatgagaatcagaagcttcaacagaaacttaaagtaatgactgaattatatcaagaaaatgaaatgaaactccacaggtaataaaaattatgttaactccattgaacagcaagtaaaatagctttagagatatatgttacatagttagctatagtgattattgaaagttctcaatttatgattagattgtatttcatcaacttatttttaagaaaggtatttgatctggagacactttttttcaacaaagaaaatattgtaagtgatgttggaatttccaagctagttaacagaatcctctttagctcctagtaagtagtcagcaacttattgccttaaacttcctaatactggcagggaatctgaatggacactcttgattaaactgcccattaattccatctctgatatatgtaaaactgatttttctgttctgtgcaaattgcttctgcccaggtgttccttggcttagtaaatggcagtgtcctttacttagttacttagggtggcacctcaagctgtttttgacttctctcttgcttttatatctcctatttattctgtcattaaatcctgtcagcttttttatagcctgaatctgaccactttttaccatcttccatattagtctagtccaagtcatcaacagttaatacccggcttattatagtagccttatgggtagtctccttctttccgccctttctcctgcactgtgttttctctgcaacatgcaggatgacccttaaaatgtgaattgtgagtatggtcactctcgtgctcaaaatccctgagtgcctttatatcacactcaacccacagcttttatatcttggcctacaagacagtacaggattggacccttggccacctctttaattttagcttattcatgttctttttcctctcagtaccctccatccagcactggcctttttgatgctcttcagcacattgaccttagggtcttttgtgcttgttccttctgcctggaatgatgtttccttatatatttgaatggctcagttcttcattttattaggcctgggttcaaatgttacctcaaagaatccttccctggctactctaactaaaataatacctgctactctttattcccttattttgcctcatggctcttattgtcctctgattgattgcttttctttcttttatcttccttatgttaaatacaagctctgagagaaaattattttcttcacttctgtattcccagtgcctaaagctacatgagacgtgtggtaactgttcagtacatgtttgttgaatatatgtacaaatatgttcagtgcctttatatattggagtgaaggagtgtgtgtgtgtacatgctgttgcctaaatgcctaagtacactgaagacccttgagatatctgaagactctagattttcaaatagtgccatggcatgtatttttttttttttttatcataaagggtaataaaatgtaacagactttcaggttcctttaggctcttaatgatagttattacagttgttccttattatttatagaatctgtatttgtgaattgacttactagctaaaatttatttgtaaatcagatcagtacatgcaaagcttttgtagccattcatggacatattcagaatgatgaaaaatttgagttgcccaatgtgcatgttcccagctgaggtcaaacaaggtgacactctgctttcttgtttcagctctcattctgtaaacaggtgtcctttttacagtatatttagtgcctcattttttacatttttatgctttttgctggtgatttagctgtttaaaatgccccctaagcatagtgctgaactgctatgtagtgtttttaagcacaagaatgctgtgatatgtgttatggagaaaatacatgtgttagataaactttgtttaggcatgaattacagtgcttttggctgtgagttcaatgtcaataaattaacaatatatattaaagaaagtatctttaaacagaagcacacaaaaaaacaaggttatatattgattggttgataaaattgttgtgaccagaggctgtagcaggaagctaaccctgtattacccttaggagcagtgatctagtatttgctaatttacgatgtatagtgactttatggaacaaaactagcacaaataatgagaatctactttatctatttggaaactggtagagagtactaatgcttctttgagatcaggatgctgggtagtgcttggctcattcactgccaagttctgtacttcagtcatgatttggattcagttcacagttaaaaagctgttatttgttatggccctttggccctttgggactgctcagggtatgcaagagactaaacgtgacaaaatggaagaattacagtataacttcagggtttttcagccagtatacctaggagtgggcccttctttttaggttagaatgaaaggtattaaagtaaaacttggatataaaagtgattgaggtgaaagaaatatttttgagtgtatcttttgaataaaaaaagtatatggttgattatagaattttgatgagtaatgtttaacatttcaaagaaaaggtattttctttagatttttaaaggaaggataggaaactgagtagtaccctagttgtgtgtgttgttcacaggatttcattcattagtttaaaattattttaaattcctaaaatattttacatttccttcttatatttaactagcaagtagtttatattactgaaattcaatgaattatgccattggcacttcttcagagtagaatattgagttgatagtaccagtgaagtgttaaatttatattcttgctgcatatagtataatttaagttcagtctggatgttggcttgatgtttttcatgactgatataccattttcccaaatttaataatggaaacaaatgaaatggtaggacctagaagcttgatgtgttgcttttttttttttttttttttttttttggtgagatgaagtcttgctgcgatgcccaggctggagtacaatggtgtgatcttggcttaccacaagctccgcctcccgggttcacgccattctccttcctcagcctcccgagtagctgggactacaggcgtgcgccaccactcctggcttatttatttatttttttttgtatttttagtagaggtggggtttcaccttgttggccaggctggtctcaaactcctgacctctagtgatctgcccaccttggcctttcaaagtgtggggattataggcatgagccactgtgcctggcccttgatgtgttactttaaatatatatgatggtttttgtgtgtgtgtgtttttttttttgagatagagtctagctctgtcgcccaggctggggtgcagtggcacgatctcggctcactgcaacctctgcctcctgggttcaagcaattctcctgcctcagactcccgagtagctgggattacaggtgcgcgccaccatgcctgcctaatttttgtatttttagtggagatggggtttcaccatgttagccaggctggtctcgaactcctgacctcatgatctgcccacctctgcctcccaaagtgctgggattataggcatgagccactgcacccgaccaagatatgatatttttaagtcatatcatcaggtctcctttcacagtgtaatttctattattaataggcccacccaaattcaatgggaaggtacataaacctcaccttttatcaggagaggtgtcaaagaatttctggctatcttcagtctacacagtctgtaaaaacacatctctcttccatatccatgcccgtcgcactttcgtgcttttcctaaggagatgacttattttcttataacatccatgaaagtgattgaccttagggaatgctttctaagcaataggtaatgtagtgtgtagaatacaaaatatttactgccatactgcaagacttcttcagtagtttgtcttgttcttctcaaagttcatgaagaagggaagatatccatttaggactccaaatgtgttttcctgtggtgttcaataaatatttcttgggtgaccaagatatattaatgatagtatgtgaaatgaaacaacatgggtattatagcataaaagagtcactgcttatgagctctaggctttggtttaattatttctctgtgcttcattgtcgtttttgtaagatgggataacagtaccacccttcttgtagagctgttgtggtaattaaataatacatgtagaagtctgagaacagtttttggcacatactaatggctcaataagttatctattattattattaatagaattagatgtagtaaataggactgctactactactgtttactttggtttcattgtaattataattgtgtgtgtgtgtgtgtgtgcgtgtgtgtttacttgcctggaagcctaatcactaaccaatataaaaattaacgaaacacattttattaattggtgacttcttactagcaaatgtaatgcttgtttatacagaaagacttgataagtgatagtcataatagtttttattaaatatatctttgatcctatttttaagataaatttatatagaaaactcttgaaactattagtagttctgtattagacacaatgctttacaatttcggtttataatattaaattcaacaccaggaatatttacacagatactttttttttccttgtaggtgatgttttcagtggtattttagaaatcatttgacaggaatcaccagttttttcacaattaaaaatatagaattgattatcttttgacatgtattaagagaattataacattttttgtttttaaggaaattaacagtagaggaaaattatcggttagagaaagaagagaaactttctaaagtagatgaaaagatcagccatgccactgaagagctggagacctataggtattaaatacatttttctggtttcttttttggaatgggaagagtatctaaaaaacttaatgccagaaaaataataaatcaaatgaaaatagaaaacattttaaaatctgacaggtggtacagacaaaaaaataatatatttttgtctcatcacttttcattcagatttcttggtcttgagcaattatacagaaaatataaagaggaaaaatgtttttctttcaggttgtgtgatttttaaaatctctcaaagttgaatatggacaattctattttatgttagtgtcaatatgaatagatattaattttaaggtccttcctcattggttcaaattgagaagaatgtatgtaatattagtgaatcaataggtgtgccacaaaaagaagagtgagccatagagcatttggaagtatttaaaagactataaatctagattttaccttggtttgatccttactagatcccaggaaatagaaaatatagagaaaaaaagattcagcagtatcccaaatagttgtgatacttcattttacctcagaaagagcaagcttgctttttatccaaaataagttatcttgttaatctcacaaaagtaccaagtaacattttacttcacagtggttgctaatttcctagaattctattaagactacccacatctggccgggcatggtggctcacgcctataatccctgtactttgggaggccaaggtgggtggatcatctgaggtcaggaattcgagcccagcctggtcaacatgatgaaaccccatctctactaaaaatacaaaaaattagttggtcgtggtggtaggtgcctgtaatcccagctactcaggagactggtgcaggagaatcatttgaaccctggaggtggaggttgcagtgagccgagattacgccactgcactgcatactgggcaacaagagcgacactctgtttaaaaaaaaaaaaaatgaccaacatctgaataaatcttctaggatcattcttcttaaaaataaaaaaaaaacaacacaatataccacgtaaatatttatgtgactttgggtttaggtaaactcaagtagtagtattaagttgtaatcaatgttaaaattagtttaggaaaaaatatactgtagaacctgtcagaggtgattatttcttaatgtggagttctggagtttttttttttttttttttcatgaagtagagcattctgggttttctaataaatatttttttagtagagagtatgttctgtcatttcatgttatatgttaatagtagaataattattcgttccatttagaaagcgagccaaagatcttgaagaagaattggagagaactattcattcttatcaagggcaggtatatatatatgtgtgtgtgtgtgtgtgtgtgtgtgtatatatatataatttaaaacaattctgatttctttgaattgatgcaggaatataattacttgaccagttgtatacctcttttgaggtgttgcatgtggctgtgggacatttcccaggagccaaagattctgagataagaaatcttatttaaaattgctgtattggctgggtgcagtggctcacaccagtaatcccagcactttgggaagccgaagtgggtggatcacttgaggtcaggagttcgagaccagcctggataacatggcaaaaccctgtctctactaaaaaaaaaaaaaaaaaaaaaaaaaatacaaaaatagccgggtatggtggcacatgcctgtaatctcagctacttgggaggctaaggcaggagaatcacttgaaccctggaggcagaggttgcagtgagctgagatcacgtcacttgcactccagcctgggtgacagagtgagactccgtctcaaaaaaaaaaaaaaataaaataaataaaattgccgtatctcctgctgctttgggaaggtagattgcatcacataaatgtgtatcaacagtggggtctcatactcagtcaggctagttatatgttaactggcaattcctgttgattattacataaagtaaaagtttaccaaacaaaaaatttaattgtctttacattcagtttttgttttaaaatataatagattatgtatacatgaaaatttgctttaaaaatgttgcctactcttcagagatgcttgggatagttttgagttgtgcactacatcatagtggtagatgtgaatgttttttacttaagaaaaataatggtcagtagcattttaattactttctttttcagattatttcccatgagaaaaaagcacatgataattgggtaagtttaaaatttccttaagtctcttttgtcaaattgtatgtttttttcagaagatacgttgtttatttaaattagatgaaaataaatatagtattctaaaaaatcagtttcttttaattttacaagtagtgaaattatgttccttgtgaactagtttgttccaacacagttattagaaaaatctgatttttccttctttgcttttatcacattgcttctttgaaaggagtttatactccatggggaaggtgatataatgttcatggactgattgttccagggcactggattgccactaattagttgtggacaagctacttaaaattctttgggcctatttcctcatttgtgtaacaatgggattagattaagtgatcttagaagccccttctagttctaaaagtcataaaattcagttacctgatcctcagtgttgaattactgggtacacattaagaaaagggtcatcatgagaaatagtgtatttgtgctccagaggaactaactgtgtgaggaagtgatgaggatgcagattttgactaattataagaaagacactgtaacatataggactgttgtagtagctggcctttggagtacttgtcactaggagtcttcagcagtaggcagtttgcacagtgggtgaatacatggagtttggaattaggctgtcttggctcatgtcctggcttcatcacctatcatcagttttcttacgtgtaagatagagatagcagtagtacctatttcatagggttattgtgatgattaaattcatgtaaggttgttgccaaatgcctgacacacagtatacattcagtgaatgttaactgttgttattgttgtagtgaagcttggtaggtatttcttagacatgttggagtggagattccagcctagggtgagagattaggtgtggtgaatgtctaggtcctcctcagttgtaagattctgtatgctttagtattgagggttcaaatgaaaatttgttactaaattaagctgggcttggagatgaatttagttaaccactgctcaccacttgtaaaatacttaggtgtagattactctttgaagatggagaggtccacacacagtcccagggtaagacggtaaccaggctgtttctggaagggcagcaggaacatcttacagatcttacagagacactgacttgtaaagattagaatgaaaaccacaaacaacaatggccaagaagggaatatgctgaggtccagaggtaacaattccacatccctccctcaccgctgcgtatttagtgaagtcttctaaggtagataaaggttatctcagatgacatgggtagaggctacaaagagacagttaagcagttggatataaagatcgggacagccagatgacacctaggatatatctgtcctcacgtgttctagagcacagggcaggcaggaaaacccaaggaaccacaggctaaagaattacatatcaggaaggtcacttgggagaagctccacagacaaggtgtgtttttagctgaattgggattggtagagggaatgaaagtgacactgagcagtagcttgtcacacgctccagagctgagctacccacaggagcagacgggtctgggcagaagacagttaataggagaggctcatattagtttctgaaaagtcacatggtaacagagtttaacttgttttttagggaaaaagtgttcatttcaatgaactaatcacccaatcagatagaacccaggctggctgagtttagagtccatgaggctctgaacgtttgaccccagggtggatggggacaaggacatggctcacactgtcaactttagagatttgagggtagggggataataaagtctcaactacacaaaaaggatgtttattaaaatctcttgtgtcctaggcactgtacttaaaggccttttacatacattacttgttcaatctactcagtaactgtaaagttggtactataatcccagatttatggatgaggaaacagccgaaggtcatggactagagggtaaagagtgggtatagaaattctgatctttcagagtctaagtcttacactttttcttacttcagtgattatgatttgtataccattgttgtgatatatatatatttttaagaaatttaatgaatgtttatattgacatatttatgcttattttttaagtttatataaatatatttttaaaatgtgttattttcttcaagttggcagctcggaatgctgaaagaaacctcaatgatttaaggaaagaaaatgctcacaacagacaaaagtaagtatcttagtgggaacatttaaaattagttattctgttatttcgttaattaggtaatacttttataaggttaagcaagaaaacttgcagtgaatccagcatatcttgtgagatatctattagttttactaggaatgtctagtttgttttgtctgttgaagtacttgtcttaggtcactgaagtggcacttggaggaaactgttaacagattattctgcaaaaagtataactagaattttttttaaaccagtgtagatggatggaggtaaaaatggatggaaagagaaggggtgaatctctctgacatagtaatgcccagaatatcagcctcttttaatggataagtagataggataatattcattaatttctctcatttcctggttttgtagtattgggtgacattgttttacaataataaaatgaaaggtagaataaaagtctacaatgtacaatagcagggaagaataagtgcttttctgtgaagatgataacagtcttcctagagtgttataatttcttgtcacaatgtactgttaacattatccaatattagtttttagtcctcttgcttgtcttttctagtctcagaaattaaaatcaaattattaaatgttttatatctcatgattaagaactagaaataagattcttttaaaatgtcacatttgtaggataaaaagtttacgagtaagatagtaggacaaattaatgggatttccagtgttgtaactggaatcatgagtgtcacgttacaatggaaagcatacatgactcaaagccaggaaccctgtgtcttaatccaggcactttcattgtgaataaatatttaaactcctagcctcagtttccttagttgtaaaatgatagactggttgaccttggaggactcttgtatttcaaaaatttggattctgtgatatagtactcatggtagtctagttttgaagaagaaataaaacaattgtaaggctccacataacatcactatctctagggcagcaagaaactgattaccctagttaataagcagtgggagataaaggtgttttggtcagaataattttagaggatctgtttgttctgtgtagatattaaaatagtgaagagcagcttgtagttggtagaggcattttttcttgtggtgcttctcttggatgagtaacttagagatgtttgttctttatttgcagattaactgaaacagagcttaaatttgaacttttagaaaaagatccttatgcactcgatgttccaaatacagcatttggcagaggtagtctttttttttttacccctcatttaaaatacatattttacatatatatatatattgcacatatagtttctattagtgtaagttaacactgttatttatataaatattttagattttagaaccaaggttctagactaagctttctcatagactcacaagcttctaggttttgtttcctgtgcagtaatgaaaattactgttgcttttatttctcagtgggattttgtaagatgatacatatttagtactttgagctccttgaaaagctaggtgcttggcacatagtaaggtactcattaacaattttctgtgagattgaatgaataaggagtgcttacatggactagcattgtgactgtttatatattaactatactttggaatttgcttgtttaataattaaaaaatagtttctaattatttaaaagtatcaatttaaaatgtgggaaaaactcagtctgaggtttgattgctttaattaccctcaagggaggaccaattttttttgtaagatatatttaatatttctgtccattgttgagttagggtctgcagtgatctcaaactattgcaaacagtttaaattttttcataataattttggttgaattggaattaagcttctaaggtactgaaaaatctatatataggtagaattccattttaataaccttggaaagttataaaaatcacttttgagagtaaaatttcattaaaatgaaagtctgtttctacatttaaaaaatattagattattacgaatttcaggtagtaacaaagtttggattggggtgaagtatatagaaggatttttttttgtctgaatccaacacaaaatttcaagaagggtaactaatgctttgatcttttcttgtagctggtttgaatattataccagctacactcatgttttaaatttaacatgttttaaaaatgttattttggtggtttttgtttgtattttgtttttgatttttgactttggaaacaaaaccattatttgagagtggtgaagtttgtaaagtggtaggtgtcttggctgtatagattatagataaagtgatttagttgataaattagtatttgtaagctgactttttactggtaatgaatcaaaagtaaattgtgatcttgcttcagagtattttatgcatttttctcctcttcataatctgagcattatttaaacaattcatggcccaatacagcctatctggccctgatttaaactgagtacttctatgttgcaactctcaccagctgaaatgtctgggtgcatactgccagtaaaaacaaaccaaaaaaaaatctaactttatgctcctataactctaagatatatctccaatatcctttgcttaatataaatgattatttatcatgatctttttattcccagttcgttgatgtttttattgcttaaagtgtctatttgatagacaaatatcgaaaacaccagggtctgtatttaattctgttctatattagcaaaatcaaaggatacattcaggacatagattaaacttaaattggcaataggatgacctgatggtaattgtcgaaatgggattctaactctgtagtgtagctaagtgaaactatgaatttaaatatgctgttttaattattccagagcattccccatatggtccctcaccattgggttggccttcatctgaaacaagagcttttctctctcctccaactttgttggagggtccactcagactctcacctttgcttccagggggaggaggaagaggtatattgtttaaacatctttattactctagatttcttccttactttatattttcatctcaacttaccttaaaaatgatctgtaaaatatttggaaaatacaggcattccttgcacttactgtagataacttttatttggaaaaggagctctatgacatctaattttgatgtatttttctcttagaaaccgtgctatattagataacattttgatcaaggacttgatgtgtatctttttatttatttttctttttaattttaatttttattttttgagatggagtcttgctctttcacccaggctggagtgcagtggcgcgatcttggctcattgcaggctccacctcccaggttcacgccattctcctgcctcagcctcccgagtagctgggactacaggcgcccgccaccatgcccggctaatttttttttgtatttttagtagagacggggtttcaccatgttagccaggatggtctcgatctcctgacctcgtgatccaccctcctcggcctcccaaagtgctgggattacaggcgtgagccaccacgcctagcctgataacgtatctttttaaaccatatttttgacttcttaaaaactatatattacatgatataatataaaattttgtaagactgcatgaaatataataacagtataacctagcataaaaattatctatgtgtatgtatatatatgtaatttttttttttttttggagactgttttcactcttgttgctcaggctggaatgcagtggcgcgatctcggctcactgcaacctctgcctcccaggtagcttggattctcctgcctcagcctcctgagtagctgggattacaggcacatgccaccacacctggctaatttttttttgtatttttagtagaaaatacaaaaggttgttttgccacattggctggccaggctggtctcgaactcctgaccttaggtgatccacccgcctcagcctcccaaagtgctgggattacaagtgtgaaacaccataaaattatattttgatgaagcattagaatttggaattaaaaaaatttacattagtatcatgatctttttattgtagaaaattagaaagtgaaataatctttttatagactcaaggaaatcagtagtgctcttgtaggcagatttttgatgggaacctttactgtggtctgcatcatttgttaacacactgggggctgggcgtggtggctcatgcctgtaatcccagtattttgggaggccgacgggggcagatcatgaggtcaagagatcaagaccatcctggccaacatggtgaaaccctgtctctactaaaaatacagaaatcagctgggtgtggtggtgggcgcctgtagtcccagctacttgggaggctgaagcaggagaattgcttgaacccgggggacggagattgcagtgagccgagatagtgccactgcactccagcctggcaacagagcgagactccgtctcaaaaaaaaaaaaaaaaaaaagtacattgggaaaccaagccacaattgtctgctgttacccccttataggtacctcaggcctaatcattagctattctacatttatctcatcagcatcaccctggtgttacaaaaggccctagtacctttgaaaactcctgtgtacctggagttttccttttttgatctctcaccatactttctttgtcaagttcctttaaagttttatcttaatttgtggcgaaattcaaagatatagggccttatttatttcaaaatcaaaagtcttacattttcagttccaagtatgtgttttataagagctgatggcattcttcaccagtgaaacattcccaccctttgtatcagtgattttaacagattgaatttgagataggaacataaagtaatgaatctaaataaaaacaccaaattaaatccaacaaatcaaagttcatatactcagatgggtattactcatctaaatagtatctcaggaagtctgtgtacttgttagttgaagctgccattactccacatatttttggaactcttcctttggaattgctttcaaataatatgagaaaatcaacttactactgtatggtcatgagatattctccctttgcccatatcctgtttgtatcctctttctccaccctcattttgcttcacttagaactgttcctgtccacctcccagtccccccagtagattgggccacagcctggggtccctacagagcctctgcttgtgttgattttgaactggaagctcctagggaaagggactgccctatagactgatacttagagccttagggaggctttgcattgagcacttcaggaaagagactgattttgacattgacatgtctgctgcaagcttatgacttagttctctaagtccacccccacccctccattttttaccttggcttacactaagaaatgtattttgtatcatgtcatattgtacactaacataaacatgattgaaatataattgaaaccgctacatgaaatagtacttgccattacagttttgatgctttctattcaattttatcccgtttcattaatttaatcttaattagcattattttttaaacttcacacatcacaaatgagtaggagctagcagtctgaaaaaacagtgccctagaaataagggtataattggctaaactgcaaatatgagtcactggaaattgaattacataagtcaaggattgcttgtagtcaattgaatatttggaatgattaaaatttacatttgatttctcctcttctatttcctctcctatttaatttaaagatacagtgtgtttagattatctgcaagggtgttttaccatttgtttaaaaagctacagaagttctaggtaagttgtcatcgggtcttacagagttgatccgaactaaaagtttctatgatccaccaaaggaggatggagagtacctgttatttttccttacttttattatctttttaatttgaagtttggatgagtggtatatttgaataatactgagtacaagtaaaacaatttcttcttagagtaaattgtatgtaactgggtttgaatagaaaactttaaccattagaacttttaggtttgtaatattcactgggtagtcagttggcctgtagctttggtcttctggaagtaagcaatcaggaaggaaagcctctgaatgtctcctttaaatctctgtgcttcattccagatgaactcagcctaaatgacgacttgcacattttctgctttcccagccttcttcttctaatgagctaattattaggatgaagaagcgagaaggaaagatttggggaacttaatagaatgtatactaataaggaaaaatgatagtttacctcctgatgtaaaagccagttgatctgattctactaaagggagtagatggaaaatttgttttaaagattactatatattaaatgtgaatgcttatgctgatttgtacaagttaccaagaaaagttaaaattaattttgttctcttaaaggaggtactgaaatagagtaagcatttttgttagacttcttttttttttattttttttttttgagatagtctcactgtgttgcccaggctggagtgcagtggcacgatctcggttcactgcaaccccttcctctcaggttcaaatgattcttgttccttagcttcccgagtagctgggattacaggcacgtgccactgtacccagctaatttttgtattttcagtagagatggggtttcaccatgttggccaggctggtttcgaactcctcacctcaggtgatccgcccacctcggcctcccagagtgctaggattacaggcatgagccatcacgcctggctattttagttaggcttctattgaaaaaaaattgttcactgggtgcagtggcttacaactataatcctagtactttgggaggtcaaggtggtgggattgtttgagcccaggagttcaagaccagcctgggcaacatggcaaaaccctgtatctacaaaaaatacaacaattaacaaagcgtggtggcacatgcctgttgtcccagctacttgtaaggctgaggtgggagaattgcttgagcctaggaggcggaggttgcagtgagctgagaatcgcaccactgcactccagtctgggtaacagagtgagtgagaccttgtctcaaaaaaaaaaatgtttttaaagctgttccttgagaataataagcttttgttttctggacaatataattttgagaagaccccccttttccctctcaatgacagataaatgaggtattaatatattttattgaatgttaaatttttttttttttttttttgagatggagtctcgctctatcccccagactggtgtgcagtggcatgatcttggctcactgcaacctcctcctcctgagttcaagccattcttctgcctcagcctcctgagtagctgggactacaggcgcctgccaccatgcccggctaattttttgtatttttagtagagatggggtttcaccttgttagccaggatggtctcgatctcctgaccttgtgacccgcccgccttgacctcccaaagtgctgggattacaggtgtgagccaccgcgcctggccaaaatttttttatatttgtcttttccattttagttgaatatgggttttgttttttgtttttttttgagatggagtctcactctgtcacccaggctggagtgcagtggcacgatcttggctcactgcaacctccacctcctgagttcaagccattcttctgcctcagcctccctagtagctgggattacaggcacctgccaccatgcctggctaacttttgtacttttagtagagacagggtttcaccatgttggccaggcttgtctcaaattcctgatctcaggtggtccaccctcctcgacctcccaaagtgctgggattacaggcatgggccactgcgtccagccctgtatatgggtttttaattaaggtactatcttttctgtggtcgtaagaagggaactttaaaattactcctgtttgtaaatgtaaatatactagattttcttatccaaaagaatgttagctcatttaaagtgattatttcaacagtgctgttgtttttgaaactatcgttttagacttgtcttcagaacttatgaattcttcttttgaatgtgaatttgatatttagaaatcactaaaagccatctagtgccagtttatctgttgtacataatgttttaaatcaggctatttaaaatcattttggggcagaagtatttatcttttttatcttctcattgactcgtaacactattcagtgaatttgggcagaagtagagagtcatgttttaactttgagatgcagttttttacatggctcttaagttaaactgagtacatttccaaaagagtttttctgaaaaatactttagtagcaaaattagtagaatagatatagaactgctaagatgactgttttaaaggaatcatgctcatttggactattgatatattagtttaagcaacaaaatcatttatgctttttatttaatcatttattatattttatatttattttaaatattttatatttattttatattatattttttatttaatcagttcttataattactttataattatcctgttacatcaggcataggaatcatagcaatttactttctacactgttatttttcagactttgtatttataatttatgatttaaccactgattttatgtgtaaaacaagtatataagactttttaagatgaaacagatttgtatgtttttttttctttaattaggctcacgaggcccagggaatcctctggaccatcagattaccaatgaaagaggagaatcaagctgtgataggttaaccgatcctcatagggctccctctgacactgggtctctgtcacctccatgggaccaggaccgtaggatgatgtttcctccgccaggtatgtaaagacaatagttattatttctctttgaaaggcagctgggatgtggaatacacaggaatggaagaagggaggagtatatgtttgttctctcttaagaaaaatcatcgtacatttttgaaaacaacaatgataaataatctaaacagaatgatttgagataattgttcatattatagaaagctgttttctccctaaatggaatgtttttattgtttttgttgcttgtagaggtaataatgcatgtttactttagaaaatccaaacaacacagaaatgtgtaaagaagtgaaaaatcccttttgtcatcttagcgtgtccttcccagaatttagttgtaggtatatatcttttagagatttttttgggtatacatttatacacatagctgttcaaattcttttaatcactctgtgcagttgtaccattcatcctcttttgtaattgtcttttttcactgaccattttatctcaccaaaataaatatatttaccagaagagtcacagcagaatatcttgaaataagataataactgccattcaacagctgcatcatctacattaggtgtttctcctaatgctatcctcccctggccccccacccccagagaggccccggtgtgtgatgttcccctccctgtgcccatatgttctcattattcaactcccacttatgagtgagaacatgcggtgtttggttttctgttcctgtgttagtttgctgagaatgatggtttccagcttcatccatgtaccttgcaaaggacatgaactcattcttttttatggctgcctagtattccatggtgtgtatgtgccacattttctttatgcagtctgacattgatgggcatttgggttggttccaagtctttactatcatgaacagtgccgcaataaatatacatgtgcatgtgtctttatagtagaatgatttataatcctttgggtatatacccagtaatgggatggctgggtcaaatggtatttctagttctagatgcttgaggaatcgccacactgtcttccacaatggttgaactaacttacactcccactaacagtgtaaagcgttcctatttcttcacatcctctgcagcatctgtagtttcctgactttttaatgatcaccattctgactggcgtgagatggtatctcattgtggttttgatttgcatttctctaatgaccagtgatggtgagctttttttcatatgtttgttggctgcataaatgtcttcttttgagaagtgtctgttcatatccttcgcccactttttgttggggttgtttgcttttttcttgtaaatttaagttgcttgtagattgtggatattagccctttgtcagatggatagattgcaaaaattttctcccattctgtaggttgcctgttcactctgatggtagtttcttttgctgtgcagaagctcttcagtttaattatatctcatgtgtcaattttggcttttgttgccattgcttttgttgttttagtcatgaagtctttgcctatgcctgtgtcctgaatggtattgcctaggttttcttgtagggtttttatggttttagttcttatatttaaatccttaatccatcttgagttgatttttgtataaggtgcagggaaggggtccagtttcagttctctgcataaggctagccatttttccgaacgcaatttattaaatagggaatcctttccccattggttgtttttgtcaggtttgtcaaagatcagttggttgtagatgtgttgtgttatttctgaggcctctgttttgttccattgttctatatgtctgtttttgtaccagtaccatgctgttttggctactgtagccttgtagtatagcttgaagtcaggtggtgtgatgtctccagctttgtattttttgcttaggattgtcttggatatatgggcttttttttgcttctatatgaaatttaaagtagttttttctaattctttgaagaaagtcagtggtagcttgatgggaatagcattgaatctataaattactttgggtagtatggccattttcacgatattgattcttcatatccatgagcatggaatgtttcttcttttgtttgtgtcctctcttatttccttgagcagtggtttgtagttctccttgaagaggtccttcacatcccttgtaagttgtattcctagatattttattctctttgtagtaattgcgaatgggagtttggtcatgatttggctctctgttattggtatataggaatgcttgtgatttttgcacattgattttgtatcctgagactttgctgaagttgcttattagcttaaggagtgtttgggctgagatgatggggttttctaaatatacaatcatgtcatctgcaaacagagacaacttgacttcctctcttcctatatgaataccctttatttatttctcttgcctgattgccctggccagaacttccaatactatgttgaataggggtggtgagagagggcatccttgtcttgtgctggttttcaaagggaattcttccagcttttgcccattcagtatgatattgcctgtgagtttgtcataaatagctcttattattttgagatatgttccatcactacctagtttattgagtttttttttttttttttagcatgaaggggtgttggattttatcaaaggccttttctgcatctattgagataatcatgtggtttttgtcattggttctgtttatgtgatgaattacgtttactaatttgcatatgttgaaccagccttgcatcccagggatgaagccaacttgatcgtggtgggtaagctttttaatgtgctgcttgatttggtttgccagtattttattgaggatttttgcatcaatgttcatcagagatattggcctgaaattttctttttttgttgtgtctctgccaggttttggtatcaggatgatgctgacctcataaaatgagctagggaggattccctctttttctgttgattggaatagtttcagaaggaatggtaccagctcctccttgtacctctggtagaatttggctgtgaatccatctggtcctggacttttttggttggtaggctattaattactacgtcaatttcagaacttgttactgatctattcaggaatttgacttcttcctggtttagtcttgtgagggtgtgtgtgtccaggaatttatccatttcttctagattttctagtttgttcacatggagttctttatagtattctctgatggtagtttgtatttctgtgggatcagtggtgatatcccctttatcatttttccttgcatctatttgattcttctctcttttcttccttattagtctggctagtggtctatttattttgttaatcttttcagaacaccagctcatggattttttgaagggttttttgtgtctttatctccttcagttctgccctcatcttagttatttcttgtcttctgctagatttttactttgtttgctcttacttctgtagttcttttaattgtgatgtttgggtgttgattttagatttttcccgcttgatctcctgtgggtattttagtgctgtaaatttccctctaaacactgctttagctgtgtcccagagattctggtatgttgtgtctttgttctcattggtttcaaataacttatttatttctgccttaattttgttatttacctagtagtcattcaggagcaggttgttcagtttccatgtagctgtgcggttttgagtgaatttcttaatcctgagttctaatttgattgcactgtggtgtgagggactgttatgatttccatccttttgcatttgctgaggagtgatttacttccaattatgtggttgattttagaataagtgctatgtggcactgagaaaaatgtatattttgttgatttggggtggagagttctgtagttgtctgttaggtccgcttggtccagagctgaattcaagtcctgaatattgttaattttctgtctcgttgatctgtctaatattgacagtggggtgtcaaagtctcccactattattgtgtgggagtctaagtctctttgtaggtctctaagaacttgctttatgaatctgcatgctcatgtattgggtgcatatataattagggtagttagctcttggtgttgcattgatccctttaccattatgtaatgcccttctttgactttttgatctttgttggtttcaagtcttttttatcagagactaggattacaaccctgcttttttttgctttccatttgcttggtaaatcttcctccatccctttattttgagcctatgtgtgtctatgcacatgagatgggtctcctgaatacagtacaccgatgggtcttgactctttatccaatttgccattctctgtcttttaattggggcatttagcccatttacatttaaggttaatattgttatgtgtgaatttgatcctgttattatgatgctagctggttattttgcccattagttgatgcagtttcttcatcacgttgatggtcttttacgttttgttgtgtttttgcagtggctggtagcggtttttcccttccatatttagtgcttccttcaggagcccttgtaaggcaggcctggtggagccaaaatccctaagcatttgcttttctgtaaaggattttatttttcctttacttataaagcttagtttggctggatatgaaattctgggttgaaaattctttaagaatattgcatattggcccccattctcttctggcttgtagggtttctgcagagagatccgctgttagtctgatgggcttccctttgtggttaacctgacctttctctctggctgcccttaacgttttttccttcatttcaatgttgctgaatctgacgattatgtatcttggggttgttcttctagaagagtgtctttgtatttcgtgaatttgaatgttggcctatcttgctaggttggggaagttctcctggctaatatcctgaagagagttttccaacttgattccattctcccgatcactttcaggtacaccaatcaaatataggtttggtcttttcacatagtcccatatttcttggaggctttgttcattccattttattcttgtttctctaatcttgtcttcacgctttattttagtaagttagtgttcaatctctgatatcctttcttccgactgatcaatttggctatattgatacttgtgtatgcttcatgaagttctcgtgttgtgttttttggctgcatcaggtcatttatgttcttctcgaaattggtttttccagtttgcaattcctctaaccttttatcaatgttcttagcttccttgcattaggttagaatatgctcctttagcttggcggagtttattactcaccttctgaagcctacttctgtccatttgtcgaactcattgtctgtccagttttgttcccttgctgccaaggagttgtgatcctttgaaagacgaggcatcctggtttttggaatttttagcctttttgcctggtttttcctcatcttcctggatttatttaccattggtctttgctgttgatgaccttcggatggagtttttgcttggtccttcacggcacagtccctcatggcttctcttggctaggggaggaaatttcctgaacgcttgtgcttcccaggtgaggtgacgcccaccctgcttctgcttgcagtccgtggactgcacccgctctctaaccagtcccagtgagatgaaccaggtacctcagttggaaatgaagacatcacccgccttctgctttggcctcactgggagctgaagaccggagctgttcctatttcgacgtcttgcctgggaatcaacaatttcttgtgatctatcttcaggtttactgactctttccttgtcatctccattctgttattaagcttatctagtaaaagttttattttagatatatttttcaggtctaaaattaccatttggttcctttttataatttgatttatctgctgagttttttatctttttattcattataagcattttttttaaaccattgagtatattagttttataataactgctttaaagtcattgtatggtaattctaacatcagggtcatcttgaggttggcctctagtgatgatattttcccttaaggatgggtcacattctctttcttgatgagtttgtattggatactagacattgtggcaattctggattctattctattcctctaagagtgttactggtcttgctgtagaagaccattaacttggatgggctcagactgcagccttttcccttctgtggtggggaacagctcaaatattagttcagttatttttgccttagctgaaaactgcttaaatttgccatacacatgtgttgctctggagtcagccatagacttgggcagagattgtacccagaatattgggctctacctttgcggctttctcctttctaggatatcccaatcccattgcctcaggcttgggctctgtgtacttgttcttcaggcaagaaagttttatcgagttttgactgctgtgtgctgcaactcactgtggtcttctatcaggctaaaacataaaaatggaaaactcaccccatacccggttgttactcctttcttcttccaagctctctcttcttttctaagtcctcctgcttttgttgatgcttaagcgcttcaggcagttatttttttgcatattgtctggagtttatacttatgtgtaggagagtcagtctgaatttactctaccatactagaaatggaacctggtctccgtacttttcaatcatttgtgagcttctaaattgataccttcatagaagagatatggtccattctacagagtatctccaaataatgaacctgatccctgtggtttgacagagggccaacctgtgtcaactataatctcaatgtcatagacaagggtaattctacagacacagtaaaggaattttcagtattgttccaaaatttatgatgagtgagaagggctaaatgactcctgaggctctagcatgaattagagtaatgctgataaatgtatttctcagttagcttcattcctacctaaagttaaaaaatattctatgtttgctcttggtatattggtacatgccatttaaatagtcactgaacaggccgggtgtggtggctcatgcctgtgatcccagcactttgggaggccaaggcaggtggatcacctgaggccaggagttcaagaccagcctggctaacatggcaaaaccctgttcctacaaaaaatacaaaaattagctgggtgtggtggcaggcgcctgtaatctcagctactcgggaggctgaggcaggagaattgcttgaacctgggagacagaggttgcagtgagccgagattgcgccactgcactctagtctggcaacagagagagactctctcaaaaaaaaaataaaaaaatggtcactgaacagatttcagggttcttttcttttatgttgtgtttcagttaacgaaatgataatgaatgaggggacttaggctttttttttttgaagtggagtttcacctttgtcatccaggctggggtgcaatggtgccatctcagctcactgcaacctctgcctcccgggttcaagcgattctcctgcctcatcctcccgagtacccgggattacagggcatgtgccaccatgcccagctaatatttgtatttttagtagagacggggtttcaccatgttggccaggcttgtctcgaactcctgacctcaggtgatccacctgccttggcctcccaaagtgctgtgattacaggtgtgagccaccacacctggcctaggctttttaaaccttatcattgctattacttttttgtgtaaccttgagcaataaattttacctgtcatggttttctctctttcaaaatatggtcttctggctgggtgcagtggctcatgcctgtaatcctagcactttgggaggatgaggtaggaggattgcttgaggccaggagttctggagcaagctggccaaaatagtgagattctgtctccacaaaaaaacaaacaaaatagtgacttctgtaaaacagagatggtgatattctaaagtaatctgcctctcttttatgtaaggttgacttattgggactcatgaagagtccttctcactaataattgtctttaagatttttcttaaattttaaaatattttagtttaaaatacttatgttaaaaaaatatgacaactaaaataactaagtttctgaagaatatggattctgcatttgagattatctgtcatttagtctgttaggcataatttataaaatgtatatattttcttaacatgtttctacttggaagaagtgttttagatttccattgacttaagatgagttagcagaaatgattttaaatagttccatatttacaaggaatcatttatttttgcaccgttaaatactttgaaaaaggagaaaactttacttagcttatatagtcagaaaaaactgctctaacttatctcttttctcatatgccctattccagacattcttttaaaaaatattttaataatgttatcttttatttgagattcacagggtacatgtgcaggtttgttacatgggtatattgcatgatactgaagtttggggcgtgactgaattcatcacccagaaagtgagcatagtacccacagtttttcagcccttgcctccctttgtctctcctcgctctactctggtagtccccagtgtctcttgttatcatctttatatccatgtgtacccagtgtttagctaccacttacaagtaagaatgtgttagttttatatttctgcattaattcacttaggataatggcttccagctgcatccatgttgttgcaaaggacataattttattctttcttatggctgtgtagtattctatggtgtatatgtactgcattttctttatccagtccaccgttggtgggtatctgggttgatttcatgtctttgctgttgtgaatagtgttacgataaacatgagtgcttgtgccttttttgtagaacgacttagtttcttttggatatatacccagtaatgggattgctgggtcaaatggtagttctgttttaagttctttgagaaatcttcaaactgatttccacagtggcctaataatttacattccctccaacagtgtataagcattcccttttctctacaaccttggcaacatctgttattttgactttttaatagtagccattctgactagtgtgaggtggaatctcattgtggttttgatccaaacattcttattacttaaaggttttattagcaagtatacacctagtttcttcaagtaatcaacactttattctcattattttcagtagcagactcaatcttataaactaataaggattttaaaacttttaagttttcttttaaaactctgtggttattaaaggttagtacacaaatttggctaccttattaggaaagagctaattctgctgaagcatagtatgtgtacaaagttttgtacagtgttgaacagtctacaatgtatctgttcatctaacattcttatatgtgcttttaattagtttgcatgtttagaacaagactggcttaggtgaaaaagcatttggactggaaatcaagaaatttgctttctggttttcactcctttatcttttagtgtgattttaaaaatttattaaaaaatttttttagagacaggttctcactttgtcacccagctagagtgctgtggtgtgattatagctcactgtagccttgaactcctgatctcaagcaatcctcccctctcagcctcccaagtaactgggactgtaagcacatgccacaatgcctgggtaatttttattttattttaaattgtttttggagacaggtttttgctgtgttacccagtctggtgtcaaactcttggcctcaggtggtcctccctcctcagcctcctgaatagtgggggattacaggcacgagccatcgtgcctggcttttagtgtgatttttaaaacttgtttcatttctttggaccttatatattatatagtgacataaccatataactccataagaaactcattcgaatataatagtataagtaggtggaaagtaaaaggatagaaaagatacaccatgcaaacattaatcgaaagaaaatgaggtcaagaagatatagcaaatgttaaatgtgtgtatgccaacagcagctacaaagtatgggaaacaaaaactgatagcactgagaggaacaaagacaaatccagttataattggagacttcaacacccctctctcggcaattgatggaacaactgaagagaaaattcagcaagtatatagaagaactgaacagtgccctcaaccaacaagacctaactgacatttatagaacaagttacccaacagcagcagaatacacgtgtttttaaagtagcagtggaacattttacaagacagattgtatcctgggccataaaacaaacctcaacacatttaaaagaagtgaaataatatacagtatgttctttgatcacaatggaatcaaactataaataataaactattgatacatgcaacaatttggatgtatctcaatggttgagtgaagaaaaccagtctcaaaagtttacatactgtgttattccatgtatataacattcttttttttttcgagatggagtctcactctgtcacccaggctggagtgctgtggtgtaatctcggctcactgcaacctctgcctcctgggttcaaactgtccttcagcctcagcctcctgagtagctgggacttcaggcacacaccaccatgcccggccaggctaattttaaaatttttagtagagacagggttttgccattttagccaggctggtctcgaacttctgacctcaagtgatccacccacctcggcctcccaaagtgctgggattacaggcgtgagccactgtgcccggccatatataacattcttgaaatgacggtatagaaacagaaaacagattggtggattcaagagtttgagacagtagtggggaggggagtgggtatgactgtaaaggggtggcacgagggaggtgtttttggtggcacaataattctgtatcttgagagtggtagtgattacataaatctacatatgctgtaaaatgtcatagaactagacacgagttgtaccaatgtcagttttctggctgttacaatacactatagttatgaaagacgtaaacattgagtaaagggtgtgcaggatctctctgtagtatttttgcatctttctgtgaatctattttaaaataaaaaagtaaaaatcttattgtatatcatacacatacagggaagtacaaatattaagcatataatgtgattttttttcacaatttgagcacagtgatataactaacactcagataaagggatagttttcagtttggtttttcataagtttaattagaaaacttatttataattttagcagaaaaaatgttcttgaataatgtaagtgagttgataatattcacatatcatatagtaatcacaattaaaattttaacagaaatatgtcctgggaataaccagttcattataaattctttataaatactaacctgcaacaaaaatttatcaatgtgacttaccttgctcagcgcttcagttgttaagaaaaaacacaaaagtgttttcatatttagaatgagaacattacagatcaaagagacttggtaagaaagtagtttaaattgtccatgtaattcttttgccagggttaactgtaacaaaggtgattctcataaaaactttcaagttgtatgtgttggcttgttttgtcttcacttttagaaatgaaagtgaggtatcataatttattaagtagataatgtcactatcctgtagatcagcagtccctaacctttttggcatcagggactggtttcatggagcccagtttttccatggaggttgcagggaggaggatggtttcgggatgaaagtgttcacttcagatcatcaggcattagttagattctcataaggaatgcacaggctagatccctcacatgcgcagttcacagtagggtttgcgcttctatgagaatagaatgcctcagctgacaggaggtggagcttaggtggtaatgctcgcttgccctcctcacctcctgctgtgcaaacagttcctaacagcccgcggaaaggtactggcccgcagcccaggggttagggacccctgctgtagatgactacatacatttatttatttatttccctgtcttatggtgctgattgataactacttctactgtagctcaggttgggatatatagtttgaaaattgttggcatatatttagatagagagatacagtgggttagtagctttcacaaggagaaggaattaaaatgttaactctatattttttgttctaaatatatttttaggatctatgtgctatagtttgtttcatttttacaagaatttctactgaacatcttattcaagatgttgggataaaagataaattattaaaaaggtgtagttatgtatttcaatgatgagttaatataatgaaatgaatgtaatactgaaacagatctttttctacaacagctctgtccaatagagctttctgtaataatagaaatgttttatatctatactgtccagtacagtagccactaggcacatgtggctagtaaatacctaatgtgtctagtacaacttgagaaacagaatttttaatcttattgaattttgtcagttaaaatttatttaattttctttattattttgttttgttttgagacagaatctcactctgtcatccaggctggagtgcagtggcatgaacacagcttactacagcctcgacctcctgggcccaagtgatcctcctgctttagcctcccaagtggctgggactataggcatgcaccactaatgcctaatttttaaattttctgtagagacggggcctcactatgttgcccaggcaggtttcgaaatccttggctcaagcaatcctcccaccttggcctcccaaagtgctgggattacagacgtgagccaccacgccctccttcgtacccttttgagctttagtattcctagttttcattgtttaaaagaacaaggagtgtgtatgtggtttctccttatttttgttggtgcttatcttttactgatttggataatatattttatgtaagcatagcaaagagactaagcaaccataccttggtggtgtaatcatgagttaagtgtggttgctagcctggcatgtttaaaaactctttttcttaaagagctgaacaaataagagacatatagtgtacagctaaattgatgagaacagttttgactctttccttgggaaacaaaagtgtgctaagcagatcaaaataccttggatagctttgaatgcataggcgtagatttttacttcactgactctgattcatagacatttatgctgaccattgtcctacattctgaacagttttttcagacaagactgatttagtagaattatagtttgtcttaaggctcattttgatctctttgatgaaaacttgtggtcttcccaaacttaataaggtgttctgaagtcgtggtatatatgcttttatcctctcagaggatgatatttacttaaagttgttcctaaattttaggctaccagttttttaggaatatatatatcttaatcacttatgtcttatataatgatcctttataaattctaatgattattcagttgataaattgccactgtatgtgtttttataaactttaaaaatctgtgtttaatttgtcagtcttcctgaagagactaggttgtggagagattaagatacagggacaaatgtaaacaactttttgaaaaatttcactttgaatgaaaaagagatggtagctggagggagaggtgttttggtttttaaagatggataatattggctgggcatggtggcttacgcttgtaattccagcactttgggaagctgaggcgggcagatcacctgaggtcagaagttcaagaccaacctggccaacatggtgaaactccgtctctactaaaaatacaaaaattagccgggtgtggtggcacgcgcctgtagtcccagctgctcgggaggctgaggcaggagaattgcttgaccctgggagggagagcttacagtgagctgagaccgcaccgttgcactccagcctgggcaacagagtgagactccctctcaaaaataaataaataaataaatgaataaataaataaataaatgatggataatataacatatttatttgctgatgggaataattcaggctagaaggggaaattaatgatgtttggagaaggtctggttataaaagtgaaaccctggaatattaagcacaaaagatgctatccagagtgtaattgcagaaattgtggtagctgggtcaatttatccattctaaaaagaaggaaggcagagcaagtgagtacagatgtagctgttgggtggagggtaagtggaggtgtccagttgtttcaattttcttgttgtggcaagatcatcagctgaagcaggtggtagaggagaggactgtcagatctgaagagaaaaaaaggtatgcagtagctatttaggagagtggaagaactcaaacattagtaaagtgtagtatgattatagggcattgttgagcatcagtttgaaatttatggtcataaatttgaatgaaaagcagtcaatactatatttttaatatagtttataatcataacaagcttaatttatcatcagatattgataaagctgtatatagaatgtatttgtgtcagactaaatgccttttattaatcattctaacactcttaagagtgttattctgttattcccattttacagatgaagaaacaaaaccacagaaaggttgggtaacttggtgaacaacacaaattgagatttaaaaaaaaaattttattatactctaagttttagggttcatgtgcacaacgtgcaggtttgttacatatgtatacatgtgccatgttggtgtgctacacccattaactagtcatttagcattaggtatctctcctaatgctatccctcccccctccccacaacagtccccggtgtgtgatgttccccttcctgtgtccatgtgttctcattgttcaattcccacctatgagtgagaacatgcagtgtttggttttttgtccttgcgatagtttgctgagaatgatggtttccagcttcatccatgtccctacaaaggacatgaactcatcattttttatggctgcatagtattccatggtgtatatgtgccacattttcttaatccagtctatcgttgttggacatttgggttggttccaagtctttgctattgtgaatagtgcctcaataaacatatgtgtgcatgtgtctttatagcagcatgatttataatcctttgggtatatacccagtaatgggatggctggatcaaatggtagttctagttctagatccctgaggaattgccacactgacttccacaatggttgaaacaaattgagatattatagcacaatcctggatatcacccttgagaatttacatattaatatttgcttcagatatatatgtgtttgtgtgcgtaaatgtgtaaataagacataaaaagaaaaagcacactatttacatgaattgaacactattgcatttcctttcctgggcatattaccttcctctcctagaagcagctattcatgagtttagcgtgtgtaaactttcagttctaataatgattaaaaaaaattaaagttctgttttatcagctttccttatcagccttacctacttgaattctttccatgttagtatatagagagtttatcaccttaattgtggtatggtatttcagtgtataagaaaccacaaaatgtttaaccatttcctgttggtgagcatttagagtgtctccaatatctcaccattactaacagtgctgcagctagcaccctttttgtacatatgttctttcaagattgtccaggaattggaattcctaggtaatagggtatgcacacttttgatcttattttcaatttttatttttttgggacaggatcttgctttgtcgctcaggctggggtgcagtggcgtgatcttggctgactgcaacctccgcctcctgggttcaagcgattcttgtgtctcagcctcccgagtagctgggatcgcaggcctgtgccaccacacctggctaatttttttgtgttttcagtagagatgggatttcaccatgttggccaggccgatcttgaactcttggcctcaagcagtccacctgccttggcctctcaaagtgctgggattacaggcatgagccaccatgcccggcctgtttttggttttaatagatatctccccatcgccctcaacagaagctgtgaatgaagtatatgagagtagctgatttctgcagtataattcttagtttgcaaaactgctttagaatgcccagtacacttattcccactccttattcatttttttcttatctttttttcttccattctttctttctaatcatgtcttctattataagcgtagaatactattatagaaaacaaaagtttgaaagcaaaaaagaaagggacctttcatgtccttactttctgtagttcagttcagtctttaattggtcatatgctttccacatagctgtatcttattatgtgtatatgtgtatgtgtatatgtgcatatgagggtgtgtgtatatgtgtgtatgtatgtgtgtatatgtatatgtgcatttgaccagaatacccttgattacttgttcatctttacttttctttcagggcaagctttactgcctctgactccatttctgattcctgcaatcagaaatagatagtctacctcttatattatgtatatttccttttattaagacattaatcacatggtgtttatgtgtttctatcagaattagactgtaaggacatggggtttatcaaggccaacattgtattgtttgtgcctgacacatactaggccttggtaagatttaaggaatgaattgcttttgccagtggagggcaacatagccatgtagtttataaagtagtaaatttataacaaaatttttttatttctgaggttgttgatgtgtggggatataatttagaagcaaaataatgatgtagtatctggagacctgattaaaaaagagttggtgttcaggtttccttattttatccccttgtccaactccaccatttaattaatcctttgtttgaagtagaaagggaaaactgagtttagatctcagtgattggtattgaccttttctttcattaggctaactcaaaccctttgaaacagctcctccctaggattttgaaagggagtgtaaatgagccttcaaactatttgtatctttctctcctcagtcacatctcccgaccattgggagctcattaaatataattctctttattgactctcgttgatgccaggtggtctctctggttttgtgtaggagagatgatgtgtcaataaggtcccctgtggcagagtcagatgaggagtgatatatccaacactgattctataaagtcaattagaggcaatttggggttgtttacgtatatctgtaataggataggggaaagttacacaattcaccttctttgtcgttctccttatttttggagttggacatatgcatgcctaatctagcagtctgacatcacctttcaagaatgagaaactacctatactttttcaagagtgatgagttccacaaggacccaggaattattaaaccgcaattacttttgcaccaacctaataccatattgtcatcataaatcacccctggggacaaagggtggctgtagaagcacttgagatagttggtgtccaaatttgtgtctctccagatgttcttcgtttcagcagtggtactcatctgttgagtcagagagagctttccatttagtttgttttttatttattttcatttatttatttatttattttgagatagagtcttgctctgtcacccaggttggagtgcagtggcatgatctcggctcactgcaacctctgccccactgggttcaggtgattcttctgcctcagtctcccgagtagctgggattacagactaccatgcctggctaatttttatatttttagtagagacagggtttcaccatgttggccaggctggtctggaactcccgaccttaggtgatccacccgcttcggcctctcaaagtgctggtattacaggtgtgagccaccatacccgtctctttccatttggtttggaatagatactaaattccaaaacgtcaatattactgaaagtttgacaatgatgacatctgaatgatactctttctgctttgatgacaaattatcacctgttctggtaaatttcttgctgtgcttacgttttttctctttactttttccttatgttagtagatgtttcctgggtcttttttgatacattgatgtatttacttccatccattattaaaatggaaagttaatttacatatatataaaactaaattctgttttcacatattctaatttacacatagtaattgaaattttcaaaatccaaagtagcagattatgcttgtgtttactataaaggttattgcctatagtaaaatatgcaattcttctgaaattgtctactgttgtcaaccaagaagatgatgagtttaagtgttagaatacaggtcaaaagtgtaagttcaatacgttaaacttaagtaaacttgatttatatttacattaatgaagacattttaaaaacttattttctaggacaatcatatcctgattcagcccttcctccacaaaggcaagacagattttgttctaattctggtagactgtctggaccagcagaactcagaagttttaatatgccttctttggataaaatgggtaagaagtactttgtgcttttcttctttaaaaattttggtggcacactaaagaactggaagttagaataaagaccaatataattgctatctctagtagttcctaaggccaaaatctctttcctgaaaatgtcctggttttatgtttcttgttatattgtacacagacatggcatccaaatatatgttggtgggttggtttgagcaccatggaaataggtttactccatatacctatgatgataaattttactctgttctatgactaattttctaatttttctagtccacttacatgtgttctgtttagtaatcagggaaataagccaggcaaatgtgaatggatacataaaaacccaccagaaaacaatttagatgcatgctctgttgatattgtaatcagttatattaaacatttcatgcttagatataactaacatgtactgagcaatctactatttgtcaggctgtcttttacttaaactacctcatagcaacccattaaagttgggaaatagatgtatgcagtgtatcaaccagaagtacacaacgttaagaaaataaaaattttttttaaagtcaagatttaaatgtattggtaaaaggtttcctcaggaaaggacatatatttatatattattaaatatatataataaataatgttatatatataattttaaaaatattgattttctgacatagtagactatataatatagctgggactacaggtgtgcaccaccacacatggctaattttttgtaaagatgaggtttcgacatgttgttgaggctggtcttgaactcctgggctcaagcaatccacctgccttggtctcccaaagtgctgggattacaagcatgagacaccttgctcagcctggaaagtcagtattttattttatttattttttaattattatttttgagacagagtctctgttgcccagactggagtgcagtggctccatctcggctccactgcaacctccgcctcctgggttaaagagaaacccaggaggtttcacttgtgtcaagcacaagtgaaaaatgaccagtaagacaaggacatttataactggctgaagtcatggactttggagtctagttagttggggaaggaagtgagggaggaaactcagtggtcagaagcatcagtgacttccaaggacagatgtagtgagaataaatgagaaagctacaagaggagaggtagttgtggtcagagaggattgcatttcttgatgataacaaagttcgggaacatttatttcggaacagtagctaaatttcagtagctagtctctcttacttaatggaggaataaggacggaaggaagaagaggaggaaggagaagaggataggaggcaaacataaaaggagggaggaggaaaagaaggaaggagggagatgcttcctcccagatgtcttcttagcattctgctccagcaggattgcttaggaactagccagagaaataattgccacatgccatcatagaactctgagtctgccagaatttctagggacctcaagctgttcttgtggccgcaatataggatattggtgtccagctggcttatgtgccaacaaggggagtgggaaaataccaattttgtgatctggagatactctaggaataaagtgataaatcatgtacttttcatggtttaacttttatgtctagatgggtcaatgccttcagaaatggaatccagtagaaatgataccaaagatgatcttggtgtaagtattgaaagagtggaattgtatgcatgtattcagaagccttctttttttttttttttttttttttatggagtttcactattgttgcccaagctggagtgcagtggcgctatctcggctcactgcaacctgggttcaagcaattctcctgcctcagcctcctgagtagctgggactacaggcgtgtgccaccacacccagctaatttttgtatatttagtagagacggagtttcaccctgttggcgaggctggtcttgaagtcctgacctcagatgatccactcgccttggcctcccaaagtgctggtattacaggtgtgagctgctgcgcctggccctgagccactgtgcctggcctgtgccttctaatctcatgctttactagaatagaaatatagctaataatctaggttttgatataaagctgattttctctttttgattaatatactttctacttagcgtgaaagctgtttcttttgtagatggtaacctatggtgataaaatacaatttgcagactaggagtttgagttagtttaagattttagttccctccccatccttggatttttatttgaatattttaaagtatatttttgtttattaagatattgatttttggaaaatataaacatagacattttgctttttctttttttccagtatatatttgatacaatagtatatattttagtgctcttgggttaaatttctgttttatctttagccagactgttactttgttggttaaagctgttttctgttgacttaataaaatatttatgataactaaaatgtgatagctgatacattactgtggaaagctgtttgaatctttctctagagctttctaagactatcatggaatgctttctgtctagatgatttcttctaagcctgagattttcgggaaaatgattgcaaatttactgttttagtgactgccatatgtcaatttgttgtagaatttaaatgtgcctgattcatctctccctgctgaaaatgaagccactggccctggctttgttcctccacctcttgctccaatcagaggtccattgtttccagtggatgcaagaggcccattcttgagaagaggacctcctttccccccacctcctccaggagccatgtttggagcttctcgagattattttccaccaggggatttcccaggtccaccacctgctccatttgcaagtatgcttttttaaactttttttttaaagctcaatatgtggtttattaatcggagatttaattttactatctgttaatgtagtaacacagtggaggaaagttttttctagcattctgtgaatctgaaaattctcattacttttccgaattgggaaggcagccagccataagtggactgcaatgaggtttcagcttgattcatcttaataatatagaattatttctgtattttggcagtcaagaaaataatggactttttgcaggtcttacgataaaactaaaattatctgtaccttatttggtagcaactggttattctgacagttagtgaaaataataacttatattctagcattaaaattactggctaagatattttttaaagtctttttcataagtagttctgatgcagtcctacttatttaaaacttaaaatgtatttattacgtttgaccgaatttttggatttattgaattcttttaaagcttcacataagaaaaagggaataatatgttgcttttatattcatactttactgttttgaactatagggttctgcagaataaatatgtggttaccaaatactaggctttgcctatgaatgtctcatatagtctttccttcccttgtttctcttctctttttaaagttaaaggtgaattaaaatgaattttgtttggggaaattttaaggtggcctttgatattactggaaatgttttagtataatatcaaattagaattgggaatcactaatacgaattttaagtttgttgaaaattatattacatgcagatgttttttgaggactttgataatgaaagaaaaaagtgatttacagtaagttttatatattttgaaataattcctcttttttaaaaaacaggtgttaagataggacaaaaattacataaaaattaatgatatttcctttaatcatctgtatttgaagaggtacgtttttctcaatgtaaaaattaatttgttagatcaagtaattatctagtgtcaattttcaaataaaagaataggtaatggaagttataaacttaatgatttattagggcacagtacaggttcttaaagttaaaaaatgtcttttaccaatctctttgaacagtgagaaatgtctatccaccgaggggttttcctccttaccttcccccaagacctggatttttccccccacccccacattctgaaggtagaagtgagttcccctcaggtttgattccaccttcaaatgagcctgctactgaacatccagaaccacagcaagaaacctgacaatatttttgctctcttcaaaagtaattttgactgatctcattttcagtttaagtaactgctgttacttaagtgattacacttttgctcaaattgaagcttaatggaattataattctcaggatagtattttgtaaataaagatgatttaaatatgaatcttatgagtaaattatttcaattttattttagacggtataactatttcaatttgattaatccactattatataaacaatagtgggagttttatatatgtaatctttcaggtggggaggctttaaattctgaagtctgtgtctttatgccaagaactgtatttactgtggttgtggacaaatgtgaaagtaactttatgcttaaataaattatagttgatttaaagatttgtttggcattgataataataaaatcagtagtttttctataactatggctctattaacttttttccttttaccaataactttgaggtgcaaaactcaaacttatgtgggtcttttgtgttcaattatgttatgacaaatgtgctctctttcttgtaaatagacatgagtggcccaaagcaacaaattaatacacttttaaaagtcaaaattgattatattttaaagataaccaggatattatctaatggtgaattgtagaattttgatcttcttattcactgagtttcttgcacggtttctttattgcttttttttccccgcctgttcttttgtaaggtatttactattttctgtggaggatattgagatgtactacaggataactgtagtgaatgatgtgtcatcattttgagctttggactcaatatctttagtgtttccctaaatcagatttgtaggtcatgttaagcttcttgcacattaatatgattatggaaggaaaggcagtgaagcataactaataaacatcataatacttaa

SEQ ID NO: 1181 - DNA, 84071 bp, Homo sapiens; identical to SEQ ID NO: 1180

SEQ ID NO: 1182 - DNA, 84070 bp, Homo sapiens
cgcctccccgccttctcgcggctgcccggccgaaaccaaaccgaggggtggggtggcgaggacagggtacgtcgcaggcttgtgcgggtcgggctcggacctgcgctgcctcgggatgtaaagtataacaagagggtcgggatgggcagcgtaggcctgtgaggcctgcgggtgcccctgtcccccagctccccccgcagccggctccgcagtggtccactccggttgccgggtgcggattcgggttccggaccgaaggctgtgtgttctccgccgtttattgtggccccgacaggccggggttactgtggcgaccacgagagcagctttggcgctatggaggagcccggggttacccctcaaccgtatttggggctgctcctggaggagctacgcagggtgagcccaggcgcgatgagtgttacgtggcccaggggtcgcgggagccgccgggggaaggaagcagtagaccggctttggggtctaagccgccgtggtcagaggtcccgaagccagtcctcgtctgctgcccggctcccgcccgtgttcgaggcagtagttaggctcgtagggcgcttgagtggtttttgtgtgatggaggaggacctggggctctgggaaggtgaagaaagcacttgcttagctggactttgcaaagatgtaaatgtttcccgattcctaaaactaattagcctttccgctatgttgtttattttgagcagagacacgtggttccttcgactgtgagaaacttgaggactgttcctttaaattagttacatttactgatgtaacttctcgttgaaccttgaaagaacacctgaggttgggcggggagttgaaattttgattctgcattttttttttttttggtaaagaatgaatgcccttttgagatgctctaccatgagtgagattgttcttcgcttctgtcttgttaatgtacagtctagagatagtaaactcccagtgttcaaattttgttttttatttttcaggtctagtttataatcaagttgtagagatttttctccttaagtgtttctaggtatctttgttgacatgtgtaggggcatttatgtcgccgtgtttttaaaaactggattaaatctttaaaaagaccacttaattattgaggcagttacgattatgttttcttgttaggtgaattaaaggtagtgttgccatggtgtttatgagttcatagtttgtctaatgcatacgcatatatatgtatttaatatgaaaagagcacctttatggagattctaaatggactaagacttagttttggccactagcatcatgttgtctgttaagagagagaagacaaaaaaaaaaatagtacaaagtagaaactgatgaagtgcttacctaagcatacacacacagtgcagggaactaggagctgtattacttagagtgtaaagtgggcttagggagtgatgggcaatgatgcttgccggagatgtaagtaggttccaagtgctgtaggtgttggagagctcttgaaggcttttccgtggttagacttgtggtttaaaatttaagctcttcttgatagtagcatgtagattagatgttagggaaacaaaacttgaaatagggattaagggagaggtgacagtagtaaggataggaaagagggtactgtgtggagaaatagcctctaagagctaaaatatgtttgactttattgattgcatgtgaagggtgagagagaaggaatctagaaggactcccaggtttctggctgtggtaacttattcatggaggtagggtttttagaaagagaagcatatttccctttcttcactaaaaacaataataatcaagatttagtttttataggactgccagtgtacatggagaaatgcagaaatacatggagaaatgcagccagattttgcagttttctctagtctggtgcgttgtatcttcacctgcacagtttttttttttttttttttttttttgctaaatgcgagtaccctggcctgggggctaggatggcacaacattgttccgctttaaattttttttttatttttaaaaattattttgtattgagatatattcacacaacataaaattcatccttttataatgtccatttcagtgctttttttgttaaattcactatgttatgcaactgtcagcacagttcctcaacatttttattaccccagaaaataaactctactgattagcagtcttaattcccacccctcatcccttgacaaccactaatctattttctgtctctatgaacatgtctattctgcatgtgtcatgtagtcatgctatatgtggccttttgtctggcttcttttacttagcatgttttcaaggcttatccatgttgtagcatgtaacagagcttcatttcttttttctttctttttttttttttgagacagggtctcatccctgtcacccaggggggagtgcagtggcttgatctcagctcactgcagcttagacctctctggctcaggtgatcctcccacctcagcctcctgaataggtgggaccacagcacatgccaccaggcctggctaatttttttgtattttttgtagagacagggtttctccatgttacccaggctggtcttgagctcctaggctcaagtgatctgcccacctaggcctccaaaaatgctgggattacaggcgtgagccacttcgcctggcccttcatttctttttatggtgaaaaaatattccgttgtgtgactatatcacatttatgtcatagttgatggacatatggattattaatactttttggctattatgaataatgctgctttgtgtataagtttttatatatgtttttagttctcctgggtaagtacctgggtggaatcgctgagtcatatttaccatatgtttaactttttgagaactgccaaattgttttccagaggtcacaccattttacatccccaccagcagtttatgagggtttcagttttctgcattctctccaacgcttgtgattttctgttttcttttgtttttaattgccacccttgtgggtgtacaggtgagtggtatttcactctgttgtggtttttttttttttttttttgagactgagtcttgctctgtcacccaggctggagtgcagtggcatgatctcggctcactgcagcctccacctcccaggttcaagtgattctcctgcctcagcctcctgtgtagctgggactataggcactaaccaccacacctggctgatttttgtatttttagtagagacaggtttcaccatgttggccaggatgatctcgatctcctgaccttgtgatccacccgcctcggcctcccaaagtgcagggattacaggtgtgagtccccccacccggctttactctgttttttgttgttgttgttgtttgtttgttttgttttttaagagatggggtcttgctttgttgcccaggctggagcgtagtggcgtgatcatagcccactgctgccttaaattcctggcctcaagggatcctcctgcctcagccttccagagtgctggtgttacagatgtgagccaccacaccaggccttgtggttgttttgatttgtattttcctagtaactaatgatgttgagcatgtgcttattgtttatatcttctttggggaaatgtctattgatttccttttgctcatttaaaaaatgggtggtctttttattgttgagttataagcattctttatacatttagggtgctaaatgcttaccagataaatgatttagaaagattttctctcattctgtgcattttcttttcaccttcttggtgtgtcctttgaagcgtaagcgttctaaattttgattaagtctaatttatcttttcttcctttggttgcttgtgcttttggtatcatagctaagaaaccgttgcttaagacaaggttacaaacatttacagttatgcttccttctaagagttttagctcttacgggaagttcttcgatccactttgagtgattttgtttccatatatgttatgaagaatgggtctagattcattccttggcatgtggatatttattggcttattctagtatgatttgtttgaaagaactgtttttttctcattgatttgtcttaatactgttgaaaataatttaccataaatttaagggtttatttctggactctgatttctatttcattggtctgtgtctgtccctatgccattactacattatctttaaaacatttttttacccaatgtcttgattattgtttctttgtagtaagatacagtagggaagtatgagtcccccagcgttgtttttgtttatccacgttctttttctttatcaatattgttttggctatgtggagtcccttgcatttctatataaattttaggaattcagttttaggaatttaggattcagtttgtccatttctgcaaaaaaggcagttggaattttaataggggttgcattgagtctgttgatcagtttagggagtattgctctcttaataatattaagtcttccaagctgggtgcagtggttcatgcttgtaatcccagcactttgggagaccaaggtgagcagatcatttgagcccaggacttcaagaccagcccgggcaacttggtgaaactgttgtggtctttctgctccttagctcagctaggtccaagttcttgtctcacaaccaagaagaattaggcatgcggaccccagagagtgagtggaatagaatttattaagtgaaaggaaagctctcagcaaagagggaatgcagggggtggttcccctaccagaaggcaggaaagtccccctgtgtggctgggtctgcggccttttgtggactcagaatggggagtgcatgctgattggtttgtgagtatgcaaaaaaggttaaagcaaagacaccacttagaggtgggcgtgacaatgtagacaactaattaggaggccgggtgcggtggctcatgcctgtaatcccagcactttgggaggctgatgggggtggatcacgaggtcaggagtttgagaccagcctggccaacatggtgaaacccttctctactaaagatacaaaaaattagctgagcatggtggtgtgcgtctgtaatcccagctactcaggaggctgaggcaggagaatcgcttgaacccgggaggcggaggttgccgtgagctgagattgcgccattgcactccatcctgggtgacagggcgagactccatcccaaaaaaaagaaaaagaaaacttattagtaaagggtaggtatatgtaaaataggtgaaagatggggatcaatcagaggaaagtgggccaaacaagaaggcaagttctcaatctggtccaaggatttaacttgtggcttggctttcaggctttaaactgtctttggcttgaagttggggtttcactagggacccgcccctatctgcctgggcatttggctgcctcctgccactctcaaaatcctgtctttaaaagaaatacaaaaattagttgggcaaggtggcatgtgcctgtagtcctgctgcttgaggctgaggtgggaggatcatctgagcctggggagggcaaggctgcagtgagccaagatcgcaccactgcactccagcctgggtgacagactcagtccctgtttcaaacaaagaagtcttccagcccatggacgtggattggctttacatttatttaagtcttccttcgttgctttccacaatattttgtagtttcagtgtgcacttcttttgttaaatgtattcctaataatcttattctttttgatgctattatagatggaaatgttttctttatttcattttcaggttgctcattgctgttgtatagaaattcaactgatttttctatgttgattttgtattctgcaactttgctgaacttaatagctctgatagtttttctataggttctttaggattttctctgtgtatagaatagcattatgtcatcttcaaacagtttttcttcttcctttccagtctggatgccttttatttatttttctttcctaattgctctggctagaacctccattacaatgttgaatacatgttgatagagcggacattattgttcctgatcttaggagaaaagctttttttttttttttttcctcatctttaagtatgatgttaactgtaggttttgcatagatgtttcttgtcaggttgaggaaattccctcaaatcgtactttgttgagtgtgttttgttttttttgttgtttgtttgggacagggcctcactctgttgcccaggctggagtgcagtggcatgatcatgattcactgccgtctcgacttcctgggcacaggtgattctcccacctcggccttctgagtagctgggaccacaggcatgtgccatcatgcttggctaatttttgttgaatgttttgactatgaaacggtgctagatatagtcaaatgctttttctgtgtctattgagatgatcatgcgttttttttttctcttcattttcttaatatggttcataagattattgtatgttaaaccaaccttgcatttctgggataaatcccacttggtcatggtacataatcctttttatatgttgctggatttggtttgtcaatatttttttgaggatttttgcatctggagtcataagatatattggtgtgtgattttcttttcttgtgtgatgtatttgtctggcttttagggtaaataccagcctcatagaataagttaggaagtatttcttcctcctctatgtttgggaagagtttgagagtgattggtgttaatgttttatcttggagaggtgtaccttcatggaactttgtgttatagtcaagtattcacagggtctgcatgttgacattctttttgttattagtatatatcatgtttgaagttagatgaaaaacaattttagtttattcttagtatattttgtcaacctgattaattgattttttttaaagctacttgatcttgaactcctttagtactcatgttttggaaatggaatagattttaagtgttctgtgattaatcactaccgtactttatggagggttactcttggaggggttacccatcaccctttaaatttcagtttatcagattacatgtaattctgtattatatttgttgatatttgagaaatttggttgttctttctatgtttttgtgagatagggtgttatgttgtagataaaatttaagggtgaaaaatctccttgagaaagccagaataatttagaccagagcaatgaatttgagatgaatcctttagaactcagtttctttttttctttttttctttttttttttttttgagatggagtctcactctgtcacccaggctggagtgcagtggcgtgttcttggctcactgtagcctcctcccgggttcaggcaattcttgtatctcagcctcccaagtagctgggattacaggcttacgccaccatgcccagctaatttttgtatttttggtagagatggggtttcaccacgttggccagactggtctcaaactcctgacctcaagtgatctgcccaccttggcctcccaaagtgctgggattacaggcctgagccaccgtgcgtggccaagactcagattctttgcttttctccagtctgccagatctaaccagctcaaggctttattttattttatttttttaaagttttttttttttgtaatcccagcactttgggaggccaaggcaggtggatcacctgaggtcaggagtttgagaccagtctggccaacatggtgaaaccctgtctctactaaaaatataaaaactagccgggcatggtggtgggcacctgtaatcccagctactcgggaggctgaggcaggagaattgcttgaacccaggagacggaggttgcagtaagcctacacggtgccgctgtactccagcctcggcaacagagtgagactccgtctcaaaaaaaaaaaaaaattttttttttttttaaattattccttaatttccatgtttccttaatcctttgtgtgtgtgtgtgtgtgtgtgtgtgtcagagtccagttttgttttgtcacccaggcttgagtgtagtggtgcgatctgcagcctttgcctcccaggttcaagtgattgtcccacctcagcctttctagtagctggaactacaggtgcctgccaccatgcctggctaatttttgtatttttagtagagacagggttttgccacgttggccaggctggtctcaaactcctggcctcatgtgatccgcctacgttggcttcccaaagtgctggcatgagccactgcgcccggccctagctcaatgctttaaactagaatttaccatgtccttttagaagagaagagctgataaaatgtgattgaatctaagaaatattattgtactaaaggtaattacgtgtttgatctgagagatgcttttggaattgccttttaaagtagagtgtcataggtcatattgattacacaatttttgagttagtgtgcgtcttatgtgttgaatacattagctaaaagtaagatgcttggaaaatgtgtaaactgtgaagaaaacttttcttcctggtattgtgtattgaatgccttttttcccccaatagcaaaaataatttttttttatcattaattgcttgtaatgatattagatttctgcgaactggtacctagggtaatgtagggagaggcagaagcagagatcagggtaaagggatattttttagaagtataatcaggtttgtttggtacaggttatgaagtatagatagtaccttggaaggagtacatatttggattagagttataaaagattttggagaggaaaataactattaaacactgttcttataggcagaaagggcctaaaaggaagatttgctgtagaggttttgggttaaagcctgaaaagaatcaaaccccatcatacttcagattgttcttaaaatggcatttttcttttttccccttacctttccccttttctttttgatcaagtaatatcttgggcctggtaacaaagagcagaataaccccattaggtaaggatgagtaatgagctgacccagagaaaggtgaaatatagaagcaacagcaaaagccttaggctgtgttgtgctgaaggtctgctgtggggagaagtaatgtggaaaggccatggtcagaagatcagggtctttggaggagataatataaataattacccttttttgagcacctgtctggcatgttcaaacagcattattctcattacacttaagagaagggacgcacagaggtagggtggggagattcaaactccaaacccaaatctctatcagtggtgttcaaaacttgtttttattttttgagacaggtcttactttgttgcccaggctggctttgaatcaaactttttatttttaaagctgcaaattgattttttcttcctgtagggaaattgtatattggggaactgattatactttacagataaaacctgaactggttgaaatcagggtaagagtacctgaaccctaggtcactcagtttctttctttggccttctcttattctcatccttggaaactttaagtcacctctgtagaactccagtttgaagataattgcatttcaccatactgctgttctttacttggcgatagtgattgaaagttgacaaaaaaatgtactctgatactttctgtttggtgttagtctggcagcccattttgtgttgaccacataaacttgtacctatgtttgtaatcaatatttttaccaaaagtacatttttaagaacttacttttctttatcttgaaggttgtggcagcactgcctgaaggtatgagaccagattctaatctttatggttttccatgggaattggtgatatgtgcagctgttgttggattttttgctgttctcttttttttgtggagaagttttagatcggtaagtaaccagtgctatactaagagaatgttcattttgtcactgggctgaacaaataatatgagaaacatatttgttattttaagtaaacaagttagaaactacatagggattcagaggtttttgttttttgttttttgttttttttaaaagagatgagggtcaggaatgagagtcaggcccagtgctgtggctcccacctctaatcccagcactttgggaggccaaggcagaaagatcacttgagcttaggggtttgtgaccagcctgggcaacacggtgagaccccatcactacaaaaaatacaaaaattagctggacatgaggacacccgtctgtggtcctggctactcaggaggctgaggtgggaggattgcctgatcctgggaagtcgatgctgcagtgagccatggttgtgacactgtactccagcctgggtgacagagagagaccctgtctcaaaaataaagagatgagggtcttgtgttgctcaggctggtctcaaactcctgggctcaagtgatcctcctgcctcggcctcccaaagtcttgggattacaggtttgagccaccatgctcaactggaatcttttaatgtaagatcttttatatatatatatatgtgtgtatatatatatatatatatatatgtgtgtatatatatatatatatatatatgtgtgtatatatatatatatatatatatatatatatatttatatttaaagagatggggtctcactatgttgcctaggttgtagtgcagttgctattcacagatgcaattatagtgcgcctacagcctacagcctcaaactcctgggcttaagcaatcctttctcagccttttgagtagttgggactacacaggtccatgtcactctgcccagcttcatcttttttttaattctgggaaattttatttgagacaggatttcactcctgtcacccgggctggagcgcagtggcatgatctcggctcactgcaatctctgcttcctgtgctgaagcaattctcctgcctcagcctcctgagtagctgggactacaggcgtgcactaccatgcctggctaatttttgtatttttttgtagagacgggtttcactgtgttgctcagaactcctggcctcaagtgatctgcctgccttggtctcccaaagttctgggattataggcattaatcaccacgcctggcctaattttgggaaatttttaatgcatttttgggactgctatttttcagatgttgccccttttacttctgacttccctatctcttaacttctatttttcaatttctttatggttttctataccttttgagagttccttaatctgaggaactgaaatctattcttcatctacactcattgtagagtatcttgtcttttaaaggttttcccttttatctctatccatattctgtagatgattgaagtcctcatttcttttctacttgtttgtgttacctcagccctaaggctgatccttttacaaatgaattcccgcctgcttcattatttgagagagaggttaaggaagaaaaaggtttggtttactgtttctttagtcagttcagatctatggccctatggtaacatttctcaggctgttttattttggatattggcatcaagggatatgataataggggcttcttgaaattatttttttagggtcaaatttgtttggggagcaatgggttaaatgaaattaaacaagtatctttagagtaaagttatttcagagtctttaatatgctaattcacaatgtgaatcttcaatagggagtctttaataagtagtatttaggctgggcatggtggttcatgcctgtaatcccagcactttgggggacccaggcaggtggatcacctgaggtcaggagttccagaccagcctggccaacatggtgaaacccggtctctactaaaaatatgaaaattggctaggcatggtggtgggcacctgtaatcccagctactcaggaggctgaggcagaggaattgcttgaacccaggaggtggaggttgcagtgagctgagatcgcgtcattgcactccagcctgggagacagagcaagactctgtctcaaaaaaaaaaaaaaaaaagcatttattttctcattggaaacagaatacttttggcttgtatttatacaaaggcaataagaaacctgtatttctaagttggcagtagacgttaaatgaattgatttacttgagagcgtatttgttttaatgtaatttttgttaaaaatttgtttcaggttaggagtcggctttatgtgggtaagttcttttttctgctttgactctcattgttgtgttgtaaaaacttataataatttactcatggtaatattgacttgacttttttaggacgagagaaaaagcttgctctaatgctttctggactaattgaagaaaaaagtaaactacttgaaaaatttagccttgttcaaaaagaggtaagatatttttgaaaataatattcatgttagagtcagagaactttatacttctcactgtaggtacttctgtgtaaatttaagattatgaatgctttgtttgcagagtatgagagttctctttgctcttcatattcaacacttaaccagtcttactaattttaaccattgtagtaggtgtacaatggtgtctccttgtgctttccttttgagttttcctgactgatgaggtcgagcacacaaacacatcctctgcatgtgcacatttctggtatctgttcgtgtatccaaatgttctcttttcgtaaagacaccagtcagattggattagggcccaccctaacaaccttattttattttgaccacctccaaaggccttgtctccaaatacagtcacattctgaggtactggggttggagcttcaacatgtgaatttgtggggacacaattcagtccataatagtctttgatccatttgaaatcagatctgtgatggtgcagttgagggtgtgtgtgtgtgtgtgtgaagattcattttttttcctgggcgtgtcgagttaatgccatttattggaaggaccatcttttctctgttgttctgtagtgtcatcttcttaagtcactgaatatatgtgagtctgtttctgttaaatcttctattttgttgggctttttgtttgttttttgccaataacatgctttttatagcctgtagttttataacaagccttagtatctggtatggttaatttacagttcttggctattgtgaataaagttactgtgaacattcttctacaagttttttttttgtgggcatgtattttcatttctcttcataagtagtagtggaattggtaagtcattagggcattagggcaggtatagtttaactgtgtaagataagaaaccggctgggcacggtggctcatgcttgtaatcccagcactttgggaggctgaggcgggcaaatcacgaggtcaggagatcgagactatcctggctaacatggtgaaaccccgtccctactaaaaatacaaaaaaattagccaagtgtggtggtgggtacctgtagtcccagctactcgggaggctgaggcaggagaatggcgtgaaccaggagacggagcttgcagtgagccgagattgtgccactgcactccagcctgggcaacagagtgagactccttctcaaaacaaacaaacaaacaaacaaacaaaaaaaccctactggctgtttttatcattttttcttggttttggctctcagcagtgttactatgatttgtctaggtgtggtttttttctatttgtccttattggggtttatgatgcttctagaatctgtggcttaatgtcttttattagtttagtttttttttttttttttttttttttgagacagcgtctctctctctctcttgtctaggctgcagtacagtggtgtgatcttggctcacttcaatctccacttcctggactcaggtgatcctcccacctcagcctcctgagtagctgggattacaggcatgcgccaccatgtccagctaattttttaaaatttcttgtagagatggggttttgccatgttgtccaggctggtctcgaactcctgggttcaagcaatcctcccgtcttggcttcccaaagtgctaggattacagctgtgagccaccgtgctctaccttttattagttttgaaacactcttgattgttacttttccacatattgtttttgcccttttttgttctttctttctgggactataaaaatgggtattttaactttttattatatctcatctgtctcttacgttcttttccagggtttccatctttttgtttgcccacacttcagtctagacataatcttctttaacttccatgttgccaatagttttcacttatgcctataatcatcttttaaaccatccattgagatcttaatttcatctcttgcctttttcagttctgcagttttattgtggctctttttgtagttctttttctctggtacaattctattttttaattccatttacacattatgctctcttatttttgttttgttttgttttggtttttttttttttttggagacggagtttcccctgttgcccaggctggagtggagtgcagtagcgcgacctcggctcactgcaacctctgcctcccaggttcaagtgattctcctgcctcagcctcccaagtagctgggactacaggcacacgctgccacgcctggctaattttttgtattttagtagggatgggtttcactgtgttgctcaggctggtctcaaactcctgagctcaggcaatccacctgccttggcctcccaaagtgctaggattacaggtgtgagccaccatgcctggcctatgctctcttattttatttatttatgtgttatttttattttctgattttcagaatatatgctgccgacaaatatgctttcttattttaatgactactgcattatccagtagtctatttctggtgctcattttttctcttgtttctcagtcaagtcttgtccgcttgaatgccaggttattttatatgaagtgtcagtgataatataataaaaattgtaaagataattttgaagctgtgggtgctgtcgtctctcttcagtgaggatttactgttgcttttcataggcagctaggctagggacattggaaatttcagataactttatgtatttgactttcttttatgtaaaataagttttattgtgtatatttaaggtatagaaatttcagataactttgattttgttttttgtaaaataagttttattgtatatatttaaggtataaacatgatgagatacgtgtatagtaaatggttactatagtgaaacaaattaacgtattctttctctctcatagttacccattccctgcccacccctccagggcagctataatgtactcatataacaaaaatcatgaatgcagtacactattattaactatggatctcatgttgtacatgagatcttttaacttgttcatcccatatattttcttttcttttattgagacagggtctcattctgtcacacaggctggggtgcagtggcatgatcttggctcattgcagcctctatctcctgggctcaagtaatcctcccacctcagactcctgagtaactgcggctacaggcacatgatacatgcttgcctgatttttaaattttttgtagagatggggtctccctatgttgccaaggatggtctcaaactccctggctcaggtgatcctctcgcctcagcctcccaaattgttgggattacaggcatgagccaccatacccggccatattttctgacctacatgtttcttccctcctacccaacactgctaaccactgttttgttctctatctctatatatttgacctttacaaaaattccgcatataagtgagatcatgcaatatttttctttctatatctggcttattttacttagcaaaatgtcttctaggtccgtccatgttgtagcaaatggcaggatctccacctttttatggctgagtaatattccattgtaaatatataccacagtttctttattcgtttgttcattgatagatacctaggttgtctccatactggctactgtgaataatgctgcagtgaacatgggcatgcagctgtgtgtagaaggtgccaatttcatttttttcggataaatatctggaagaaggtttgctggatatagtagctctattttaaatttctttaggagtctccatactactttctgtagtgactgtacccatctacatccctgccagtagtgtacagtaagccctcaatgtccttgatagatggttgaaaattgactttaagtgaaacagtgtatactgaattcagtttttttttctcatcaatgttataatgaaacaatgttgaagaaaacaatgttattcaaaggacaaaggacctgctctatgcctttctcttttcttgtctagaaaaagggttcccttttttttgtaacttttaagttcaggggtacaagtgcacatttgttacataggtaaacttgcgtcctgggggtttgttgtagagggttcccttttctccacaccttcacaaatacttgtcatctctcttgtctttttgataatagctattctaacagatacaaggtagtatctcattgtgtttttgatttgcatatccttgatgattggtgatattgaacaccatttcatatacctgttggccatttttatgtcatcttcagagaaatatctatttaagtcctttgcctgtttttaaatcaggttgtatgtttgcttgctgttgagttgtatgaggtcttttaaaatattgaatattaaccccttatctgatatattttttctcaatctgtaggttgcctttttattgtgtttacttgtgtatatttttattttttttaccttgcagcttcacctcaaaggaactttcattttattgtttcttttgctttgcaaaagctttttagtttgatgtagtcctgttcacttactttttgcttttgtagcctaagttgttgatgtgatagtcaataaattattgccaaggccagtgtcagggagctttttccctgtgttttcttctaggagttttgtagtttcaggttttatgtttaggtcttttatccactttgagttgatttctatgtgttgtataaagttaagagttcagtttcattcttttgcgtgtgaaatccagttttctcactaccatttattgatgagactattctttctgcattgtatattcttggtgccctattgaaaatttgaccatatttatttggatttatttctgggctctctattctgttccactggtctgtgtatttgtttttatactagtaccacgttgttttcgtgactacagctttggaatataatttaaaatgagttagtctgatgctgccaactctatttttctcagaattgctttgactatttgggatcttttgctattccatattaaatttagattaaaaaaatttctgtgaagaatgccattgagattttggctgcgtttccatttctttgtgtgctcctcaatttctttcatcaatgttttatacttttcagtgtgcagatctttcacctccttggttgaatttgttcctaggtattttattttttttgatgctatgtaaataggattgttttctttttttttcttttttttattttttttttattgatcattcttgggtgtttctcgcagagggggatttggcagggtcataggacaatagtggagggaaggtcagcagataaacaagtgaacaaaggtctctggttttcctaggcagaggaccctgcggtcttccgcagtgtttgtgtccctgggtacttgagattagggagtggtgatgactcttaacgagcatgctgccttcaagcatctgtttagcaaagcacatcttgcaccgcccttaatccattgttaaccctgagtggacacagcacatgtttcagagagcacagggttgggggtaaggtcatagatcaacagcatcccaaggcagaagaatttttcttagtacagaacaaaatgaagtctcccatgtctacttctttctacacatacacagcaacaatctgatttctctatcttttccccacctttcccccttttctattccacaaaaccgccatcgtcatcctggcccgttctcaatgagctgttgggtacacctcccagacggggtggtggctgggcagaagggctcctcacttcccagaaggggcagccgggcagaggcgcccccccacctcccggacggggcggcggccgggcgggggctgccccccacctccctcccggaaggggcggctggccgggcgggggctgacccccccaccttcctcccggacggggcggctggccgggcgggggctgaccccccacctccctcccggacggggcggctggccgggcgggggctgaccccccacctccctcccggacgggatggctggccgggcgggggctgaccccccgacctccctcccggacggggcggctggccgggcgggggctgccccccacctccctcccggatggggtggctggccgggctggggctgaccccccacctccctcccggtcggggtggctgccgggcggagacgctcctcacttcccagacggggcagctgccgggcggaggggctcctcacttctcagacggggcggctgccgggcggaggggctcctcacttctcagatggggcggccgggcagagacgctcctcacctcccagacggggtcgcggccgggcagaggtgctccccacatctcagacgatgggcggccgggcagagatgctcctcacttcctagacgggatggcggccgggaagaggcgctcctcacttcccagactgggcagccgggcagaggggctcctcacatcctagacgatgggcggccaggcagagacgctcttcacttcccagacggggtggcggctgggcagaggctgcaatctcagcactttgggaggccaaggcaggtggctgggaggtggaggttgtagctagccgagatcacaccactgcactccagcctgggcaacgttgagcactgagtgaacgagactccatctgcaatcccggcacctcgggaggccgaggctggcagatcactcttggttaggagctggagaccagcccggccaacacagtgaaaccccgtctccaccagaaaaatatgaaaaccagtcaggtgtggtggcgcgcgcctgcaattgcaggcactcggcaggctgaggcaggagaatcaggcagggaggttgcagtgagcggagatggcagcagtacagtccagctttggctcggcatcagagggagactgtggagaggggagaggggagagggagagggagattgttttctagatttcgtttttggctaggtcgttatttgtgtatagaaatgacatagttttgttttgatattatatcctgcatctttactgaattcagttattatatctgtatttttgatgacatcttttgggttttctacatataggatcatgtcatctgcgaacagataattttacttctctgatttggatatcttttctttccttatccttctcttccttccttcttactttttttttttttttgagacaggctctcactctgttgcccaggctggattgcagcagtgcaatctcagctcactgcaacctctgcctcccgggttcaagtgattctcccacctcagcctcccaaattgctgggattacagatgtgcactactgtgcctggctatttttctgtgtgtgtgtgtgtgtgtgtgtgtgtgtgtgtattttttggtagagacagggtttcaccatgttggacaggctggtctcgaacttctgacctcaagtgatctgcccaccttggcctcccaaagtgctggcattacaggcgtgagctaccatgccaggccttttatttctttttcttgtctaattgctttgatagtacttccagtactattttgtttttgttttttgagacaaggtctcactctgttgcccaggctggagtgcagtggcatggtcatggctcactgcagcctcagcctcccgggttcaggtgtttctcccaccttagcctcccaagtagctgggactacaggcgtgcaccaccacgcccagttaattttttgtattttttttgtagagatggtgtttggccaagttgcccaagctggtctcgaacttgggctcaagtgatccgcttatctcagcctcccaaagtgctgggattacaggtgtgagccaccgcacccagcccttccagtactgttttgaatagaagtggtggttgtgggcatccttgctttgtaccagatcttaatggaaaaggtttcagtttctccccactgatgatgatatttgctgtaagtttttcataaatggcttttgttatgttgaggaactttctttttattttttttcattattttaaaaattttattatttattatttatttatttttttgagatgaagtcttgctctttcactaggctggaatgcagtggcgtgatctcggctcactgcaactctgcctcctgggttcaagcaattctcctgcgtcagcctcctgagtagctgggactacagtcatgcgccaccatggctggctaattttttgtattttggtagagacggggtttcaccatgttggccaggatggtcttgatctcctgacctcatgatctgcccgcctcggcctcccaaagtgctgggattacaggcatgagccactatttagttttttgagacaaggtctcgctttgttgcccaggatggagtgcagtggcatgctcatggctcactgcagcctcaacctcctggggtcatgtgattctcccaccttagcctccctagagtagctgggactacaggtgtgtgccaccaagcctggctaatttgtctatctttggtagagatgtggttttgccatgttgcacaggctggtctcgaactcctcggacttcccaaagtgttgggattacaggcgtgagccaccacacctggccagaactttacttctatacttaaactgttaagggtttttatcaagagatgatgttgggctggacgtgagggtgtgtgcctatagtcccacctacttgggagcatgaggtgggaggatggcttgagcccaggaattcaagtccaacctgggcaacataggagaacctatctctcaaaagaaaaaaaaaatggatgttcaactttgttgaatgttttttctgtgtcaattggtatgatcatgtggtttttgtctttcagtctgtgaatgtgatgtatcacattaattgatttgagcgtgtatatattatacatatatatatatatatatatatatatatatatatatatatatatttttttttttttttttgagacggagtctggcgctgtcacccgggctggagtggaatggtgtgatctcagcacactgcaacctccgcctcccgggttcaagcgattctcctgcctcagccacctgagtatctaggactacaggtgcctggctaatttttgtatttttagtagagtcagggtttcaccatgttggctaggatggtctggaactcctgaccctgtgatctgtccgcctcggcctcccaaagtgctgggattacatgcgtgagccactgtgccggccaatttgcatatattaaaccggctttgcatgccagggataaataccacttgatcccaatgcataatctttttgatgcattgttaatttcaatttgctgatattttatttaggatttttgcatcagtgttcatcagagatattgacctgtaggtttgtttgtttgtttatttatttattttttgtggtttcttggtctggcttaggtatcaaggtgatgctggactcataaaatgtgttaggaaatattccctcctgttgtttttcttggaagagtttaagaagtcttggtaataattctactttgaaaatttggtaaaattcagccgtgaagccatctcttcctgggcttttctttgttgggaggtcagattactttaataacagattgagatatttggaagctgggcctcagttcagaggattagtctgtttttggtttcgactttgttgtaaggtaggcaggttttctttttttttttttgagacagtcttgctatgtcactcaggctggagtgcatgatctcgactcactgcaacttccgcctcatgggctcaagtgattcttgtgcctcagcctctcgaatagctgggattacgagtacacgtcaccacgctcggctaatttttgtatttttagtagagacagagtttcaccatgttggctaggctgttcttgaactcctgacctcatgatccctgtgatctggcctcctaaagtgctaggattacaggtgtgagccactgcgcccatccaaggtaccagttttggttggtaaggacattaatttccttttgctgctgtaacaaattagtgcaacctagtggtgtaaaacaacacacatttattctcttaaaattttgaaggtcagaagtctagaactgatcttttaaaaaatattttgttgtagagatgggatctcactatgttgcccaggctggccttgaactcttggcctcaagtgatcctcccacgttggcctcccaaaatgctgggattacagacatgagctaccatgcccagccttaaaaccaatcttgggggcaaaagttaagatagcagcaagtttgtttccttatgcatgttctaggagagaatctgtgtcttgtgtcttatatggagtctaccaacatttcttggctcataactatgtcaccccagtttctgcttctatcttatatcattcttttctaagtttggtcgtcttgcctcctccttttaaggacccttggcattatattgggcccaccaaaataattctggatgctttttccgtcttaagatcctttatcacacctggacattctggggagcagaacatagacatctttggacaggtcattgtttagccaagcacagggttcatctgacttggcaggtcctgaactccaagtgttttttctcagcttctgattctcctgaaatctctgcttagtttcttagcccatcagcctcttcttctagggggaatagaaatgtcaaatactagacttgcctttctggggattcccacttctctcacaaattctcactgttttgatagctctctgaggctttcagacagatatatatttttttttttggtattttttgtcaagcttttcttgttcttgccagaaaggtggatccagaacaacgtagtcttcaatttgatcactttttttgaataattgaagtgcattttgccaaatcttatagcattatatgttttattgttcattttttgatggttgttccctaccttttaaagatttttatattccccacctgctttatttgttgtatggtatggattaaaagtgaaaagttttgatggtcagttgctatatatttctctttaatgaataggcttaaagaagaggtttacttgtttggggcataattagacagcttacgtaaaaatacgctctttgagtaaatctttggataatctttagtacaatcttaccattagaatttttacttcatttttagtaaaagatgctaatatgagttatagtcctatgttctctgagaagcagactttactcttagaggtgaagttctggcatttgttgccagagctagtggtttgtgatgtgttagctgctctggcattgtttgttgtagtggtcagatttaaaaaacttaaagctaagtaaatccaagtaaatttaatgtattatgtggaaatggattctgtctgcttcttaggcatctatccagataagatttagaatacaattggtagagtttttacttgtgatgttgctttgtttcagtatgaaggctatgaagtagagtcatctttaaaggatgccagctttgagaaggaggcaacagaagcacaaagtttggaggtagaaaatcaaatggtataattttaaaagctggggaaaaaaatactaagtaacaaaaactttaaaaatgtatcttctgaaaactatttgaaaaaaatgtgaaagagcatctctggatgttaaaacttaaataagaaaattaatataggaaatgggacaataggaggtagcataaaatattataaaaatttaaaaatttgagcttttattgctaacttgttttgagtcaggcatgtttatgttcaaggaatcaggagctgtatagaaacttcgttctattattcctgggaaatgtattaaggtgatcgttccttttttgactcagtttgctctagaaaggagaaataagattcatttttacaaacttaggaatagttggcaacaataactttgtaaattatgacagtatttgctttattttcatcctgaggatattaagagctaactagaattaggccagaggtttacgttataagtaatggtgtatgttggtaaatgtttgacaactttttttttaaaaagcagccttatttgtagcatttgctgagttctgtagtatgaatacttccaccatggccagtttcaagctaccaacatgatgtcactgaatgaggagtcttggaagataatgcttaaagtaggctttcctgagccaagtgtgatttggttaattttaaggaaggaaagtatggtaatttgtaatttagctaaactaagacagattagggtaagtgatgggagtgccttactactgtttagatgtggacgtgttgtaaaaagcacagaagtgacaaaggatagcagaggacacctgcgtctgcagatactaaaacagaaaacagtagaccttgtacctttgataagcgtctagtacagtgtggcagttctcaatcactgctctccgtaatcatcagaaactctatgtgttatgattcagaattttctagtagagtccaaaggaagttataaattggattccaaataagtttcttaatgttttcttcatttgttgcctattactatcttcaagaacttgttgaaattatattttatttgctaaccctctgtcttaactacccttccattagtaatttatgtttgataaaaaaattttagaaggcatttgacatgctaacagaagagcaaaaagtaggtagcaaagacatttactcaagcttggtaatactgaggataaaatattacacatcaatttattttcaaggtaatgaattattataggagtaaaattagctgaatttttagctgcattcaacattttggaaatttttcttcaatttcagtaattttttagcatagtattttcagtaatagtaatcataattgaattcaaactataatgtgatgcaatttaaaaaaatatgatagctgaatctgtagataaaatcaaaccagtagagtaattttcattcgggtcagggaattcctagaatgaaatattcaaatttggggtaatatgtataaacaagtttttaaatcactgtaatgtagtatgtattttttttgcttttattttggcctgcattaaaatctttgaatcttttggtttatttttctttaacaagtttgttgaaggatcacaaatatcagaggtatgtttattatagtatttaaaatccatttggaataatccaataactaatcattttaaattaaaaaggtcatagaaaataggtcttaattcaatatggaatattatcatgaagcagccttgatttttttttagttgattttttatgtcatgcctttaattgtattaaattggctttatttctcatttttttctttatagtgcttttaagcagaggttggcaaactgtgcctaatgggctctccacttttttttgtaaaaaattgttttggaacacagccatgctcatttatgtaggtattgcttttgtttctcactgcagtggcatagttgagtaattgcaacaaagactgcatggcctacgagcctaaaatatttattctctggctctttacagaactttgctgaccactgctacaattgctgttattttgatattataaaaatgagcaaatgtataaatgaaagttatttaacttatagtacatattttttattatgctcgtctgatttccctaatgaaaaattcttatatctgtttaataaagttggctttctctcttaggcaacctgtgaaaagctgaacaggtccaattctgaacttgaggatgaaatactctgtctagaaaaagagttaaaagaagagaaatccaaacattctgaacaagatgaattggtaaggcttttttatttgaggagaatataagaaaaagaaagttactgagctttaaaaaattaatatgatactggttaaagtattacattattgtaaaaaatgtaaagaatacaggtggttgtagagagcaaaattttctagatccattcttttcacttcccccagatgttactgtgttaaatttcttgcatatttttatagaaattttctatatgcactatggaagtagctcatgtaaataaaaactgaataatcatgtccatagtgtatatttgtaattacttaacatgtatattaacattaaaactttttcttttgaaaaaacctgtcttaatgaaaatcttgatgtatgtgagattatttagtaaaacatgttagtggacttatcttgagcctatataacttaaatgttatgaaatattaaagttatgagatactattgttacgtaatgttcatataaaatcccttttagcatatggctaaataaactgagaaggtttcttaatttgagcttcacttatggagctaaagtgttaggttaacagtatatctaataaacatggcattttggaaactagagtttagtaaatattaattgcctgatactgtgtttctagatggcggatatttcaaaaaggatacagtctctagaagatgagtcaaaatccctcaaatcacaagtagctgaagtaagttgaattagtctagtaggtctgttgcttttggaaataattttagtttaattttttaaaattaagaaataagacacaatagtaggatttgagatataggggatcccagatatgtatttttttttttttaacaatacctaaatgaattagcatggctgtgttgcccaggctggagtatagcagcacgatcttggctcactgcaacctccacctcctgggttcaagcagttctcctgccttagcctcctgaatagctgggattacaggcatgtgccaccacacccggctaagttttgtatttttagtagaggcagggtttcaccatgatggccaggctggtcttgaactcctgagctcaagtgatcggcccacctcggcctcccaaagtgctgggattacaggcatgagccaccacacccagcttgtattttttttttttttacgtgaagtgcttcagaaaagttcatcttttcagtggacaagtgtttattgagctattactatatattgaggactggttgcttgacacttaacattaatagacaaaaaagtccccaggaagtttaaattttagtaggggaggcagaataaatagttatcaaaatttgctgcacagtacatagaaagttacaagaggtttgtccaaggtcacatcgtagcaagttagtgggaaaggcaggactagacctggattctagacaagccttttttctgctacaccatgctgcctctgctgttaatattggcatggttttgcctttgtttaattctgtgttctagggagtatgtgtaaagatgagctatgtattaaattaattgttacaaacttgacattttttgtttcacttaggccaaaatgaccttcaagatatttcaaatgaatgaagaacgactgaagatagcaataaaagatgctttgaatgaaaattctcaacttcaggaaagccagaaacaggtttgtgctccgtagggactcttcaacttgtgaatatgtaattatagatgttcttgtcatcctcatgactgacccatgctagggacaagtataggcttttccttgagagcatgagagcaggacagtctcccatacatatttcagtgtctgtctcttttgtatagtatacaaaagtgtatacttttggcaccctctaccccagggcagggaaagtaagccagggcatttagcattttggtaatcataaccaacttcttaaagccatgccgaaggggtacagagaatatgagtgaggattattgaagttatagatctggggtctaaagatagaaacaattctggtggcagatcacataaggatgtgacatttgccctctttctcccccacatacatagatactcccacgtatatttcttcttctcctttgccaatgtaattgtaacttttcagtgggaaaatttttcagtgattaaattattataattatccaaatattactcacaccagagccacatggtttgttcttttttttttattttttaattttttagacggagtctcactctgttgccaggctggagtgcagtggcgtgatctcggctcactgcgacctctgcctcccaggttcaagcaatttttctgcctcagcctcccgagtagctgggactacaggcgcgcgcctccacgcccagctaatttttgtatttttagtagagatagggtttcaccatattggccaggatggtctcaatctcttgacctcgtgatccgcctgcctcggcctcctaaagtgttgggattacaggcgtgagccactgcacctggcctcatggtttgttattacatattctgtcttattcaatattttccttagggttaataattgttttgtttcttgtatacttatccggttcatctgtatgctgtcttctagagatacagatatcttattcatgccttcaaatgctttgtttaatctgttaattgcattttttttttcttgaagcagttttttctttggcctcccttggtttcataagaacttattctgtaggtgtgtgttctgttctgtgtcctaagatttcacttcacccccatcctaaaggttcctcttgtctttctcctgtgttagatcttttattttccatatctgagcccttttgcggttaattcttttggttaattttctgaggaagaggtataggagataatttttttagaacttacatgcctggaaatgtcttgtttctcatacttgttgatattttggttgaatatattctgggttggcattttttttttcctcaaaattttgacactgtcactccattgtcttgactttccaatattgcttttaagaagtcagaagctattcagataattggtcatttttggaaatctgcttttttcctcctggaagcttttaatatctttttattgtttccccttctctgaaattacagatcattacacatctcttgacctcgtgatccacccgcctcggcctcccaaagtgctaggattacaggtgtgagccaccgcgcctggccacgggcggggttttcttttcttttctttttttttttttttaatttttatttttattattttttttttattatactctaagttttagggtacatgtgcacattgtgcaggttagttacatatgtatacatgtgccatgctggtgcgctgcacccactaatgtgtcatctagcattaggtatatcttttctttttgttgttttttttttgtttttgagatggagtcttgccttgttgatcaggctggagttcaatggcctgatcttggctcactgcaacctccacctcccgcgttcaagtgattctcgtgcctcagcctcccgagtagctgggattataggtgtctgccaccacgcccggctaattttttgtatttttaatagagacggagtttcaccatgttggccaggctggtcttgaactcctgacctgaggtgatccactcacctcggcctcccaaagtgctgagattacaagcgcgagccaccacgcccggctattggtgggcttttctataggatatatattttttttgtgacagagtctcactttgtcacccagtctggagttcatggcgctatctcagctcactataacctctgctgcccgggttcaagtgattctcctgcctcagcctcccgagtagctgggattgcaggcatgtaccaccatctgactaatttttatgtttttagtagagatggggtttcatcatgttggccaggttggtcttgaactcttgacctcaagtgatctgcttgcctcggcctcccaaagtgctgggattacacgcatgagccaccacgcctggccaggttagggtatttctaattggaggattctcagttgttggtatctgaagagcatttccacagggatgagtcctccacatttcccatttgggaggtgtaagcctgtttgccaacagtcttgcaacttaggtaaagaatgctggtgtctgactgttcagtagtcagtttcctcttaatacttttatgttttcagtatgttacttccaccttcacctggatagatgtcccagagtctcaggttccacctctccaaagaatgaccctgtagggttttgcgtgtgtgtgtgtgtgtgtgtgtgtgtgtgtgtttgtgtgtgtgaaagagacagagatagagaatgaatgagagagaatgagaataagaatgtgtatatatttatgtcatgggaggctttccaactgctttttatacagacttttggccagtcctccttttttccagtcctgcttatacccctggtatttgtgccttcaaatcatgaggctttctagggtatatcaaatcagcctacttttgggtgttcctaccttcaggcttagatttaagttctctctagttggttgagtctttttatcacacttccatttctttccattttctacttctacaattattttttgtctcatctcctattttcttttttccttgtgggtttatgcctttgaaaaaaaaatctgttttctgccattttaatagatttgagtagaaagtggtggtaaaccctgtgttaaatttgccatgttatgatcaaaagtggccttttccaccttggaaaatatttcacctagatcagtcttactctttacaactgttttcatctaactcccttgtaataatccaaattcttgaaacaaactgtattcactgatgccatgttctaatgcactccttctctaatgttttaatactgtatactgtgtacttaagtctctttactaactcatgagagatgacctaatcaccaaatgtgaattttttcttggattctcatttgtttttacctgtatcatctgattctgttttatatatatatatatatatatatatatataaagattagtttttcatgtgttcggaatacgctaatgaagccttagttttgcggagaaatccaataattactgtttggtagaacagagttttttttttttttttttttttttgtgagcaacatggctgtttatttcacctgggtgcgcaggcgggctgagtccgaaaagagtcagccagaacagagttttaaagactaaataaatttagactttttcatatatatgagccatttcttttgtgaattgcctgctcagtcttcttttttctttgcctattttttcttattgacatctaagagctctttgcttgctaaggttattaaccttttgctacaaatattatgagaattcctttcttggtggggtgcagtgggtaacacctgtaatctcagtgatttggaaggtccaggtgggaggatcacttgaggccaggagttcaagatcagtctgggcgacatagtaagaccttgactctacaaaaaataaaaataaaaaaattagcagagtatgtgacatgtgcttgtagtctagttgcttgggagggtgaggtgagagaatatcttgagcccagtagtttgagattgtggtccagcttggatgacagaatgagaccctccctgcctctaaaaaaaaaaaaaaaaaaaaaaaaaaaaagaaataattcctttctagttatttatctttaaatgtcatttgtgttatatttgatttgtgaagcttttaagctttatgtagtcaagtctaccttttataatgatctttactttttgtcatgttcagaaaggctttcctttcctgtaaaagtatatatagtagaatactgttgtggagaatctgatctgttctagattaatggtatttctttttttttttttttttttttgagacggagtctcgctctgttgccaggctggagtgcagtggtgcaatcttggctcactgcaacctctgcctcctgggttcaagcgattctcctgcctcaacttcctgagtagctgggactacaggcgcgtgccaccatgccaagctaatttttgtgttttagtagagacgaggtttcaccatgttggccaggatggtggtatttctaaaggttagttattttaagtacaaaattgcacaatgatttaaaaaataaattttaatgcaagtaaggtatgatattttatatgggatataaggaatggtaagaaatgatcaaatctaagatatgtatatctcaggaaacctttatttgatataaatatatgatataaactagttgaagaatgtgtgtgttattttacactaccccattttgaaagttctttgaaaataggagccatgtttttcttttttaagtagctacataatgccttcttggtatcttttaatgattcacttgtgtgatgagttgcatttttaaaattttcattttcagcttttgcaagaagctgaagtatggaaagaacaagtgagtgaacttaataaacagaaagtaacatttgaagactccaaagtacatgcagaacaagttctaaatgataaagaaagtcacatcaaggtaaatggctctactggttttagtgatcaagttggctagaattttacactaactctgaaatttgaaagctagtttttagcaacttttattttcacaacatattttcataacatatttggccagattttcaaatgtttcttgaagacttacagatttgtcatatgtacatacacatacacacacacatacttatatgaatattctgtgtgtccttttttcttctctgtattttagcctaggtatttaataaagaaataaaaataatggtttctaccatttctcttcaggatgctatctgctcctgttaggaggttggaagagtttgagaaattggatgtatagttatatatattaattgaatatctttaatgtaactggtgtatgtactttgatggagaggaatacttttaaaaaataaatttaattgaaacttgactccagtcataagaataaaaggattttttgattttttagatttttaagatttttaaaaatcttaatgctgataaatacagatactcaagtgtatcaaataatgatatgtaaaactaacgttctataatttacacagtgatgtggatgttgtcatattgaaagtgatgctctcactcataggtgggagttgaacaatgaggacacttggacacaggaagaggaacatcacacaccgggacctgttgtggggtggggggaggggggagggatagcattaggagatatacctaatgtaaatgacgagttaatgggtacagcacaccaacatggcacaggtatacatatgtaacaaacctgcacattgtgcacgtgtatcccagaacttaaaatataataaaaaatagtataaagaaagtgatacatttatgccagttatgttgctactaagaatattttcaaaattccagctttctgagttttattcagaatttggcatatatatatatacacacacatatatacatatatacacatacatatacacatatatacacatatatacatatatacacatatatacatatatacacatatatacacacatatatacatatacatacacacacacacacacacacacacacacacacacacacgagatggactttcaatcttgtcacctaggctggagtgcaatggcaccatctcggctcattgcaacctctgcctcgtgggttcaagtgattctgctgcctcagcctcctgagtagctgggactacaggcatgtgccactatgcctggctaattttttttgtatttttagtaaagacgcggtttcaccattttggccaggctagtcttggaactcctgacctcaggtgatccgcccaccttagcctcccaaagttttgggattacaggcgtgagccaccgcatctggctgtggcatattgttttatttattttttctaaacttcctctactaaaggctttgggattcttttaaagataacaagaatgagatgctaacctcaagctctgctcaaaggtataggccatgttatttgtgcctggaactctgaagagagggaggagatcgaagggtgaaaattgtagatcagtgcattatttttaggtgggtccctccagaggaatacatgacacgtcatttgattatctgtagtgttagaaaatatttctttaatcaacaaaattcaaaaagtacttttggaaaacctctaatgttccattcaaattctcttttataaatgtctttatctcagctaattgtttccttgaataaatcaactaaaaatctacgatctttttatacattatgtatctcactgcagatgtgtttggtgtcacacagaatttactctcatgttaattagggcactgttatttgtggcatgtgagaaatgtcatataaaaaatattttactactttttagttgcataatattaatatgtactatatttgatttgggaataactagttttggcttttacttgcagagtttaatagtcaataaatgttaccatttctcaagactacaatatcttaataagaggtggaaaataagagctcttgtgttgttatttatgtggactgatttttaaactataactgtacattcacaagttgtaaagctgttagcataaggcattaccctctctatttttcccctttgttcaatgtcaagactctgactgaacgcttgttaaagatgaaagattgggctgctatgcttggagaagacataacggatgatgataacttggaattagaaatgaacagtgaatcggaaaatggtgcttacttaggtattaagtcatgactcatctccttttgctaaaatggtgactagctcttctatttccttttcgttccctgtgtgcaccatgttctttatatgcttttactttggcacattctgtctgtctgtgacacactgtcctttctcaccatcccttatagtttttagcttcagctggagcactgccttttcagtaagtctttctccagctgctcagacacacttacagcctcctcccttttttttgtgtattatacatatctttattatagccattttcaaaattacatcataatcatttcaatgcctgtttttccctgtactgtaagctaatcaaatggatgaatgactagtttgaagaacaagtgttctataaatacttcaggatacttcttttgcttttgtcagaggttcagatggttacagtacttttaatgttagccattcaaattattattgccattgatggttgtgctctgaagttggcaaaagtggccaaatttagtttcactatagccccttaatgtattctcacaccaattcctttgacctaaaaaaaacctttttattttgaaatatggcatcataggaagttctaaaactagtacagaggtcccatgtacccctctctcattttaccccagtggcagttcttcagacttttatgtcatttttctgttctcttccccagcccctgcataattaacaaatttattatggaggaaaaagtgtgattaaaaatttttttcgtgacaacattaatatgttggaaaaaattacatccctaaaataagtatataaagttctgtttgtactttttcatttctactttattatatataaaataatcctttctctatttgagaaaactcatgcttgtttaatgttattttaacttgggttataattttactcatattttggatgctgtaagaatccaagaatagttaatgattgtggtctatatttagatgaatatagaatccttgttataactctgttcttggagttagagctgaagaaccttgttaaatggtatgacacttcagtgcttttattgtttagcttcctgggagcaggtccaaggccattctgctttataccaaattctttattgtagcaagaagagggattataagtttctggtttagtgaactgataaaatcattttgatgtctattgtcgtattgtactattttcccaaatcattgttgtgcttttgattttcactgtagataatcctccaaaaggagctttgaagaaactgattcatgctgctaaggtttgtgctattagatacttaaaaagaataaggaggaagaaagagaacgtggattactcatgtcccagtaaatgtttaaaaagtccattttattgttcccatataaatatatttacaaattatcagaattttcatcatcaattgctttttcctttcaattattaactttagaaatttatataatttttggaatttatcaaaataaaaaattccaagttctgtactcatttttcggataagactatatttaaaatgtttcctgtattttatcttgtagttccctcagtgcattctttttcttctagtctcagtattttcttaccccttctgccctatatcctattttaagtaaatactagatgcctttttttctggtttattccttctcttttccaccctagtagtgtggtatcctcatttttgctgatctatgtgaagtcttggtaatgtagtttgaaggctgctttaataaaaacttttgttgaaagtaaatagaatgaaaatagtcactttcttaagcagccagtgaaaagcattcactacttttccctgtcccttgttctgagacttacaagcattgacgactttgctggtttttttaagacggaagctgcattatggtttctgtattccaggtgataatttcatcaaaacgataaaatcacttaaaaagtgttaggggggtcatactgaggttttattttttatttttatttttttgtataactgattaatgttacttttttccttcttcccttctttaaagttaaatgcttctttaaaaaccttagaaggagaaagaaaccaaatttatattcagttgtctgaagttgataaaacaaaggaagagcttacaggtaggtcattgacatacatacttttaatgtttttctaagtaagtacatctcttggcagagaatggtaaaaatgaattgaattaactttgggaagatccaattttatttttttttaacttttgttcctgttgggtatttgtgaaacattagtcctggtttttgttgtcattgttgctaaaggcatatcgatttcctctgtatttatgtgaagttaaaataaggaaattttttaaaaaacatgtaaaaccgtatttatcttcgaattacagtgttatgtgtttgaatggttttagatgttaaaaagtagcaaattgaaacttaatgtttaaagtctttgttaattgaaaaattgatcttcaatagtggtactatttgcagtatgattcgttcctttaatgtacatacgtagtatattagtacatacgagagtgatgttagacctgtagaaatgaaggtgttgttttaattgaaaacatttatgtttattttgctgatagtgtttgtattttcaaaaagtaaacaagttctgtcaatatgtttgaaaatttttaaagttgagataaatagcatctcattttgtaaaaataaaaaatataaagatttaccatatgcgtttgcatcagaaaagactggaaggacatactcaaatgtcaacaatgattatctctgaatatgggattatgggcagatttttatattctttttacttatctgtattttcaaaaacttctacagtaagtgaactgcatttataatactgttttaaaagattgaaccaccaaagatagaggttattaaaaaattatatccctactcacatgattatagtaattggattatttttggatttcaagaaacattagtattagtttaagagaatgttgctatatgtaaagcattgtactaaaaactatgggagatatacagaaggaaaagatagcttactttcaaggaagctgtatttcaaaaaatgtgtgtagaaagtgccagagtggcaaggaaatttgctcaccagttatcccactccttaatacagtttcctggcaaatctttgtttctttcttagactaatacttggagacctatgtctccttgtactcttctttcaaatctaactttgtttttttaatggatcatgaaagataaatttctgtaattgatgttttattcatagcatgaagattttcctctaaactgtttcttccttttctggtaatcatttacagtggtctttatgttacaatttgaaacacagtagaagtacaaaaatatggccaggcgcggcggctcacgcctataatcccagcactttgggaggccaacgtgggtggatcacttgagctggggagttcaagaccagcttggtcaacatggtgaaaccctgtctctactaaaaatacgaaaattagtcgggcgtggtggcacatgcctgtaatcccagctgcttgggaggctgaggcacgagaatcgcttgaacatgggaggtggaggttgcagtgagccaaggttgcaccactgcactccagcctaggcaaccaagcgagactttgtctcaaaaaaaaaaaaaaaagtacataaatatattaaataattaagtgttgggttgtagttttcttgtttgttttacaatagggatgattaaattttaatagagataatacccaacgttaatttctttacgtgattgttcttggcaatggcttaaagcctaggtcaatgaatttttttttttctgatgtagattaaaaaatttctgtggaaagatagttacgtacaatttcctatacatttaatcatttaatgtttaggtatttatgtaaactgttcttttggtttgtatgtttaatgggttatattagtccgttctcacattgctgtaaagaactacctgaaactgagaagtttgtaaagaaaagaggtttaactggctcatggttttgcaggctgtacaggcttctgcttctggggaggtgtcaggaaattaacagtcatggtggaaggtgaaggggtagcttccttacatggtgggagcaggaggaagagagtgaagggggaggtgttacacactttaaaacaaccagatctcatgagaactctatcatctagggggagacagcgctaggaggatggtgataaaccattagaaaccacccccttggtccaatcacctcccatctggccccacctctaacattgggaattacaattcaacatgaaagttggatggggacacaaagccaaaccatatcatgagggttttagaataattaaataccattacatgtaattactaaaattttcatgcttgttaatactgtttccaaaacttccctctttaggcagagtgagttttgtcttttaagatttgtggtggtgattcatatacacgttacaggagatgatgccttccttcatcttagaggagttgaggttattatcttgataccttaatgttagagttgttcagagttggtacttcaattttagaggcgctcagagttgaggtaattatgttagaagagaaacgaggtttttaaaaaaattgatgcataaattataaagcattcataattatttagaatgattcatttttattttatagatttttttaaagatggcttagcggttgaaacaacgcttaaagttggtatttttctctctggtcttgatctgttttaaactaggagtatgtttgggcatttgttatgagaagatctagatttctggcttgacttatatgtcaaaattttagcttaaaagggagggctaggtagaatttaagtattattaagagagaaagtttttactagataaaaacaggcattattcatcacctggaaatagttttacggggaatgttgaactacaatatctccctttaaaactcttatctccaaaaccttcctgagaactttagtggcgtttagctctaaaattgaaaattagatgctagaattagaatgttgaaggtgttgggaatcctataaataataacaaaagttaaaagaattttttttttttttttttttttttttttggagacagggtctccctttgtcatccaggctggagtgcagtggcgtgatcttggctcactgcacgctctgcctcctaggttcaagcaattctccttcctcagcctcccaagtagctgggattgcaggcacgccccagcacgcctgactaatttttgtattttaagtagagatggttttgccatgttggccaggctggtcttgaactcctggcctcaagtgatccacccccttcggccttccaaagtgctgagatgtacaggcgtgagccaccgtgcccggccaaaattaaaacaatttatatagctccttaattcagatattaatgcactcaatggagcactattcagccatcaaaaaataatgggatcctgttttgtggcaacatgagtgagcctattttaagtgaaataagccacacgagaaagagaaatggctcatgttctcacttatatatgggagctaaaaaagttgatctcatacaagtaaagagtggaatagtaatagtaatatgagggtgggaagtatagagggtagggggttagggagaggttagttagcagatacaaaattataactagataggtggaacaatttctaatgttctatagcactgtagagtggttagttaagttgctgtatatttatatttctttttcttagatctactttatttgtcatattgttatttttgaatagctagaagagaggattttgaatgttcataacataaagaaatgacaaatgttagaggcgatggttatgctaattaccctgataggattattacacatcgaatacctatattgaaatatcacactgtaccacataaatatgtacaatttttatgtgtcaatcaactaataacaataaaagcatttaggtaaacagaatcccttatagattttctgttattggaaagagtttagtttattaataatttattatttttagtaatttttatctttctgaaatgttaatatgcaactcaaaatgtttctcctttaattatgacttaaaatttttatatagagcatattaaaaatcttcagactgaacaagcatctttgcagtcagaaaacacacattttgaaaatgagaatcagaagcttcaacagaaacttaaagtaatgactgaattatatcaagaaaatgaaatgaaactccacaggtaataaaaattatgttaactccattgaacagcaagtaaaatagctttagagatatatgttacatagttagctatagtgattattgaaagttctcaatttatgattagattgtatttcatcaacttatttttaagaaaggtatttgatctggagacactttttttcaacaaagaaaatattgtaagtgatgttggaatttccaagctagttaacagaatcctctttagctcctagtaagtagtcagcaacttattgccttaaacttcctaatactggcagggaatctgaatggacactcttgattaaactgcccattaattccatctctgatatatgtaaaactgatttttctgttctgtgcaaattgcttctgcccaggtgttccttggcttagtaaatggcagtgtcctttacttagttacttagggtggcacctcaagctgtttttgacttctctcttgcttttatatctcctatttattctgtcattaaatcctgtcagcttttttatagcctgaatctgaccactttttaccatcttccatattagtctagtccaagtcatcaacagttaatacccggcttattatagtagccttatgggtagtctccttctttccgccctttctcctgcactgtgttttctctgcaacatgcaggatgacccttaaaatgtgaattgtgagtatggtcactctcgtgctcaaaatccctgagtgcctttatatcacactcaacccacagcttttatatcttggcctacaagacagtacaggattggacccttggccacctctttaattttagcttattcatgttctttttcctctcagtaccctccatccagcactggcctttttgatgctcttcagcacattgaccttagggtcttttgtgcttgttccttctgcctggaatgatgtttccttatatatttgaatggctcagttcttcattttattaggcctgggttcaaatgttacctcaaagaatccttccctggctactctaactaaaataatacctgctactctttattcccttattttgcctcatggctcttattgtcctctgattgattgcttttctttcttttatcttccttatgttaaatacaagctctgagagaaaattattttcttcacttctgtattcccagtgcctaaagctacatgagacgtgtggtaactgttcagtacatgtttgttgaatatatgtacaaatatgttcagtgcctttatatattggagtgaaggagtgtgtgtgtgtacatgctgttgcctaaatgcctaagtacactgaagacccttgagatatctgaagactctagattttcaaatagtgccatggcatgtatttttttttttttttatcataaagggtaataaaatgtaacagactttcaggttcctttaggctcttaatgatagttattacagttgttccttattatttatagaatctgtatttgtgaattgacttactagctaaaatttatttgtaaatcagatcagtacatgcaaagcttttgtagccattcatggacatattcagaatgatgaaaaatttgagttgcccaatgtgcatgttcccagctgaggtcaaacaaggtgacactctgctttcttgtttcagctctcattctgtaaacaggtgtcctttttacagtatatttagtgcctcattttttacatttttatgctttttgctggtgatttagctgtttaaaatgccccctaagcatagtgctgaactgctatgtagtgtttttaagcacaagaatgctgtgatatgtgttatggagaaaatacatgtgttagataaactttgtttaggcatgaattacagtgcttttggctgtgagttcaatgtcaataaattaacaatatatattaaagaaagtatctttaaacagaagcacacaaaaaaacaaggttatatattgattggttgataaaattgttgtgaccagaggctgtagcaggaagctaaccctgtattacccttaggagcagtgatctagtatttgctaatttacgatgtatagtgactttatggaacaaaactagcacaaataatgagaatctactttatctatttggaaactggtagagagtactaatgcttctttgagatcaggatgctgggtagtgcttggctcattcactgccaagttctgtacttcagtcatgatttggattcagttcacagttaaaaagctgttatttgttatggccctttggccctttgggactgctcagggtatgcaagagactaaacgtgacaaaatggaagaattacagtataacttcagggtttttcagccagtatacctaggagtgggcccttctttttaggttagaatgaaaggtattaaagtaaaacttggatataaaagtgattgaggtgaaagaaatatttttgagtgtatcttttgaataaaaaaagtatatggttgattatagaattttgatgagtaatgtttaacatttcaaagaaaaggtattttctttagatttttaaaggaaggataggaaactgagtagtaccctagttgtgtgtgttgttcacaggatttcattcattagtttaaaattattttaaattcctaaaatattttacatttccttcttatatttaactagcaagtagtttatattactgaaattcaatgaattatgccattggcacttcttcagagtagaatattgagttgatagtaccagtgaagtgttaaatttatattcttgctgcatatagtataatttaagttcagtctggatgttggcttgatgtttttcatgactgatataccattttcccaaatttaataatggaaacaaatgaaatggtaggacctagaagcttgatgtgttgcttttttttttttttttttttttttttggtgagatgaagtcttgctgcgatgcccaggctggagtacaatggtgtgatcttggcttaccacaagctccgcctcccgggttcacgccattctccttcctcagcctcccgagtagctgggactacaggcgtgcgccaccactcctggcttatttatttatttttttttgtatttttagtagaggtggggtttcaccttgttggccaggctggtctcaaactcctgacctctagtgatctgcccaccttggcctttcaaagtgtggggattataggcatgagccactgtgcctggcccttgatgtgttactttaaatatatatgatggtttttgtgtgtgtgtgtttttttttttgagatagagtctagctctgtcgcccaggctggggtgcagtggcacgatctcggctcactgcaacctctgcctcctgggttcaagcaattctcctgcctcagactcccgagtagctgggattacaggtgcgcgccaccatgcctgcctaatttttgtatttttagtggagatggggtttcaccatgttagccaggctggtctcgaactcctgacctcatgatctgcccacctctgcctcccaaagtgctgggattataggcatgagccactgcacccgaccaagatatgatatttttaagtcatatcatcaggtctcctttcacagtgtaatttctattattaataggcccacccaaattcaatgggaaggtacataaacctcaccttttatcaggagaggtgtcaaagaatttctggctatcttcagtctacacagtctgtaaaaacacatctctcttccatatccatgcccgtcgcactttcgtgcttttcctaaggagatgacttattttcttataacatccatgaaagtgattgaccttagggaatgctttctaagcaataggtaatgtagtgtgtagaatacaaaatatttactgccatactgcaagacttcttcagtagtttgtcttgttcttctcaaagttcatgaagaagggaagatatccatttaggactccaaatgtgttttcctgtggtgttcaataaatatttcttgggtgaccaagatatattaatgatagtatgtgaaatgaaacaacatgggtattatagcataaaagagtcactgcttatgagctctaggctttggtttaattatttctctgtgcttcattgtcgtttttgtaagatgggataacagtaccacccttcttgtagagctgttgtggtaattaaataatacatgtagaagtctgagaacagtttttggcacatactaatggctcaataagttatctattattattattaatagaattagatgtagtaaataggactgctactactactgtttactttggtttcattgtaattataattgtgtgtgtgtgtgtgtgtgcgtgtgtgtttacttgcctggaagcctaatcactaaccaatataaaaattaacgaaacacattttattaattggtgacttcttactagcaaatgtaatgcttgtttatacagaaagacttgataagtgatagtcataatagtttttattaaatatatctttgatcctatttttaagataaatttatatagaaaactcttgaaactattagtagttctgtattagacacaatgctttacaatttcggtttataatattaaattcaacaccaggaatatttacacagatactttttttttccttgtaggtgatgttttcagtggtattttagaaatcatttgacaggaatcaccagttttttcacaattaaaaatatagaattgattatcttttgacatgtattaagagaattataacattttttgtttttaaggaaattaacagtagaggaaaattatcggttagagaaagaagagaaactttctaaagtagatgaaaagatcagccatgccactgaagagctggagacctataggtattaaatacatttttctggtttcttttttggaatgggaagagtatctaaaaaacttaatgccagaaaaataataaatcaaatgaaaatagaaaacattttaaaatctgacaggtggtacagacaaaaaaataatatatttttgtctcatcacttttcattcagatttcttggtcttgagcaattatacagaaaatataaagaggaaaaatgtttttctttcaggttgtgtgatttttaaaatctctcaaagttgaatatggacaattctattttatgttagtgtcaatatgaatagatattaattttaaggtccttcctcattggttcaaattgagaagaatgtatgtaatattagtgaatcaataggtgtgccacaaaaagaagagtgagccatagagcatttggaagtatttaaaagactataaatctagattttaccttggtttgatccttactagatcccaggaaatagaaaatatagagaaaaaaagattcagcagtatcccaaatagttgtgatacttcattttacctcagaaagagcaagcttgctttttatccaaaataagttatcttgttaatctcacaaaagtaccaagtaacattttacttcacagtggttgctaatttcctagaattctattaagactacccacatctggccgggcatggtggctcacgcctataatccctgtactttgggaggccaaggtgggtggatcatctgaggtcaggaattcgagcccagcctggtcaacatgatgaaaccccatctctactaaaaatacaaaaaattagttggtcgtggtggtaggtgcctgtaatcccagctactcaggagactggtgcaggagaatcatttgaaccctggaggtggaggttgcagtgagccgagattacgccactgcactgcatactgggcaacaagagcgacactctgtttaaaaaaaaaaaaaatgaccaacatctgaataaatcttctaggatcattcttcttaaaaataaaaaaaaaacaacacaatataccacgtaaatatttatgtgactttgggtttaggtaaactcaagtagtagtattaagttgtaatcaatgttaaaattagtttaggaaaaaatatactgtagaacctgtcagaggtgattatttcttaatgtggagttctggagtttttttttttttttttttcatgaagtagagcattctgggttttctaataaatatttttttagtagagagtatgttctgtcatttcatgttatatgttaatagtagaataattattcgttccatttagaaagcgagccaaagatcttgaagaagaattggagagaactattcattcttatcaagggcaggtatatatatatgtgtgtgtgtgtgtgtgtgtgtgtgtatatatatataatttaaaacaattctgatttctttgaattgatgcaggaatataattacttgaccagttgtatacctcttttgaggtgttgcatgtggctgtgggacatttcccaggagccaaagattctgagataagaaatcttatttaaaattgctgtattggctgggtgcagtggctcacaccagtaatcccagcactttgggaagccgaagtgggtggatcacttgaggtcaggagttcgagaccagcctggataacatggcaaaaccctgtctctactaaaaaaaaaaaaaaaaaaaaaaaaaatacaaaaatagccgggtatggtggcacatgcctgtaatctcagctacttgggaggctaaggcaggagaatcacttgaaccctggaggcagaggttgcagtgagctgagatcacgtcacttgcactccagcctgggtgacagagtgagactccgtctcaaaaaaaaaaaaaaataaaataaataaaattgccgtatctcctgctgctttgggaaggtagattgcatcacataaatgtgtatcaacagtggggtctcatactcagtcaggctagttatatgttaactggcaattcctgttgattattacataaagtaaaagtttaccaaacaaaaaatttaattgtctttacattcagtttttgttttaaaatataatagattatgtatacatgaaaatttgctttaaaaatgttgcctactcttcagagatgcttgggatagttttgagttgtgcactacatcatagtggtagatgtgaatgttttttacttaagaaaaataatggtcagtagcattttaattactttctttttcagattatttcccatgagaaaaaagcacatgataattgggtaagtttaaaatttccttaagtctcttttgtcaaattgtatgtttttttcagaagatacgttgtttatttaaattagatgaaaataaatatagtattctaaaaaatcagtttcttttaattttacaagtagtgaaattatgttccttgtgaactagtttgttccaacacagttattagaaaaatctgatttttccttctttgcttttatcacattgcttctttgaaaggagtttatactccatggggaaggtgatataatgttcatggactgattgttccagggcactggattgccactaattagttgtggacaagctacttaaaattctttgggcctatttcctcatttgtgtaacaatgggattagattaagtgatcttagaagccccttctagttctaaaagtcataaaattcagttacctgatcctcagtgttgaattactgggtacacattaagaaaagggtcatcatgagaaatagtgtatttgtgctccagaggaactaactgtgtgaggaagtgatgaggatgcagattttgactaattataagaaagacactgtaacatataggactgttgtagtagctggcctttggagtacttgtcactaggagtcttcagcagtaggcagtttgcacagtgggtgaatacatggagtttggaattaggctgtcttggctcatgtcctggcttcatcacctatcatcagttttcttacgtgtaagatagagatagcagtagtacctatttcatagggttattgtgatgattaaattcatgtaaggttgttgccaaatgcctgacacacagtatacattcagtgaatgttaactgttgttattgttgtagtgaagcttggtaggtatttcttagacatgttggagtggagattccagcctagggtgagagattaggtgtggtgaatgtctaggtcctcctcagttgtaagattctgtatgctttagtattgagggttcaaatgaaaatttgttactaaattaagctgggcttggagatgaatttagttaaccactgctcaccacttgtaaaatacttaggtgtagattactctttgaagatggagaggtccacacacagtcccagggtaagacggtaaccaggctgtttctggaagggcagcaggaacatcttacagatcttacagagacactgacttgtaaagattagaatgaaaaccacaaacaacaatggccaagaagggaatatgctgaggtccagaggtaacaattccacatccctccctcaccgctgcgtatttagtgaagtcttctaaggtagataaaggttatctcagatgacatgggtagaggctacaaagagacagttaagcagttggatataaagatcgggacagccagatgacacctaggatatatctgtcctcacgtgttctagagcacagggcaggcaggaaaacccaaggaaccacaggctaaagaattacatatcaggaaggtcacttgggagaagctccacagacaaggtgtgtttttagctgaattgggattggtagagggaatgaaagtgacactgagcagtagcttgtcacacgctccagagctgagctacccacaggagcagacgggtctgggcagaagacagttaataggagaggctcatattagtttctgaaaagtcacatggtaacagagtttaacttgttttttagggaaaaagtgttcatttcaatgaactaatcacccaatcagatagaacccaggctggctgagtttagagtccatgaggctctgaacgtttgaccccagggtggatggggacaaggacatggctcacactgtcaactttagagatttgagggtagggggataataaagtctcaactacacaaaaaggatgtttattaaaatctcttgtgtcctaggcactgtacttaaaggccttttacatacattacttgttcaatctactcagtaactgtaaagttggtactataatcccagatttatggatgaggaaacagccgaaggtcatggactagagggtaaagagtgggtatagaaattctgatctttcagagtctaagtcttacactttttcttacttcagtgattatgatttgtataccattgttgtgatatatatatatttttaagaaatttaatgaatgtttatattgacatatttatgcttattttttaagtttatataaatatatttttaaaatgtgttattttcttcaagttggcagctcggaatgctgaaagaaacctcaatgatttaaggaaagaaaatgctcacaacagacaaaagtaagtatcttagtgggaacatttaaaattagttattctgttatttcgttaattaggtaatacttttataaggttaagcaagaaaacttgcagtgaatccagcatatcttgtgagatatctattagttttactaggaatgtctagtttgttttgtctgttgaagtacttgtcttaggtcactgaagtggcacttggaggaaactgttaacagattattctgcaaaaagtataactagaattttttttaaaccagtgtagatggatggaggtaaaaatggatggaaagagaaggggtgaatctctctgacatagtaatgcccagaatatcagcctcttttaatggataagtagataggataatattcattaatttctctcatttcctggttttgtagtattgggtgacattgttttacaataataaaatgaaaggtagaataaaagtctacaatgtacaatagcagggaagaataagtgcttttctgtgaagatgataacagtcttcctagagtgttataatttcttgtcacaatgtactgttaacattatccaatattagtttttagtcctcttgcttgtcttttctagtctcagaaattaaaatcaaattattaaatgttttatatctcatgattaagaactagaaataagattcttttaaaatgtcacatttgtaggataaaaagtttacgagtaagatagtaggacaaattaatgggatttccagtgttgtaactggaatcatgagtgtcacgttacaatggaaagcatacatgactcaaagccaggaaccctgtgtcttaatccaggcactttcattgtgaataaatatttaaactcctagcctcagtttccttagttgtaaaatgatagactggttgaccttggaggactcttgtatttcaaaaatttggattctgtgatatagtactcatggtagtctagttttgaagaagaaataaaacaattgtaaggctccacataacatcactatctctagggcagcaagaaactgattaccctagttaataagcagtgggagataaaggtgttttggtcagaataattttagaggatctgtttgttctgtgtagatattaaaatagtgaagagcagcttgtagttggtagaggcattttttcttgtggtgcttctcttggatgagtaacttagagatgtttgttctttatttgcagattaactgaaacagagcttaaatttgaacttttagaaaaagatccttatgcactcgatgttccaaatacagcatttggcagaggtagtctttttttttttacccctcatttaaaatacatattttacatatatatatatattgcacatatagtttctattagtgtaagttaacactgttatttatataaatattttagattttagaaccaaggttctagactaagctttctcatagactcacaagcttctaggttttgtttcctgtgcagtaatgaaaattactgttgcttttatttctcagtgggattttgtaagatgatacatatttagtactttgagctccttgaaaagctaggtgcttggcacatagtaaggtactcattaacaattttctgtgagattgaatgaataaggagtgcttacatggactagcattgtgactgtttatatattaactatactttggaatttgcttgtttaataattaaaaaatagtttctaattatttaaaagtatcaatttaaaatgtgggaaaaactcagtctgaggtttgattgctttaattaccctcaagggaggaccaattttttttgtaagatatatttaatatttctgtccattgttgagttagggtctgcagtgatctcaaactattgcaaacagtttaaattttttcataataattttggttgaattggaattaagcttctaaggtactgaaaaatctatatataggtagaattccattttaataaccttggaaagttataaaaatcacttttgagagtaaaatttcattaaaatgaaagtctgtttctacatttaaaaaatattagattattacgaatttcaggtagtaacaaagtttggattggggtgaagtatatagaaggatttttttttgtctgaatccaacacaaaatttcaagaagggtaactaatgctttgatcttttcttgtagctggtttgaatattataccagctacactcatgttttaaatttaacatgttttaaaaatgttattttggtggtttttgtttgtattttgtttttgatttttgactttggaaacaaaaccattatttgagagtggtgaagtttgtaaagtggtaggtgtcttggctgtatagattatagataaagtgatttagttgataaattagtatttgtaagctgactttttactggtaatgaatcaaaagtaaattgtgatcttgcttcagagtattttatgcatttttctcctcttcataatctgagcattatttaaacaattcatggcccaatacagcctatctggccctgatttaaactgagtacttctatgttgcaactctcaccagctgaaatgtctgggtgcatactgccagtaaaaacaaaccaaaaaaaaatctaactttatgctcctataactctaagatatatctccaatatcctttgcttaatataaatgattatttatcatgatctttttattcccagttcgttgatgtttttattgcttaaagtgtctatttgatagacaaatatcgaaaacaccagggtctgtatttaattctgttctatattagcaaaatcaaaggatacattcaggacatagattaaacttaaattggcaataggatgacctgatggtaattgtcgaaatgggattctaactctgtagtgtagctaagtgaaactatgaatttaaatatgctgttttaattattccagagcattccccatatggtccctcaccattgggttggccttcatctgaaacaagagcttttctctctcctccaactttgttggagggtccactcagactctcacctttgcttccagggggaggaggaagaggtatattgtttaaacatctttattactctagatttcttccttactttatattttcatctcaacttaccttaaaaatgatctgtaaaatatttggaaaatacaggcattccttgcacttactgtagataacttttatttggaaaaggagctctatgacatctaattttgatgtatttttctcttagaaaccgtgctatattagataacattttgatcaaggacttgatgtgtatctttttatttatttttctttttaattttaatttttattttttgagatggagtcttgctctttcacccaggctggagtgcagtggcgcgatcttggctcattgcaggctccacctcccaggttcacgccattctcctgcctcagcctcccgagtagctgggactacaggcgcccgccaccatgcccggctaatttttttttgtatttttagtagagacggggtttcaccatgttagccaggatggtctcgatctcctgacctcgtgatccaccctcctcggcctcccaaagtgctgggattacaggcgtgagccaccacgcctagcctgataacgtatctttttaaaccatatttttgacttcttaaaaactatatattacatgatataatataaaattttgtaagactgcatgaaatataataacagtataacctagcataaaaattatctatgtgtatgtatatatatgtaatttttttttttttttggagactgttttcactcttgttgctcaggctggaatgcagtggcgcgatctcggctcactgcaacctctgcctcccaggtagcttggattctcctgcctcagcctcctgagtagctgggattacaggcacatgccaccacacctggctaatttttttttgtatttttagtagaaaatacaaaaggttgttttgccacattggctggccaggctggtctcgaactcctgaccttaggtgatccacccgcctcagcctcccaaagtgctgggattacaagtgtgaaacaccataaaattatattttgatgaagcattagaatttggaattaaaaaaatttacattagtatcatgatctttttattgtagaaaattagaaagtgaaataatctttttatagactcaaggaaatcagtagtgctcttgtaggcagatttttgatgggaacctttactgtggtctgcatcatttgttaacacactgggggctgggcgtggtggctcatgcctgtaatcccagtattttgggaggccgacgggggcagatcatgaggtcaagagatcaagaccatcctggccaacatggtgaaaccctgtctctactaaaaatacagaaatcagctgggtgtggtggtgggcgcctgtagtcccagctacttgggaggctgaagcaggagaattgcttgaacccgggggacggagattgcagtgagccgagatagtgccactgcactccagcctggcaacagagcgagactccgtctcaaaaaaaaaaaaaaaaaaaagtacattgggaaaccaagccacaattgtctgctgttacccccttataggtacctcaggcctaatcattagctattctacatttatctcatcagcatcaccctggtgttacaaaaggccctagtacctttgaaaactcctgtgtacctggagttttccttttttgatctctcaccatactttctttgtcaagttcctttaaagttttatcttaatttgtggcgaaattcaaagatatagggccttatttatttcaaaatcaaaagtcttacattttcagttccaagtatgtgttttataagagctgatggcattcttcaccagtgaaacattcccaccctttgtatcagtgattttaacagattgaatttgagataggaacataaagtaatgaatctaaataaaaacaccaaattaaatccaacaaatcaaagttcatatactcagatgggtattactcatctaaatagtatctcaggaagtctgtgtacttgttagttgaagctgccattactccacatatttttggaactcttcctttggaattgctttcaaataatatgagaaaatcaacttactactgtatggtcatgagatattctccctttgcccatatcctgtttgtatcctctttctccaccctcattttgcttcacttagaactgttcctgtccacctcccagtccccccagtagattgggccacagcctggggtccctacagagcctctgcttgtgttgattttgaactggaagctcctagggaaagggactgccctatagactgatacttagagccttagggaggctttgcattgagcacttcaggaaagagactgattttgacattgacatgtctgctgcaagcttatgacttagttctctaagtccacccccacccctccattttttaccttggcttacactaagaaatgtattttgtatcatgtcatattgtacactaacataaacatgattgaaatataattgaaaccgctacatgaaatagtacttgccattacagttttgatgctttctattcaattttatcccgtttcattaatttaatcttaattagcattattttttaaacttcacacatcacaaatgagtaggagctagcagtctgaaaaaacagtgccctagaaataagggtataattggctaaactgcaaatatgagtcactggaaattgaattacataagtcaaggattgcttgtagtcaattgaatatttggaatgattaaaatttacatttgatttctcctcttctatttcctctcctatttaatttaaagatacagtgtgtttagattatctgcaagggtgttttaccatttgtttaaaaagctacagaagttctaggtaagttgtcatcgggtcttacagagttgatccgaactaaaagtttctatgatccaccaaaggaggatggagagtacctgttatttttccttacttttattatctttttaatttgaagtttggatgagtggtatatttgaataatactgagtacaagtaaaacaatttcttcttagagtaaattgtatgtaactgggtttgaatagaaaactttaaccattagaacttttaggtttgtaatattcactgggtagtcagttggcctgtagctttggtcttctggaagtaagcaatcaggaaggaaagcctctgaatgtctcctttaaatctctgtgcttcattccagatgaactcagcctaaatgacgacttgcacattttctgctttcccagccttcttcttctaatgagctaattattaggatgaagaagcgagaaggaaagatttggggaacttaatagaatgtatactaataaggaaaaatgatagtttacctcctgatgtaaaagccagttgatctgattctactaaagggagtagatggaaaatttgttttaaagattactatatattaaatgtgaatgcttatgctgatttgtacaagttaccaagaaaagttaaaattaattttgttctcttaaaggaggtactgaaatagagtaagcatttttgttagacttcttttttttttattttttttttttgagatagtctcactgtgttgcccaggctggagtgcagtggcacgatctcggttcactgcaaccccttcctctcaggttcaaatgattcttgttccttagcttcccgagtagctgggattacaggcacgtgccactgtacccagctaatttttgtattttcagtagagatggggtttcaccatgttggccaggctggtttcgaactcctcacctcaggtgatccgcccacctcggcctcccagagtgctaggattacaggcatgagccatcacgcctggctattttagttaggcttctattgaaaaaaaattgttcactgggtgcagtggcttacaactataatcctagtactttgggaggtcaaggtggtgggattgtttgagcccaggagttcaagaccagcctgggcaacatggcaaaaccctgtatctacaaaaaatacaacaattaacaaagcgtggtggcacatgcctgttgtcccagctacttgtaaggctgaggtgggagaattgcttgagcctaggaggcggaggttgcagtgagctgagaatcgcaccactgcactccagtctgggtaacagagtgagtgagaccttgtctcaaaaaaaaaaatgtttttaaagctgttccttgagaataataagcttttgttttctggacaatataattttgagaagaccccccttttccctctcaatgacagataaatgaggtattaatatattttattgaatgttaaatttttttttttttttttttgagatggagtctcgctctatcccccagactggtgtgcagtggcatgatcttggctcactgcaacctcctcctcctgagttcaagccattcttctgcctcagcctcctgagtagctgggactacaggcgcctgccaccatgcccggctaattttttgtatttttagtagagatggggtttcaccttgttagccaggatggtctcgatctcctgaccttgtgacccgcccgccttgacctcccaaagtgctgggattacaggtgtgagccaccgcgcctggccaaaatttttttatatttgtcttttccattttagttgaatatgggttttgttttttgtttttttttgagatggagtctcactctgtcacccaggctggagtgcagtggcacgatcttggctcactgcaacctccacctcctgagttcaagccattcttctgcctcagcctccctagtagctgggattacaggcacctgccaccatgcctggctaacttttgtacttttagtagagacagggtttcaccatgttggccaggcttgtctcaaattcctgatctcaggtggtccaccctcctcgacctcccaaagtgctgggattacaggcatgggccactgcgtccagccctgtatatgggtttttaattaaggtactatcttttctgtggtcgtaagaagggaactttaaaattactcctgtttgtaaatgtaaatatactagattttcttatccaaaagaatgttagctcatttaaagtgattatttcaacagtgctgttgtttttgaaactatcgttttagacttgtcttcagaacttatgaattcttcttttgaatgtgaatttgatatttagaaatcactaaaagccatctagtgccagtttatctgttgtacataatgttttaaatcaggctatttaaaatcattttggggcagaagtatttatcttttttatcttctcattgactcgtaacactattcagtgaatttgggcagaagtagagagtcatgttttaactttgagatgcagttttttacatggctcttaagttaaactgagtacatttccaaaagagtttttctgaaaaatactttagtagcaaaattagtagaatagatatagaactgctaagatgactgttttaaaggaatcatgctcatttggactattgatatattagtttaagcaacaaaatcatttatgctttttatttaatcatttattatattttatatttattttaaatattttatatttattttatattatattttttatttaatcagttcttataattactttataattatcctgttacatcaggcataggaatcatagcaatttactttctacactgttatttttcagactttgtatttataatttatgatttaaccactgattttatgtgtaaaacaagtatataagactttttaagatgaaacagatttgtatgtttttttttctttaattaggctcacgaggcccagggaatcctctggaccatcagattaccaatgaaagaggagaatcaagctgtgataggttaaccgatcctcatagggctccctctgacactgggtctctgtcacctccatgggaccaggaccgtaggatgatgtttcctccgccaggtatgtaaagacaatagttattatttctctttgaaaggcagctgggatgtggaatacacaggaatggaagaagggaggagtatatgtttgttctctcttaagaaaaatcatcgtacatttttgaaaacaacaatgataaataatctaaacagaatgatttgagataattgttcatattatagaaagctgttttctccctaaatggaatgtttttattgtttttgttgcttgtagaggtaataatgcatgtttactttagaaaatccaaacaacacagaaatgtgtaaagaagtgaaaaatcccttttgtcatcttagcgtgtccttcccagaatttagttgtaggtatatatcttttagagatttttttgggtatacatttatacacatagctgttcaaattcttttaatcactctgtgcagttgtaccattcatcctcttttgtaattgtcttttttcactgaccattttatctcaccaaaataaatatatttaccagaagagtcacagcagaatatcttgaaataagataataactgccattcaacagctgcatcatctacattaggtgtttctcctaatgctatcctcccctggccccccacccccagagaggccccggtgtgtgatgttcccctccctgtgcccatatgttctcattattcaactcccacttatgagtgagaacatgcggtgtttggttttctgttcctgtgttagtttgctgagaatgatggtttccagcttcatccatgtaccttgcaaaggacatgaactcattcttttttatggctgcctagtattccatggtgtgtatgtgccacattttctttatgcagtctgacattgatgggcatttgggttggttccaagtctttactatcatgaacagtgccgcaataaatatacatgtgcatgtgtctttatagtagaatgatttataatcctttgggtatatacccagtaatgggatggctgggtcaaatggtatttctagttctagatgcttgaggaatcgccacactgtcttccacaatggttgaactaacttacactcccactaacagtgtaaagcgttcctatttcttcacatcctctgcagcatctgtagtttcctgactttttaatgatcaccattctgactggcgtgagatggtatctcattgtggttttgatttgcatttctctaatgaccagtgatggtgagctttttttcatatgtttgttggctgcataaatgtcttcttttgagaagtgtctgttcatatccttcgcccactttttgttggggttgtttgcttttttcttgtaaatttaagttgcttgtagattgtggatattagccctttgtcagatggatagattgcaaaaattttctcccattctgtaggttgcctgttcactctgatggtagtttcttttgctgtgcagaagctcttcagtttaattatatctcatgtgtcaattttggcttttgttgccattgcttttgttgttttagtcatgaagtctttgcctatgcctgtgtcctgaatggtattgcctaggttttcttgtagggtttttatggttttagttcttatatttaaatccttaatccatcttgagttgatttttgtataaggtgcagggaaggggtccagtttcagttctctgcataaggctagccatttttccgaacgcaatttattaaatagggaatcctttccccattggttgtttttgtcaggtttgtcaaagatcagttggttgtagatgtgttgtgttatttctgaggcctctgttttgttccattgttctatatgtctgtttttgtaccagtaccatgctgttttggctactgtagccttgtagtatagcttgaagtcaggtggtgtgatgtctccagctttgtattttttgcttaggattgtcttggatatatgggcttttttttgcttctatatgaaatttaaagtagttttttctaattctttgaagaaagtcagtggtagcttgatgggaatagcattgaatctataaattactttgggtagtatggccattttcacgatattgattcttcatatccatgagcatggaatgtttcttcttttgtttgtgtcctctcttatttccttgagcagtggtttgtagttctccttgaagaggtccttcacatcccttgtaagttgtattcctagatattttattctctttgtagtaattgcgaatgggagtttggtcatgatttggctctctgttattggtatataggaatgcttgtgatttttgcacattgattttgtatcctgagactttgctgaagttgcttattagcttaaggagtgtttgggctgagatgatggggttttctaaatatacaatcatgtcatctgcaaacagagacaacttgacttcctctcttcctatatgaataccctttatttatttctcttgcctgattgccctggccagaacttccaatactatgttgaataggggtggtgagagagggcatccttgtcttgtgctggttttcaaagggaattcttccagcttttgcccattcagtatgatattgcctgtgagtttgtcataaatagctcttattattttgagatatgttccatcactacctagtttattgagtttttttttttttttttagcatgaaggggtgttggattttatcaaaggccttttctgcatctattgagataatcatgtggtttttgtcattggttctgtttatgtgatgaattacgtttactaatttgcatatgttgaaccagccttgcatcccagggatgaagccaacttgatcgtggtgggtaagctttttaatgtgctgcttgatttggtttgccagtattttattgaggatttttgcatcaatgttcatcagagatattggcctgaaattttctttttttgttgtgtctctgccaggttttggtatcaggatgatgctgacctcataaaatgagctagggaggattccctctttttctgttgattggaatagtttcagaaggaatggtaccagctcctccttgtacctctggtagaatttggctgtgaatccatctggtcctggacttttttggttggtaggctattaattactacgtcaatttcagaacttgttactgatctattcaggaatttgacttcttcctggtttagtcttgtgagggtgtgtgtgtccaggaatttatccatttcttctagattttctagtttgttcacatggagttctttatagtattctctgatggtagtttgtatttctgtgggatcagtggtgatatcccctttatcatttttccttgcatctatttgattcttctctcttttcttccttattagtctggctagtggtctatttattttgttaatcttttcagaacaccagctcatggattttttgaagggttttttgtgtctttatctccttcagttctgccctcatcttagttatttcttgtcttctgctagatttttactttgtttgctcttacttctgtagttcttttaattgtgatgtttgggtgttgattttagatttttcccgcttgatctcctgtgggtattttagtgctgtaaatttccctctaaacactgctttagctgtgtcccagagattctggtatgttgtgtctttgttctcattggtttcaaataacttatttatttctgccttaattttgttatttacctagtagtcattcaggagcaggttgttcagtttccatgtagctgtgcggttttgagtgaatttcttaatcctgagttctaatttgattgcactgtggtgtgagggactgttatgatttccatccttttgcatttgctgaggagtgatttacttccaattatgtggttgattttagaataagtgctatgtggcactgagaaaaatgtatattttgttgatttggggtggagagttctgtagttgtctgttaggtccgcttggtccagagctgaattcaagtcctgaatattgttaattttctgtctcgttgatctgtctaatattgacagtggggtgtcaaagtctcccactattattgtgtgggagtctaagtctctttgtaggtctctaagaacttgctttatgaatctgcatgctcatgtattgggtgcatatataattagggtagttagctcttggtgttgcattgatccctttaccattatgtaatgcccttctttgactttttgatctttgttggtttcaagtcttttttatcagagactaggattacaaccctgcttttttttgctttccatttgcttggtaaatcttcctccatccctttattttgagcctatgtgtgtctatgcacatgagatgggtctcctgaatacagtacaccgatgggtcttgactctttatccaatttgccattctctgtcttttaattggggcatttagcccatttacatttaaggttaatattgttatgtgtgaatttgatcctgttattatgatgctagctggttattttgcccattagttgatgcagtttcttcatcacgttgatggtcttttacgttttgttgtgtttttgcagtggctggtagcggtttttcccttccatatttagtgcttccttcaggagcccttgtaaggcaggcctggtggagccaaaatccctaagcatttgcttttctgtaaaggattttatttttcctttacttataaagcttagtttggctggatatgaaattctgggttgaaaattctttaagaatattgcatattggcccccattctcttctggcttgtagggtttctgcagagagatccgctgttagtctgatgggcttccctttgtggttaacctgacctttctctctggctgcccttaacgttttttccttcatttcaatgttgctgaatctgacgattatgtatcttggggttgttcttctagaagagtgtctttgtatttcgtgaatttgaatgttggcctatcttgctaggttggggaagttctcctggctaatatcctgaagagagttttccaacttgattccattctcccgatcactttcaggtacaccaatcaaatataggtttggtcttttcacatagtcccatatttcttggaggctttgttcattccattttattcttgtttctctaatcttgtcttcacgctttattttagtaagttagtgttcaatctctgatatcctttcttccgactgatcaatttggctatattgatacttgtgtatgcttcatgaagttctcgtgttgtgttttttggctgcatcaggtcatttatgttcttctcgaaattggtttttccagtttgcaattcctctaaccttttatcaatgttcttagcttccttgcattaggttagaatatgctcctttagcttggcggagtttattactcaccttctgaagcctacttctgtccatttgtcgaactcattgtctgtccagttttgttcccttgctgccaaggagttgtgatcctttgaaagacgaggcatcctggtttttggaatttttagcctttttgcctggtttttcctcatcttcctggatttatttaccattggtctttgctgttgatgaccttcggatggagtttttgcttggtccttcacggcacagtccctcatggcttctcttggctaggggaggaaatttcctgaacgcttgtgcttcccaggtgaggtgacgcccaccctgcttctgcttgcagtccgtggactgcacccgctctctaaccagtcccagtgagatgaaccaggtacctcagttggaaatgaagacatcacccgccttctgctttggcctcactgggagctgaagaccggagctgttcctatttcgacgtcttgcctgggaatcaacaatttcttgtgatctatcttcaggtttactgactctttccttgtcatctccattctgttattaagcttatctagtaaaagttttattttagatatatttttcaggtctaaaattaccatttggttcctttttataatttgatttatctgctgagttttttatctttttattcattataagcattttttttaaaccattgagtatattagttttataataactgctttaaagtcattgtatggtaattctaacatcagggtcatcttgaggttggcctctagtgatgatattttcccttaaggatgggtcacattctctttcttgatgagtttgtattggatactagacattgtggcaattctggattctattctattcctctaagagtgttactggtcttgctgtagaagaccattaacttggatgggctcagactgcagccttttcccttctgtggtggggaacagctcaaatattagttcagttatttttgccttagctgaaaactgcttaaatttgccatacacatgtgttgctctggagtcagccatagacttgggcagagattgtacccagaatattgggctctacctttgcggctttctcctttctaggatatcccaatcccattgcctcaggcttgggctctgtgtacttgttcttcaggcaagaaagttttatcgagttttgactgctgtgtgctgcaactcactgtggtcttctatcaggctaaaacataaaaatggaaaactcaccccatacccggttgttactcctttcttcttccaagctctctcttcttttctaagtcctcctgcttttgttgatgcttaagcgcttcaggcagttatttttttgcatattgtctggagtttatacttatgtgtaggagagtcagtctgaatttactctaccatactagaaatggaacctggtctccgtacttttcaatcatttgtgagcttctaaattgataccttcatagaagagatatggtccattctacagagtatctccaaataatgaacctgatccctgtggtttgacagagggccaacctgtgtcaactataatctcaatgtcatagacaagggtaattctacagacacagtaaaggaattttcagtattgttccaaaatttatgatgagtgagaagggctaaatgactcctgaggctctagcatgaattagagtaatgctgataaatgtatttctcagttagcttcattcctacctaaagttaaaaaatattctatgtttgctcttggtatattggtacatgccatttaaatagtcactgaacaggccgggtgtggtggctcatgcctgtgatcccagcactttgggaggccaaggcaggtggatcacctgaggccaggagttcaagaccagcctggctaacatggcaaaaccctgttcctacaaaaaatacaaaaattagctgggtgtggtggcaggcgcctgtaatctcagctactcgggaggctgaggcaggagaattgcttgaacctgggagacagaggttgcagtgagccgagattgcgccactgcactctagtctggcaacagagagagactctctcaaaaaaaaaataaaaaaatggtcactgaacagatttcagggttcttttcttttatgttgtgtttcagttaacgaaatgataatgaatgaggggacttaggctttttttttttgaagtggagtttcacctttgtcatccaggctggggtgcaatggtgccatctcagctcactgcaacctctgcctcccgggttcaagcgattctcctgcctcatcctcccgagtacccgggattacagggcatgtgccaccatgcccagctaatatttgtatttttagtagagacggggtttcaccatgttggccaggcttgtctcgaactcctgacctcaggtgatccacctgccttggcctcccaaagtgctgtgattacaggtgtgagccaccacacctggcctaggctttttaaaccttatcattgctattacttttttgtgtaaccttgagcaataaattttacctgtcatggttttctctctttcaaaatatggtcttctggctgggtgcagtggctcatgcctgtaatcctagcactttgggaggatgaggtaggaggattgcttgaggccaggagttctggagcaagctggccaaaatagtgagattctgtctccacaaaaaaacaaacaaaatagtgacttctgtaaaacagagatggtgatattctaaagtaatctgcctctcttttatgtaaggttgacttattgggactcatgaagagtccttctcactaataattgtctttaagatttttcttaaattttaaaatattttagtttaaaatacttatgttaaaaaaatatgacaactaaaataactaagtttctgaagaatatggattctgcatttgagattatctgtcatttagtctgttaggcataatttataaaatgtatatattttcttaacatgtttctacttggaagaagtgttttagatttccattgacttaagatgagttagcagaaatgattttaaatagttccatatttacaaggaatcatttatttttgcaccgttaaatactttgaaaaaggagaaaactttacttagcttatatagtcagaaaaaactgctctaacttatctcttttctcatatgccctattccagacattcttttaaaaaatattttaataatgttatcttttatttgagattcacagggtacatgtgcaggtttgttacatgggtatattgcatgatactgaagtttggggcgtgactgaattcatcacccagaaagtgagcatagtacccacagtttttcagcccttgcctccctttgtctctcctcgctctactctggtagtccccagtgtctcttgttatcatctttatatccatgtgtacccagtgtttagctaccacttacaagtaagaatgtgttagttttatatttctgcattaattcacttaggataatggcttccagctgcatccatgttgttgcaaaggacataattttattctttcttatggctgtgtagtattctatggtgtatatgtactgcattttctttatccagtccaccgttggtgggtatctgggttgatttcatgtctttgctgttgtgaatagtgttacgataaacatgagtgcttgtgccttttttgtagaacgacttagtttcttttggatatatacccagtaatgggattgctgggtcaaatggtagttctgttttaagttctttgagaaatcttcaaactgatttccacagtggcctaataatttacattccctccaacagtgtataagcattcccttttctctacaaccttggcaacatctgttattttgactttttaatagtagccattctgactagtgtgaggtggaatctcattgtggttttgatccaaacattcttattacttaaaggttttattagcaagtatacacctagtttcttcaagtaatcaacactttattctcattattttcagtagcagactcaatcttataaactaataaggattttaaaacttttaagttttcttttaaaactctgtggttattaaaggttagtacacaaatttggctaccttattaggaaagagctaattctgctgaagcatagtatgtgtacaaagttttgtacagtgttgaacagtctacaatgtatctgttcatctaacattcttatatgtgcttttaattagtttgcatgtttagaacaagactggcttaggtgaaaaagcatttggactggaaatcaagaaatttgctttctggttttcactcctttatcttttagtgtgattttaaaaatttattaaaaaatttttttagagacaggttctcactttgtcacccagctagagtgctgtggtgtgattatagctcactgtagccttgaactcctgatctcaagcaatcctcccctctcagcctcccaagtaactgggactgtaagcacatgccacaatgcctgggtaatttttattttattttaaattgtttttggagacaggtttttgctgtgttacccagtctggtgtcaaactcttggcctcaggtggtcctccctcctcagcctcctgaatagtgggggattacaggcacgagccatcgtgcctggcttttagtgtgatttttaaaacttgtttcatttctttggaccttatatattatatagtgacataaccatataactccataagaaactcattcgaatataatagtataagtaggtggaaagtaaaaggatagaaaagatacaccatgcaaacattaatcgaaagaaaatgaggtcaagaagatatagcaaatgttaaatgtgtgtatgccaacagcagctacaaagtatgggaaacaaaaactgatagcactgagaggaacaaagacaaatccagttataattggagacttcaacacccctctctcggcaattgatggaacaactgaagagaaaattcagcaagtatatagaagaactgaacagtgccctcaaccaacaagacctaactgacatttatagaacaagttacccaacagcagcagaatacacgtgtttttaaagtagcagtggaacattttacaagacagattgtatcctgggccataaaacaaacctcaacacatttaaaagaagtgaaataatatacagtatgttctttgatcacaatggaatcaaactataaataataaactattgatacatgcaacaatttggatgtatctcaatggttgagtgaagaaaaccagtctcaaaagtttacatactgtgttattccatgtatataacattcttttttttttcgagatggagtctcactctgtcacccaggctggagtgctgtggtgtaatctcggctcactgcaacctctgcctcctgggttcaaactgtccttcagcctcagcctcctgagtagctgggacttcaggcacacaccaccatgcccggccaggctaattttaaaatttttagtagagacagggttttgccattttagccaggctggtctcgaacttctgacctcaagtgatccacccacctcggcctcccaaagtgctgggattacaggcgtgagccactgtgcccggccatatataacattcttgaaatgacggtatagaaacagaaaacagattggtggattcaagagtttgagacagtagtggggaggggagtgggtatgactgtaaaggggtggcacgagggaggtgtttttggtggcacaataattctgtatcttgagagtggtagtgattacataaatctacatatgctgtaaaatgtcatagaactagacacgagttgtaccaatgtcagttttctggctgttacaatacactatagttatgaaagacgtaaacattgagtaaagggtgtgcaggatctctctgtagtatttttgcatctttctgtgaatctattttaaaataaaaaagtaaaaatcttattgtatatcatacacatacagggaagtacaaatattaagcatataatgtgattttttttcacaatttgagcacagtgatataactaacactcagataaagggatagttttcagtttggtttttcataagtttaattagaaaacttatttataattttagcagaaaaaatgttcttgaataatgtaagtgagttgataatattcacatatcatatagtaatcacaattaaaattttaacagaaatatgtcctgggaataaccagttcattataaattctttataaatactaacctgcaacaaaaatttatcaatgtgacttaccttgctcagcgcttcagttgttaagaaaaaacacaaaagtgttttcatatttagaatgagaacattacagatcaaagagacttggtaagaaagtagtttaaattgtccatgtaattcttttgccagggttaactgtaacaaaggtgattctcataaaaactttcaagttgtatgtgttggcttgttttgtcttcacttttagaaatgaaagtgaggtatcataatttattaagtagataatgtcactatcctgtagatcagcagtccctaacctttttggcatcagggactggtttcatggagcccagtttttccatggaggttgcagggaggaggatggtttcgggatgaaagtgttcacttcagatcatcaggcattagttagattctcataaggaatgcacaggctagatccctcacatgcgcagttcacagtagggtttgcgcttctatgagaatagaatgcctcagctgacaggaggtggagcttaggtggtaatgctcgcttgccctcctcacctcctgctgtgcaaacagttcctaacagcccgcggaaaggtactggcccgcagcccaggggttagggacccctgctgtagatgactacatacatttatttatttatttccctgtcttatggtgctgattgataactacttctactgtagctcaggttgggatatatagtttgaaaattgttggcatatatttagatagagagatacagtgggttagtagctttcacaaggagaaggaattaaaatgttaactctatattttttgttctaaatatatttttaggatctatgtgctatagtttgtttcatttttacaagaatttctactgaacatcttattcaagatgttgggataaaagataaattattaaaaaggtgtagttatgtatttcaatgatgagttaatataatgaaatgaatgtaatactgaaacagatctttttctacaacagctctgtccaatagagctttctgtaataatagaaatgttttatatctatactgtccagtacagtagccactaggcacatgtggctagtaaatacctaatgtgtctagtacaacttgagaaacagaatttttaatcttattgaattttgtcagttaaaatttatttaattttctttattattttgttttgttttgagacagaatctcactctgtcatccaggctggagtgcagtggcatgaacacagcttactacagcctcgacctcctgggcccaagtgatcctcctgctttagcctcccaagtggctgggactataggcatgcaccactaatgcctaatttttaaattttctgtagagacggggcctcactatgttgcccaggcaggtttcgaaatccttggctcaagcaatcctcccaccttggcctcccaaagtgctgggattacagacgtgagccaccacgccctccttcgtacccttttgagctttagtattcctagttttcattgtttaaaagaacaaggagtgtgtatgtggtttctccttatttttgttggtgcttatcttttactgatttggataatatattttatgtaagcatagcaaagagactaagcaaccataccttggtggtgtaatcatgagttaagtgtggttgctagcctggcatgtttaaaaactctttttcttaaagagctgaacaaataagagacatatagtgtacagctaaattgatgagaacagttttgactctttccttgggaaacaaaagtgtgctaagcagatcaaaataccttggatagctttgaatgcataggcgtagatttttacttcactgactctgattcatagacatttatgctgaccattgtcctacattctgaacagttttttcagacaagactgatttagtagaattatagtttgtcttaaggctcattttgatctctttgatgaaaacttgtggtcttcccaaacttaataaggtgttctgaagtcgtggtatatatgcttttatcctctcagaggatgatatttacttaaagttgttcctaaattttaggctaccagttttttaggaatatatatatcttaatcacttatgtcttatataatgatcctttataaattctaatgattattcagttgataaattgccactgtatgtgtttttataaactttaaaaatctgtgtttaatttgtcagtcttcctgaagagactaggttgtggagagattaagatacagggacaaatgtaaacaactttttgaaaaatttcactttgaatgaaaaagagatggtagctggagggagaggtgttttggtttttaaagatggataatattggctgggcatggtggcttacgcttgtaattccagcactttgggaagctgaggcgggcagatcacctgaggtcagaagttcaagaccaacctggccaacatggtgaaactccgtctctactaaaaatacaaaaattagccgggtgtggtggcacgcgcctgtagtcccagctgctcgggaggctgaggcaggagaattgcttgaccctgggagggagagcttacagtgagctgagaccgcaccgttgcactccagcctgggcaacagagtgagactccctctcaaaaataaataaataaataaatgaataaataaataaataaatgatggataatataacatatttatttgctgatgggaataattcaggctagaaggggaaattaatgatgtttggagaaggtctggttataaaagtgaaaccctggaatattaagcacaaaagatgctatccagagtgtaattgcagaaattgtggtagctgggtcaatttatccattctaaaaagaaggaaggcagagcaagtgagtacagatgtagctgttgggtggagggtaagtggaggtgtccagttgtttcaattttcttgttgtggcaagatcatcagctgaagcaggtggtagaggagaggactgtcagatctgaagagaaaaaaaggtatgcagtagctatttaggagagtggaagaactcaaacattagtaaagtgtagtatgattatagggcattgttgagcatcagtttgaaatttatggtcataaatttgaatgaaaagcagtcaatactatatttttaatatagtttataatcataacaagcttaatttatcatcagatattgataaagctgtatatagaatgtatttgtgtcagactaaatgccttttattaatcattctaacactcttaagagtgttattctgttattcccattttacagatgaagaaacaaaaccacagaaaggttgggtaacttggtgaacaacacaaattgagatttaaaaaaaaaattttattatactctaagttttagggttcatgtgcacaacgtgcaggtttgttacatatgtatacatgtgccatgttggtgtgctacacccattaactagtcatttagcattaggtatctctcctaatgctatccctcccccctccccacaacagtccccggtgtgtgatgttccccttcctgtgtccatgtgttctcattgttcaattcccacctatgagtgagaacatgcagtgtttggttttttgtccttgcgatagtttgctgagaatgatggtttccagcttcatccatgtccctacaaaggacatgaactcatcattttttatggctgcatagtattccatggtgtatatgtgccacattttcttaatccagtctatcgttgttggacatttgggttggttccaagtctttgctattgtgaatagtgcctcaataaacatatgtgtgcatgtgtctttatagcagcatgatttataatcctttgggtatatacccagtaatgggatggctggatcaaatggtagttctagttctagatccctgaggaattgccacactgacttccacaatggttgaaacaaattgagatattatagcacaatcctggatatcacccttgagaatttacatattaatatttgcttcagatatatatgtgtttgtgtgcgtaaatgtgtaaataagacataaaaagaaaaagcacactatttacatgaattgaacactattgcatttcctttcctgggcatattaccttcctctcctagaagcagctattcatgagtttagcgtgtgtaaactttcagttctaataatgattaaaaaaaattaaagttctgttttatcagctttccttatcagccttacctacttgaattctttccatgttagtatatagagagtttatcaccttaattgtggtatggtatttcagtgtataagaaaccacaaaatgtttaaccatttcctgttggtgagcatttagagtgtctccaatatctcaccattactaacagtgctgcagctagcaccctttttgtacatatgttctttcaagattgtccaggaattggaattcctaggtaatagggtatgcacacttttgatcttattttcaatttttatttttttgggacaggatcttgctttgtcgctcaggctggggtgcagtggcgtgatcttggctgactgcaacctccgcctcctgggttcaagcgattcttgtgtctcagcctcccgagtagctgggatcgcaggcctgtgccaccacacctggctaatttttttgtgttttcagtagagatgggatttcaccatgttggccaggccgatcttgaactcttggcctcaagcagtccacctgccttggcctctcaaagtgctgggattacaggcatgagccaccatgcccggcctgtttttggttttaatagatatctccccatcgccctcaacagaagctgtgaatgaagtatatgagagtagctgatttctgcagtataattcttagtttgcaaaactgctttagaatgcccagtacacttattcccactccttattcatttttttcttatctttttttcttccattctttctttctaatcatgtcttctattataagcgtagaatactattatagaaaacaaaagtttgaaagcaaaaaagaaagggacctttcatgtccttactttctgtagttcagttcagtctttaattggtcatatgctttccacatagctgtatcttattatgtgtatatgtgtatgtgtatatgtgcatatgagggtgtgtgtatatgtgtgtatgtatgtgtgtatatgtatatgtgcatttgaccagaatacccttgattacttgttcatctttacttttctttcagggcaagctttactgcctctgactccatttctgattcctgcaatcagaaatagatagtctacctcttatattatgtatatttccttttattaagacattaatcacatggtgtttatgtgtttctatcagaattagactgtaaggacatggggtttatcaaggccaacattgtattgtttgtgcctgacacatactaggccttggtaagatttaaggaatgaattgcttttgccagtggagggcaacatagccatgtagtttataaagtagtaaatttataacaaaatttttttatttctgaggttgttgatgtgtggggatataatttagaagcaaaataatgatgtagtatctggagacctgattaaaaaagagttggtgttcaggtttccttattttatccccttgtccaactccaccatttaattaatcctttgtttgaagtagaaagggaaaactgagtttagatctcagtgattggtattgaccttttctttcattaggctaactcaaaccctttgaaacagctcctccctaggattttgaaagggagtgtaaatgagccttcaaactatttgtatctttctctcctcagtcacatctcccgaccattgggagctcattaaatataattctctttattgactctcgttgatgccaggtggtctctctggttttgtgtaggagagatgatgtgtcaataaggtcccctgtggcagagtcagatgaggagtgatatatccaacactgattctataaagtcaattagaggcaatttggggttgtttacgtatatctgtaataggataggggaaagttacacaattcaccttctttgtcgttctccttatttttggagttggacatatgcatgcctaatctagcagtctgacatcacctttcaagaatgagaaactacctatactttttcaagagtgatgagttccacaaggacccaggaattattaaaccgcaattacttttgcaccaacctaataccatattgtcatcataaatcacccctggggacaaagggtggctgtagaagcacttgagatagttggtgtccaaatttgtgtctctccagatgttcttcgtttcagcagtggtactcatctgttgagtcagagagagctttccatttagtttgttttttatttattttcatttatttatttatttattttgagatagagtcttgctctgtcacccaggttggagtgcagtggcatgatctcggctcactgcaacctctgccccactgggttcaggtgattcttctgcctcagtctcccgagtagctgggattacagactaccatgcctggctaatttttatatttttagtagagacagggtttcaccatgttggccaggctggtctggaactcccgaccttaggtgatccacccgcttcggcctctcaaagtgctggtattacaggtgtgagccaccatacccgtctctttccatttggtttggaatagatactaaattccaaaacgtcaatattactgaaagtttgacaatgatgacatctgaatgatactctttctgctttgatgacaaattatcacctgttctggtaaatttcttgctgtgcttacgttttttctctttactttttccttatgttagtagatgtttcctgggtcttttttgatacattgatgtatttacttccatccattattaaaatggaaagttaatttacatatatataaaactaaattctgttttcacatattctaatttacacatagtaattgaaattttcaaaatccaaagtagcagattatgcttgtgtttactataaaggttattgcctatagtaaaatatgcaattcttctgaaattgtctactgttgtcaaccaagaagatgatgagtttaagtgttagaatacaggtcaaaagtgtaagttcaatacgttaaacttaagtaaacttgatttatatttacattaatgaagacattttaaaaacttattttctaggacaatcatatcctgattcagcccttcctccacaaaggcaagacagattttgttctaattctggtagactgtctggaccagcagaactcagaagttttaatatgccttctttggataaaatgggtaagaagtactttgtgcttttcttctttaaaaattttggtggcacactaaagaactggaagttagaataaagaccaatataattgctatctctagtagttcctaaggccaaaatctctttcctgaaaatgtcctggttttatgtttcttgttatattgtacacagacatggcatccaaatatatgttggtgggttggtttgagcaccatggaaataggtttactccatatacctatgatgataaattttactctgttctatgactaattttctaatttttctagtccacttacatgtgttctgtttagtaatcagggaaataagccaggcaaatgtgaatggatacataaaaacccaccagaaaacaatttagatgcatgctctgttgatattgtaatcagttatattaaacatttcatgcttagatataactaacatgtactgagcaatctactatttgtcaggctgtcttttacttaaactacctcatagcaacccattaaagttgggaaatagatgtatgcagtgtatcaaccagaagtacacaacgttaagaaaataaaaattttttttaaagtcaagatttaaatgtattggtaaaaggtttcctcaggaaaggacatatatttatatattattaaatatatataataaataatgttatatatataattttaaaaatattgattttctgacatagtagactatataatatagctgggactacaggtgtgcaccaccacacatggctaattttttgtaaagatgaggtttcgacatgttgttgaggctggtcttgaactcctgggctcaagcaatccacctgccttggtctcccaaagtgctgggattacaagcatgagacaccttgctcagcctggaaagtcagtattttattttatttattttttaattattatttttgagacagagtctctgttgcccagactggagtgcagtggctccatctcggctccactgcaacctccgcctcctgggttaaagagaaacccaggaggtttcacttgtgtcaagcacaagtgaaaaatgaccagtaagacaaggacatttataactggctgaagtcatggactttggagtctagttagttggggaaggaagtgagggaggaaactcagtggtcagaagcatcagtgacttccaaggacagatgtagtgagaataaatgagaaagctacaagaggagaggtagttgtggtcagagaggattgcatttcttgatgataacaaagttcgggaacatttatttcggaacagtagctaaatttcagtagctagtctctcttacttaatggaggaataaggacggaaggaagaagaggaggaaggagaagaggataggaggcaaacataaaaggagggaggaggaaaagaaggaaggagggagatgcttcctcccagatgtcttcttagcattctgctccagcaggattgcttaggaactagccagagaaataattgccacatgccatcatagaactctgagtctgccagaatttctagggacctcaagctgttcttgtggccgcaatataggatattggtgtccagctggcttatgtgccaacaaggggagtgggaaaataccaattttgtgatctggagatactctaggaataaagtgataaatcatgtacttttcatggtttaacttttatgtctagatgggtcaatgccttcagaaatggaatccagtagaaatgataccaaagatgatcttggtgtaagtattgaaagagtggaattgtatgcatgtattcagaagccttctttttttttttttttttttttttatggagtttcactattgttgcccaagctggagtgcagtggcgctatctcggctcactgcaacctgggttcaagcaattctcctgcctcagcctcctgagtagctgggactacaggcgtgtgccaccacacccagctaatttttgtatatttagtagagacggagtttcaccctgttggcgaggctggtcttgaagtcctgacctcagatgatccactcgccttggcctcccaaagtgctggtattacaggtgtgagctgctgcgcctggccctgagccactgtgcctggcctgtgccttctaatctcatgctttactagaatagaaatatagctaataatctaggttttgatataaagctgattttctctttttgattaatatactttctacttagcgtgaaagctgtttcttttgtagatggtaacctatggtgataaaatacaatttgcagactaggagtttgagttagtttaagattttagttccctccccatccttggatttttatttgaatattttaaagtatatttttgtttattaagatattgatttttggaaaatataaacatagacattttgctttttctttttttccagtatatatttgatacaatagtatatattttagtgctcttgggttaaatttctgttttatctttagccagactgttactttgttggttaaagctgttttctgttgacttaataaaatatttatgataactaaaatgtgatagctgatacattactgtggaaagctgtttgaatctttctctagagctttctaagactatcatggaatgctttctgtctagatgatttcttctaagcctgagattttcgggaaaatgattgcaaatttactgttttagtgactgccatatgtcaatttgttgtagaatttaaatgtgcctgattcatctctccctgctgaaaatgaagccactggccctggctttgttcctccacctcttgctccaatcagaggtccattgtttccagtggatgcaagaggcccattcttgagaagaggacctcctttccccccacctcctccaggagccatgtttggagcttctcgagattattttccaccaggggatttcccaggtccaccacctgctccatttgcaagtatgcttttttaaactttttttttaaagctcaatatgtggtttattaatcggagatttaattttactatctgttaatgtagtaacacagtggaggaaagttttttctagcattctgtgaatctgaaaattctcattacttttccgaattgggaaggcagccagccataagtggactgcaatgaggtttcagcttgattcatcttaataatatagaattatttctgtattttggcagtcaagaaaataatggactttttgcaggtcttacgataaaactaaaattatctgtaccttatttggtagcaactggttattctgacagttagtgaaaataataacttatattctagcattaaaattactggctaagatattttttaaagtctttttcataagtagttctgatgcagtcctacttatttaaaacttaaaatgtatttattacgtttgaccgaatttttggatttattgaattcttttaaagcttcacataagaaaaagggaataatatgttgcttttatattcatactttactgttttgaactatagggttctgcagaataaatatgtggttaccaaatactaggctttgcctatgaatgtctcatatagtctttccttcccttgtttctcttctctttttaaagttaaaggtgaattaaaatgaattttgtttggggaaattttaaggtggcctttgatattactggaaatgttttagtataatatcaaattagaattgggaatcactaatacgaattttaagtttgttgaaaattatattacatgcagatgttttttgaggactttgataatgaaagaaaaaagtgatttacagtaagttttatatattttgaaataattcctcttttttaaaaaacaggtgttaagataggacaaaaattacataaaaattaatgatatttcctttaatcatctgtatttgaagaggtacgtttttctcaatgtaaaaattaatttgttagatcaagtaattatctagtgtcaattttcaaataaaagaataggtaatggaagttataaacttaatgatttattagggcacagtacaggttcttaaagttaaaaaatgtcttttaccaatctctttgaacagtgagaaatgtctatccaccgaggggttttcctccttaccttcccccaagacctggatttttccccccacccccacattctgaaggtagaagtgagttcccctcaggtttgattccaccttcaaatgagcctgctactgaacatccagaaccacagcaagaaacctgacaatatttttgctctcttcaaaagtaattttgactgatctcattttcagtttaagtaactgctgttacttaagtgattacacttttgctcaaattgaagcttaatggaattataattctcaggatagtattttgtaaataaagatgatttaaatatgaatcttatgagtaaattatttcaattttattttagacggtataactatttcaatttgattaatccactattatataaacaatagtgggagttttatatatgtaatctttcaggtggggaggctttaaattctgaagtctgtgtctttatgccaagaactgtatttactgtggttgtggacaaatgtgaaagtaactttatgcttaaataaattatagttgatttaaagatttgtttggcattgataataataaaatcagtagtttttctataactatggctctattaacttttttccttttaccaataactttgaggtgcaaaactcaaacttatgtgggtcttttgtgttcaattatgttatgacaaatgtgctctctttcttgtaaatagacatgagtggcccaaagcaacaaattaatacacttttaaaagtcaaaattgattatattttaaagataaccaggatattatctaatggtgaattgtagaattttgatcttcttattcactgagtttcttgcacggtttctttattgcttttttttccccgcctgttcttttgtaaggtatttactattttctgtggaggatattgagatgtactacaggataactgtagtgaatgatgtgtcatcattttgagctttggactcaatatctttagtgtttccctaaatcagatttgtaggtcatgttaagcttcttgcacattaatatgattatggaaggaaaggcagtgaagcataactaataaacatcataatacttaa

SEQ ID NO: 1183 - DNA, 85922 bp, Homo sapiens
atcacagtgtggaaacagaagagtgcaggatatattagaatctgaaatctttctcaaggatatgaggtgcctggtagaactttatttacatgttaggaaattttaacatgagcttttcaagaaatggaattgaaaagtccagaggaagaggtgagtttataactattaagcatactgaaacaaatgaggtttggaattttgcactaagtttgttaagctttactgtgtttttgctatggggggaacttggatttttctttttttttcattttatcctctgtccttaatatttttaatatttggagtggtaattactgaaaattggagagggacatagagtgacttagggagggcaaagggaggttttttttttgtttttgttttttgaaagttctaaaacctgaaaattattctggagtcttccgaaaatgttcagacacatttaagaatttttattgagtaatacaatgttctaattgaggcatacacgttgttctaggagtctgtgaaattctaaagataaaagtttgattatgcttgttttgactttaatgaactattcacataattttaatacacagtgtctaacacgtatgaaagttgtgtaataccttataccttaacaatggagaattactaagcaattttggctactctgatattagcatttcctgaaactcctcaggctgatgtggcaaaggagaaatagcaatcttgagttctgaaaagctaggccgcattttggtcctgaaaaatcacttgctgtgaacttgggccagtttttgattttttaaatggcataacagttcgttgctacaagaggttacatcaggaaaatttcctaaggatttaagattttgttcatctattgagttcttttgggtgatttgtttaggaggaagtatctgctcctttttgagttgcttcaccaaagtacttgagtgagaaggcagaatataatgagaatgatcatgctggcaaggaagacatatatatgagatgggttatcctttacacctacgtcagctaaaaccgtctcctacgaacaaatccagcacttggcactttattcgacggtcctaaaaatagagtcctaaatttagaaggcaaggtgctacttttagctcctcttctcggaggaaaacagcacgcaccgcgccaggccaaggtccacggggatttgatttagcatttgggtaactggccgctaatggaactgaagacagctgggcctaacaagtgcccaggtgactcaggtaagcgaggaaaccagatcgaggttctcttgcgtgggacaggttaaactctgaccaaaccacagctgagccgggacgccttcctgtctaaagtccaaagtccggacgtggttggcagggcgcaccggcgcgtgccccgcaggccatttttctgactggaatgacggcggcggctggcttctcggggctgccggggtctcccggggtacgccgccgtcaggacttctgcagggcgcagacagcaggctccagcgaggctgcggaaggaaagccttgggtgtcggggctgggcctggcgtcggcccctgggtcgggggggtgggggttgcgccgagacgcctctaggagaagtctcgccgccgccgccaccgcggccgcccgaggcgggtgcccttgggacatagccctggtctttggggttgtgcggctcacacgacagcgcggagtatgaggccgaatctcatcctctagtcccaagcctctccactaccagggctgggtggcttcgccaggtagagcgccggcccctttaagagcaaacgacccggacacgtctgcgaagcttgcgcgaagaaggggaagtttgcggctgtccgcgcctccccgccttctcgcggctgcccggccgaaaccaaaccgaggggtggggtggcgaggacagggtacgtcgcaggcttgtgcgggtcgggctcggacctgcgctgcctcgggatgtaaagtataacaagagggtcgggatgggcagcgtaggcctgtgaggcctgcgggtgcccctgtcccccagctccccccgcagccggctccgcagtggtccactccggttgccgggtgcggattcgggttccggaccgaaggctgtgtgttctccgccgtttattgtggccccgacaggccggggttactgtggcgaccacgagagcagctttggcgctatggaggagcccggggttacccctcaaccgtatttggggctgctcctggaggagctacgcagggtgagcccaggcgcgatgagtgttacgtggcccaggggtcgcgggagccgccgggggaaggaagcagtagaccggctttggggtctaagccgccgtggtcagaggtcccgaagccagtcctcgtctgctgcccggctcccgcccgtgttcgaggcagtagttaggctcgtagggcgcttgagtggtttttgtgtgatggaggaggacctggggctctgggaaggtgaagaaagcacttgcttagctggactttgcaaagatgtaaatgtttcccgattcctaaaactaattagcctttccgctatgttgtttattttgagcagagacacgtggttccttcgactgtgagaaacttgaggactgttcctttaaattagttacatttactgatgtaacttctcgttgaaccttgaaagaacacctgaggttgggcggggagttgaaattttgattctgcattttttttttttttggtaaagaatgaatgcccttttgagatgctctaccatgagtgagattgttcttcgcttctgtcttgttaatgtacagtctagagatagtaaactcccagtgttcaaattttgttttttatttttcaggtctagtttataatcaagttgtagagatttttctccttaagtgtttctaggtatctttgttgacatgtgtaggggcatttatgtcgccgtgtttttaaaaactggattaaatctttaaaaagaccacttaattattgaggcagttacgattatgttttcttgttaggtgaattaaaggtagtgttgccatggtgtttatgagttcatagtttgtctaatgcatacgcatatatatgtatttaatatgaaaagagcacctttatggagattctaaatggactaagacttagttttggccactagcatcatgttgtctgttaagagagagaagacaaaaaaaaaaatagtacaaagtagaaactgatgaagtgcttacctaagcatacacacacagtgcagggaactaggagctgtattacttagagtgtaaagtgggcttagggagtgatgggcaatgatgcttgccggagatgtaagtaggttccaagtgctgtaggtgttggagagctcttgaaggcttttccgtggttagacttgtggtttaaaatttaagctcttcttgatagtagcatgtagattagatgttagggaaacaaaacttgaaatagggattaagggagaggtgacagtagtaaggataggaaagagggtactgtgtggagaaatagcctctaagagctaaaatatgtttgactttattgattgcatgtgaagggtgagagagaaggaatctagaaggactcccaggtttctggctgtggtaacttattcatggaggtagggtttttagaaagagaagcatatttccctttcttcactaaaaacaataataatcaagatttagtttttataggactgccagtgtacatggagaaatgcagaaatacatggagaaatgcagccagattttgcagttttctctagtctggtgcgttgtatcttcacctgcacagtttttttttttttttttttttttttgctaaatgcgagtaccctggcctgggggctaggatggcacaacattgttccgctttaaattttttttttatttttaaaaattattttgtattgagatatattcacacaacataaaattcatccttttataatgtccatttcagtgctttttttgttaaattcactatgttatgcaactgtcagcacagttcctcaacatttttattaccccagaaaataaactctactgattagcagtcttaattcccacccctcatcccttgacaaccactaatctattttctgtctctatgaacatgtctattctgcatgtgtcatgtagtcatgctatatgtggccttttgtctggcttcttttacttagcatgttttcaaggcttatccatgttgtagcatgtaacagagcttcatttcttttttctttctttttttttttttgagacagggtctcatccctgtcacccaggggggagtgcagtggcttgatctcagctcactgcagcttagacctctctggctcaggtgatcctcccacctcagcctcctgaataggtgggaccacagcacatgccaccaggcctggctaatttttttgtattttttgtagagacagggtttctccatgttacccaggctggtcttgagctcctaggctcaagtgatctgcccacctaggcctccaaaaatgctgggattacaggcgtgagccacttcgcctggcccttcatttctttttatggtgaaaaaatattccgttgtgtgactatatcacatttatgtcatagttgatggacatatggattattaatactttttggctattatgaataatgctgctttgtgtataagtttttatatatgtttttagttctcctgggtaagtacctgggtggaatcgctgagtcatatttaccatatgtttaactttttgagaactgccaaattgttttccagaggtcacaccattttacatccccaccagcagtttatgagggtttcagttttctgcattctctccaacgcttgtgattttctgttttcttttgtttttaattgccacccttgtgggtgtacaggtgagtggtatttcactctgttgtggtttttttttttttttttttgagactgagtcttgctctgtcacccaggctggagtgcagtggcatgatctcggctcactgcagcctccacctcccaggttcaagtgattctcctgcctcagcctcctgtgtagctgggactataggcactaaccaccacacctggctgatttttgtatttttagtagagacaggtttcaccatgttggccaggatgatctcgatctcctgaccttgtgatccacccgcctcggcctcccaaagtgcagggattacaggtgtgagtccccccacccggctttactctgttttttgttgttgttgttgtttgtttgttttgttttttaagagatggggtcttgctttgttgcccaggctggagcgtagtggcgtgatcatagcccactgctgccttaaattcctggcctcaagggatcctcctgcctcagccttccagagtgctggtgttacagatgtgagccaccacaccaggccttgtggttgttttgatttgtattttcctagtaactaatgatgttgagcatgtgcttattgtttatatcttctttggggaaatgtctattgatttccttttgctcatttaaaaaatgggtggtctttttattgttgagttataagcattctttatacatttagggtgctaaatgcttaccagataaatgatttagaaagattttctctcattctgtgcattttcttttcaccttcttggtgtgtcctttgaagcgtaagcgttctaaattttgattaagtctaatttatcttttcttcctttggttgcttgtgcttttggtatcatagctaagaaaccgttgcttaagacaaggttacaaacatttacagttatgcttccttctaagagttttagctcttacgggaagttcttcgatccactttgagtgattttgtttccatatatgttatgaagaatgggtctagattcattccttggcatgtggatatttattggcttattctagtatgatttgtttgaaagaactgtttttttctcattgatttgtcttaatactgttgaaaataatttaccataaatttaagggtttatttctggactctgatttctatttcattggtctgtgtctgtccctatgccattactacattatctttaaaacatttttttacccaatgtcttgattattgtttctttgtagtaagatacagtagggaagtatgagtcccccagcgttgtttttgtttatccacgttctttttctttatcaatattgttttggctatgtggagtcccttgcatttctatataaattttaggaattcagttttaggaatttaggattcagtttgtccatttctgcaaaaaaggcagttggaattttaataggggttgcattgagtctgttgatcagtttagggagtattgctctcttaataatattaagtcttccaagctgggtgcagtggttcatgcttgtaatcccagcactttgggagaccaaggtgagcagatcatttgagcccaggacttcaagaccagcccgggcaacttggtgaaactgttgtggtctttctgctccttagctcagctaggtccaagttcttgtctcacaaccaagaagaattaggcatgcggaccccagagagtgagtggaatagaatttattaagtgaaaggaaagctctcagcaaagagggaatgcagggggtggttcccctaccagaaggcaggaaagtccccctgtgtggctgggtctgcggccttttgtggactcagaatggggagtgcatgctgattggtttgtgagtatgcaaaaaaggttaaagcaaagacaccacttagaggtgggcgtgacaatgtagacaactaattaggaggccgggtgcggtggctcatgcctgtaatcccagcactttgggaggctgatgggggtggatcacgaggtcaggagtttgagaccagcctggccaacatggtgaaacccttctctactaaagatacaaaaaattagctgagcatggtggtgtgcgtctgtaatcccagctactcaggaggctgaggcaggagaatcgcttgaacccgggaggcggaggttgccgtgagctgagattgcgccattgcactccatcctgggtgacagggcgagactccatcccaaaaaaaagaaaaagaaaacttattagtaaagggtaggtatatgtaaaataggtgaaagatggggatcaatcagaggaaagtgggccaaacaagaaggcaagttctcaatctggtccaaggatttaacttgtggcttggctttcaggctttaaactgtctttggcttgaagttggggtttcactagggacccgcccctatctgcctgggcatttggctgcctcctgccactctcaaaatcctgtctttaaaagaaatacaaaaattagttgggcaaggtggcatgtgcctgtagtcctgctgcttgaggctgaggtgggaggatcatctgagcctggggagggcaaggctgcagtgagccaagatcgcaccactgcactccagcctgggtgacagactcagtccctgtttcaaacaaagaagtcttccagcccatggacgtggattggctttacatttatttaagtcttccttcgttgctttccacaatattttgtagtttcagtgtgcacttcttttgttaaatgtattcctaataatcttattctttttgatgctattatagatggaaatgttttctttatttcattttcaggttgctcattgctgttgtatagaaattcaactgatttttctatgttgattttgtattctgcaactttgctgaacttaatagctctgatagtttttctataggttctttaggattttctctgtgtatagaatagcattatgtcatcttcaaacagtttttcttcttcctttccagtctggatgccttttatttatttttctttcctaattgctctggctagaacctccattacaatgttgaatacatgttgatagagcggacattattgttcctgatcttaggagaaaagctttttttttttttttttcctcatctttaagtatgatgttaactgtaggttttgcatagatgtttcttgtcaggttgaggaaattccctcaaatcgtactttgttgagtgtgttttgttttttttgttgtttgtttgggacagggcctcactctgttgcccaggctggagtgcagtggcatgatcatgattcactgccgtctcgacttcctgggcacaggtgattctcccacctcggccttctgagtagctgggaccacaggcatgtgccatcatgcttggctaatttttgttgaatgttttgactatgaaacggtgctagatatagtcaaatgctttttctgtgtctattgagatgatcatgcgttttttttttctcttcattttcttaatatggttcataagattattgtatgttaaaccaaccttgcatttctgggataaatcccacttggtcatggtacataatcctttttatatgttgctggatttggtttgtcaatatttttttgaggatttttgcatctggagtcataagatatattggtgtgtgattttcttttcttgtgtgatgtatttgtctggcttttagggtaaataccagcctcatagaataagttaggaagtatttcttcctcctctatgtttgggaagagtttgagagtgattggtgttaatgttttatcttggagaggtgtaccttcatggaactttgtgttatagtcaagtattcacagggtctgcatgttgacattctttttgttattagtatatatcatgtttgaagttagatgaaaaacaattttagtttattcttagtatattttgtcaacctgattaattgattttttttaaagctacttgatcttgaactcctttagtactcatgttttggaaatggaatagattttaagtgttctgtgattaatcactaccgtactttatggagggttactcttggaggggttacccatcaccctttaaatttcagtttatcagattacatgtaattctgtattatatttgttgatatttgagaaatttggttgttctttctatgtttttgtgagatagggtgttatgttgtagataaaatttaagggtgaaaaatctccttgagaaagccagaataatttagaccagagcaatgaatttgagatgaatcctttagaactcagtttctttttttctttttttctttttttttttttttgagatggagtctcactctgtcacccaggctggagtgcagtggcgtgttcttggctcactgtagcctcctcccgggttcaggcaattcttgtatctcagcctcccaagtagctgggattacaggcttacgccaccatgcccagctaatttttgtatttttggtagagatggggtttcaccacgttggccagactggtctcaaactcctgacctcaagtgatctgcccaccttggcctcccaaagtgctgggattacaggcctgagccaccgtgcgtggccaagactcagattctttgcttttctccagtctgccagatctaaccagctcaaggctttattttattttatttttttaaagttttttttttttgtaatcccagcactttgggaggccaaggcaggtggatcacctgaggtcaggagtttgagaccagtctggccaacatggtgaaaccctgtctctactaaaaatataaaaactagccgggcatggtggtgggcacctgtaatcccagctactcgggaggctgaggcaggagaattgcttgaacccaggagacggaggttgcagtaagcctacacggtgccgctgtactccagcctcggcaacagagtgagactccgtctcaaaaaaaaaaaaaaattttttttttttttaaattattccttaatttccatgtttccttaatcctttgtgtgtgtgtgtgtgtgtgtgtgtgtcagagtccagttttgttttgtcacccaggcttgagtgtagtggtgcgatctgcagcctttgcctcccaggttcaagtgattgtcccacctcagcctttctagtagctggaactacaggtgcctgccaccatgcctggctaatttttgtatttttagtagagacagggttttgccacgttggccaggctggtctcaaactcctggcctcatgtgatccgcctacgttggcttcccaaagtgctggcatgagccactgcgcccggccctagctcaatgctttaaactagaatttaccatgtccttttagaagagaagagctgataaaatgtgattgaatctaagaaatattattgtactaaaggtaattacgtgtttgatctgagagatgcttttggaattgccttttaaagtagagtgtcataggtcatattgattacacaatttttgagttagtgtgcgtcttatgtgttgaatacattagctaaaagtaagatgcttggaaaatgtgtaaactgtgaagaaaacttttcttcctggtattgtgtattgaatgccttttttcccccaatagcaaaaataatttttttttatcattaattgcttgtaatgatattagatttctgcgaactggtacctagggtaatgtagggagaggcagaagcagagatcagggtaaagggatattttttagaagtataatcaggtttgtttggtacaggttatgaagtatagatagtaccttggaaggagtacatatttggattagagttataaaagattttggagaggaaaataactattaaacactgttcttataggcagaaagggcctaaaaggaagatttgctgtagaggttttgggttaaagcctgaaaagaatcaaaccccatcatacttcagattgttcttaaaatggcatttttcttttttccccttacctttccccttttctttttgatcaagtaatatcttgggcctggtaacaaagagcagaataaccccattaggtaaggatgagtaatgagctgacccagagaaaggtgaaatatagaagcaacagcaaaagccttaggctgtgttgtgctgaaggtctgctgtggggagaagtaatgtggaaaggccatggtcagaagatcagggtctttggaggagataatataaataattacccttttttgagcacctgtctggcatgttcaaacagcattattctcattacacttaagagaagggacgcacagaggtagggtggggagattcaaactccaaacccaaatctctatcagtggtgttcaaaacttgtttttattttttgagacaggtcttactttgttgcccaggctggctttgaatcaaactttttatttttaaagctgcaaattgattttttcttcctgtagggaaattgtatattggggaactgattatactttacagataaaacctgaactggttgaaatcagggtaagagtacctgaaccctaggtcactcagtttctttctttggccttctcttattctcatccttggaaactttaagtcacctctgtagaactccagtttgaagataattgcatttcaccatactgctgttctttacttggcgatagtgattgaaagttgacaaaaaaatgtactctgatactttctgtttggtgttagtctggcagcccattttgtgttgaccacataaacttgtacctatgtttgtaatcaatatttttaccaaaagtacatttttaagaacttacttttctttatcttgaaggttgtggcagcactgcctgaaggtatgagaccagattctaatctttatggttttccatgggaattggtgatatgtgcagctgttgttggattttttgctgttctcttttttttgtggagaagttttagatcggtaagtaaccagtgctatactaagagaatgttcattttgtcactgggctgaacaaataatatgagaaacatatttgttattttaagtaaacaagttagaaactacatagggattcagaggtttttgttttttgttttttgttttttttaaaagagatgagggtcaggaatgagagtcaggcccagtgctgtggctcccacctctaatcccagcactttgggaggccaaggcagaaagatcacttgagcttaggggtttgtgaccagcctgggcaacacggtgagaccccatcactacaaaaaatacaaaaattagctggacatgaggacacccgtctgtggtcctggctactcaggaggctgaggtgggaggattgcctgatcctgggaagtcgatgctgcagtgagccatggttgtgacactgtactccagcctgggtgacagagagagaccctgtctcaaaaataaagagatgagggtcttgtgttgctcaggctggtctcaaactcctgggctcaagtgatcctcctgcctcggcctcccaaagtcttgggattacaggtttgagccaccatgctcaactggaatcttttaatgtaagatcttttatatatatatatatgtgtgtatatatatatatatatatatatgtgtgtatatatatatatatatatatatgtgtgtatatatatatatatatatatatatatatatatttatatttaaagagatggggtctcactatgttgcctaggttgtagtgcagttgctattcacagatgcaattatagtgcgcctacagcctacagcctcaaactcctgggcttaagcaatcctttctcagccttttgagtagttgggactacacaggtccatgtcactctgcccagcttcatcttttttttaattctgggaaattttatttgagacaggatttcactcctgtcacccgggctggagcgcagtggcatgatctcggctcactgcaatctctgcttcctgtgctgaagcaattctcctgcctcagcctcctgagtagctgggactacaggcgtgcactaccatgcctggctaatttttgtatttttttgtagagacgggtttcactgtgttgctcagaactcctggcctcaagtgatctgcctgccttggtctcccaaagttctgggattataggcattaatcaccacgcctggcctaattttgggaaatttttaatgcatttttgggactgctatttttcagatgttgccccttttacttctgacttccctatctcttaacttctatttttcaatttctttatggttttctataccttttgagagttccttaatctgaggaactgaaatctattcttcatctacactcattgtagagtatcttgtcttttaaaggttttcccttttatctctatccatattctgtagatgattgaagtcctcatttcttttctacttgtttgtgttacctcagccctaaggctgatccttttacaaatgaattcccgcctgcttcattatttgagagagaggttaaggaagaaaaaggtttggtttactgtttctttagtcagttcagatctatggccctatggtaacatttctcaggctgttttattttggatattggcatcaagggatatgataataggggcttcttgaaattatttttttagggtcaaatttgtttggggagcaatgggttaaatgaaattaaacaagtatctttagagtaaagttatttcagagtctttaatatgctaattcacaatgtgaatcttcaatagggagtctttaataagtagtatttaggctgggcatggtggttcatgcctgtaatcccagcactttgggggacccaggcaggtggatcacctgaggtcaggagttccagaccagcctggccaacatggtgaaacccggtctctactaaaaatatgaaaattggctaggcatggtggtgggcacctgtaatcccagctactcaggaggctgaggcagaggaattgcttgaacccaggaggtggaggttgcagtgagctgagatcgcgtcattgcactccagcctgggagacagagcaagactctgtctcaaaaaaaaaaaaaaaaaagcatttattttctcattggaaacagaatacttttggcttgtatttatacaaaggcaataagaaacctgtatttctaagttggcagtagacgttaaatgaattgatttacttgagagcgtatttgttttaatgtaatttttgttaaaaatttgtttcaggttaggagtcggctttatgtgggtaagttcttttttctgctttgactctcattgttgtgttgtaaaaacttataataatttactcatggtaatattgacttgacttttttaggacgagagaaaaagcttgctctaatgctttctggactaattgaagaaaaaagtaaactacttgaaaaatttagccttgttcaaaaagaggtaagatatttttgaaaataatattcatgttagagtcagagaactttatacttctcactgtaggtacttctgtgtaaatttaagattatgaatgctttgtttgcagagtatgagagttctctttgctcttcatattcaacacttaaccagtcttactaattttaaccattgtagtaggtgtacaatggtgtctccttgtgctttccttttgagttttcctgactgatgaggtcgagcacacaaacacatcctctgcatgtgcacatttctggtatctgttcgtgtatccaaatgttctcttttcgtaaagacaccagtcagattggattagggcccaccctaacaaccttattttattttgaccacctccaaaggccttgtctccaaatacagtcacattctgaggtactggggttggagcttcaacatgtgaatttgtggggacacaattcagtccataatagtctttgatccatttgaaatcagatctgtgatggtgcagttgagggtgtgtgtgtgtgtgtgtgaagattcattttttttcctgggcgtgtcgagttaatgccatttattggaaggaccatcttttctctgttgttctgtagtgtcatcttcttaagtcactgaatatatgtgagtctgtttctgttaaatcttctattttgttgggctttttgtttgttttttgccaataacatgctttttatagcctgtagttttataacaagccttagtatctggtatggttaatttacagttcttggctattgtgaataaagttactgtgaacattcttctacaagttttttttttgtgggcatgtattttcatttctcttcataagtagtagtggaattggtaagtcattagggcattagggcaggtatagtttaactgtgtaagataagaaaccggctgggcacggtggctcatgcttgtaatcccagcactttgggaggctgaggcgggcaaatcacgaggtcaggagatcgagactatcctggctaacatggtgaaaccccgtccctactaaaaatacaaaaaaattagccaagtgtggtggtgggtacctgtagtcccagctactcgggaggctgaggcaggagaatggcgtgaaccaggagacggagcttgcagtgagccgagattgtgccactgcactccagcctgggcaacagagtgagactccttctcaaaacaaacaaacaaacaaacaaacaaaaaaaccctactggctgtttttatcattttttcttggttttggctctcagcagtgttactatgatttgtctaggtgtggtttttttctatttgtccttattggggtttatgatgcttctagaatctgtggcttaatgtcttttattagtttagtttttttttttttttttttttttttgagacagcgtctctctctctctcttgtctaggctgcagtacagtggtgtgatcttggctcacttcaatctccacttcctggactcaggtgatcctcccacctcagcctcctgagtagctgggattacaggcatgcgccaccatgtccagctaattttttaaaatttcttgtagagatggggttttgccatgttgtccaggctggtctcgaactcctgggttcaagcaatcctcccgtcttggcttcccaaagtgctaggattacagctgtgagccaccgtgctctaccttttattagttttgaaacactcttgattgttacttttccacatattgtttttgcccttttttgttctttctttctgggactataaaaatgggtattttaactttttattatatctcatctgtctcttacgttcttttccagggtttccatctttttgtttgcccacacttcagtctagacataatcttctttaacttccatgttgccaatagttttcacttatgcctataatcatcttttaaaccatccattgagatcttaatttcatctcttgcctttttcagttctgcagttttattgtggctctttttgtagttctttttctctggtacaattctattttttaattccatttacacattatgctctcttatttttgttttgttttgttttggtttttttttttttttggagacggagtttcccctgttgcccaggctggagtggagtgcagtagcgcgacctcggctcactgcaacctctgcctcccaggttcaagtgattctcctgcctcagcctcccaagtagctgggactacaggcacacgctgccacgcctggctaattttttgtattttagtagggatgggtttcactgtgttgctcaggctggtctcaaactcctgagctcaggcaatccacctgccttggcctcccaaagtgctaggattacaggtgtgagccaccatgcctggcctatgctctcttattttatttatttatgtgttatttttattttctgattttcagaatatatgctgccgacaaatatgctttcttattttaatgactactgcattatccagtagtctatttctggtgctcattttttctcttgtttctcagtcaagtcttgtccgcttgaatgccaggttattttatatgaagtgtcagtgataatataataaaaattgtaaagataattttgaagctgtgggtgctgtcgtctctcttcagtgaggatttactgttgcttttcataggcagctaggctagggacattggaaatttcagataactttatgtatttgactttcttttatgtaaaataagttttattgtgtatatttaaggtatagaaatttcagataactttgattttgttttttgtaaaataagttttattgtatatatttaaggtataaacatgatgagatacgtgtatagtaaatggttactatagtgaaacaaattaacgtattctttctctctcatagttacccattccctgcccacccctccagggcagctataatgtactcatataacaaaaatcatgaatgcagtacactattattaactatggatctcatgttgtacatgagatcttttaacttgttcatcccatatattttcttttcttttattgagacagggtctcattctgtcacacaggctggggtgcagtggcatgatcttggctcattgcagcctctatctcctgggctcaagtaatcctcccacctcagactcctgagtaactgcggctacaggcacatgatacatgcttgcctgatttttaaattttttgtagagatggggtctccctatgttgccaaggatggtctcaaactccctggctcaggtgatcctctcgcctcagcctcccaaattgttgggattacaggcatgagccaccatacccggccatattttctgacctacatgtttcttccctcctacccaacactgctaaccactgttttgttctctatctctatatatttgacctttacaaaaattccgcatataagtgagatcatgcaatatttttctttctatatctggcttattttacttagcaaaatgtcttctaggtccgtccatgttgtagcaaatggcaggatctccacctttttatggctgagtaatattccattgtaaatatataccacagtttctttattcgtttgttcattgatagatacctaggttgtctccatactggctactgtgaataatgctgcagtgaacatgggcatgcagctgtgtgtagaaggtgccaatttcatttttttcggataaatatctggaagaaggtttgctggatatagtagctctattttaaatttctttaggagtctccatactactttctgtagtgactgtacccatctacatccctgccagtagtgtacagtaagccctcaatgtccttgatagatggttgaaaattgactttaagtgaaacagtgtatactgaattcagtttttttttctcatcaatgttataatgaaacaatgttgaagaaaacaatgttattcaaaggacaaaggacctgctctatgcctttctcttttcttgtctagaaaaagggttcccttttttttgtaacttttaagttcaggggtacaagtgcacatttgttacataggtaaacttgcgtcctgggggtttgttgtagagggttcccttttctccacaccttcacaaatacttgtcatctctcttgtctttttgataatagctattctaacagatacaaggtagtatctcattgtgtttttgatttgcatatccttgatgattggtgatattgaacaccatttcatatacctgttggccatttttatgtcatcttcagagaaatatctatttaagtcctttgcctgtttttaaatcaggttgtatgtttgcttgctgttgagttgtatgaggtcttttaaaatattgaatattaaccccttatctgatatattttttctcaatctgtaggttgcctttttattgtgtttacttgtgtatatttttattttttttaccttgcagcttcacctcaaaggaactttcattttattgtttcttttgctttgcaaaagctttttagtttgatgtagtcctgttcacttactttttgcttttgtagcctaagttgttgatgtgatagtcaataaattattgccaaggccagtgtcagggagctttttccctgtgttttcttctaggagttttgtagtttcaggttttatgtttaggtcttttatccactttgagttgatttctatgtgttgtataaagttaagagttcagtttcattcttttgcgtgtgaaatccagttttctcactaccatttattgatgagactattctttctgcattgtatattcttggtgccctattgaaaatttgaccatatttatttggatttatttctgggctctctattctgttccactggtctgtgtatttgtttttatactagtaccacgttgttttcgtgactacagctttggaatataatttaaaatgagttagtctgatgctgccaactctatttttctcagaattgctttgactatttgggatcttttgctattccatattaaatttagattaaaaaaatttctgtgaagaatgccattgagattttggctgcgtttccatttctttgtgtgctcctcaatttctttcatcaatgttttatacttttcagtgtgcagatctttcacctccttggttgaatttgttcctaggtattttattttttttgatgctatgtaaataggattgttttctttttttttcttttttttattttttttttattgatcattcttgggtgtttctcgcagagggggatttggcagggtcataggacaatagtggagggaaggtcagcagataaacaagtgaacaaaggtctctggttttcctaggcagaggaccctgcggtcttccgcagtgtttgtgtccctgggtacttgagattagggagtggtgatgactcttaacgagcatgctgccttcaagcatctgtttagcaaagcacatcttgcaccgcccttaatccattgttaaccctgagtggacacagcacatgtttcagagagcacagggttgggggtaaggtcatagatcaacagcatcccaaggcagaagaatttttcttagtacagaacaaaatgaagtctcccatgtctacttctttctacacatacacagcaacaatctgatttctctatcttttccccacctttcccccttttctattccacaaaaccgccatcgtcatcctggcccgttctcaatgagctgttgggtacacctcccagacggggtggtggctgggcagaagggctcctcacttcccagaaggggcagccgggcagaggcgcccccccacctcccggacggggcggcggccgggcgggggctgccccccacctccctcccggaaggggcggctggccgggcgggggctgacccccccaccttcctcccggacggggcggctggccgggcgggggctgaccccccacctccctcccggacggggcggctggccgggcgggggctgaccccccacctccctcccggacgggatggctggccgggcgggggctgaccccccgacctccctcccggacggggcggctggccgggcgggggctgccccccacctccctcccggatggggtggctggccgggctggggctgaccccccacctccctcccggtcggggtggctgccgggcggagacgctcctcacttcccagacggggcagctgccgggcggaggggctcctcacttctcagacggggcggctgccgggcggaggggctcctcacttctcagatggggcggccgggcagagacgctcctcacctcccagacggggtcgcggccgggcagaggtgctccccacatctcagacgatgggcggccgggcagagatgctcctcacttcctagacgggatggcggccgggaagaggcgctcctcacttcccagactgggcagccgggcagaggggctcctcacatcctagacgatgggcggccaggcagagacgctcttcacttcccagacggggtggcggctgggcagaggctgcaatctcagcactttgggaggccaaggcaggtggctgggaggtggaggttgtagctagccgagatcacaccactgcactccagcctgggcaacgttgagcactgagtgaacgagactccatctgcaatcccggcacctcgggaggccgaggctggcagatcactcttggttaggagctggagaccagcccggccaacacagtgaaaccccgtctccaccagaaaaatatgaaaaccagtcaggtgtggtggcgcgcgcctgcaattgcaggcactcggcaggctgaggcaggagaatcaggcagggaggttgcagtgagcggagatggcagcagtacagtccagctttggctcggcatcagagggagactgtggagaggggagaggggagagggagagggagattgttttctagatttcgtttttggctaggtcgttatttgtgtatagaaatgacatagttttgttttgatattatatcctgcatctttactgaattcagttattatatctgtatttttgatgacatcttttgggttttctacatataggatcatgtcatctgcgaacagataattttacttctctgatttggatatcttttctttccttatccttctcttccttccttcttactttttttttttttttgagacaggctctcactctgttgcccaggctggattgcagcagtgcaatctcagctcactgcaacctctgcctcccgggttcaagtgattctcccacctcagcctcccaaattgctgggattacagatgtgcactactgtgcctggctatttttctgtgtgtgtgtgtgtgtgtgtgtgtgtgtgtgtattttttggtagagacagggtttcaccatgttggacaggctggtctcgaacttctgacctcaagtgatctgcccaccttggcctcccaaagtgctggcattacaggcgtgagctaccatgccaggccttttatttctttttcttgtctaattgctttgatagtacttccagtactattttgtttttgttttttgagacaaggtctcactctgttgcccaggctggagtgcagtggcatggtcatggctcactgcagcctcagcctcccgggttcaggtgtttctcccaccttagcctcccaagtagctgggactacaggcgtgcaccaccacgcccagttaattttttgtattttttttgtagagatggtgtttggccaagttgcccaagctggtctcgaacttgggctcaagtgatccgcttatctcagcctcccaaagtgctgggattacaggtgtgagccaccgcacccagcccttccagtactgttttgaatagaagtggtggttgtgggcatccttgctttgtaccagatcttaatggaaaaggtttcagtttctccccactgatgatgatatttgctgtaagtttttcataaatggcttttgttatgttgaggaactttctttttattttttttcattattttaaaaattttattatttattatttatttatttttttgagatgaagtcttgctctttcactaggctggaatgcagtggcgtgatctcggctcactgcaactctgcctcctgggttcaagcaattctcctgcgtcagcctcctgagtagctgggactacagtcatgcgccaccatggctggctaattttttgtattttggtagagacggggtttcaccatgttggccaggatggtcttgatctcctgacctcatgatctgcccgcctcggcctcccaaagtgctgggattacaggcatgagccactatttagttttttgagacaaggtctcgctttgttgcccaggatggagtgcagtggcatgctcatggctcactgcagcctcaacctcctggggtcatgtgattctcccaccttagcctccctagagtagctgggactacaggtgtgtgccaccaagcctggctaatttgtctatctttggtagagatgtggttttgccatgttgcacaggctggtctcgaactcctcggacttcccaaagtgttgggattacaggcgtgagccaccacacctggccagaactttacttctatacttaaactgttaagggtttttatcaagagatgatgttgggctggacgtgagggtgtgtgcctatagtcccacctacttgggagcatgaggtgggaggatggcttgagcccaggaattcaagtccaacctgggcaacataggagaacctatctctcaaaagaaaaaaaaaatggatgttcaactttgttgaatgttttttctgtgtcaattggtatgatcatgtggtttttgtctttcagtctgtgaatgtgatgtatcacattaattgatttgagcgtgtatatattatacatatatatatatatatatatatatatatatatatatatatatatttttttttttttttttgagacggagtctggcgctgtcacccgggctggagtggaatggtgtgatctcagcacactgcaacctccgcctcccgggttcaagcgattctcctgcctcagccacctgagtatctaggactacaggtgcctggctaatttttgtatttttagtagagtcagggtttcaccatgttggctaggatggtctggaactcctgaccctgtgatctgtccgcctcggcctcccaaagtgctgggattacatgcgtgagccactgtgccggccaatttgcatatattaaaccggctttgcatgccagggataaataccacttgatcccaatgcataatctttttgatgcattgttaatttcaatttgctgatattttatttaggatttttgcatcagtgttcatcagagatattgacctgtaggtttgtttgtttgtttatttatttattttttgtggtttcttggtctggcttaggtatcaaggtgatgctggactcataaaatgtgttaggaaatattccctcctgttgtttttcttggaagagtttaagaagtcttggtaataattctactttgaaaatttggtaaaattcagccgtgaagccatctcttcctgggcttttctttgttgggaggtcagattactttaataacagattgagatatttggaagctgggcctcagttcagaggattagtctgtttttggtttcgactttgttgtaaggtaggcaggttttctttttttttttttgagacagtcttgctatgtcactcaggctggagtgcatgatctcgactcactgcaacttccgcctcatgggctcaagtgattcttgtgcctcagcctctcgaatagctgggattacgagtacacgtcaccacgctcggctaatttttgtatttttagtagagacagagtttcaccatgttggctaggctgttcttgaactcctgacctcatgatccctgtgatctggcctcctaaagtgctaggattacaggtgtgagccactgcgcccatccaaggtaccagttttggttggtaaggacattaatttccttttgctgctgtaacaaattagtgcaacctagtggtgtaaaacaacacacatttattctcttaaaattttgaaggtcagaagtctagaactgatcttttaaaaaatattttgttgtagagatgggatctcactatgttgcccaggctggccttgaactcttggcctcaagtgatcctcccacgttggcctcccaaaatgctgggattacagacatgagctaccatgcccagccttaaaaccaatcttgggggcaaaagttaagatagcagcaagtttgtttccttatgcatgttctaggagagaatctgtgtcttgtgtcttatatggagtctaccaacatttcttggctcataactatgtcaccccagtttctgcttctatcttatatcattcttttctaagtttggtcgtcttgcctcctccttttaaggacccttggcattatattgggcccaccaaaataattctggatgctttttccgtcttaagatcctttatcacacctggacattctggggagcagaacatagacatctttggacaggtcattgtttagccaagcacagggttcatctgacttggcaggtcctgaactccaagtgttttttctcagcttctgattctcctgaaatctctgcttagtttcttagcccatcagcctcttcttctagggggaatagaaatgtcaaatactagacttgcctttctggggattcccacttctctcacaaattctcactgttttgatagctctctgaggctttcagacagatatatatttttttttttggtattttttgtcaagcttttcttgttcttgccagaaaggtggatccagaacaacgtagtcttcaatttgatcactttttttgaataattgaagtgcattttgccaaatcttatagcattatatgttttattgttcattttttgatggttgttccctaccttttaaagatttttatattccccacctgctttatttgttgtatggtatggattaaaagtgaaaagttttgatggtcagttgctatatatttctctttaatgaataggcttaaagaagaggtttacttgtttggggcataattagacagcttacgtaaaaatacgctctttgagtaaatctttggataatctttagtacaatcttaccattagaatttttacttcatttttagtaaaagatgctaatatgagttatagtcctatgttctctgagaagcagactttactcttagaggtgaagttctggcatttgttgccagagctagtggtttgtgatgtgttagctgctctggcattgtttgttgtagtggtcagatttaaaaaacttaaagctaagtaaatccaagtaaatttaatgtattatgtggaaatggattctgtctgcttcttaggcatctatccagataagatttagaatacaattggtagagtttttacttgtgatgttgctttgtttcagtatgaaggctatgaagtagagtcatctttaaaggatgccagctttgagaaggaggcaacagaagcacaaagtttggaggtagaaaatcaaatggtataattttaaaagctggggaaaaaaatactaagtaacaaaaactttaaaaatgtatcttctgaaaactatttgaaaaaaatgtgaaagagcatctctggatgttaaaacttaaataagaaaattaatataggaaatgggacaataggaggtagcataaaatattataaaaatttaaaaatttgagcttttattgctaacttgttttgagtcaggcatgtttatgttcaaggaatcaggagctgtatagaaacttcgttctattattcctgggaaatgtattaaggtgatcgttccttttttgactcagtttgctctagaaaggagaaataagattcatttttacaaacttaggaatagttggcaacaataactttgtaaattatgacagtatttgctttattttcatcctgaggatattaagagctaactagaattaggccagaggtttacgttataagtaatggtgtatgttggtaaatgtttgacaactttttttttaaaaagcagccttatttgtagcatttgctgagttctgtagtatgaatacttccaccatggccagtttcaagctaccaacatgatgtcactgaatgaggagtcttggaagataatgcttaaagtaggctttcctgagccaagtgtgatttggttaattttaaggaaggaaagtatggtaatttgtaatttagctaaactaagacagattagggtaagtgatgggagtgccttactactgtttagatgtggacgtgttgtaaaaagcacagaagtgacaaaggatagcagaggacacctgcgtctgcagatactaaaacagaaaacagtagaccttgtacctttgataagcgtctagtacagtgtggcagttctcaatcactgctctccgtaatcatcagaaactctatgtgttatgattcagaattttctagtagagtccaaaggaagttataaattggattccaaataagtttcttaatgttttcttcatttgttgcctattactatcttcaagaacttgttgaaattatattttatttgctaaccctctgtcttaactacccttccattagtaatttatgtttgataaaaaaattttagaaggcatttgacatgctaacagaagagcaaaaagtaggtagcaaagacatttactcaagcttggtaatactgaggataaaatattacacatcaatttattttcaaggtaatgaattattataggagtaaaattagctgaatttttagctgcattcaacattttggaaatttttcttcaatttcagtaattttttagcatagtattttcagtaatagtaatcataattgaattcaaactataatgtgatgcaatttaaaaaaatatgatagctgaatctgtagataaaatcaaaccagtagagtaattttcattcgggtcagggaattcctagaatgaaatattcaaatttggggtaatatgtataaacaagtttttaaatcactgtaatgtagtatgtattttttttgcttttattttggcctgcattaaaatctttgaatcttttggtttatttttctttaacaagtttgttgaaggatcacaaatatcagaggtatgtttattatagtatttaaaatccatttggaataatccaataactaatcattttaaattaaaaaggtcatagaaaataggtcttaattcaatatggaatattatcatgaagcagccttgatttttttttagttgattttttatgtcatgcctttaattgtattaaattggctttatttctcatttttttctttatagtgcttttaagcagaggttggcaaactgtgcctaatgggctctccacttttttttgtaaaaaattgttttggaacacagccatgctcatttatgtaggtattgcttttgtttctcactgcagtggcatagttgagtaattgcaacaaagactgcatggcctacgagcctaaaatatttattctctggctctttacagaactttgctgaccactgctacaattgctgttattttgatattataaaaatgagcaaatgtataaatgaaagttatttaacttatagtacatattttttattatgctcgtctgatttccctaatgaaaaattcttatatctgtttaataaagttggctttctctcttaggcaacctgtgaaaagctgaacaggtccaattctgaacttgaggatgaaatactctgtctagaaaaagagttaaaagaagagaaatccaaacattctgaacaagatgaattggtaaggcttttttatttgaggagaatataagaaaaagaaagttactgagctttaaaaaattaatatgatactggttaaagtattacattattgtaaaaaatgtaaagaatacaggtggttgtagagagcaaaattttctagatccattcttttcacttcccccagatgttactgtgttaaatttcttgcatatttttatagaaattttctatatgcactatggaagtagctcatgtaaataaaaactgaataatcatgtccatagtgtatatttgtaattacttaacatgtatattaacattaaaactttttcttttgaaaaaacctgtcttaatgaaaatcttgatgtatgtgagattatttagtaaaacatgttagtggacttatcttgagcctatataacttaaatgttatgaaatattaaagttatgagatactattgttacgtaatgttcatataaaatcccttttagcatatggctaaataaactgagaaggtttcttaatttgagcttcacttatggagctaaagtgttaggttaacagtatatctaataaacatggcattttggaaactagagtttagtaaatattaattgcctgatactgtgtttctagatggcggatatttcaaaaaggatacagtctctagaagatgagtcaaaatccctcaaatcacaagtagctgaagtaagttgaattagtctagtaggtctgttgcttttggaaataattttagtttaattttttaaaattaagaaataagacacaatagtaggatttgagatataggggatcccagatatgtatttttttttttttaacaatacctaaatgaattagcatggctgtgttgcccaggctggagtatagcagcacgatcttggctcactgcaacctccacctcctgggttcaagcagttctcctgccttagcctcctgaatagctgggattacaggcatgtgccaccacacccggctaagttttgtatttttagtagaggcagggtttcaccatgatggccaggctggtcttgaactcctgagctcaagtgatcggcccacctcggcctcccaaagtgctgggattacaggcatgagccaccacacccagcttgtattttttttttttttacgtgaagtgcttcagaaaagttcatcttttcagtggacaagtgtttattgagctattactatatattgaggactggttgcttgacacttaacattaatagacaaaaaagtccccaggaagtttaaattttagtaggggaggcagaataaatagttatcaaaatttgctgcacagtacatagaaagttacaagaggtttgtccaaggtcacatcgtagcaagttagtgggaaaggcaggactagacctggattctagacaagccttttttctgctacaccatgctgcctctgctgttaatattggcatggttttgcctttgtttaattctgtgttctagggagtatgtgtaaagatgagctatgtattaaattaattgttacaaacttgacattttttgtttcacttaggccaaaatgaccttcaagatatttcaaatgaatgaagaacgactgaagatagcaataaaagatgctttgaatgaaaattctcaacttcaggaaagccagaaacaggtttgtgctccgtagggactcttcaacttgtgaatatgtaattatagatgttcttgtcatcctcatgactgacccatgctagggacaagtataggcttttccttgagagcatgagagcaggacagtctcccatacatatttcagtgtctgtctcttttgtatagtatacaaaagtgtatacttttggcaccctctaccccagggcagggaaagtaagccagggcatttagcattttggtaatcataaccaacttcttaaagccatgccgaaggggtacagagaatatgagtgaggattattgaagttatagatctggggtctaaagatagaaacaattctggtggcagatcacataaggatgtgacatttgccctctttctcccccacatacatagatactcccacgtatatttcttcttctcctttgccaatgtaattgtaacttttcagtgggaaaatttttcagtgattaaattattataattatccaaatattactcacaccagagccacatggtttgttcttttttttttattttttaattttttagacggagtctcactctgttgccaggctggagtgcagtggcgtgatctcggctcactgcgacctctgcctcccaggttcaagcaatttttctgcctcagcctcccgagtagctgggactacaggcgcgcgcctccacgcccagctaatttttgtatttttagtagagatagggtttcaccatattggccaggatggtctcaatctcttgacctcgtgatccgcctgcctcggcctcctaaagtgttgggattacaggcgtgagccactgcacctggcctcatggtttgttattacatattctgtcttattcaatattttccttagggttaataattgttttgtttcttgtatacttatccggttcatctgtatgctgtcttctagagatacagatatcttattcatgccttcaaatgctttgtttaatctgttaattgcattttttttttcttgaagcagttttttctttggcctcccttggtttcataagaacttattctgtaggtgtgtgttctgttctgtgtcctaagatttcacttcacccccatcctaaaggttcctcttgtctttctcctgtgttagatcttttattttccatatctgagcccttttgcggttaattcttttggttaattttctgaggaagaggtataggagataatttttttagaacttacatgcctggaaatgtcttgtttctcatacttgttgatattttggttgaatatattctgggttggcattttttttttcctcaaaattttgacactgtcactccattgtcttgactttccaatattgcttttaagaagtcagaagctattcagataattggtcatttttggaaatctgcttttttcctcctggaagcttttaatatctttttattgtttccccttctctgaaattacagatcattacacatctcttgacctcgtgatccacccgcctcggcctcccaaagtgctaggattacaggtgtgagccaccgcgcctggccacgggcggggttttcttttcttttctttttttttttttttaatttttatttttattattttttttttattatactctaagttttagggtacatgtgcacattgtgcaggttagttacatatgtatacatgtgccatgctggtgcgctgcacccactaatgtgtcatctagcattaggtatatcttttctttttgttgttttttttttgtttttgagatggagtcttgccttgttgatcaggctggagttcaatggcctgatcttggctcactgcaacctccacctcccgcgttcaagtgattctcgtgcctcagcctcccgagtagctgggattataggtgtctgccaccacgcccggctaattttttgtatttttaatagagacggagtttcaccatgttggccaggctggtcttgaactcctgacctgaggtgatccactcacctcggcctcccaaagtgctgagattacaagcgcgagccaccacgcccggctattggtgggcttttctataggatatatattttttttgtgacagagtctcactttgtcacccagtctggagttcatggcgctatctcagctcactataacctctgctgcccgggttcaagtgattctcctgcctcagcctcccgagtagctgggattgcaggcatgtaccaccatctgactaatttttatgtttttagtagagatggggtttcatcatgttggccaggttggtcttgaactcttgacctcaagtgatctgcttgcctcggcctcccaaagtgctgggattacacgcatgagccaccacgcctggccaggttagggtatttctaattggaggattctcagttgttggtatctgaagagcatttccacagggatgagtcctccacatttcccatttgggaggtgtaagcctgtttgccaacagtcttgcaacttaggtaaagaatgctggtgtctgactgttcagtagtcagtttcctcttaatacttttatgttttcagtatgttacttccaccttcacctggatagatgtcccagagtctcaggttccacctctccaaagaatgaccctgtagggttttgcgtgtgtgtgtgtgtgtgtgtgtgtgtgtgtgtttgtgtgtgtgaaagagacagagatagagaatgaatgagagagaatgagaataagaatgtgtatatatttatgtcatgggaggctttccaactgctttttatacagacttttggccagtcctccttttttccagtcctgcttatacccctggtatttgtgccttcaaatcatgaggctttctagggtatatcaaatcagcctacttttgggtgttcctaccttcaggcttagatttaagttctctctagttggttgagtctttttatcacacttccatttctttccattttctacttctacaattattttttgtctcatctcctattttcttttttccttgtgggtttatgcctttgaaaaaaaaatctgttttctgccattttaatagatttgagtagaaagtggtggtaaaccctgtgttaaatttgccatgttatgatcaaaagtggccttttccaccttggaaaatatttcacctagatcagtcttactctttacaactgttttcatctaactcccttgtaataatccaaattcttgaaacaaactgtattcactgatgccatgttctaatgcactccttctctaatgttttaatactgtatactgtgtacttaagtctctttactaactcatgagagatgacctaatcaccaaatgtgaattttttcttggattctcatttgtttttacctgtatcatctgattctgttttatatatatatatatatatatatatatataaagattagtttttcatgtgttcggaatacgctaatgaagccttagttttgcggagaaatccaataattactgtttggtagaacagagttttttttttttttttttttttttgtgagcaacatggctgtttatttcacctgggtgcgcaggcgggctgagtccgaaaagagtcagccagaacagagttttaaagactaaataaatttagactttttcatatatatgagccatttcttttgtgaattgcctgctcagtcttcttttttctttgcctattttttcttattgacatctaagagctctttgcttgctaaggttattaaccttttgctacaaatattatgagaattcctttcttggtggggtgcagtgggtaacacctgtaatctcagtgatttggaaggtccaggtgggaggatcacttgaggccaggagttcaagatcagtctgggcgacatagtaagaccttgactctacaaaaaataaaaataaaaaaattagcagagtatgtgacatgtgcttgtagtctagttgcttgggagggtgaggtgagagaatatcttgagcccagtagtttgagattgtggtccagcttggatgacagaatgagaccctccctgcctctaaaaaaaaaaaaaaaaaaaaaaaaaaaaagaaataattcctttctagttatttatctttaaatgtcatttgtgttatatttgatttgtgaagcttttaagctttatgtagtcaagtctaccttttataatgatctttactttttgtcatgttcagaaaggctttcctttcctgtaaaagtatatatagtagaatactgttgtggagaatctgatctgttctagattaatggtatttctttttttttttttttttttttgagacggagtctcgctctgttgccaggctggagtgcagtggtgcaatcttggctcactgcaacctctgcctcctgggttcaagcgattctcctgcctcaacttcctgagtagctgggactacaggcgcgtgccaccatgccaagctaatttttgtgttttagtagagacgaggtttcaccatgttggccaggatggtggtatttctaaaggttagttattttaagtacaaaattgcacaatgatttaaaaaataaattttaatgcaagtaaggtatgatattttatatgggatataaggaatggtaagaaatgatcaaatctaagatatgtatatctcaggaaacctttatttgatataaatatatgatataaactagttgaagaatgtgtgtgttattttacactaccccattttgaaagttctttgaaaataggagccatgtttttcttttttaagtagctacataatgccttcttggtatcttttaatgattcacttgtgtgatgagttgcatttttaaaattttcattttcagcttttgcaagaagctgaagtatggaaagaacaagtgagtgaacttaataaacagaaagtaacatttgaagactccaaagtacatgcagaacaagttctaaatgataaagaaagtcacatcaaggtaaatggctctactggttttagtgatcaagttggctagaattttacactaactctgaaatttgaaagctagtttttagcaacttttattttcacaacatattttcataacatatttggccagattttcaaatgtttcttgaagacttacagatttgtcatatgtacatacacatacacacacacatacttatatgaatattctgtgtgtccttttttcttctctgtattttagcctaggtatttaataaagaaataaaaataatggtttctaccatttctcttcaggatgctatctgctcctgttaggaggttggaagagtttgagaaattggatgtatagttatatatattaattgaatatctttaatgtaactggtgtatgtactttgatggagaggaatacttttaaaaaataaatttaattgaaacttgactccagtcataagaataaaaggattttttgattttttagatttttaagatttttaaaaatcttaatgctgataaatacagatactcaagtgtatcaaataatgatatgtaaaactaacgttctataatttacacagtgatgtggatgttgtcatattgaaagtgatgctctcactcataggtgggagttgaacaatgaggacacttggacacaggaagaggaacatcacacaccgggacctgttgtggggtggggggaggggggagggatagcattaggagatatacctaatgtaaatgacgagttaatgggtacagcacaccaacatggcacaggtatacatatgtaacaaacctgcacattgtgcacgtgtatcccagaacttaaaatataataaaaaatagtataaagaaagtgatacatttatgccagttatgttgctactaagaatattttcaaaattccagctttctgagttttattcagaatttggcatatatatatatacacacacatatatacatatatacacatacatatacacatatatacacatatatacatatatacacatatatacatatatacacatatatacacacatatatacatatacatacacacacacacacacacacacacacacacacacacacgagatggactttcaatcttgtcacctaggctggagtgcaatggcaccatctcggctcattgcaacctctgcctcgtgggttcaagtgattctgctgcctcagcctcctgagtagctgggactacaggcatgtgccactatgcctggctaattttttttgtatttttagtaaagacgcggtttcaccattttggccaggctagtcttggaactcctgacctcaggtgatccgcccaccttagcctcccaaagttttgggattacaggcgtgagccaccgcatctggctgtggcatattgttttatttattttttctaaacttcctctactaaaggctttgggattcttttaaagataacaagaatgagatgctaacctcaagctctgctcaaaggtataggccatgttatttgtgcctggaactctgaagagagggaggagatcgaagggtgaaaattgtagatcagtgcattatttttaggtgggtccctccagaggaatacatgacacgtcatttgattatctgtagtgttagaaaatatttctttaatcaacaaaattcaaaaagtacttttggaaaacctctaatgttccattcaaattctcttttataaatgtctttatctcagctaattgtttccttgaataaatcaactaaaaatctacgatctttttatacattatgtatctcactgcagatgtgtttggtgtcacacagaatttactctcatgttaattagggcactgttatttgtggcatgtgagaaatgtcatataaaaaatattttactactttttagttgcataatattaatatgtactatatttgatttgggaataactagttttggcttttacttgcagagtttaatagtcaataaatgttaccatttctcaagactacaatatcttaataagaggtggaaaataagagctcttgtgttgttatttatgtggactgatttttaaactataactgtacattcacaagttgtaaagctgttagcataaggcattaccctctctatttttcccctttgttcaatgtcaagactctgactgaacgcttgttaaagatgaaagattgggctgctatgcttggagaagacataacggatgatgataacttggaattagaaatgaacagtgaatcggaaaatggtgcttacttaggtattaagtcatgactcatctccttttgctaaaatggtgactagctcttctatttccttttcgttccctgtgtgcaccatgttctttatatgcttttactttggcacattctgtctgtctgtgacacactgtcctttctcaccatcccttatagtttttagcttcagctggagcactgccttttcagtaagtctttctccagctgctcagacacacttacagcctcctcccttttttttgtgtattatacatatctttattatagccattttcaaaattacatcataatcatttcaatgcctgtttttccctgtactgtaagctaatcaaatggatgaatgactagtttgaagaacaagtgttctataaatacttcaggatacttcttttgcttttgtcagaggttcagatggttacagtacttttaatgttagccattcaaattattattgccattgatggttgtgctctgaagttggcaaaagtggccaaatttagtttcactatagccccttaatgtattctcacaccaattcctttgacctaaaaaaaacctttttattttgaaatatggcatcataggaagttctaaaactagtacagaggtcccatgtacccctctctcattttaccccagtggcagttcttcagacttttatgtcatttttctgttctcttccccagcccctgcataattaacaaatttattatggaggaaaaagtgtgattaaaaatttttttcgtgacaacattaatatgttggaaaaaattacatccctaaaataagtatataaagttctgtttgtactttttcatttctactttattatatataaaataatcctttctctatttgagaaaactcatgcttgtttaatgttattttaacttgggttataattttactcatattttggatgctgtaagaatccaagaatagttaatgattgtggtctatatttagatgaatatagaatccttgttataactctgttcttggagttagagctgaagaaccttgttaaatggtatgacacttcagtgcttttattgtttagcttcctgggagcaggtccaaggccattctgctttataccaaattctttattgtagcaagaagagggattataagtttctggtttagtgaactgataaaatcattttgatgtctattgtcgtattgtactattttcccaaatcattgttgtgcttttgattttcactgtagataatcctccaaaaggagctttgaagaaactgattcatgctgctaaggtttgtgctattagatacttaaaaagaataaggaggaagaaagagaacgtggattactcatgtcccagtaaatgtttaaaaagtccattttattgttcccatataaatatatttacaaattatcagaattttcatcatcaattgctttttcctttcaattattaactttagaaatttatataatttttggaatttatcaaaataaaaaattccaagttctgtactcatttttcggataagactatatttaaaatgtttcctgtattttatcttgtagttccctcagtgcattctttttcttctagtctcagtattttcttaccccttctgccctatatcctattttaagtaaatactagatgcctttttttctggtttattccttctcttttccaccctagtagtgtggtatcctcatttttgctgatctatgtgaagtcttggtaatgtagtttgaaggctgctttaataaaaacttttgttgaaagtaaatagaatgaaaatagtcactttcttaagcagccagtgaaaagcattcactacttttccctgtcccttgttctgagacttacaagcattgacgactttgctggtttttttaagacggaagctgcattatggtttctgtattccaggtgataatttcatcaaaacgataaaatcacttaaaaagtgttaggggggtcatactgaggttttattttttatttttatttttttgtataactgattaatgttacttttttccttcttcccttctttaaagttaaatgcttctttaaaaaccttagaaggagaaagaaaccaaatttatattcagttgtctgaagttgataaaacaaaggaagagcttacaggtaggtcattgacatacatacttttaatgtttttctaagtaagtacatctcttggcagagaatggtaaaaatgaattgaattaactttgggaagatccaattttatttttttttaacttttgttcctgttgggtatttgtgaaacattagtcctggtttttgttgtcattgttgctaaaggcatatcgatttcctctgtatttatgtgaagttaaaataaggaaattttttaaaaaacatgtaaaaccgtatttatcttcgaattacagtgttatgtgtttgaatggttttagatgttaaaaagtagcaaattgaaacttaatgtttaaagtctttgttaattgaaaaattgatcttcaatagtggtactatttgcagtatgattcgttcctttaatgtacatacgtagtatattagtacatacgagagtgatgttagacctgtagaaatgaaggtgttgttttaattgaaaacatttatgtttattttgctgatagtgtttgtattttcaaaaagtaaacaagttctgtcaatatgtttgaaaatttttaaagttgagataaatagcatctcattttgtaaaaataaaaaatataaagatttaccatatgcgtttgcatcagaaaagactggaaggacatactcaaatgtcaacaatgattatctctgaatatgggattatgggcagatttttatattctttttacttatctgtattttcaaaaacttctacagtaagtgaactgcatttataatactgttttaaaagattgaaccaccaaagatagaggttattaaaaaattatatccctactcacatgattatagtaattggattatttttggatttcaagaaacattagtattagtttaagagaatgttgctatatgtaaagcattgtactaaaaactatgggagatatacagaaggaaaagatagcttactttcaaggaagctgtatttcaaaaaatgtgtgtagaaagtgccagagtggcaaggaaatttgctcaccagttatcccactccttaatacagtttcctggcaaatctttgtttctttcttagactaatacttggagacctatgtctccttgtactcttctttcaaatctaactttgtttttttaatggatcatgaaagataaatttctgtaattgatgttttattcatagcatgaagattttcctctaaactgtttcttccttttctggtaatcatttacagtggtctttatgttacaatttgaaacacagtagaagtacaaaaatatggccaggcgcggcggctcacgcctataatcccagcactttgggaggccaacgtgggtggatcacttgagctggggagttcaagaccagcttggtcaacatggtgaaaccctgtctctactaaaaatacgaaaattagtcgggcgtggtggcacatgcctgtaatcccagctgcttgggaggctgaggcacgagaatcgcttgaacatgggaggtggaggttgcagtgagccaaggttgcaccactgcactccagcctaggcaaccaagcgagactttgtctcaaaaaaaaaaaaaaaagtacataaatatattaaataattaagtgttgggttgtagttttcttgtttgttttacaatagggatgattaaattttaatagagataatacccaacgttaatttctttacgtgattgttcttggcaatggcttaaagcctaggtcaatgaatttttttttttctgatgtagattaaaaaatttctgtggaaagatagttacgtacaatttcctatacatttaatcatttaatgtttaggtatttatgtaaactgttcttttggtttgtatgtttaatgggttatattagtccgttctcacattgctgtaaagaactacctgaaactgagaagtttgtaaagaaaagaggtttaactggctcatggttttgcaggctgtacaggcttctgcttctggggaggtgtcaggaaattaacagtcatggtggaaggtgaaggggtagcttccttacatggtgggagcaggaggaagagagtgaagggggaggtgttacacactttaaaacaaccagatctcatgagaactctatcatctagggggagacagcgctaggaggatggtgataaaccattagaaaccacccccttggtccaatcacctcccatctggccccacctctaacattgggaattacaattcaacatgaaagttggatggggacacaaagccaaaccatatcatgagggttttagaataattaaataccattacatgtaattactaaaattttcatgcttgttaatactgtttccaaaacttccctctttaggcagagtgagttttgtcttttaagatttgtggtggtgattcatatacacgttacaggagatgatgccttccttcatcttagaggagttgaggttattatcttgataccttaatgttagagttgttcagagttggtacttcaattttagaggcgctcagagttgaggtaattatgttagaagagaaacgaggtttttaaaaaaattgatgcataaattataaagcattcataattatttagaatgattcatttttattttatagatttttttaaagatggcttagcggttgaaacaacgcttaaagttggtatttttctctctggtcttgatctgttttaaactaggagtatgtttgggcatttgttatgagaagatctagatttctggcttgacttatatgtcaaaattttagcttaaaagggagggctaggtagaatttaagtattattaagagagaaagtttttactagataaaaacaggcattattcatcacctggaaatagttttacggggaatgttgaactacaatatctccctttaaaactcttatctccaaaaccttcctgagaactttagtggcgtttagctctaaaattgaaaattagatgctagaattagaatgttgaaggtgttgggaatcctataaataataacaaaagttaaaagaattttttttttttttttttttttttttttggagacagggtctccctttgtcatccaggctggagtgcagtggcgtgatcttggctcactgcacgctctgcctcctaggttcaagcaattctccttcctcagcctcccaagtagctgggattgcaggcacgccccagcacgcctgactaatttttgtattttaagtagagatggttttgccatgttggccaggctggtcttgaactcctggcctcaagtgatccacccccttcggccttccaaagtgctgagatgtacaggcgtgagccaccgtgcccggccaaaattaaaacaatttatatagctccttaattcagatattaatgcactcaatggagcactattcagccatcaaaaaataatgggatcctgttttgtggcaacatgagtgagcctattttaagtgaaataagccacacgagaaagagaaatggctcatgttctcacttatatatgggagctaaaaaagttgatctcatacaagtaaagagtggaatagtaatagtaatatgagggtgggaagtatagagggtagggggttagggagaggttagttagcagatacaaaattataactagataggtggaacaatttctaatgttctatagcactgtagagtggttagttaagttgctgtatatttatatttctttttcttagatctactttatttgtcatattgttatttttgaatagctagaagagaggattttgaatgttcataacataaagaaatgacaaatgttagaggcgatggttatgctaattaccctgataggattattacacatcgaatacctatattgaaatatcacactgtaccacataaatatgtacaatttttatgtgtcaatcaactaataacaataaaagcatttaggtaaacagaatcccttatagattttctgttattggaaagagtttagtttattaataatttattatttttagtaatttttatctttctgaaatgttaatatgcaactcaaaatgtttctcctttaattatgacttaaaatttttatatagagcatattaaaaatcttcagactgaacaagcatctttgcagtcagaaaacacacattttgaaaatgagaatcagaagcttcaacagaaacttaaagtaatgactgaattatatcaagaaaatgaaatgaaactccacaggtaataaaaattatgttaactccattgaacagcaagtaaaatagctttagagatatatgttacatagttagctatagtgattattgaaagttctcaatttatgattagattgtatttcatcaacttatttttaagaaaggtatttgatctggagacactttttttcaacaaagaaaatattgtaagtgatgttggaatttccaagctagttaacagaatcctctttagctcctagtaagtagtcagcaacttattgccttaaacttcctaatactggcagggaatctgaatggacactcttgattaaactgcccattaattccatctctgatatatgtaaaactgatttttctgttctgtgcaaattgcttctgcccaggtgttccttggcttagtaaatggcagtgtcctttacttagttacttagggtggcacctcaagctgtttttgacttctctcttgcttttatatctcctatttattctgtcattaaatcctgtcagcttttttatagcctgaatctgaccactttttaccatcttccatattagtctagtccaagtcatcaacagttaatacccggcttattatagtagccttatgggtagtctccttctttccgccctttctcctgcactgtgttttctctgcaacatgcaggatgacccttaaaatgtgaattgtgagtatggtcactctcgtgctcaaaatccctgagtgcctttatatcacactcaacccacagcttttatatcttggcctacaagacagtacaggattggacccttggccacctctttaattttagcttattcatgttctttttcctctcagtaccctccatccagcactggcctttttgatgctcttcagcacattgaccttagggtcttttgtgcttgttccttctgcctggaatgatgtttccttatatatttgaatggctcagttcttcattttattaggcctgggttcaaatgttacctcaaagaatccttccctggctactctaactaaaataatacctgctactctttattcccttattttgcctcatggctcttattgtcctctgattgattgcttttctttcttttatcttccttatgttaaatacaagctctgagagaaaattattttcttcacttctgtattcccagtgcctaaagctacatgagacgtgtggtaactgttcagtacatgtttgttgaatatatgtacaaatatgttcagtgcctttatatattggagtgaaggagtgtgtgtgtgtacatgctgttgcctaaatgcctaagtacactgaagacccttgagatatctgaagactctagattttcaaatagtgccatggcatgtatttttttttttttttatcataaagggtaataaaatgtaacagactttcaggttcctttaggctcttaatgatagttattacagttgttccttattatttatagaatctgtatttgtgaattgacttactagctaaaatttatttgtaaatcagatcagtacatgcaaagcttttgtagccattcatggacatattcagaatgatgaaaaatttgagttgcccaatgtgcatgttcccagctgaggtcaaacaaggtgacactctgctttcttgtttcagctctcattctgtaaacaggtgtcctttttacagtatatttagtgcctcattttttacatttttatgctttttgctggtgatttagctgtttaaaatgccccctaagcatagtgctgaactgctatgtagtgtttttaagcacaagaatgctgtgatatgtgttatggagaaaatacatgtgttagataaactttgtttaggcatgaattacagtgcttttggctgtgagttcaatgtcaataaattaacaatatatattaaagaaagtatctttaaacagaagcacacaaaaaaacaaggttatatattgattggttgataaaattgttgtgaccagaggctgtagcaggaagctaaccctgtattacccttaggagcagtgatctagtatttgctaatttacgatgtatagtgactttatggaacaaaactagcacaaataatgagaatctactttatctatttggaaactggtagagagtactaatgcttctttgagatcaggatgctgggtagtgcttggctcattcactgccaagttctgtacttcagtcatgatttggattcagttcacagttaaaaagctgttatttgttatggccctttggccctttgggactgctcagggtatgcaagagactaaacgtgacaaaatggaagaattacagtataacttcagggtttttcagccagtatacctaggagtgggcccttctttttaggttagaatgaaaggtattaaagtaaaacttggatataaaagtgattgaggtgaaagaaatatttttgagtgtatcttttgaataaaaaaagtatatggttgattatagaattttgatgagtaatgtttaacatttcaaagaaaaggtattttctttagatttttaaaggaaggataggaaactgagtagtaccctagttgtgtgtgttgttcacaggatttcattcattagtttaaaattattttaaattcctaaaatattttacatttccttcttatatttaactagcaagtagtttatattactgaaattcaatgaattatgccattggcacttcttcagagtagaatattgagttgatagtaccagtgaagtgttaaatttatattcttgctgcatatagtataatttaagttcagtctggatgttggcttgatgtttttcatgactgatataccattttcccaaatttaataatggaaacaaatgaaatggtaggacctagaagcttgatgtgttgcttttttttttttttttttttttttttggtgagatgaagtcttgctgcgatgcccaggctggagtacaatggtgtgatcttggcttaccacaagctccgcctcccgggttcacgccattctccttcctcagcctcccgagtagctgggactacaggcgtgcgccaccactcctggcttatttatttatttttttttgtatttttagtagaggtggggtttcaccttgttggccaggctggtctcaaactcctgacctctagtgatctgcccaccttggcctttcaaagtgtggggattataggcatgagccactgtgcctggcccttgatgtgttactttaaatatatatgatggtttttgtgtgtgtgtgtttttttttttgagatagagtctagctctgtcgcccaggctggggtgcagtggcacgatctcggctcactgcaacctctgcctcctgggttcaagcaattctcctgcctcagactcccgagtagctgggattacaggtgcgcgccaccatgcctgcctaatttttgtatttttagtggagatggggtttcaccatgttagccaggctggtctcgaactcctgacctcatgatctgcccacctctgcctcccaaagtgctgggattataggcatgagccactgcacccgaccaagatatgatatttttaagtcatatcatcaggtctcctttcacagtgtaatttctattattaataggcccacccaaattcaatgggaaggtacataaacctcaccttttatcaggagaggtgtcaaagaatttctggctatcttcagtctacacagtctgtaaaaacacatctctcttccatatccatgcccgtcgcactttcgtgcttttcctaaggagatgacttattttcttataacatccatgaaagtgattgaccttagggaatgctttctaagcaataggtaatgtagtgtgtagaatacaaaatatttactgccatactgcaagacttcttcagtagtttgtcttgttcttctcaaagttcatgaagaagggaagatatccatttaggactccaaatgtgttttcctgtggtgttcaataaatatttcttgggtgaccaagatatattaatgatagtatgtgaaatgaaacaacatgggtattatagcataaaagagtcactgcttatgagctctaggctttggtttaattatttctctgtgcttcattgtcgtttttgtaagatgggataacagtaccacccttcttgtagagctgttgtggtaattaaataatacatgtagaagtctgagaacagtttttggcacatactaatggctcaataagttatctattattattattaatagaattagatgtagtaaataggactgctactactactgtttactttggtttcattgtaattataattgtgtgtgtgtgtgtgtgtgcgtgtgtgtttacttgcctggaagcctaatcactaaccaatataaaaattaacgaaacacattttattaattggtgacttcttactagcaaatgtaatgcttgtttatacagaaagacttgataagtgatagtcataatagtttttattaaatatatctttgatcctatttttaagataaatttatatagaaaactcttgaaactattagtagttctgtattagacacaatgctttacaatttcggtttataatattaaattcaacaccaggaatatttacacagatactttttttttccttgtaggtgatgttttcagtggtattttagaaatcatttgacaggaatcaccagttttttcacaattaaaaatatagaattgattatcttttgacatgtattaagagaattataacattttttgtttttaaggaaattaacagtagaggaaaattatcggttagagaaagaagagaaactttctaaagtagatgaaaagatcagccatgccactgaagagctggagacctataggtattaaatacatttttctggtttcttttttggaatgggaagagtatctaaaaaacttaatgccagaaaaataataaatcaaatgaaaatagaaaacattttaaaatctgacaggtggtacagacaaaaaaataatatatttttgtctcatcacttttcattcagatttcttggtcttgagcaattatacagaaaatataaagaggaaaaatgtttttctttcaggttgtgtgatttttaaaatctctcaaagttgaatatggacaattctattttatgttagtgtcaatatgaatagatattaattttaaggtccttcctcattggttcaaattgagaagaatgtatgtaatattagtgaatcaataggtgtgccacaaaaagaagagtgagccatagagcatttggaagtatttaaaagactataaatctagattttaccttggtttgatccttactagatcccaggaaatagaaaatatagagaaaaaaagattcagcagtatcccaaatagttgtgatacttcattttacctcagaaagagcaagcttgctttttatccaaaataagttatcttgttaatctcacaaaagtaccaagtaacattttacttcacagtggttgctaatttcctagaattctattaagactacccacatctggccgggcatggtggctcacgcctataatccctgtactttgggaggccaaggtgggtggatcatctgaggtcaggaattcgagcccagcctggtcaacatgatgaaaccccatctctactaaaaatacaaaaaattagttggtcgtggtggtaggtgcctgtaatcccagctactcaggagactggtgcaggagaatcatttgaaccctggaggtggaggttgcagtgagccgagattacgccactgcactgcatactgggcaacaagagcgacactctgtttaaaaaaaaaaaaaatgaccaacatctgaataaatcttctaggatcattcttcttaaaaataaaaaaaaaacaacacaatataccacgtaaatatttatgtgactttgggtttaggtaaactcaagtagtagtattaagttgtaatcaatgttaaaattagtttaggaaaaaatatactgtagaacctgtcagaggtgattatttcttaatgtggagttctggagtttttttttttttttttttcatgaagtagagcattctgggttttctaataaatatttttttagtagagagtatgttctgtcatttcatgttatatgttaatagtagaataattattcgttccatttagaaagcgagccaaagatcttgaagaagaattggagagaactattcattcttatcaagggcaggtatatatatatgtgtgtgtgtgtgtgtgtgtgtgtgtatatatatataatttaaaacaattctgatttctttgaattgatgcaggaatataattacttgaccagttgtatacctcttttgaggtgttgcatgtggctgtgggacatttcccaggagccaaagattctgagataagaaatcttatttaaaattgctgtattggctgggtgcagtggctcacaccagtaatcccagcactttgggaagccgaagtgggtggatcacttgaggtcaggagttcgagaccagcctggataacatggcaaaaccctgtctctactaaaaaaaaaaaaaaaaaaaaaaaaaatacaaaaatagccgggtatggtggcacatgcctgtaatctcagctacttgggaggctaaggcaggagaatcacttgaaccctggaggcagaggttgcagtgagctgagatcacgtcacttgcactccagcctgggtgacagagtgagactccgtctcaaaaaaaaaaaaaaataaaataaataaaattgccgtatctcctgctgctttgggaaggtagattgcatcacataaatgtgtatcaacagtggggtctcatactcagtcaggctagttatatgttaactggcaattcctgttgattattacataaagtaaaagtttaccaaacaaaaaatttaattgtctttacattcagtttttgttttaaaatataatagattatgtatacatgaaaatttgctttaaaaatgttgcctactcttcagagatgcttgggatagttttgagttgtgcactacatcatagtggtagatgtgaatgttttttacttaagaaaaataatggtcagtagcattttaattactttctttttcagattatttcccatgagaaaaaagcacatgataattgggtaagtttaaaatttccttaagtctcttttgtcaaattgtatgtttttttcagaagatacgttgtttatttaaattagatgaaaataaatatagtattctaaaaaatcagtttcttttaattttacaagtagtgaaattatgttccttgtgaactagtttgttccaacacagttattagaaaaatctgatttttccttctttgcttttatcacattgcttctttgaaaggagtttatactccatggggaaggtgatataatgttcatggactgattgttccagggcactggattgccactaattagttgtggacaagctacttaaaattctttgggcctatttcctcatttgtgtaacaatgggattagattaagtgatcttagaagccccttctagttctaaaagtcataaaattcagttacctgatcctcagtgttgaattactgggtacacattaagaaaagggtcatcatgagaaatagtgtatttgtgctccagaggaactaactgtgtgaggaagtgatgaggatgcagattttgactaattataagaaagacactgtaacatataggactgttgtagtagctggcctttggagtacttgtcactaggagtcttcagcagtaggcagtttgcacagtgggtgaatacatggagtttggaattaggctgtcttggctcatgtcctggcttcatcacctatcatcagttttcttacgtgtaagatagagatagcagtagtacctatttcatagggttattgtgatgattaaattcatgtaaggttgttgccaaatgcctgacacacagtatacattcagtgaatgttaactgttgttattgttgtagtgaagcttggtaggtatttcttagacatgttggagtggagattccagcctagggtgagagattaggtgtggtgaatgtctaggtcctcctcagttgtaagattctgtatgctttagtattgagggttcaaatgaaaatttgttactaaattaagctgggcttggagatgaatttagttaaccactgctcaccacttgtaaaatacttaggtgtagattactctttgaagatggagaggtccacacacagtcccagggtaagacggtaaccaggctgtttctggaagggcagcaggaacatcttacagatcttacagagacactgacttgtaaagattagaatgaaaaccacaaacaacaatggccaagaagggaatatgctgaggtccagaggtaacaattccacatccctccctcaccgctgcgtatttagtgaagtcttctaaggtagataaaggttatctcagatgacatgggtagaggctacaaagagacagttaagcagttggatataaagatcgggacagccagatgacacctaggatatatctgtcctcacgtgttctagagcacagggcaggcaggaaaacccaaggaaccacaggctaaagaattacatatcaggaaggtcacttgggagaagctccacagacaaggtgtgtttttagctgaattgggattggtagagggaatgaaagtgacactgagcagtagcttgtcacacgctccagagctgagctacccacaggagcagacgggtctgggcagaagacagttaataggagaggctcatattagtttctgaaaagtcacatggtaacagagtttaacttgttttttagggaaaaagtgttcatttcaatgaactaatcacccaatcagatagaacccaggctggctgagtttagagtccatgaggctctgaacgtttgaccccagggtggatggggacaaggacatggctcacactgtcaactttagagatttgagggtagggggataataaagtctcaactacacaaaaaggatgtttattaaaatctcttgtgtcctaggcactgtacttaaaggccttttacatacattacttgttcaatctactcagtaactgtaaagttggtactataatcccagatttatggatgaggaaacagccgaaggtcatggactagagggtaaagagtgggtatagaaattctgatctttcagagtctaagtcttacactttttcttacttcagtgattatgatttgtataccattgttgtgatatatatatatttttaagaaatttaatgaatgtttatattgacatatttatgcttattttttaagtttatataaatatatttttaaaatgtgttattttcttcaagttggcagctcggaatgctgaaagaaacctcaatgatttaaggaaagaaaatgctcacaacagacaaaagtaagtatcttagtgggaacatttaaaattagttattctgttatttcgttaattaggtaatacttttataaggttaagcaagaaaacttgcagtgaatccagcatatcttgtgagatatctattagttttactaggaatgtctagtttgttttgtctgttgaagtacttgtcttaggtcactgaagtggcacttggaggaaactgttaacagattattctgcaaaaagtataactagaattttttttaaaccagtgtagatggatggaggtaaaaatggatggaaagagaaggggtgaatctctctgacatagtaatgcccagaatatcagcctcttttaatggataagtagataggataatattcattaatttctctcatttcctggttttgtagtattgggtgacattgttttacaataataaaatgaaaggtagaataaaagtctacaatgtacaatagcagggaagaataagtgcttttctgtgaagatgataacagtcttcctagagtgttataatttcttgtcacaatgtactgttaacattatccaatattagtttttagtcctcttgcttgtcttttctagtctcagaaattaaaatcaaattattaaatgttttatatctcatgattaagaactagaaataagattcttttaaaatgtcacatttgtaggataaaaagtttacgagtaagatagtaggacaaattaatgggatttccagtgttgtaactggaatcatgagtgtcacgttacaatggaaagcatacatgactcaaagccaggaaccctgtgtcttaatccaggcactttcattgtgaataaatatttaaactcctagcctcagtttccttagttgtaaaatgatagactggttgaccttggaggactcttgtatttcaaaaatttggattctgtgatatagtactcatggtagtctagttttgaagaagaaataaaacaattgtaaggctccacataacatcactatctctagggcagcaagaaactgattaccctagttaataagcagtgggagataaaggtgttttggtcagaataattttagaggatctgtttgttctgtgtagatattaaaatagtgaagagcagcttgtagttggtagaggcattttttcttgtggtgcttctcttggatgagtaacttagagatgtttgttctttatttgcagattaactgaaacagagcttaaatttgaacttttagaaaaagatccttatgcactcgatgttccaaatacagcatttggcagaggtagtctttttttttttacccctcatttaaaatacatattttacatatatatatatattgcacatatagtttctattagtgtaagttaacactgttatttatataaatattttagattttagaaccaaggttctagactaagctttctcatagactcacaagcttctaggttttgtttcctgtgcagtaatgaaaattactgttgcttttatttctcagtgggattttgtaagatgatacatatttagtactttgagctccttgaaaagctaggtgcttggcacatagtaaggtactcattaacaattttctgtgagattgaatgaataaggagtgcttacatggactagcattgtgactgtttatatattaactatactttggaatttgcttgtttaataattaaaaaatagtttctaattatttaaaagtatcaatttaaaatgtgggaaaaactcagtctgaggtttgattgctttaattaccctcaagggaggaccaattttttttgtaagatatatttaatatttctgtccattgttgagttagggtctgcagtgatctcaaactattgcaaacagtttaaattttttcataataattttggttgaattggaattaagcttctaaggtactgaaaaatctatatataggtagaattccattttaataaccttggaaagttataaaaatcacttttgagagtaaaatttcattaaaatgaaagtctgtttctacatttaaaaaatattagattattacgaatttcaggtagtaacaaagtttggattggggtgaagtatatagaaggatttttttttgtctgaatccaacacaaaatttcaagaagggtaactaatgctttgatcttttcttgtagctggtttgaatattataccagctacactcatgttttaaatttaacatgttttaaaaatgttattttggtggtttttgtttgtattttgtttttgatttttgactttggaaacaaaaccattatttgagagtggtgaagtttgtaaagtggtaggtgtcttggctgtatagattatagataaagtgatttagttgataaattagtatttgtaagctgactttttactggtaatgaatcaaaagtaaattgtgatcttgcttcagagtattttatgcatttttctcctcttcataatctgagcattatttaaacaattcatggcccaatacagcctatctggccctgatttaaactgagtacttctatgttgcaactctcaccagctgaaatgtctgggtgcatactgccagtaaaaacaaaccaaaaaaaaatctaactttatgctcctataactctaagatatatctccaatatcctttgcttaatataaatgattatttatcatgatctttttattcccagttcgttgatgtttttattgcttaaagtgtctatttgatagacaaatatcgaaaacaccagggtctgtatttaattctgttctatattagcaaaatcaaaggatacattcaggacatagattaaacttaaattggcaataggatgacctgatggtaattgtcgaaatgggattctaactctgtagtgtagctaagtgaaactatgaatttaaatatgctgttttaattattccagagcattccccatatggtccctcaccattgggttggccttcatctgaaacaagagcttttctctctcctccaactttgttggagggtccactcagactctcacctttgcttccagggggaggaggaagaggtatattgtttaaacatctttattactctagatttcttccttactttatattttcatctcaacttaccttaaaaatgatctgtaaaatatttggaaaatacaggcattccttgcacttactgtagataacttttatttggaaaaggagctctatgacatctaattttgatgtatttttctcttagaaaccgtgctatattagataacattttgatcaaggacttgatgtgtatctttttatttatttttctttttaattttaatttttattttttgagatggagtcttgctctttcacccaggctggagtgcagtggcgcgatcttggctcattgcaggctccacctcccaggttcacgccattctcctgcctcagcctcccgagtagctgggactacaggcgcccgccaccatgcccggctaatttttttttgtatttttagtagagacggggtttcaccatgttagccaggatggtctcgatctcctgacctcgtgatccaccctcctcggcctcccaaagtgctgggattacaggcgtgagccaccacgcctagcctgataacgtatctttttaaaccatatttttgacttcttaaaaactatatattacatgatataatataaaattttgtaagactgcatgaaatataataacagtataacctagcataaaaattatctatgtgtatgtatatatatgtaatttttttttttttttggagactgttttcactcttgttgctcaggctggaatgcagtggcgcgatctcggctcactgcaacctctgcctcccaggtagcttggattctcctgcctcagcctcctgagtagctgggattacaggcacatgccaccacacctggctaatttttttttgtatttttagtagaaaatacaaaaggttgttttgccacattggctggccaggctggtctcgaactcctgaccttaggtgatccacccgcctcagcctcccaaagtgctgggattacaagtgtgaaacaccataaaattatattttgatgaagcattagaatttggaattaaaaaaatttacattagtatcatgatctttttattgtagaaaattagaaagtgaaataatctttttatagactcaaggaaatcagtagtgctcttgtaggcagatttttgatgggaacctttactgtggtctgcatcatttgttaacacactgggggctgggcgtggtggctcatgcctgtaatcccagtattttgggaggccgacgggggcagatcatgaggtcaagagatcaagaccatcctggccaacatggtgaaaccctgtctctactaaaaatacagaaatcagctgggtgtggtggtgggcgcctgtagtcccagctacttgggaggctgaagcaggagaattgcttgaacccgggggacggagattgcagtgagccgagatagtgccactgcactccagcctggcaacagagcgagactccgtctcaaaaaaaaaaaaaaaaaaaagtacattgggaaaccaagccacaattgtctgctgttacccccttataggtacctcaggcctaatcattagctattctacatttatctcatcagcatcaccctggtgttacaaaaggccctagtacctttgaaaactcctgtgtacctggagttttccttttttgatctctcaccatactttctttgtcaagttcctttaaagttttatcttaatttgtggcgaaattcaaagatatagggccttatttatttcaaaatcaaaagtcttacattttcagttccaagtatgtgttttataagagctgatggcattcttcaccagtgaaacattcccaccctttgtatcagtgattttaacagattgaatttgagataggaacataaagtaatgaatctaaataaaaacaccaaattaaatccaacaaatcaaagttcatatactcagatgggtattactcatctaaatagtatctcaggaagtctgtgtacttgttagttgaagctgccattactccacatatttttggaactcttcctttggaattgctttcaaataatatgagaaaatcaacttactactgtatggtcatgagatattctccctttgcccatatcctgtttgtatcctctttctccaccctcattttgcttcacttagaactgttcctgtccacctcccagtccccccagtagattgggccacagcctggggtccctacagagcctctgcttgtgttgattttgaactggaagctcctagggaaagggactgccctatagactgatacttagagccttagggaggctttgcattgagcacttcaggaaagagactgattttgacattgacatgtctgctgcaagcttatgacttagttctctaagtccacccccacccctccattttttaccttggcttacactaagaaatgtattttgtatcatgtcatattgtacactaacataaacatgattgaaatataattgaaaccgctacatgaaatagtacttgccattacagttttgatgctttctattcaattttatcccgtttcattaatttaatcttaattagcattattttttaaacttcacacatcacaaatgagtaggagctagcagtctgaaaaaacagtgccctagaaataagggtataattggctaaactgcaaatatgagtcactggaaattgaattacataagtcaaggattgcttgtagtcaattgaatatttggaatgattaaaatttacatttgatttctcctcttctatttcctctcctatttaatttaaagatacagtgtgtttagattatctgcaagggtgttttaccatttgtttaaaaagctacagaagttctaggtaagttgtcatcgggtcttacagagttgatccgaactaaaagtttctatgatccaccaaaggaggatggagagtacctgttatttttccttacttttattatctttttaatttgaagtttggatgagtggtatatttgaataatactgagtacaagtaaaacaatttcttcttagagtaaattgtatgtaactgggtttgaatagaaaactttaaccattagaacttttaggtttgtaatattcactgggtagtcagttggcctgtagctttggtcttctggaagtaagcaatcaggaaggaaagcctctgaatgtctcctttaaatctctgtgcttcattccagatgaactcagcctaaatgacgacttgcacattttctgctttcccagccttcttcttctaatgagctaattattaggatgaagaagcgagaaggaaagatttggggaacttaatagaatgtatactaataaggaaaaatgatagtttacctcctgatgtaaaagccagttgatctgattctactaaagggagtagatggaaaatttgttttaaagattactatatattaaatgtgaatgcttatgctgatttgtacaagttaccaagaaaagttaaaattaattttgttctcttaaaggaggtactgaaatagagtaagcatttttgttagacttcttttttttttattttttttttttgagatagtctcactgtgttgcccaggctggagtgcagtggcacgatctcggttcactgcaaccccttcctctcaggttcaaatgattcttgttccttagcttcccgagtagctgggattacaggcacgtgccactgtacccagctaatttttgtattttcagtagagatggggtttcaccatgttggccaggctggtttcgaactcctcacctcaggtgatccgcccacctcggcctcccagagtgctaggattacaggcatgagccatcacgcctggctattttagttaggcttctattgaaaaaaaattgttcactgggtgcagtggcttacaactataatcctagtactttgggaggtcaaggtggtgggattgtttgagcccaggagttcaagaccagcctgggcaacatggcaaaaccctgtatctacaaaaaatacaacaattaacaaagcgtggtggcacatgcctgttgtcccagctacttgtaaggctgaggtgggagaattgcttgagcctaggaggcggaggttgcagtgagctgagaatcgcaccactgcactccagtctgggtaacagagtgagtgagaccttgtctcaaaaaaaaaaatgtttttaaagctgttccttgagaataataagcttttgttttctggacaatataattttgagaagaccccccttttccctctcaatgacagataaatgaggtattaatatattttattgaatgttaaatttttttttttttttttttgagatggagtctcgctctatcccccagactggtgtgcagtggcatgatcttggctcactgcaacctcctcctcctgagttcaagccattcttctgcctcagcctcctgagtagctgggactacaggcgcctgccaccatgcccggctaattttttgtatttttagtagagatggggtttcaccttgttagccaggatggtctcgatctcctgaccttgtgacccgcccgccttgacctcccaaagtgctgggattacaggtgtgagccaccgcgcctggccaaaatttttttatatttgtcttttccattttagttgaatatgggttttgttttttgtttttttttgagatggagtctcactctgtcacccaggctggagtgcagtggcacgatcttggctcactgcaacctccacctcctgagttcaagccattcttctgcctcagcctccctagtagctgggattacaggcacctgccaccatgcctggctaacttttgtacttttagtagagacagggtttcaccatgttggccaggcttgtctcaaattcctgatctcaggtggtccaccctcctcgacctcccaaagtgctgggattacaggcatgggccactgcgtccagccctgtatatgggtttttaattaaggtactatcttttctgtggtcgtaagaagggaactttaaaattactcctgtttgtaaatgtaaatatactagattttcttatccaaaagaatgttagctcatttaaagtgattatttcaacagtgctgttgtttttgaaactatcgttttagacttgtcttcagaacttatgaattcttcttttgaatgtgaatttgatatttagaaatcactaaaagccatctagtgccagtttatctgttgtacataatgttttaaatcaggctatttaaaatcattttggggcagaagtatttatcttttttatcttctcattgactcgtaacactattcagtgaatttgggcagaagtagagagtcatgttttaactttgagatgcagttttttacatggctcttaagttaaactgagtacatttccaaaagagtttttctgaaaaatactttagtagcaaaattagtagaatagatatagaactgctaagatgactgttttaaaggaatcatgctcatttggactattgatatattagtttaagcaacaaaatcatttatgctttttatttaatcatttattatattttatatttattttaaatattttatatttattttatattatattttttatttaatcagttcttataattactttataattatcctgttacatcaggcataggaatcatagcaatttactttctacactgttatttttcagactttgtatttataatttatgatttaaccactgattttatgtgtaaaacaagtatataagactttttaagatgaaacagatttgtatgtttttttttctttaattaggctcacgaggcccagggaatcctctggaccatcagattaccaatgaaagaggagaatcaagctgtgataggttaaccgatcctcatagggctccctctgacactgggtctctgtcacctccatgggaccaggaccgtaggatgatgtttcctccgccaggtatgtaaagacaatagttattatttctctttgaaaggcagctgggatgtggaatacacaggaatggaagaagggaggagtatatgtttgttctctcttaagaaaaatcatcgtacatttttgaaaacaacaatgataaataatctaaacagaatgatttgagataattgttcatattatagaaagctgttttctccctaaatggaatgtttttattgtttttgttgcttgtagaggtaataatgcatgtttactttagaaaatccaaacaacacagaaatgtgtaaagaagtgaaaaatcccttttgtcatcttagcgtgtccttcccagaatttagttgtaggtatatatcttttagagatttttttgggtatacatttatacacatagctgttcaaattcttttaatcactctgtgcagttgtaccattcatcctcttttgtaattgtcttttttcactgaccattttatctcaccaaaataaatatatttaccagaagagtcacagcagaatatcttgaaataagataataactgccattcaacagctgcatcatctacattaggtgtttctcctaatgctatcctcccctggccccccacccccagagaggccccggtgtgtgatgttcccctccctgtgcccatatgttctcattattcaactcccacttatgagtgagaacatgcggtgtttggttttctgttcctgtgttagtttgctgagaatgatggtttccagcttcatccatgtaccttgcaaaggacatgaactcattcttttttatggctgcctagtattccatggtgtgtatgtgccacattttctttatgcagtctgacattgatgggcatttgggttggttccaagtctttactatcatgaacagtgccgcaataaatatacatgtgcatgtgtctttatagtagaatgatttataatcctttgggtatatacccagtaatgggatggctgggtcaaatggtatttctagttctagatgcttgaggaatcgccacactgtcttccacaatggttgaactaacttacactcccactaacagtgtaaagcgttcctatttcttcacatcctctgcagcatctgtagtttcctgactttttaatgatcaccattctgactggcgtgagatggtatctcattgtggttttgatttgcatttctctaatgaccagtgatggtgagctttttttcatatgtttgttggctgcataaatgtcttcttttgagaagtgtctgttcatatccttcgcccactttttgttggggttgtttgcttttttcttgtaaatttaagttgcttgtagattgtggatattagccctttgtcagatggatagattgcaaaaattttctcccattctgtaggttgcctgttcactctgatggtagtttcttttgctgtgcagaagctcttcagtttaattatatctcatgtgtcaattttggcttttgttgccattgcttttgttgttttagtcatgaagtctttgcctatgcctgtgtcctgaatggtattgcctaggttttcttgtagggtttttatggttttagttcttatatttaaatccttaatccatcttgagttgatttttgtataaggtgcagggaaggggtccagtttcagttctctgcataaggctagccatttttccgaacgcaatttattaaatagggaatcctttccccattggttgtttttgtcaggtttgtcaaagatcagttggttgtagatgtgttgtgttatttctgaggcctctgttttgttccattgttctatatgtctgtttttgtaccagtaccatgctgttttggctactgtagccttgtagtatagcttgaagtcaggtggtgtgatgtctccagctttgtattttttgcttaggattgtcttggatatatgggcttttttttgcttctatatgaaatttaaagtagttttttctaattctttgaagaaagtcagtggtagcttgatgggaatagcattgaatctataaattactttgggtagtatggccattttcacgatattgattcttcatatccatgagcatggaatgtttcttcttttgtttgtgtcctctcttatttccttgagcagtggtttgtagttctccttgaagaggtccttcacatcccttgtaagttgtattcctagatattttattctctttgtagtaattgcgaatgggagtttggtcatgatttggctctctgttattggtatataggaatgcttgtgatttttgcacattgattttgtatcctgagactttgctgaagttgcttattagcttaaggagtgtttgggctgagatgatggggttttctaaatatacaatcatgtcatctgcaaacagagacaacttgacttcctctcttcctatatgaataccctttatttatttctcttgcctgattgccctggccagaacttccaatactatgttgaataggggtggtgagagagggcatccttgtcttgtgctggttttcaaagggaattcttccagcttttgcccattcagtatgatattgcctgtgagtttgtcataaatagctcttattattttgagatatgttccatcactacctagtttattgagtttttttttttttttttagcatgaaggggtgttggattttatcaaaggccttttctgcatctattgagataatcatgtggtttttgtcattggttctgtttatgtgatgaattacgtttactaatttgcatatgttgaaccagccttgcatcccagggatgaagccaacttgatcgtggtgggtaagctttttaatgtgctgcttgatttggtttgccagtattttattgaggatttttgcatcaatgttcatcagagatattggcctgaaattttctttttttgttgtgtctctgccaggttttggtatcaggatgatgctgacctcataaaatgagctagggaggattccctctttttctgttgattggaatagtttcagaaggaatggtaccagctcctccttgtacctctggtagaatttggctgtgaatccatctggtcctggacttttttggttggtaggctattaattactacgtcaatttcagaacttgttactgatctattcaggaatttgacttcttcctggtttagtcttgtgagggtgtgtgtgtccaggaatttatccatttcttctagattttctagtttgttcacatggagttctttatagtattctctgatggtagtttgtatttctgtgggatcagtggtgatatcccctttatcatttttccttgcatctatttgattcttctctcttttcttccttattagtctggctagtggtctatttattttgttaatcttttcagaacaccagctcatggattttttgaagggttttttgtgtctttatctccttcagttctgccctcatcttagttatttcttgtcttctgctagatttttactttgtttgctcttacttctgtagttcttttaattgtgatgtttgggtgttgattttagatttttcccgcttgatctcctgtgggtattttagtgctgtaaatttccctctaaacactgctttagctgtgtcccagagattctggtatgttgtgtctttgttctcattggtttcaaataacttatttatttctgccttaattttgttatttacctagtagtcattcaggagcaggttgttcagtttccatgtagctgtgcggttttgagtgaatttcttaatcctgagttctaatttgattgcactgtggtgtgagggactgttatgatttccatccttttgcatttgctgaggagtgatttacttccaattatgtggttgattttagaataagtgctatgtggcactgagaaaaatgtatattttgttgatttggggtggagagttctgtagttgtctgttaggtccgcttggtccagagctgaattcaagtcctgaatattgttaattttctgtctcgttgatctgtctaatattgacagtggggtgtcaaagtctcccactattattgtgtgggagtctaagtctctttgtaggtctctaagaacttgctttatgaatctgcatgctcatgtattgggtgcatatataattagggtagttagctcttggtgttgcattgatccctttaccattatgtaatgcccttctttgactttttgatctttgttggtttcaagtcttttttatcagagactaggattacaaccctgcttttttttgctttccatttgcttggtaaatcttcctccatccctttattttgagcctatgtgtgtctatgcacatgagatgggtctcctgaatacagtacaccgatgggtcttgactctttatccaatttgccattctctgtcttttaattggggcatttagcccatttacatttaaggttaatattgttatgtgtgaatttgatcctgttattatgatgctagctggttattttgcccattagttgatgcagtttcttcatcacgttgatggtcttttacgttttgttgtgtttttgcagtggctggtagcggtttttcccttccatatttagtgcttccttcaggagcccttgtaaggcaggcctggtggagccaaaatccctaagcatttgcttttctgtaaaggattttatttttcctttacttataaagcttagtttggctggatatgaaattctgggttgaaaattctttaagaatattgcatattggcccccattctcttctggcttgtagggtttctgcagagagatccgctgttagtctgatgggcttccctttgtggttaacctgacctttctctctggctgcccttaacgttttttccttcatttcaatgttgctgaatctgacgattatgtatcttggggttgttcttctagaagagtgtctttgtatttcgtgaatttgaatgttggcctatcttgctaggttggggaagttctcctggctaatatcctgaagagagttttccaacttgattccattctcccgatcactttcaggtacaccaatcaaatataggtttggtcttttcacatagtcccatatttcttggaggctttgttcattccattttattcttgtttctctaatcttgtcttcacgctttattttagtaagttagtgttcaatctctgatatcctttcttccgactgatcaatttggctatattgatacttgtgtatgcttcatgaagttctcgtgttgtgttttttggctgcatcaggtcatttatgttcttctcgaaattggtttttccagtttgcaattcctctaaccttttatcaatgttcttagcttccttgcattaggttagaatatgctcctttagcttggcggagtttattactcaccttctgaagcctacttctgtccatttgtcgaactcattgtctgtccagttttgttcccttgctgccaaggagttgtgatcctttgaaagacgaggcatcctggtttttggaatttttagcctttttgcctggtttttcctcatcttcctggatttatttaccattggtctttgctgttgatgaccttcggatggagtttttgcttggtccttcacggcacagtccctcatggcttctcttggctaggggaggaaatttcctgaacgcttgtgcttcccaggtgaggtgacgcccaccctgcttctgcttgcagtccgtggactgcacccgctctctaaccagtcccagtgagatgaaccaggtacctcagttggaaatgaagacatcacccgccttctgctttggcctcactgggagctgaagaccggagctgttcctatttcgacgtcttgcctgggaatcaacaatttcttgtgatctatcttcaggtttactgactctttccttgtcatctccattctgttattaagcttatctagtaaaagttttattttagatatatttttcaggtctaaaattaccatttggttcctttttataatttgatttatctgctgagttttttatctttttattcattataagcattttttttaaaccattgagtatattagttttataataactgctttaaagtcattgtatggtaattctaacatcagggtcatcttgaggttggcctctagtgatgatattttcccttaaggatgggtcacattctctttcttgatgagtttgtattggatactagacattgtggcaattctggattctattctattcctctaagagtgttactggtcttgctgtagaagaccattaacttggatgggctcagactgcagccttttcccttctgtggtggggaacagctcaaatattagttcagttatttttgccttagctgaaaactgcttaaatttgccatacacatgtgttgctctggagtcagccatagacttgggcagagattgtacccagaatattgggctctacctttgcggctttctcctttctaggatatcccaatcccattgcctcaggcttgggctctgtgtacttgttcttcaggcaagaaagttttatcgagttttgactgctgtgtgctgcaactcactgtggtcttctatcaggctaaaacataaaaatggaaaactcaccccatacccggttgttactcctttcttcttccaagctctctcttcttttctaagtcctcctgcttttgttgatgcttaagcgcttcaggcagttatttttttgcatattgtctggagtttatacttatgtgtaggagagtcagtctgaatttactctaccatactagaaatggaacctggtctccgtacttttcaatcatttgtgagcttctaaattgataccttcatagaagagatatggtccattctacagagtatctccaaataatgaacctgatccctgtggtttgacagagggccaacctgtgtcaactataatctcaatgtcatagacaagggtaattctacagacacagtaaaggaattttcagtattgttccaaaatttatgatgagtgagaagggctaaatgactcctgaggctctagcatgaattagagtaatgctgataaatgtatttctcagttagcttcattcctacctaaagttaaaaaatattctatgtttgctcttggtatattggtacatgccatttaaatagtcactgaacaggccgggtgtggtggctcatgcctgtgatcccagcactttgggaggccaaggcaggtggatcacctgaggccaggagttcaagaccagcctggctaacatggcaaaaccctgttcctacaaaaaatacaaaaattagctgggtgtggtggcaggcgcctgtaatctcagctactcgggaggctgaggcaggagaattgcttgaacctgggagacagaggttgcagtgagccgagattgcgccactgcactctagtctggcaacagagagagactctctcaaaaaaaaaataaaaaaatggtcactgaacagatttcagggttcttttcttttatgttgtgtttcagttaacgaaatgataatgaatgaggggacttaggctttttttttttgaagtggagtttcacctttgtcatccaggctggggtgcaatggtgccatctcagctcactgcaacctctgcctcccgggttcaagcgattctcctgcctcatcctcccgagtacccgggattacagggcatgtgccaccatgcccagctaatatttgtatttttagtagagacggggtttcaccatgttggccaggcttgtctcgaactcctgacctcaggtgatccacctgccttggcctcccaaagtgctgtgattacaggtgtgagccaccacacctggcctaggctttttaaaccttatcattgctattacttttttgtgtaaccttgagcaataaattttacctgtcatggttttctctctttcaaaatatggtcttctggctgggtgcagtggctcatgcctgtaatcctagcactttgggaggatgaggtaggaggattgcttgaggccaggagttctggagcaagctggccaaaatagtgagattctgtctccacaaaaaaacaaacaaaatagtgacttctgtaaaacagagatggtgatattctaaagtaatctgcctctcttttatgtaaggttgacttattgggactcatgaagagtccttctcactaataattgtctttaagatttttcttaaattttaaaatattttagtttaaaatacttatgttaaaaaaatatgacaactaaaataactaagtttctgaagaatatggattctgcatttgagattatctgtcatttagtctgttaggcataatttataaaatgtatatattttcttaacatgtttctacttggaagaagtgttttagatttccattgacttaagatgagttagcagaaatgattttaaatagttccatatttacaaggaatcatttatttttgcaccgttaaatactttgaaaaaggagaaaactttacttagcttatatagtcagaaaaaactgctctaacttatctcttttctcatatgccctattccagacattcttttaaaaaatattttaataatgttatcttttatttgagattcacagggtacatgtgcaggtttgttacatgggtatattgcatgatactgaagtttggggcgtgactgaattcatcacccagaaagtgagcatagtacccacagtttttcagcccttgcctccctttgtctctcctcgctctactctggtagtccccagtgtctcttgttatcatctttatatccatgtgtacccagtgtttagctaccacttacaagtaagaatgtgttagttttatatttctgcattaattcacttaggataatggcttccagctgcatccatgttgttgcaaaggacataattttattctttcttatggctgtgtagtattctatggtgtatatgtactgcattttctttatccagtccaccgttggtgggtatctgggttgatttcatgtctttgctgttgtgaatagtgttacgataaacatgagtgcttgtgccttttttgtagaacgacttagtttcttttggatatatacccagtaatgggattgctgggtcaaatggtagttctgttttaagttctttgagaaatcttcaaactgatttccacagtggcctaataatttacattccctccaacagtgtataagcattcccttttctctacaaccttggcaacatctgttattttgactttttaatagtagccattctgactagtgtgaggtggaatctcattgtggttttgatccaaacattcttattacttaaaggttttattagcaagtatacacctagtttcttcaagtaatcaacactttattctcattattttcagtagcagactcaatcttataaactaataaggattttaaaacttttaagttttcttttaaaactctgtggttattaaaggttagtacacaaatttggctaccttattaggaaagagctaattctgctgaagcatagtatgtgtacaaagttttgtacagtgttgaacagtctacaatgtatctgttcatctaacattcttatatgtgcttttaattagtttgcatgtttagaacaagactggcttaggtgaaaaagcatttggactggaaatcaagaaatttgctttctggttttcactcctttatcttttagtgtgattttaaaaatttattaaaaaatttttttagagacaggttctcactttgtcacccagctagagtgctgtggtgtgattatagctcactgtagccttgaactcctgatctcaagcaatcctcccctctcagcctcccaagtaactgggactgtaagcacatgccacaatgcctgggtaatttttattttattttaaattgtttttggagacaggtttttgctgtgttacccagtctggtgtcaaactcttggcctcaggtggtcctccctcctcagcctcctgaatagtgggggattacaggcacgagccatcgtgcctggcttttagtgtgatttttaaaacttgtttcatttctttggaccttatatattatatagtgacataaccatataactccataagaaactcattcgaatataatagtataagtaggtggaaagtaaaaggatagaaaagatacaccatgcaaacattaatcgaaagaaaatgaggtcaagaagatatagcaaatgttaaatgtgtgtatgccaacagcagctacaaagtatgggaaacaaaaactgatagcactgagaggaacaaagacaaatccagttataattggagacttcaacacccctctctcggcaattgatggaacaactgaagagaaaattcagcaagtatatagaagaactgaacagtgccctcaaccaacaagacctaactgacatttatagaacaagttacccaacagcagcagaatacacgtgtttttaaagtagcagtggaacattttacaagacagattgtatcctgggccataaaacaaacctcaacacatttaaaagaagtgaaataatatacagtatgttctttgatcacaatggaatcaaactataaataataaactattgatacatgcaacaatttggatgtatctcaatggttgagtgaagaaaaccagtctcaaaagtttacatactgtgttattccatgtatataacattcttttttttttcgagatggagtctcactctgtcacccaggctggagtgctgtggtgtaatctcggctcactgcaacctctgcctcctgggttcaaactgtccttcagcctcagcctcctgagtagctgggacttcaggcacacaccaccatgcccggccaggctaattttaaaatttttagtagagacagggttttgccattttagccaggctggtctcgaacttctgacctcaagtgatccacccacctcggcctcccaaagtgctgggattacaggcgtgagccactgtgcccggccatatataacattcttgaaatgacggtatagaaacagaaaacagattggtggattcaagagtttgagacagtagtggggaggggagtgggtatgactgtaaaggggtggcacgagggaggtgtttttggtggcacaataattctgtatcttgagagtggtagtgattacataaatctacatatgctgtaaaatgtcatagaactagacacgagttgtaccaatgtcagttttctggctgttacaatacactatagttatgaaagacgtaaacattgagtaaagggtgtgcaggatctctctgtagtatttttgcatctttctgtgaatctattttaaaataaaaaagtaaaaatcttattgtatatcatacacatacagggaagtacaaatattaagcatataatgtgattttttttcacaatttgagcacagtgatataactaacactcagataaagggatagttttcagtttggtttttcataagtttaattagaaaacttatttataattttagcagaaaaaatgttcttgaataatgtaagtgagttgataatattcacatatcatatagtaatcacaattaaaattttaacagaaatatgtcctgggaataaccagttcattataaattctttataaatactaacctgcaacaaaaatttatcaatgtgacttaccttgctcagcgcttcagttgttaagaaaaaacacaaaagtgttttcatatttagaatgagaacattacagatcaaagagacttggtaagaaagtagtttaaattgtccatgtaattcttttgccagggttaactgtaacaaaggtgattctcataaaaactttcaagttgtatgtgttggcttgttttgtcttcacttttagaaatgaaagtgaggtatcataatttattaagtagataatgtcactatcctgtagatcagcagtccctaacctttttggcatcagggactggtttcatggagcccagtttttccatggaggttgcagggaggaggatggtttcgggatgaaagtgttcacttcagatcatcaggcattagttagattctcataaggaatgcacaggctagatccctcacatgcgcagttcacagtagggtttgcgcttctatgagaatagaatgcctcagctgacaggaggtggagcttaggtggtaatgctcgcttgccctcctcacctcctgctgtgcaaacagttcctaacagcccgcggaaaggtactggcccgcagcccaggggttagggacccctgctgtagatgactacatacatttatttatttatttccctgtcttatggtgctgattgataactacttctactgtagctcaggttgggatatatagtttgaaaattgttggcatatatttagatagagagatacagtgggttagtagctttcacaaggagaaggaattaaaatgttaactctatattttttgttctaaatatatttttaggatctatgtgctatagtttgtttcatttttacaagaatttctactgaacatcttattcaagatgttgggataaaagataaattattaaaaaggtgtagttatgtatttcaatgatgagttaatataatgaaatgaatgtaatactgaaacagatctttttctacaacagctctgtccaatagagctttctgtaataatagaaatgttttatatctatactgtccagtacagtagccactaggcacatgtggctagtaaatacctaatgtgtctagtacaacttgagaaacagaatttttaatcttattgaattttgtcagttaaaatttatttaattttctttattattttgttttgttttgagacagaatctcactctgtcatccaggctggagtgcagtggcatgaacacagcttactacagcctcgacctcctgggcccaagtgatcctcctgctttagcctcccaagtggctgggactataggcatgcaccactaatgcctaatttttaaattttctgtagagacggggcctcactatgttgcccaggcaggtttcgaaatccttggctcaagcaatcctcccaccttggcctcccaaagtgctgggattacagacgtgagccaccacgccctccttcgtacccttttgagctttagtattcctagttttcattgtttaaaagaacaaggagtgtgtatgtggtttctccttatttttgttggtgcttatcttttactgatttggataatatattttatgtaagcatagcaaagagactaagcaaccataccttggtggtgtaatcatgagttaagtgtggttgctagcctggcatgtttaaaaactctttttcttaaagagctgaacaaataagagacatatagtgtacagctaaattgatgagaacagttttgactctttccttgggaaacaaaagtgtgctaagcagatcaaaataccttggatagctttgaatgcataggcgtagatttttacttcactgactctgattcatagacatttatgctgaccattgtcctacattctgaacagttttttcagacaagactgatttagtagaattatagtttgtcttaaggctcattttgatctctttgatgaaaacttgtggtcttcccaaacttaataaggtgttctgaagtcgtggtatatatgcttttatcctctcagaggatgatatttacttaaagttgttcctaaattttaggctaccagttttttaggaatatatatatcttaatcacttatgtcttatataatgatcctttataaattctaatgattattcagttgataaattgccactgtatgtgtttttataaactttaaaaatctgtgtttaatttgtcagtcttcctgaagagactaggttgtggagagattaagatacagggacaaatgtaaacaactttttgaaaaatttcactttgaatgaaaaagagatggtagctggagggagaggtgttttggtttttaaagatggataatattggctgggcatggtggcttacgcttgtaattccagcactttgggaagctgaggcgggcagatcacctgaggtcagaagttcaagaccaacctggccaacatggtgaaactccgtctctactaaaaatacaaaaattagccgggtgtggtggcacgcgcctgtagtcccagctgctcgggaggctgaggcaggagaattgcttgaccctgggagggagagcttacagtgagctgagaccgcaccgttgcactccagcctgggcaacagagtgagactccctctcaaaaataaataaataaataaatgaataaataaataaataaatgatggataatataacatatttatttgctgatgggaataattcaggctagaaggggaaattaatgatgtttggagaaggtctggttataaaagtgaaaccctggaatattaagcacaaaagatgctatccagagtgtaattgcagaaattgtggtagctgggtcaatttatccattctaaaaagaaggaaggcagagcaagtgagtacagatgtagctgttgggtggagggtaagtggaggtgtccagttgtttcaattttcttgttgtggcaagatcatcagctgaagcaggtggtagaggagaggactgtcagatctgaagagaaaaaaaggtatgcagtagctatttaggagagtggaagaactcaaacattagtaaagtgtagtatgattatagggcattgttgagcatcagtttgaaatttatggtcataaatttgaatgaaaagcagtcaatactatatttttaatatagtttataatcataacaagcttaatttatcatcagatattgataaagctgtatatagaatgtatttgtgtcagactaaatgccttttattaatcattctaacactcttaagagtgttattctgttattcccattttacagatgaagaaacaaaaccacagaaaggttgggtaacttggtgaacaacacaaattgagatttaaaaaaaaaattttattatactctaagttttagggttcatgtgcacaacgtgcaggtttgttacatatgtatacatgtgccatgttggtgtgctacacccattaactagtcatttagcattaggtatctctcctaatgctatccctcccccctccccacaacagtccccggtgtgtgatgttccccttcctgtgtccatgtgttctcattgttcaattcccacctatgagtgagaacatgcagtgtttggttttttgtccttgcgatagtttgctgagaatgatggtttccagcttcatccatgtccctacaaaggacatgaactcatcattttttatggctgcatagtattccatggtgtatatgtgccacattttcttaatccagtctatcgttgttggacatttgggttggttccaagtctttgctattgtgaatagtgcctcaataaacatatgtgtgcatgtgtctttatagcagcatgatttataatcctttgggtatatacccagtaatgggatggctggatcaaatggtagttctagttctagatccctgaggaattgccacactgacttccacaatggttgaaacaaattgagatattatagcacaatcctggatatcacccttgagaatttacatattaatatttgcttcagatatatatgtgtttgtgtgcgtaaatgtgtaaataagacataaaaagaaaaagcacactatttacatgaattgaacactattgcatttcctttcctgggcatattaccttcctctcctagaagcagctattcatgagtttagcgtgtgtaaactttcagttctaataatgattaaaaaaaattaaagttctgttttatcagctttccttatcagccttacctacttgaattctttccatgttagtatatagagagtttatcaccttaattgtggtatggtatttcagtgtataagaaaccacaaaatgtttaaccatttcctgttggtgagcatttagagtgtctccaatatctcaccattactaacagtgctgcagctagcaccctttttgtacatatgttctttcaagattgtccaggaattggaattcctaggtaatagggtatgcacacttttgatcttattttcaatttttatttttttgggacaggatcttgctttgtcgctcaggctggggtgcagtggcgtgatcttggctgactgcaacctccgcctcctgggttcaagcgattcttgtgtctcagcctcccgagtagctgggatcgcaggcctgtgccaccacacctggctaatttttttgtgttttcagtagagatgggatttcaccatgttggccaggccgatcttgaactcttggcctcaagcagtccacctgccttggcctctcaaagtgctgggattacaggcatgagccaccatgcccggcctgtttttggttttaatagatatctccccatcgccctcaacagaagctgtgaatgaagtatatgagagtagctgatttctgcagtataattcttagtttgcaaaactgctttagaatgcccagtacacttattcccactccttattcatttttttcttatctttttttcttccattctttctttctaatcatgtcttctattataagcgtagaatactattatagaaaacaaaagtttgaaagcaaaaaagaaagggacctttcatgtccttactttctgtagttcagttcagtctttaattggtcatatgctttccacatagctgtatcttattatgtgtatatgtgtatgtgtatatgtgcatatgagggtgtgtgtatatgtgtgtatgtatgtgtgtatatgtatatgtgcatttgaccagaatacccttgattacttgttcatctttacttttctttcagggcaagctttactgcctctgactccatttctgattcctgcaatcagaaatagatagtctacctcttatattatgtatatttccttttattaagacattaatcacatggtgtttatgtgtttctatcagaattagactgtaaggacatggggtttatcaaggccaacattgtattgtttgtgcctgacacatactaggccttggtaagatttaaggaatgaattgcttttgccagtggagggcaacatagccatgtagtttataaagtagtaaatttataacaaaatttttttatttctgaggttgttgatgtgtggggatataatttagaagcaaaataatgatgtagtatctggagacctgattaaaaaagagttggtgttcaggtttccttattttatccccttgtccaactccaccatttaattaatcctttgtttgaagtagaaagggaaaactgagtttagatctcagtgattggtattgaccttttctttcattaggctaactcaaaccctttgaaacagctcctccctaggattttgaaagggagtgtaaatgagccttcaaactatttgtatctttctctcctcagtcacatctcccgaccattgggagctcattaaatataattctctttattgactctcgttgatgccaggtggtctctctggttttgtgtaggagagatgatgtgtcaataaggtcccctgtggcagagtcagatgaggagtgatatatccaacactgattctataaagtcaattagaggcaatttggggttgtttacgtatatctgtaataggataggggaaagttacacaattcaccttctttgtcgttctccttatttttggagttggacatatgcatgcctaatctagcagtctgacatcacctttcaagaatgagaaactacctatactttttcaagagtgatgagttccacaaggacccaggaattattaaaccgcaattacttttgcaccaacctaataccatattgtcatcataaatcacccctggggacaaagggtggctgtagaagcacttgagatagttggtgtccaaatttgtgtctctccagatgttcttcgtttcagcagtggtactcatctgttgagtcagagagagctttccatttagtttgttttttatttattttcatttatttatttatttattttgagatagagtcttgctctgtcacccaggttggagtgcagtggcatgatctcggctcactgcaacctctgccccactgggttcaggtgattcttctgcctcagtctcccgagtagctgggattacagactaccatgcctggctaatttttatatttttagtagagacagggtttcaccatgttggccaggctggtctggaactcccgaccttaggtgatccacccgcttcggcctctcaaagtgctggtattacaggtgtgagccaccatacccgtctctttccatttggtttggaatagatactaaattccaaaacgtcaatattactgaaagtttgacaatgatgacatctgaatgatactctttctgctttgatgacaaattatcacctgttctggtaaatttcttgctgtgcttacgttttttctctttactttttccttatgttagtagatgtttcctgggtcttttttgatacattgatgtatttacttccatccattattaaaatggaaagttaatttacatatatataaaactaaattctgttttcacatattctaatttacacatagtaattgaaattttcaaaatccaaagtagcagattatgcttgtgtttactataaaggttattgcctatagtaaaatatgcaattcttctgaaattgtctactgttgtcaaccaagaagatgatgagtttaagtgttagaatacaggtcaaaagtgtaagttcaatacgttaaacttaagtaaacttgatttatatttacattaatgaagacattttaaaaacttattttctaggacaatcatatcctgattcagcccttcctccacaaaggcaagacagattttgttctaattctggtagactgtctggaccagcagaactcagaagttttaatatgccttctttggataaaatgggtaagaagtactttgtgcttttcttctttaaaaattttggtggcacactaaagaactggaagttagaataaagaccaatataattgctatctctagtagttcctaaggccaaaatctctttcctgaaaatgtcctggttttatgtttcttgttatattgtacacagacatggcatccaaatatatgttggtgggttggtttgagcaccatggaaataggtttactccatatacctatgatgataaattttactctgttctatgactaattttctaatttttctagtccacttacatgtgttctgtttagtaatcagggaaataagccaggcaaatgtgaatggatacataaaaacccaccagaaaacaatttagatgcatgctctgttgatattgtaatcagttatattaaacatttcatgcttagatataactaacatgtactgagcaatctactatttgtcaggctgtcttttacttaaactacctcatagcaacccattaaagttgggaaatagatgtatgcagtgtatcaaccagaagtacacaacgttaagaaaataaaaattttttttaaagtcaagatttaaatgtattggtaaaaggtttcctcaggaaaggacatatatttatatattattaaatatatataataaataatgttatatatataattttaaaaatattgattttctgacatagtagactatataatatagctgggactacaggtgtgcaccaccacacatggctaattttttgtaaagatgaggtttcgacatgttgttgaggctggtcttgaactcctgggctcaagcaatccacctgccttggtctcccaaagtgctgggattacaagcatgagacaccttgctcagcctggaaagtcagtattttattttatttattttttaattattatttttgagacagagtctctgttgcccagactggagtgcagtggctccatctcggctccactgcaacctccgcctcctgggttaaagagaaacccaggaggtttcacttgtgtcaagcacaagtgaaaaatgaccagtaagacaaggacatttataactggctgaagtcatggactttggagtctagttagttggggaaggaagtgagggaggaaactcagtggtcagaagcatcagtgacttccaaggacagatgtagtgagaataaatgagaaagctacaagaggagaggtagttgtggtcagagaggattgcatttcttgatgataacaaagttcgggaacatttatttcggaacagtagctaaatttcagtagctagtctctcttacttaatggaggaataaggacggaaggaagaagaggaggaaggagaagaggataggaggcaaacataaaaggagggaggaggaaaagaaggaaggagggagatgcttcctcccagatgtcttcttagcattctgctccagcaggattgcttaggaactagccagagaaataattgccacatgccatcatagaactctgagtctgccagaatttctagggacctcaagctgttcttgtggccgcaatataggatattggtgtccagctggcttatgtgccaacaaggggagtgggaaaataccaattttgtgatctggagatactctaggaataaagtgataaatcatgtacttttcatggtttaacttttatgtctagatgggtcaatgccttcagaaatggaatccagtagaaatgataccaaagatgatcttggtgtaagtattgaaagagtggaattgtatgcatgtattcagaagccttctttttttttttttttttttttttatggagtttcactattgttgcccaagctggagtgcagtggcgctatctcggctcactgcaacctgggttcaagcaattctcctgcctcagcctcctgagtagctgggactacaggcgtgtgccaccacacccagctaatttttgtatatttagtagagacggagtttcaccctgttggcgaggctggtcttgaagtcctgacctcagatgatccactcgccttggcctcccaaagtgctggtattacaggtgtgagctgctgcgcctggccctgagccactgtgcctggcctgtgccttctaatctcatgctttactagaatagaaatatagctaataatctaggttttgatataaagctgattttctctttttgattaatatactttctacttagcgtgaaagctgtttcttttgtagatggtaacctatggtgataaaatacaatttgcagactaggagtttgagttagtttaagattttagttccctccccatccttggatttttatttgaatattttaaagtatatttttgtttattaagatattgatttttggaaaatataaacatagacattttgctttttctttttttccagtatatatttgatacaatagtatatattttagtgctcttgggttaaatttctgttttatctttagccagactgttactttgttggttaaagctgttttctgttgacttaataaaatatttatgataactaaaatgtgatagctgatacattactgtggaaagctgtttgaatctttctctagagctttctaagactatcatggaatgctttctgtctagatgatttcttctaagcctgagattttcgggaaaatgattgcaaatttactgttttagtgactgccatatgtcaatttgttgtagaatttaaatgtgcctgattcatctctccctgctgaaaatgaagccactggccctggctttgttcctccacctcttgctccaatcagaggtccattgtttccagtggatgcaagaggcccattcttgagaagaggacctcctttccccccacctcctccaggagccatgtttggagcttctcgagattattttccaccaggggatttcccaggtccaccacctgctccatttgcaagtatgcttttttaaactttttttttaaagctcaatatgtggtttattaatcggagatttaattttactatctgttaatgtagtaacacagtggaggaaagttttttctagcattctgtgaatctgaaaattctcattacttttccgaattgggaaggcagccagccataagtggactgcaatgaggtttcagcttgattcatcttaataatatagaattatttctgtattttggcagtcaagaaaataatggactttttgcaggtcttacgataaaactaaaattatctgtaccttatttggtagcaactggttattctgacagttagtgaaaataataacttatattctagcattaaaattactggctaagatattttttaaagtctttttcataagtagttctgatgcagtcctacttatttaaaacttaaaatgtatttattacgtttgaccgaatttttggatttattgaattcttttaaagcttcacataagaaaaagggaataatatgttgcttttatattcatactttactgttttgaactatagggttctgcagaataaatatgtggttaccaaatactaggctttgcctatgaatgtctcatatagtctttccttcccttgtttctcttctctttttaaagttaaaggtgaattaaaatgaattttgtttggggaaattttaaggtggcctttgatattactggaaatgttttagtataatatcaaattagaattgggaatcactaatacgaattttaagtttgttgaaaattatattacatgcagatgttttttgaggactttgataatgaaagaaaaaagtgatttacagtaagttttatatattttgaaataattcctcttttttaaaaaacaggtgttaagataggacaaaaattacataaaaattaatgatatttcctttaatcatctgtatttgaagaggtacgtttttctcaatgtaaaaattaatttgttagatcaagtaattatctagtgtcaattttcaaataaaagaataggtaatggaagttataaacttaatgatttattagggcacagtacaggttcttaaagttaaaaaatgtcttttaccaatctctttgaacagtgagaaatgtctatccaccgaggggttttcctccttaccttcccccaagacctggatttttccccccacccccacattctgaaggtagaagtgagttcccctcaggtttgattccaccttcaaatgagcctgctactgaacatccagaaccacagcaagaaacctgacaatatttttgctctcttcaaaagtaattttgactgatctcattttcagtttaagtaactgctgttacttaagtgattacacttttgctcaaattgaagcttaatggaattataattctcaggatagtattttgtaaataaagatgatttaaatatgaatcttatgagtaaattatttcaattttattttagacggtataactatttcaatttgattaatccactattatataaacaatagtgggagttttatatatgtaatctttcaggtggggaggctttaaattctgaagtctgtgtctttatgccaagaactgtatttactgtggttgtggacaaatgtgaaagtaactttatgcttaaataaattatagttgatttaaagatttgtttggcattgataataataaaatcagtagtttttctataactatggctctattaacttttttccttttaccaataactttgaggtgcaaaactcaaacttatgtgggtcttttgtgttcaattatgttatgacaaatgtgctctctttcttgtaaatagacatgagtggcccaaagcaacaaattaatacacttttaaaagtcaaaattgattatattttaaagataaccaggatattatctaatggtgaattgtagaattttgatcttcttattcactgagtttcttgcacggtttctttattgcttttttttccccgcctgttcttttgtaaggtatttactattttctgtggaggatattgagatgtactacaggataactgtagtgaatgatgtgtcatcattttgagctttggactcaatatctttagtgtttccctaaatcagatttgtaggtcatgttaagcttcttgcacattaatatgattatggaaggaaaggcagtgaagcataactaataaacatcataatacttaa

SEQ ID NO: 1184 - DNA, 84070 bp, Homo sapiens; identical to SEQ ID NO: 1182

SEQ ID NO: 1185 - DNA, 84896 bp, Homo sapiens
ctaaaaccgtctcctacgaacaaatccagcacttggcactttattcgacggtcctaaaaatagagtcctaaatttagaaggcaaggtgctacttttagctcctcttctcggaggaaaacagcacgcaccgcgccaggccaaggtccacggggatttgatttagcatttgggtaactggccgctaatggaactgaagacagctgggcctaacaagtgcccaggtgactcaggtaagcgaggaaaccagatcgaggttctcttgcgtgggacaggttaaactctgaccaaaccacagctgagccgggacgccttcctgtctaaagtccaaagtccggacgtggttggcagggcgcaccggcgcgtgccccgcaggccatttttctgactggaatgacggcggcggctggcttctcggggctgccggggtctcccggggtacgccgccgtcaggacttctgcagggcgcagacagcaggctccagcgaggctgcggaaggaaagccttgggtgtcggggctgggcctggcgtcggcccctgggtcgggggggtgggggttgcgccgagacgcctctaggagaagtctcgccgccgccgccaccgcggccgcccgaggcgggtgcccttgggacatagccctggtctttggggttgtgcggctcacacgacagcgcggagtatgaggccgaatctcatcctctagtcccaagcctctccactaccagggctgggtggcttcgccaggtagagcgccggcccctttaagagcaaacgacccggacacgtctgcgaagcttgcgcgaagaaggggaagtttgcggctgtccgcgcctccccgccttctcgcggctgcccggccgaaaccaaaccgaggggtggggtggcgaggacagggtacgtcgcaggcttgtgcgggtcgggctcggacctgcgctgcctcgggatgtaaagtataacaagagggtcgggatgggcagcgtaggcctgtgaggcctgcgggtgcccctgtcccccagctccccccgcagccggctccgcagtggtccactccggttgccgggtgcggattcgggttccggaccgaaggctgtgtgttctccgccgtttattgtggccccgacaggccggggttactgtggcgaccacgagagcagctttggcgctatggaggagcccggggttacccctcaaccgtatttggggctgctcctggaggagctacgcagggtgagcccaggcgcgatgagtgttacgtggcccaggggtcgcgggagccgccgggggaaggaagcagtagaccggctttggggtctaagccgccgtggtcagaggtcccgaagccagtcctcgtctgctgcccggctcccgcccgtgttcgaggcagtagttaggctcgtagggcgcttgagtggtttttgtgtgatggaggaggacctggggctctgggaaggtgaagaaagcacttgcttagctggactttgcaaagatgtaaatgtttcccgattcctaaaactaattagcctttccgctatgttgtttattttgagcagagacacgtggttccttcgactgtgagaaacttgaggactgttcctttaaattagttacatttactgatgtaacttctcgttgaaccttgaaagaacacctgaggttgggcggggagttgaaattttgattctgcattttttttttttttggtaaagaatgaatgcccttttgagatgctctaccatgagtgagattgttcttcgcttctgtcttgttaatgtacagtctagagatagtaaactcccagtgttcaaattttgttttttatttttcaggtctagtttataatcaagttgtagagatttttctccttaagtgtttctaggtatctttgttgacatgtgtaggggcatttatgtcgccgtgtttttaaaaactggattaaatctttaaaaagaccacttaattattgaggcagttacgattatgttttcttgttaggtgaattaaaggtagtgttgccatggtgtttatgagttcatagtttgtctaatgcatacgcatatatatgtatttaatatgaaaagagcacctttatggagattctaaatggactaagacttagttttggccactagcatcatgttgtctgttaagagagagaagacaaaaaaaaaaatagtacaaagtagaaactgatgaagtgcttacctaagcatacacacacagtgcagggaactaggagctgtattacttagagtgtaaagtgggcttagggagtgatgggcaatgatgcttgccggagatgtaagtaggttccaagtgctgtaggtgttggagagctcttgaaggcttttccgtggttagacttgtggtttaaaatttaagctcttcttgatagtagcatgtagattagatgttagggaaacaaaacttgaaatagggattaagggagaggtgacagtagtaaggataggaaagagggtactgtgtggagaaatagcctctaagagctaaaatatgtttgactttattgattgcatgtgaagggtgagagagaaggaatctagaaggactcccaggtttctggctgtggtaacttattcatggaggtagggtttttagaaagagaagcatatttccctttcttcactaaaaacaataataatcaagatttagtttttataggactgccagtgtacatggagaaatgcagaaatacatggagaaatgcagccagattttgcagttttctctagtctggtgcgttgtatcttcacctgcacagtttttttttttttttttttttttttgctaaatgcgagtaccctggcctgggggctaggatggcacaacattgttccgctttaaattttttttttatttttaaaaattattttgtattgagatatattcacacaacataaaattcatccttttataatgtccatttcagtgctttttttgttaaattcactatgttatgcaactgtcagcacagttcctcaacatttttattaccccagaaaataaactctactgattagcagtcttaattcccacccctcatcccttgacaaccactaatctattttctgtctctatgaacatgtctattctgcatgtgtcatgtagtcatgctatatgtggccttttgtctggcttcttttacttagcatgttttcaaggcttatccatgttgtagcatgtaacagagcttcatttcttttttctttctttttttttttttgagacagggtctcatccctgtcacccaggggggagtgcagtggcttgatctcagctcactgcagcttagacctctctggctcaggtgatcctcccacctcagcctcctgaataggtgggaccacagcacatgccaccaggcctggctaatttttttgtattttttgtagagacagggtttctccatgttacccaggctggtcttgagctcctaggctcaagtgatctgcccacctaggcctccaaaaatgctgggattacaggcgtgagccacttcgcctggcccttcatttctttttatggtgaaaaaatattccgttgtgtgactatatcacatttatgtcatagttgatggacatatggattattaatactttttggctattatgaataatgctgctttgtgtataagtttttatatatgtttttagttctcctgggtaagtacctgggtggaatcgctgagtcatatttaccatatgtttaactttttgagaactgccaaattgttttccagaggtcacaccattttacatccccaccagcagtttatgagggtttcagttttctgcattctctccaacgcttgtgattttctgttttcttttgtttttaattgccacccttgtgggtgtacaggtgagtggtatttcactctgttgtggtttttttttttttttttttgagactgagtcttgctctgtcacccaggctggagtgcagtggcatgatctcggctcactgcagcctccacctcccaggttcaagtgattctcctgcctcagcctcctgtgtagctgggactataggcactaaccaccacacctggctgatttttgtatttttagtagagacaggtttcaccatgttggccaggatgatctcgatctcctgaccttgtgatccacccgcctcggcctcccaaagtgcagggattacaggtgtgagtccccccacccggctttactctgttttttgttgttgttgttgtttgtttgttttgttttttaagagatggggtcttgctttgttgcccaggctggagcgtagtggcgtgatcatagcccactgctgccttaaattcctggcctcaagggatcctcctgcctcagccttccagagtgctggtgttacagatgtgagccaccacaccaggccttgtggttgttttgatttgtattttcctagtaactaatgatgttgagcatgtgcttattgtttatatcttctttggggaaatgtctattgatttccttttgctcatttaaaaaatgggtggtctttttattgttgagttataagcattctttatacatttagggtgctaaatgcttaccagataaatgatttagaaagattttctctcattctgtgcattttcttttcaccttcttggtgtgtcctttgaagcgtaagcgttctaaattttgattaagtctaatttatcttttcttcctttggttgcttgtgcttttggtatcatagctaagaaaccgttgcttaagacaaggttacaaacatttacagttatgcttccttctaagagttttagctcttacgggaagttcttcgatccactttgagtgattttgtttccatatatgttatgaagaatgggtctagattcattccttggcatgtggatatttattggcttattctagtatgatttgtttgaaagaactgtttttttctcattgatttgtcttaatactgttgaaaataatttaccataaatttaagggtttatttctggactctgatttctatttcattggtctgtgtctgtccctatgccattactacattatctttaaaacatttttttacccaatgtcttgattattgtttctttgtagtaagatacagtagggaagtatgagtcccccagcgttgtttttgtttatccacgttctttttctttatcaatattgttttggctatgtggagtcccttgcatttctatataaattttaggaattcagttttaggaatttaggattcagtttgtccatttctgcaaaaaaggcagttggaattttaataggggttgcattgagtctgttgatcagtttagggagtattgctctcttaataatattaagtcttccaagctgggtgcagtggttcatgcttgtaatcccagcactttgggagaccaaggtgagcagatcatttgagcccaggacttcaagaccagcccgggcaacttggtgaaactgttgtggtctttctgctccttagctcagctaggtccaagttcttgtctcacaaccaagaagaattaggcatgcggaccccagagagtgagtggaatagaatttattaagtgaaaggaaagctctcagcaaagagggaatgcagggggtggttcccctaccagaaggcaggaaagtccccctgtgtggctgggtctgcggccttttgtggactcagaatggggagtgcatgctgattggtttgtgagtatgcaaaaaaggttaaagcaaagacaccacttagaggtgggcgtgacaatgtagacaactaattaggaggccgggtgcggtggctcatgcctgtaatcccagcactttgggaggctgatgggggtggatcacgaggtcaggagtttgagaccagcctggccaacatggtgaaacccttctctactaaagatacaaaaaattagctgagcatggtggtgtgcgtctgtaatcccagctactcaggaggctgaggcaggagaatcgcttgaacccgggaggcggaggttgccgtgagctgagattgcgccattgcactccatcctgggtgacagggcgagactccatcccaaaaaaaagaaaaagaaaacttattagtaaagggtaggtatatgtaaaataggtgaaagatggggatcaatcagaggaaagtgggccaaacaagaaggcaagttctcaatctggtccaaggatttaacttgtggcttggctttcaggctttaaactgtctttggcttgaagttggggtttcactagggacccgcccctatctgcctgggcatttggctgcctcctgccactctcaaaatcctgtctttaaaagaaatacaaaaattagttgggcaaggtggcatgtgcctgtagtcctgctgcttgaggctgaggtgggaggatcatctgagcctggggagggcaaggctgcagtgagccaagatcgcaccactgcactccagcctgggtgacagactcagtccctgtttcaaacaaagaagtcttccagcccatggacgtggattggctttacatttatttaagtcttccttcgttgctttccacaatattttgtagtttcagtgtgcacttcttttgttaaatgtattcctaataatcttattctttttgatgctattatagatggaaatgttttctttatttcattttcaggttgctcattgctgttgtatagaaattcaactgatttttctatgttgattttgtattctgcaactttgctgaacttaatagctctgatagtttttctataggttctttaggattttctctgtgtatagaatagcattatgtcatcttcaaacagtttttcttcttcctttccagtctggatgccttttatttatttttctttcctaattgctctggctagaacctccattacaatgttgaatacatgttgatagagcggacattattgttcctgatcttaggagaaaagctttttttttttttttttcctcatctttaagtatgatgttaactgtaggttttgcatagatgtttcttgtcaggttgaggaaattccctcaaatcgtactttgttgagtgtgttttgttttttttgttgtttgtttgggacagggcctcactctgttgcccaggctggagtgcagtggcatgatcatgattcactgccgtctcgacttcctgggcacaggtgattctcccacctcggccttctgagtagctgggaccacaggcatgtgccatcatgcttggctaatttttgttgaatgttttgactatgaaacggtgctagatatagtcaaatgctttttctgtgtctattgagatgatcatgcgttttttttttctcttcattttcttaatatggttcataagattattgtatgttaaaccaaccttgcatttctgggataaatcccacttggtcatggtacataatcctttttatatgttgctggatttggtttgtcaatatttttttgaggatttttgcatctggagtcataagatatattggtgtgtgattttcttttcttgtgtgatgtatttgtctggcttttagggtaaataccagcctcatagaataagttaggaagtatttcttcctcctctatgtttgggaagagtttgagagtgattggtgttaatgttttatcttggagaggtgtaccttcatggaactttgtgttatagtcaagtattcacagggtctgcatgttgacattctttttgttattagtatatatcatgtttgaagttagatgaaaaacaattttagtttattcttagtatattttgtcaacctgattaattgattttttttaaagctacttgatcttgaactcctttagtactcatgttttggaaatggaatagattttaagtgttctgtgattaatcactaccgtactttatggagggttactcttggaggggttacccatcaccctttaaatttcagtttatcagattacatgtaattctgtattatatttgttgatatttgagaaatttggttgttctttctatgtttttgtgagatagggtgttatgttgtagataaaatttaagggtgaaaaatctccttgagaaagccagaataatttagaccagagcaatgaatttgagatgaatcctttagaactcagtttctttttttctttttttctttttttttttttttgagatggagtctcactctgtcacccaggctggagtgcagtggcgtgttcttggctcactgtagcctcctcccgggttcaggcaattcttgtatctcagcctcccaagtagctgggattacaggcttacgccaccatgcccagctaatttttgtatttttggtagagatggggtttcaccacgttggccagactggtctcaaactcctgacctcaagtgatctgcccaccttggcctcccaaagtgctgggattacaggcctgagccaccgtgcgtggccaagactcagattctttgcttttctccagtctgccagatctaaccagctcaaggctttattttattttatttttttaaagttttttttttttgtaatcccagcactttgggaggccaaggcaggtggatcacctgaggtcaggagtttgagaccagtctggccaacatggtgaaaccctgtctctactaaaaatataaaaactagccgggcatggtggtgggcacctgtaatcccagctactcgggaggctgaggcaggagaattgcttgaacccaggagacggaggttgcagtaagcctacacggtgccgctgtactccagcctcggcaacagagtgagactccgtctcaaaaaaaaaaaaaaattttttttttttttaaattattccttaatttccatgtttccttaatcctttgtgtgtgtgtgtgtgtgtgtgtgtgtcagagtccagttttgttttgtcacccaggcttgagtgtagtggtgcgatctgcagcctttgcctcccaggttcaagtgattgtcccacctcagcctttctagtagctggaactacaggtgcctgccaccatgcctggctaatttttgtatttttagtagagacagggttttgccacgttggccaggctggtctcaaactcctggcctcatgtgatccgcctacgttggcttcccaaagtgctggcatgagccactgcgcccggccctagctcaatgctttaaactagaatttaccatgtccttttagaagagaagagctgataaaatgtgattgaatctaagaaatattattgtactaaaggtaattacgtgtttgatctgagagatgcttttggaattgccttttaaagtagagtgtcataggtcatattgattacacaatttttgagttagtgtgcgtcttatgtgttgaatacattagctaaaagtaagatgcttggaaaatgtgtaaactgtgaagaaaacttttcttcctggtattgtgtattgaatgccttttttcccccaatagcaaaaataatttttttttatcattaattgcttgtaatgatattagatttctgcgaactggtacctagggtaatgtagggagaggcagaagcagagatcagggtaaagggatattttttagaagtataatcaggtttgtttggtacaggttatgaagtatagatagtaccttggaaggagtacatatttggattagagttataaaagattttggagaggaaaataactattaaacactgttcttataggcagaaagggcctaaaaggaagatttgctgtagaggttttgggttaaagcctgaaaagaatcaaaccccatcatacttcagattgttcttaaaatggcatttttcttttttccccttacctttccccttttctttttgatcaagtaatatcttgggcctggtaacaaagagcagaataaccccattaggtaaggatgagtaatgagctgacccagagaaaggtgaaatatagaagcaacagcaaaagccttaggctgtgttgtgctgaaggtctgctgtggggagaagtaatgtggaaaggccatggtcagaagatcagggtctttggaggagataatataaataattacccttttttgagcacctgtctggcatgttcaaacagcattattctcattacacttaagagaagggacgcacagaggtagggtggggagattcaaactccaaacccaaatctctatcagtggtgttcaaaacttgtttttattttttgagacaggtcttactttgttgcccaggctggctttgaatcaaactttttatttttaaagctgcaaattgattttttcttcctgtagggaaattgtatattggggaactgattatactttacagataaaacctgaactggttgaaatcagggtaagagtacctgaaccctaggtcactcagtttctttctttggccttctcttattctcatccttggaaactttaagtcacctctgtagaactccagtttgaagataattgcatttcaccatactgctgttctttacttggcgatagtgattgaaagttgacaaaaaaatgtactctgatactttctgtttggtgttagtctggcagcccattttgtgttgaccacataaacttgtacctatgtttgtaatcaatatttttaccaaaagtacatttttaagaacttacttttctttatcttgaaggttgtggcagcactgcctgaaggtatgagaccagattctaatctttatggttttccatgggaattggtgatatgtgcagctgttgttggattttttgctgttctcttttttttgtggagaagttttagatcggtaagtaaccagtgctatactaagagaatgttcattttgtcactgggctgaacaaataatatgagaaacatatttgttattttaagtaaacaagttagaaactacatagggattcagaggtttttgttttttgttttttgttttttttaaaagagatgagggtcaggaatgagagtcaggcccagtgctgtggctcccacctctaatcccagcactttgggaggccaaggcagaaagatcacttgagcttaggggtttgtgaccagcctgggcaacacggtgagaccccatcactacaaaaaatacaaaaattagctggacatgaggacacccgtctgtggtcctggctactcaggaggctgaggtgggaggattgcctgatcctgggaagtcgatgctgcagtgagccatggttgtgacactgtactccagcctgggtgacagagagagaccctgtctcaaaaataaagagatgagggtcttgtgttgctcaggctggtctcaaactcctgggctcaagtgatcctcctgcctcggcctcccaaagtcttgggattacaggtttgagccaccatgctcaactggaatcttttaatgtaagatcttttatatatatatatatgtgtgtatatatatatatatatatatatgtgtgtatatatatatatatatatatatgtgtgtatatatatatatatatatatatatatatatatttatatttaaagagatggggtctcactatgttgcctaggttgtagtgcagttgctattcacagatgcaattatagtgcgcctacagcctacagcctcaaactcctgggcttaagcaatcctttctcagccttttgagtagttgggactacacaggtccatgtcactctgcccagcttcatcttttttttaattctgggaaattttatttgagacaggatttcactcctgtcacccgggctggagcgcagtggcatgatctcggctcactgcaatctctgcttcctgtgctgaagcaattctcctgcctcagcctcctgagtagctgggactacaggcgtgcactaccatgcctggctaatttttgtatttttttgtagagacgggtttcactgtgttgctcagaactcctggcctcaagtgatctgcctgccttggtctcccaaagttctgggattataggcattaatcaccacgcctggcctaattttgggaaatttttaatgcatttttgggactgctatttttcagatgttgccccttttacttctgacttccctatctcttaacttctatttttcaatttctttatggttttctataccttttgagagttccttaatctgaggaactgaaatctattcttcatctacactcattgtagagtatcttgtcttttaaaggttttcccttttatctctatccatattctgtagatgattgaagtcctcatttcttttctacttgtttgtgttacctcagccctaaggctgatccttttacaaatgaattcccgcctgcttcattatttgagagagaggttaaggaagaaaaaggtttggtttactgtttctttagtcagttcagatctatggccctatggtaacatttctcaggctgttttattttggatattggcatcaagggatatgataataggggcttcttgaaattatttttttagggtcaaatttgtttggggagcaatgggttaaatgaaattaaacaagtatctttagagtaaagttatttcagagtctttaatatgctaattcacaatgtgaatcttcaatagggagtctttaataagtagtatttaggctgggcatggtggttcatgcctgtaatcccagcactttgggggacccaggcaggtggatcacctgaggtcaggagttccagaccagcctggccaacatggtgaaacccggtctctactaaaaatatgaaaattggctaggcatggtggtgggcacctgtaatcccagctactcaggaggctgaggcagaggaattgcttgaacccaggaggtggaggttgcagtgagctgagatcgcgtcattgcactccagcctgggagacagagcaagactctgtctcaaaaaaaaaaaaaaaaaagcatttattttctcattggaaacagaatacttttggcttgtatttatacaaaggcaataagaaacctgtatttctaagttggcagtagacgttaaatgaattgatttacttgagagcgtatttgttttaatgtaatttttgttaaaaatttgtttcaggttaggagtcggctttatgtgggtaagttcttttttctgctttgactctcattgttgtgttgtaaaaacttataataatttactcatggtaatattgacttgacttttttaggacgagagaaaaagcttgctctaatgctttctggactaattgaagaaaaaagtaaactacttgaaaaatttagccttgttcaaaaagaggtaagatatttttgaaaataatattcatgttagagtcagagaactttatacttctcactgtaggtacttctgtgtaaatttaagattatgaatgctttgtttgcagagtatgagagttctctttgctcttcatattcaacacttaaccagtcttactaattttaaccattgtagtaggtgtacaatggtgtctccttgtgctttccttttgagttttcctgactgatgaggtcgagcacacaaacacatcctctgcatgtgcacatttctggtatctgttcgtgtatccaaatgttctcttttcgtaaagacaccagtcagattggattagggcccaccctaacaaccttattttattttgaccacctccaaaggccttgtctccaaatacagtcacattctgaggtactggggttggagcttcaacatgtgaatttgtggggacacaattcagtccataatagtctttgatccatttgaaatcagatctgtgatggtgcagttgagggtgtgtgtgtgtgtgtgtgaagattcattttttttcctgggcgtgtcgagttaatgccatttattggaaggaccatcttttctctgttgttctgtagtgtcatcttcttaagtcactgaatatatgtgagtctgtttctgttaaatcttctattttgttgggctttttgtttgttttttgccaataacatgctttttatagcctgtagttttataacaagccttagtatctggtatggttaatttacagttcttggctattgtgaataaagttactgtgaacattcttctacaagttttttttttgtgggcatgtattttcatttctcttcataagtagtagtggaattggtaagtcattagggcattagggcaggtatagtttaactgtgtaagataagaaaccggctgggcacggtggctcatgcttgtaatcccagcactttgggaggctgaggcgggcaaatcacgaggtcaggagatcgagactatcctggctaacatggtgaaaccccgtccctactaaaaatacaaaaaaattagccaagtgtggtggtgggtacctgtagtcccagctactcgggaggctgaggcaggagaatggcgtgaaccaggagacggagcttgcagtgagccgagattgtgccactgcactccagcctgggcaacagagtgagactccttctcaaaacaaacaaacaaacaaacaaacaaaaaaaccctactggctgtttttatcattttttcttggttttggctctcagcagtgttactatgatttgtctaggtgtggtttttttctatttgtccttattggggtttatgatgcttctagaatctgtggcttaatgtcttttattagtttagtttttttttttttttttttttttttgagacagcgtctctctctctctcttgtctaggctgcagtacagtggtgtgatcttggctcacttcaatctccacttcctggactcaggtgatcctcccacctcagcctcctgagtagctgggattacaggcatgcgccaccatgtccagctaattttttaaaatttcttgtagagatggggttttgccatgttgtccaggctggtctcgaactcctgggttcaagcaatcctcccgtcttggcttcccaaagtgctaggattacagctgtgagccaccgtgctctaccttttattagttttgaaacactcttgattgttacttttccacatattgtttttgcccttttttgttctttctttctgggactataaaaatgggtattttaactttttattatatctcatctgtctcttacgttcttttccagggtttccatctttttgtttgcccacacttcagtctagacataatcttctttaacttccatgttgccaatagttttcacttatgcctataatcatcttttaaaccatccattgagatcttaatttcatctcttgcctttttcagttctgcagttttattgtggctctttttgtagttctttttctctggtacaattctattttttaattccatttacacattatgctctcttatttttgttttgttttgttttggtttttttttttttttggagacggagtttcccctgttgcccaggctggagtggagtgcagtagcgcgacctcggctcactgcaacctctgcctcccaggttcaagtgattctcctgcctcagcctcccaagtagctgggactacaggcacacgctgccacgcctggctaattttttgtattttagtagggatgggtttcactgtgttgctcaggctggtctcaaactcctgagctcaggcaatccacctgccttggcctcccaaagtgctaggattacaggtgtgagccaccatgcctggcctatgctctcttattttatttatttatgtgttatttttattttctgattttcagaatatatgctgccgacaaatatgctttcttattttaatgactactgcattatccagtagtctatttctggtgctcattttttctcttgtttctcagtcaagtcttgtccgcttgaatgccaggttattttatatgaagtgtcagtgataatataataaaaattgtaaagataattttgaagctgtgggtgctgtcgtctctcttcagtgaggatttactgttgcttttcataggcagctaggctagggacattggaaatttcagataactttatgtatttgactttcttttatgtaaaataagttttattgtgtatatttaaggtatagaaatttcagataactttgattttgttttttgtaaaataagttttattgtatatatttaaggtataaacatgatgagatacgtgtatagtaaatggttactatagtgaaacaaattaacgtattctttctctctcatagttacccattccctgcccacccctccagggcagctataatgtactcatataacaaaaatcatgaatgcagtacactattattaactatggatctcatgttgtacatgagatcttttaacttgttcatcccatatattttcttttcttttattgagacagggtctcattctgtcacacaggctggggtgcagtggcatgatcttggctcattgcagcctctatctcctgggctcaagtaatcctcccacctcagactcctgagtaactgcggctacaggcacatgatacatgcttgcctgatttttaaattttttgtagagatggggtctccctatgttgccaaggatggtctcaaactccctggctcaggtgatcctctcgcctcagcctcccaaattgttgggattacaggcatgagccaccatacccggccatattttctgacctacatgtttcttccctcctacccaacactgctaaccactgttttgttctctatctctatatatttgacctttacaaaaattccgcatataagtgagatcatgcaatatttttctttctatatctggcttattttacttagcaaaatgtcttctaggtccgtccatgttgtagcaaatggcaggatctccacctttttatggctgagtaatattccattgtaaatatataccacagtttctttattcgtttgttcattgatagatacctaggttgtctccatactggctactgtgaataatgctgcagtgaacatgggcatgcagctgtgtgtagaaggtgccaatttcatttttttcggataaatatctggaagaaggtttgctggatatagtagctctattttaaatttctttaggagtctccatactactttctgtagtgactgtacccatctacatccctgccagtagtgtacagtaagccctcaatgtccttgatagatggttgaaaattgactttaagtgaaacagtgtatactgaattcagtttttttttctcatcaatgttataatgaaacaatgttgaagaaaacaatgttattcaaaggacaaaggacctgctctatgcctttctcttttcttgtctagaaaaagggttcccttttttttgtaacttttaagttcaggggtacaagtgcacatttgttacataggtaaacttgcgtcctgggggtttgttgtagagggttcccttttctccacaccttcacaaatacttgtcatctctcttgtctttttgataatagctattctaacagatacaaggtagtatctcattgtgtttttgatttgcatatccttgatgattggtgatattgaacaccatttcatatacctgttggccatttttatgtcatcttcagagaaatatctatttaagtcctttgcctgtttttaaatcaggttgtatgtttgcttgctgttgagttgtatgaggtcttttaaaatattgaatattaaccccttatctgatatattttttctcaatctgtaggttgcctttttattgtgtttacttgtgtatatttttattttttttaccttgcagcttcacctcaaaggaactttcattttattgtttcttttgctttgcaaaagctttttagtttgatgtagtcctgttcacttactttttgcttttgtagcctaagttgttgatgtgatagtcaataaattattgccaaggccagtgtcagggagctttttccctgtgttttcttctaggagttttgtagtttcaggttttatgtttaggtcttttatccactttgagttgatttctatgtgttgtataaagttaagagttcagtttcattcttttgcgtgtgaaatccagttttctcactaccatttattgatgagactattctttctgcattgtatattcttggtgccctattgaaaatttgaccatatttatttggatttatttctgggctctctattctgttccactggtctgtgtatttgtttttatactagtaccacgttgttttcgtgactacagctttggaatataatttaaaatgagttagtctgatgctgccaactctatttttctcagaattgctttgactatttgggatcttttgctattccatattaaatttagattaaaaaaatttctgtgaagaatgccattgagattttggctgcgtttccatttctttgtgtgctcctcaatttctttcatcaatgttttatacttttcagtgtgcagatctttcacctccttggttgaatttgttcctaggtattttattttttttgatgctatgtaaataggattgttttctttttttttcttttttttattttttttttattgatcattcttgggtgtttctcgcagagggggatttggcagggtcataggacaatagtggagggaaggtcagcagataaacaagtgaacaaaggtctctggttttcctaggcagaggaccctgcggtcttccgcagtgtttgtgtccctgggtacttgagattagggagtggtgatgactcttaacgagcatgctgccttcaagcatctgtttagcaaagcacatcttgcaccgcccttaatccattgttaaccctgagtggacacagcacatgtttcagagagcacagggttgggggtaaggtcatagatcaacagcatcccaaggcagaagaatttttcttagtacagaacaaaatgaagtctcccatgtctacttctttctacacatacacagcaacaatctgatttctctatcttttccccacctttcccccttttctattccacaaaaccgccatcgtcatcctggcccgttctcaatgagctgttgggtacacctcccagacggggtggtggctgggcagaagggctcctcacttcccagaaggggcagccgggcagaggcgcccccccacctcccggacggggcggcggccgggcgggggctgccccccacctccctcccggaaggggcggctggccgggcgggggctgacccccccaccttcctcccggacggggcggctggccgggcgggggctgaccccccacctccctcccggacggggcggctggccgggcgggggctgaccccccacctccctcccggacgggatggctggccgggcgggggctgaccccccgacctccctcccggacggggcggctggccgggcgggggctgccccccacctccctcccggatggggtggctggccgggctggggctgaccccccacctccctcccggtcggggtggctgccgggcggagacgctcctcacttcccagacggggcagctgccgggcggaggggctcctcacttctcagacggggcggctgccgggcggaggggctcctcacttctcagatggggcggccgggcagagacgctcctcacctcccagacggggtcgcggccgggcagaggtgctccccacatctcagacgatgggcggccgggcagagatgctcctcacttcctagacgggatggcggccgggaagaggcgctcctcacttcccagactgggcagccgggcagaggggctcctcacatcctagacgatgggcggccaggcagagacgctcttcacttcccagacggggtggcggctgggcagaggctgcaatctcagcactttgggaggccaaggcaggtggctgggaggtggaggttgtagctagccgagatcacaccactgcactccagcctgggcaacgttgagcactgagtgaacgagactccatctgcaatcccggcacctcgggaggccgaggctggcagatcactcttggttaggagctggagaccagcccggccaacacagtgaaaccccgtctccaccagaaaaatatgaaaaccagtcaggtgtggtggcgcgcgcctgcaattgcaggcactcggcaggctgaggcaggagaatcaggcagggaggttgcagtgagcggagatggcagcagtacagtccagctttggctcggcatcagagggagactgtggagaggggagaggggagagggagagggagattgttttctagatttcgtttttggctaggtcgttatttgtgtatagaaatgacatagttttgttttgatattatatcctgcatctttactgaattcagttattatatctgtatttttgatgacatcttttgggttttctacatataggatcatgtcatctgcgaacagataattttacttctctgatttggatatcttttctttccttatccttctcttccttccttcttactttttttttttttttgagacaggctctcactctgttgcccaggctggattgcagcagtgcaatctcagctcactgcaacctctgcctcccgggttcaagtgattctcccacctcagcctcccaaattgctgggattacagatgtgcactactgtgcctggctatttttctgtgtgtgtgtgtgtgtgtgtgtgtgtgtgtgtattttttggtagagacagggtttcaccatgttggacaggctggtctcgaacttctgacctcaagtgatctgcccaccttggcctcccaaagtgctggcattacaggcgtgagctaccatgccaggccttttatttctttttcttgtctaattgctttgatagtacttccagtactattttgtttttgttttttgagacaaggtctcactctgttgcccaggctggagtgcagtggcatggtcatggctcactgcagcctcagcctcccgggttcaggtgtttctcccaccttagcctcccaagtagctgggactacaggcgtgcaccaccacgcccagttaattttttgtattttttttgtagagatggtgtttggccaagttgcccaagctggtctcgaacttgggctcaagtgatccgcttatctcagcctcccaaagtgctgggattacaggtgtgagccaccgcacccagcccttccagtactgttttgaatagaagtggtggttgtgggcatccttgctttgtaccagatcttaatggaaaaggtttcagtttctccccactgatgatgatatttgctgtaagtttttcataaatggcttttgttatgttgaggaactttctttttattttttttcattattttaaaaattttattatttattatttatttatttttttgagatgaagtcttgctctttcactaggctggaatgcagtggcgtgatctcggctcactgcaactctgcctcctgggttcaagcaattctcctgcgtcagcctcctgagtagctgggactacagtcatgcgccaccatggctggctaattttttgtattttggtagagacggggtttcaccatgttggccaggatggtcttgatctcctgacctcatgatctgcccgcctcggcctcccaaagtgctgggattacaggcatgagccactatttagttttttgagacaaggtctcgctttgttgcccaggatggagtgcagtggcatgctcatggctcactgcagcctcaacctcctggggtcatgtgattctcccaccttagcctccctagagtagctgggactacaggtgtgtgccaccaagcctggctaatttgtctatctttggtagagatgtggttttgccatgttgcacaggctggtctcgaactcctcggacttcccaaagtgttgggattacaggcgtgagccaccacacctggccagaactttacttctatacttaaactgttaagggtttttatcaagagatgatgttgggctggacgtgagggtgtgtgcctatagtcccacctacttgggagcatgaggtgggaggatggcttgagcccaggaattcaagtccaacctgggcaacataggagaacctatctctcaaaagaaaaaaaaaatggatgttcaactttgttgaatgttttttctgtgtcaattggtatgatcatgtggtttttgtctttcagtctgtgaatgtgatgtatcacattaattgatttgagcgtgtatatattatacatatatatatatatatatatatatatatatatatatatatatatttttttttttttttttgagacggagtctggcgctgtcacccgggctggagtggaatggtgtgatctcagcacactgcaacctccgcctcccgggttcaagcgattctcctgcctcagccacctgagtatctaggactacaggtgcctggctaatttttgtatttttagtagagtcagggtttcaccatgttggctaggatggtctggaactcctgaccctgtgatctgtccgcctcggcctcccaaagtgctgggattacatgcgtgagccactgtgccggccaatttgcatatattaaaccggctttgcatgccagggataaataccacttgatcccaatgcataatctttttgatgcattgttaatttcaatttgctgatattttatttaggatttttgcatcagtgttcatcagagatattgacctgtaggtttgtttgtttgtttatttatttattttttgtggtttcttggtctggcttaggtatcaaggtgatgctggactcataaaatgtgttaggaaatattccctcctgttgtttttcttggaagagtttaagaagtcttggtaataattctactttgaaaatttggtaaaattcagccgtgaagccatctcttcctgggcttttctttgttgggaggtcagattactttaataacagattgagatatttggaagctgggcctcagttcagaggattagtctgtttttggtttcgactttgttgtaaggtaggcaggttttctttttttttttttgagacagtcttgctatgtcactcaggctggagtgcatgatctcgactcactgcaacttccgcctcatgggctcaagtgattcttgtgcctcagcctctcgaatagctgggattacgagtacacgtcaccacgctcggctaatttttgtatttttagtagagacagagtttcaccatgttggctaggctgttcttgaactcctgacctcatgatccctgtgatctggcctcctaaagtgctaggattacaggtgtgagccactgcgcccatccaaggtaccagttttggttggtaaggacattaatttccttttgctgctgtaacaaattagtgcaacctagtggtgtaaaacaacacacatttattctcttaaaattttgaaggtcagaagtctagaactgatcttttaaaaaatattttgttgtagagatgggatctcactatgttgcccaggctggccttgaactcttggcctcaagtgatcctcccacgttggcctcccaaaatgctgggattacagacatgagctaccatgcccagccttaaaaccaatcttgggggcaaaagttaagatagcagcaagtttgtttccttatgcatgttctaggagagaatctgtgtcttgtgtcttatatggagtctaccaacatttcttggctcataactatgtcaccccagtttctgcttctatcttatatcattcttttctaagtttggtcgtcttgcctcctccttttaaggacccttggcattatattgggcccaccaaaataattctggatgctttttccgtcttaagatcctttatcacacctggacattctggggagcagaacatagacatctttggacaggtcattgtttagccaagcacagggttcatctgacttggcaggtcctgaactccaagtgttttttctcagcttctgattctcctgaaatctctgcttagtttcttagcccatcagcctcttcttctagggggaatagaaatgtcaaatactagacttgcctttctggggattcccacttctctcacaaattctcactgttttgatagctctctgaggctttcagacagatatatatttttttttttggtattttttgtcaagcttttcttgttcttgccagaaaggtggatccagaacaacgtagtcttcaatttgatcactttttttgaataattgaagtgcattttgccaaatcttatagcattatatgttttattgttcattttttgatggttgttccctaccttttaaagatttttatattccccacctgctttatttgttgtatggtatggattaaaagtgaaaagttttgatggtcagttgctatatatttctctttaatgaataggcttaaagaagaggtttacttgtttggggcataattagacagcttacgtaaaaatacgctctttgagtaaatctttggataatctttagtacaatcttaccattagaatttttacttcatttttagtaaaagatgctaatatgagttatagtcctatgttctctgagaagcagactttactcttagaggtgaagttctggcatttgttgccagagctagtggtttgtgatgtgttagctgctctggcattgtttgttgtagtggtcagatttaaaaaacttaaagctaagtaaatccaagtaaatttaatgtattatgtggaaatggattctgtctgcttcttaggcatctatccagataagatttagaatacaattggtagagtttttacttgtgatgttgctttgtttcagtatgaaggctatgaagtagagtcatctttaaaggatgccagctttgagaaggaggcaacagaagcacaaagtttggaggtagaaaatcaaatggtataattttaaaagctggggaaaaaaatactaagtaacaaaaactttaaaaatgtatcttctgaaaactatttgaaaaaaatgtgaaagagcatctctggatgttaaaacttaaataagaaaattaatataggaaatgggacaataggaggtagcataaaatattataaaaatttaaaaatttgagcttttattgctaacttgttttgagtcaggcatgtttatgttcaaggaatcaggagctgtatagaaacttcgttctattattcctgggaaatgtattaaggtgatcgttccttttttgactcagtttgctctagaaaggagaaataagattcatttttacaaacttaggaatagttggcaacaataactttgtaaattatgacagtatttgctttattttcatcctgaggatattaagagctaactagaattaggccagaggtttacgttataagtaatggtgtatgttggtaaatgtttgacaactttttttttaaaaagcagccttatttgtagcatttgctgagttctgtagtatgaatacttccaccatggccagtttcaagctaccaacatgatgtcactgaatgaggagtcttggaagataatgcttaaagtaggctttcctgagccaagtgtgatttggttaattttaaggaaggaaagtatggtaatttgtaatttagctaaactaagacagattagggtaagtgatgggagtgccttactactgtttagatgtggacgtgttgtaaaaagcacagaagtgacaaaggatagcagaggacacctgcgtctgcagatactaaaacagaaaacagtagaccttgtacctttgataagcgtctagtacagtgtggcagttctcaatcactgctctccgtaatcatcagaaactctatgtgttatgattcagaattttctagtagagtccaaaggaagttataaattggattccaaataagtttcttaatgttttcttcatttgttgcctattactatcttcaagaacttgttgaaattatattttatttgctaaccctctgtcttaactacccttccattagtaatttatgtttgataaaaaaattttagaaggcatttgacatgctaacagaagagcaaaaagtaggtagcaaagacatttactcaagcttggtaatactgaggataaaatattacacatcaatttattttcaaggtaatgaattattataggagtaaaattagctgaatttttagctgcattcaacattttggaaatttttcttcaatttcagtaattttttagcatagtattttcagtaatagtaatcataattgaattcaaactataatgtgatgcaatttaaaaaaatatgatagctgaatctgtagataaaatcaaaccagtagagtaattttcattcgggtcagggaattcctagaatgaaatattcaaatttggggtaatatgtataaacaagtttttaaatcactgtaatgtagtatgtattttttttgcttttattttggcctgcattaaaatctttgaatcttttggtttatttttctttaacaagtttgttgaaggatcacaaatatcagaggtatgtttattatagtatttaaaatccatttggaataatccaataactaatcattttaaattaaaaaggtcatagaaaataggtcttaattcaatatggaatattatcatgaagcagccttgatttttttttagttgattttttatgtcatgcctttaattgtattaaattggctttatttctcatttttttctttatagtgcttttaagcagaggttggcaaactgtgcctaatgggctctccacttttttttgtaaaaaattgttttggaacacagccatgctcatttatgtaggtattgcttttgtttctcactgcagtggcatagttgagtaattgcaacaaagactgcatggcctacgagcctaaaatatttattctctggctctttacagaactttgctgaccactgctacaattgctgttattttgatattataaaaatgagcaaatgtataaatgaaagttatttaacttatagtacatattttttattatgctcgtctgatttccctaatgaaaaattcttatatctgtttaataaagttggctttctctcttaggcaacctgtgaaaagctgaacaggtccaattctgaacttgaggatgaaatactctgtctagaaaaagagttaaaagaagagaaatccaaacattctgaacaagatgaattggtaaggcttttttatttgaggagaatataagaaaaagaaagttactgagctttaaaaaattaatatgatactggttaaagtattacattattgtaaaaaatgtaaagaatacaggtggttgtagagagcaaaattttctagatccattcttttcacttcccccagatgttactgtgttaaatttcttgcatatttttatagaaattttctatatgcactatggaagtagctcatgtaaataaaaactgaataatcatgtccatagtgtatatttgtaattacttaacatgtatattaacattaaaactttttcttttgaaaaaacctgtcttaatgaaaatcttgatgtatgtgagattatttagtaaaacatgttagtggacttatcttgagcctatataacttaaatgttatgaaatattaaagttatgagatactattgttacgtaatgttcatataaaatcccttttagcatatggctaaataaactgagaaggtttcttaatttgagcttcacttatggagctaaagtgttaggttaacagtatatctaataaacatggcattttggaaactagagtttagtaaatattaattgcctgatactgtgtttctagatggcggatatttcaaaaaggatacagtctctagaagatgagtcaaaatccctcaaatcacaagtagctgaagtaagttgaattagtctagtaggtctgttgcttttggaaataattttagtttaattttttaaaattaagaaataagacacaatagtaggatttgagatataggggatcccagatatgtatttttttttttttaacaatacctaaatgaattagcatggctgtgttgcccaggctggagtatagcagcacgatcttggctcactgcaacctccacctcctgggttcaagcagttctcctgccttagcctcctgaatagctgggattacaggcatgtgccaccacacccggctaagttttgtatttttagtagaggcagggtttcaccatgatggccaggctggtcttgaactcctgagctcaagtgatcggcccacctcggcctcccaaagtgctgggattacaggcatgagccaccacacccagcttgtattttttttttttttacgtgaagtgcttcagaaaagttcatcttttcagtggacaagtgtttattgagctattactatatattgaggactggttgcttgacacttaacattaatagacaaaaaagtccccaggaagtttaaattttagtaggggaggcagaataaatagttatcaaaatttgctgcacagtacatagaaagttacaagaggtttgtccaaggtcacatcgtagcaagttagtgggaaaggcaggactagacctggattctagacaagccttttttctgctacaccatgctgcctctgctgttaatattggcatggttttgcctttgtttaattctgtgttctagggagtatgtgtaaagatgagctatgtattaaattaattgttacaaacttgacattttttgtttcacttaggccaaaatgaccttcaagatatttcaaatgaatgaagaacgactgaagatagcaataaaagatgctttgaatgaaaattctcaacttcaggaaagccagaaacaggtttgtgctccgtagggactcttcaacttgtgaatatgtaattatagatgttcttgtcatcctcatgactgacccatgctagggacaagtataggcttttccttgagagcatgagagcaggacagtctcccatacatatttcagtgtctgtctcttttgtatagtatacaaaagtgtatacttttggcaccctctaccccagggcagggaaagtaagccagggcatttagcattttggtaatcataaccaacttcttaaagccatgccgaaggggtacagagaatatgagtgaggattattgaagttatagatctggggtctaaagatagaaacaattctggtggcagatcacataaggatgtgacatttgccctctttctcccccacatacatagatactcccacgtatatttcttcttctcctttgccaatgtaattgtaacttttcagtgggaaaatttttcagtgattaaattattataattatccaaatattactcacaccagagccacatggtttgttcttttttttttattttttaattttttagacggagtctcactctgttgccaggctggagtgcagtggcgtgatctcggctcactgcgacctctgcctcccaggttcaagcaatttttctgcctcagcctcccgagtagctgggactacaggcgcgcgcctccacgcccagctaatttttgtatttttagtagagatagggtttcaccatattggccaggatggtctcaatctcttgacctcgtgatccgcctgcctcggcctcctaaagtgttgggattacaggcgtgagccactgcacctggcctcatggtttgttattacatattctgtcttattcaatattttccttagggttaataattgttttgtttcttgtatacttatccggttcatctgtatgctgtcttctagagatacagatatcttattcatgccttcaaatgctttgtttaatctgttaattgcattttttttttcttgaagcagttttttctttggcctcccttggtttcataagaacttattctgtaggtgtgtgttctgttctgtgtcctaagatttcacttcacccccatcctaaaggttcctcttgtctttctcctgtgttagatcttttattttccatatctgagcccttttgcggttaattcttttggttaattttctgaggaagaggtataggagataatttttttagaacttacatgcctggaaatgtcttgtttctcatacttgttgatattttggttgaatatattctgggttggcattttttttttcctcaaaattttgacactgtcactccattgtcttgactttccaatattgcttttaagaagtcagaagctattcagataattggtcatttttggaaatctgcttttttcctcctggaagcttttaatatctttttattgtttccccttctctgaaattacagatcattacacatctcttgacctcgtgatccacccgcctcggcctcccaaagtgctaggattacaggtgtgagccaccgcgcctggccacgggcggggttttcttttcttttctttttttttttttttaatttttatttttattattttttttttattatactctaagttttagggtacatgtgcacattgtgcaggttagttacatatgtatacatgtgccatgctggtgcgctgcacccactaatgtgtcatctagcattaggtatatcttttctttttgttgttttttttttgtttttgagatggagtcttgccttgttgatcaggctggagttcaatggcctgatcttggctcactgcaacctccacctcccgcgttcaagtgattctcgtgcctcagcctcccgagtagctgggattataggtgtctgccaccacgcccggctaattttttgtatttttaatagagacggagtttcaccatgttggccaggctggtcttgaactcctgacctgaggtgatccactcacctcggcctcccaaagtgctgagattacaagcgcgagccaccacgcccggctattggtgggcttttctataggatatatattttttttgtgacagagtctcactttgtcacccagtctggagttcatggcgctatctcagctcactataacctctgctgcccgggttcaagtgattctcctgcctcagcctcccgagtagctgggattgcaggcatgtaccaccatctgactaatttttatgtttttagtagagatggggtttcatcatgttggccaggttggtcttgaactcttgacctcaagtgatctgcttgcctcggcctcccaaagtgctgggattacacgcatgagccaccacgcctggccaggttagggtatttctaattggaggattctcagttgttggtatctgaagagcatttccacagggatgagtcctccacatttcccatttgggaggtgtaagcctgtttgccaacagtcttgcaacttaggtaaagaatgctggtgtctgactgttcagtagtcagtttcctcttaatacttttatgttttcagtatgttacttccaccttcacctggatagatgtcccagagtctcaggttccacctctccaaagaatgaccctgtagggttttgcgtgtgtgtgtgtgtgtgtgtgtgtgtgtgtgtttgtgtgtgtgaaagagacagagatagagaatgaatgagagagaatgagaataagaatgtgtatatatttatgtcatgggaggctttccaactgctttttatacagacttttggccagtcctccttttttccagtcctgcttatacccctggtatttgtgccttcaaatcatgaggctttctagggtatatcaaatcagcctacttttgggtgttcctaccttcaggcttagatttaagttctctctagttggttgagtctttttatcacacttccatttctttccattttctacttctacaattattttttgtctcatctcctattttcttttttccttgtgggtttatgcctttgaaaaaaaaatctgttttctgccattttaatagatttgagtagaaagtggtggtaaaccctgtgttaaatttgccatgttatgatcaaaagtggccttttccaccttggaaaatatttcacctagatcagtcttactctttacaactgttttcatctaactcccttgtaataatccaaattcttgaaacaaactgtattcactgatgccatgttctaatgcactccttctctaatgttttaatactgtatactgtgtacttaagtctctttactaactcatgagagatgacctaatcaccaaatgtgaattttttcttggattctcatttgtttttacctgtatcatctgattctgttttatatatatatatatatatatatatatataaagattagtttttcatgtgttcggaatacgctaatgaagccttagttttgcggagaaatccaataattactgtttggtagaacagagttttttttttttttttttttttttgtgagcaacatggctgtttatttcacctgggtgcgcaggcgggctgagtccgaaaagagtcagccagaacagagttttaaagactaaataaatttagactttttcatatatatgagccatttcttttgtgaattgcctgctcagtcttcttttttctttgcctattttttcttattgacatctaagagctctttgcttgctaaggttattaaccttttgctacaaatattatgagaattcctttcttggtggggtgcagtgggtaacacctgtaatctcagtgatttggaaggtccaggtgggaggatcacttgaggccaggagttcaagatcagtctgggcgacatagtaagaccttgactctacaaaaaataaaaataaaaaaattagcagagtatgtgacatgtgcttgtagtctagttgcttgggagggtgaggtgagagaatatcttgagcccagtagtttgagattgtggtccagcttggatgacagaatgagaccctccctgcctctaaaaaaaaaaaaaaaaaaaaaaaaaaaaagaaataattcctttctagttatttatctttaaatgtcatttgtgttatatttgatttgtgaagcttttaagctttatgtagtcaagtctaccttttataatgatctttactttttgtcatgttcagaaaggctttcctttcctgtaaaagtatatatagtagaatactgttgtggagaatctgatctgttctagattaatggtatttctttttttttttttttttttttgagacggagtctcgctctgttgccaggctggagtgcagtggtgcaatcttggctcactgcaacctctgcctcctgggttcaagcgattctcctgcctcaacttcctgagtagctgggactacaggcgcgtgccaccatgccaagctaatttttgtgttttagtagagacgaggtttcaccatgttggccaggatggtggtatttctaaaggttagttattttaagtacaaaattgcacaatgatttaaaaaataaattttaatgcaagtaaggtatgatattttatatgggatataaggaatggtaagaaatgatcaaatctaagatatgtatatctcaggaaacctttatttgatataaatatatgatataaactagttgaagaatgtgtgtgttattttacactaccccattttgaaagttctttgaaaataggagccatgtttttcttttttaagtagctacataatgccttcttggtatcttttaatgattcacttgtgtgatgagttgcatttttaaaattttcattttcagcttttgcaagaagctgaagtatggaaagaacaagtgagtgaacttaataaacagaaagtaacatttgaagactccaaagtacatgcagaacaagttctaaatgataaagaaagtcacatcaaggtaaatggctctactggttttagtgatcaagttggctagaattttacactaactctgaaatttgaaagctagtttttagcaacttttattttcacaacatattttcataacatatttggccagattttcaaatgtttcttgaagacttacagatttgtcatatgtacatacacatacacacacacatacttatatgaatattctgtgtgtccttttttcttctctgtattttagcctaggtatttaataaagaaataaaaataatggtttctaccatttctcttcaggatgctatctgctcctgttaggaggttggaagagtttgagaaattggatgtatagttatatatattaattgaatatctttaatgtaactggtgtatgtactttgatggagaggaatacttttaaaaaataaatttaattgaaacttgactccagtcataagaataaaaggattttttgattttttagatttttaagatttttaaaaatcttaatgctgataaatacagatactcaagtgtatcaaataatgatatgtaaaactaacgttctataatttacacagtgatgtggatgttgtcatattgaaagtgatgctctcactcataggtgggagttgaacaatgaggacacttggacacaggaagaggaacatcacacaccgggacctgttgtggggtggggggaggggggagggatagcattaggagatatacctaatgtaaatgacgagttaatgggtacagcacaccaacatggcacaggtatacatatgtaacaaacctgcacattgtgcacgtgtatcccagaacttaaaatataataaaaaatagtataaagaaagtgatacatttatgccagttatgttgctactaagaatattttcaaaattccagctttctgagttttattcagaatttggcatatatatatatacacacacatatatacatatatacacatacatatacacatatatacacatatatacatatatacacatatatacatatatacacatatatacacacatatatacatatacatacacacacacacacacacacacacacacacacacacacgagatggactttcaatcttgtcacctaggctggagtgcaatggcaccatctcggctcattgcaacctctgcctcgtgggttcaagtgattctgctgcctcagcctcctgagtagctgggactacaggcatgtgccactatgcctggctaattttttttgtatttttagtaaagacgcggtttcaccattttggccaggctagtcttggaactcctgacctcaggtgatccgcccaccttagcctcccaaagttttgggattacaggcgtgagccaccgcatctggctgtggcatattgttttatttattttttctaaacttcctctactaaaggctttgggattcttttaaagataacaagaatgagatgctaacctcaagctctgctcaaaggtataggccatgttatttgtgcctggaactctgaagagagggaggagatcgaagggtgaaaattgtagatcagtgcattatttttaggtgggtccctccagaggaatacatgacacgtcatttgattatctgtagtgttagaaaatatttctttaatcaacaaaattcaaaaagtacttttggaaaacctctaatgttccattcaaattctcttttataaatgtctttatctcagctaattgtttccttgaataaatcaactaaaaatctacgatctttttatacattatgtatctcactgcagatgtgtttggtgtcacacagaatttactctcatgttaattagggcactgttatttgtggcatgtgagaaatgtcatataaaaaatattttactactttttagttgcataatattaatatgtactatatttgatttgggaataactagttttggcttttacttgcagagtttaatagtcaataaatgttaccatttctcaagactacaatatcttaataagaggtggaaaataagagctcttgtgttgttatttatgtggactgatttttaaactataactgtacattcacaagttgtaaagctgttagcataaggcattaccctctctatttttcccctttgttcaatgtcaagactctgactgaacgcttgttaaagatgaaagattgggctgctatgcttggagaagacataacggatgatgataacttggaattagaaatgaacagtgaatcggaaaatggtgcttacttaggtattaagtcatgactcatctccttttgctaaaatggtgactagctcttctatttccttttcgttccctgtgtgcaccatgttctttatatgcttttactttggcacattctgtctgtctgtgacacactgtcctttctcaccatcccttatagtttttagcttcagctggagcactgccttttcagtaagtctttctccagctgctcagacacacttacagcctcctcccttttttttgtgtattatacatatctttattatagccattttcaaaattacatcataatcatttcaatgcctgtttttccctgtactgtaagctaatcaaatggatgaatgactagtttgaagaacaagtgttctataaatacttcaggatacttcttttgcttttgtcagaggttcagatggttacagtacttttaatgttagccattcaaattattattgccattgatggttgtgctctgaagttggcaaaagtggccaaatttagtttcactatagccccttaatgtattctcacaccaattcctttgacctaaaaaaaacctttttattttgaaatatggcatcataggaagttctaaaactagtacagaggtcccatgtacccctctctcattttaccccagtggcagttcttcagacttttatgtcatttttctgttctcttccccagcccctgcataattaacaaatttattatggaggaaaaagtgtgattaaaaatttttttcgtgacaacattaatatgttggaaaaaattacatccctaaaataagtatataaagttctgtttgtactttttcatttctactttattatatataaaataatcctttctctatttgagaaaactcatgcttgtttaatgttattttaacttgggttataattttactcatattttggatgctgtaagaatccaagaatagttaatgattgtggtctatatttagatgaatatagaatccttgttataactctgttcttggagttagagctgaagaaccttgttaaatggtatgacacttcagtgcttttattgtttagcttcctgggagcaggtccaaggccattctgctttataccaaattctttattgtagcaagaagagggattataagtttctggtttagtgaactgataaaatcattttgatgtctattgtcgtattgtactattttcccaaatcattgttgtgcttttgattttcactgtagataatcctccaaaaggagctttgaagaaactgattcatgctgctaaggtttgtgctattagatacttaaaaagaataaggaggaagaaagagaacgtggattactcatgtcccagtaaatgtttaaaaagtccattttattgttcccatataaatatatttacaaattatcagaattttcatcatcaattgctttttcctttcaattattaactttagaaatttatataatttttggaatttatcaaaataaaaaattccaagttctgtactcatttttcggataagactatatttaaaatgtttcctgtattttatcttgtagttccctcagtgcattctttttcttctagtctcagtattttcttaccccttctgccctatatcctattttaagtaaatactagatgcctttttttctggtttattccttctcttttccaccctagtagtgtggtatcctcatttttgctgatctatgtgaagtcttggtaatgtagtttgaaggctgctttaataaaaacttttgttgaaagtaaatagaatgaaaatagtcactttcttaagcagccagtgaaaagcattcactacttttccctgtcccttgttctgagacttacaagcattgacgactttgctggtttttttaagacggaagctgcattatggtttctgtattccaggtgataatttcatcaaaacgataaaatcacttaaaaagtgttaggggggtcatactgaggttttattttttatttttatttttttgtataactgattaatgttacttttttccttcttcccttctttaaagttaaatgcttctttaaaaaccttagaaggagaaagaaaccaaatttatattcagttgtctgaagttgataaaacaaaggaagagcttacaggtaggtcattgacatacatacttttaatgtttttctaagtaagtacatctcttggcagagaatggtaaaaatgaattgaattaactttgggaagatccaattttatttttttttaacttttgttcctgttgggtatttgtgaaacattagtcctggtttttgttgtcattgttgctaaaggcatatcgatttcctctgtatttatgtgaagttaaaataaggaaattttttaaaaaacatgtaaaaccgtatttatcttcgaattacagtgttatgtgtttgaatggttttagatgttaaaaagtagcaaattgaaacttaatgtttaaagtctttgttaattgaaaaattgatcttcaatagtggtactatttgcagtatgattcgttcctttaatgtacatacgtagtatattagtacatacgagagtgatgttagacctgtagaaatgaaggtgttgttttaattgaaaacatttatgtttattttgctgatagtgtttgtattttcaaaaagtaaacaagttctgtcaatatgtttgaaaatttttaaagttgagataaatagcatctcattttgtaaaaataaaaaatataaagatttaccatatgcgtttgcatcagaaaagactggaaggacatactcaaatgtcaacaatgattatctctgaatatgggattatgggcagatttttatattctttttacttatctgtattttcaaaaacttctacagtaagtgaactgcatttataatactgttttaaaagattgaaccaccaaagatagaggttattaaaaaattatatccctactcacatgattatagtaattggattatttttggatttcaagaaacattagtattagtttaagagaatgttgctatatgtaaagcattgtactaaaaactatgggagatatacagaaggaaaagatagcttactttcaaggaagctgtatttcaaaaaatgtgtgtagaaagtgccagagtggcaaggaaatttgctcaccagttatcccactccttaatacagtttcctggcaaatctttgtttctttcttagactaatacttggagacctatgtctccttgtactcttctttcaaatctaactttgtttttttaatggatcatgaaagataaatttctgtaattgatgttttattcatagcatgaagattttcctctaaactgtttcttccttttctggtaatcatttacagtggtctttatgttacaatttgaaacacagtagaagtacaaaaatatggccaggcgcggcggctcacgcctataatcccagcactttgggaggccaacgtgggtggatcacttgagctggggagttcaagaccagcttggtcaacatggtgaaaccctgtctctactaaaaatacgaaaattagtcgggcgtggtggcacatgcctgtaatcccagctgcttgggaggctgaggcacgagaatcgcttgaacatgggaggtggaggttgcagtgagccaaggttgcaccactgcactccagcctaggcaaccaagcgagactttgtctcaaaaaaaaaaaaaaaagtacataaatatattaaataattaagtgttgggttgtagttttcttgtttgttttacaatagggatgattaaattttaatagagataatacccaacgttaatttctttacgtgattgttcttggcaatggcttaaagcctaggtcaatgaatttttttttttctgatgtagattaaaaaatttctgtggaaagatagttacgtacaatttcctatacatttaatcatttaatgtttaggtatttatgtaaactgttcttttggtttgtatgtttaatgggttatattagtccgttctcacattgctgtaaagaactacctgaaactgagaagtttgtaaagaaaagaggtttaactggctcatggttttgcaggctgtacaggcttctgcttctggggaggtgtcaggaaattaacagtcatggtggaaggtgaaggggtagcttccttacatggtgggagcaggaggaagagagtgaagggggaggtgttacacactttaaaacaaccagatctcatgagaactctatcatctagggggagacagcgctaggaggatggtgataaaccattagaaaccacccccttggtccaatcacctcccatctggccccacctctaacattgggaattacaattcaacatgaaagttggatggggacacaaagccaaaccatatcatgagggttttagaataattaaataccattacatgtaattactaaaattttcatgcttgttaatactgtttccaaaacttccctctttaggcagagtgagttttgtcttttaagatttgtggtggtgattcatatacacgttacaggagatgatgccttccttcatcttagaggagttgaggttattatcttgataccttaatgttagagttgttcagagttggtacttcaattttagaggcgctcagagttgaggtaattatgttagaagagaaacgaggtttttaaaaaaattgatgcataaattataaagcattcataattatttagaatgattcatttttattttatagatttttttaaagatggcttagcggttgaaacaacgcttaaagttggtatttttctctctggtcttgatctgttttaaactaggagtatgtttgggcatttgttatgagaagatctagatttctggcttgacttatatgtcaaaattttagcttaaaagggagggctaggtagaatttaagtattattaagagagaaagtttttactagataaaaacaggcattattcatcacctggaaatagttttacggggaatgttgaactacaatatctccctttaaaactcttatctccaaaaccttcctgagaactttagtggcgtttagctctaaaattgaaaattagatgctagaattagaatgttgaaggtgttgggaatcctataaataataacaaaagttaaaagaattttttttttttttttttttttttttttggagacagggtctccctttgtcatccaggctggagtgcagtggcgtgatcttggctcactgcacgctctgcctcctaggttcaagcaattctccttcctcagcctcccaagtagctgggattgcaggcacgccccagcacgcctgactaatttttgtattttaagtagagatggttttgccatgttggccaggctggtcttgaactcctggcctcaagtgatccacccccttcggccttccaaagtgctgagatgtacaggcgtgagccaccgtgcccggccaaaattaaaacaatttatatagctccttaattcagatattaatgcactcaatggagcactattcagccatcaaaaaataatgggatcctgttttgtggcaacatgagtgagcctattttaagtgaaataagccacacgagaaagagaaatggctcatgttctcacttatatatgggagctaaaaaagttgatctcatacaagtaaagagtggaatagtaatagtaatatgagggtgggaagtatagagggtagggggttagggagaggttagttagcagatacaaaattataactagataggtggaacaatttctaatgttctatagcactgtagagtggttagttaagttgctgtatatttatatttctttttcttagatctactttatttgtcatattgttatttttgaatagctagaagagaggattttgaatgttcataacataaagaaatgacaaatgttagaggcgatggttatgctaattaccctgataggattattacacatcgaatacctatattgaaatatcacactgtaccacataaatatgtacaatttttatgtgtcaatcaactaataacaataaaagcatttaggtaaacagaatcccttatagattttctgttattggaaagagtttagtttattaataatttattatttttagtaatttttatctttctgaaatgttaatatgcaactcaaaatgtttctcctttaattatgacttaaaatttttatatagagcatattaaaaatcttcagactgaacaagcatctttgcagtcagaaaacacacattttgaaaatgagaatcagaagcttcaacagaaacttaaagtaatgactgaattatatcaagaaaatgaaatgaaactccacaggtaataaaaattatgttaactccattgaacagcaagtaaaatagctttagagatatatgttacatagttagctatagtgattattgaaagttctcaatttatgattagattgtatttcatcaacttatttttaagaaaggtatttgatctggagacactttttttcaacaaagaaaatattgtaagtgatgttggaatttccaagctagttaacagaatcctctttagctcctagtaagtagtcagcaacttattgccttaaacttcctaatactggcagggaatctgaatggacactcttgattaaactgcccattaattccatctctgatatatgtaaaactgatttttctgttctgtgcaaattgcttctgcccaggtgttccttggcttagtaaatggcagtgtcctttacttagttacttagggtggcacctcaagctgtttttgacttctctcttgcttttatatctcctatttattctgtcattaaatcctgtcagcttttttatagcctgaatctgaccactttttaccatcttccatattagtctagtccaagtcatcaacagttaatacccggcttattatagtagccttatgggtagtctccttctttccgccctttctcctgcactgtgttttctctgcaacatgcaggatgacccttaaaatgtgaattgtgagtatggtcactctcgtgctcaaaatccctgagtgcctttatatcacactcaacccacagcttttatatcttggcctacaagacagtacaggattggacccttggccacctctttaattttagcttattcatgttctttttcctctcagtaccctccatccagcactggcctttttgatgctcttcagcacattgaccttagggtcttttgtgcttgttccttctgcctggaatgatgtttccttatatatttgaatggctcagttcttcattttattaggcctgggttcaaatgttacctcaaagaatccttccctggctactctaactaaaataatacctgctactctttattcccttattttgcctcatggctcttattgtcctctgattgattgcttttctttcttttatcttccttatgttaaatacaagctctgagagaaaattattttcttcacttctgtattcccagtgcctaaagctacatgagacgtgtggtaactgttcagtacatgtttgttgaatatatgtacaaatatgttcagtgcctttatatattggagtgaaggagtgtgtgtgtgtacatgctgttgcctaaatgcctaagtacactgaagacccttgagatatctgaagactctagattttcaaatagtgccatggcatgtatttttttttttttttatcataaagggtaataaaatgtaacagactttcaggttcctttaggctcttaatgatagttattacagttgttccttattatttatagaatctgtatttgtgaattgacttactagctaaaatttatttgtaaatcagatcagtacatgcaaagcttttgtagccattcatggacatattcagaatgatgaaaaatttgagttgcccaatgtgcatgttcccagctgaggtcaaacaaggtgacactctgctttcttgtttcagctctcattctgtaaacaggtgtcctttttacagtatatttagtgcctcattttttacatttttatgctttttgctggtgatttagctgtttaaaatgccccctaagcatagtgctgaactgctatgtagtgtttttaagcacaagaatgctgtgatatgtgttatggagaaaatacatgtgttagataaactttgtttaggcatgaattacagtgcttttggctgtgagttcaatgtcaataaattaacaatatatattaaagaaagtatctttaaacagaagcacacaaaaaaacaaggttatatattgattggttgataaaattgttgtgaccagaggctgtagcaggaagctaaccctgtattacccttaggagcagtgatctagtatttgctaatttacgatgtatagtgactttatggaacaaaactagcacaaataatgagaatctactttatctatttggaaactggtagagagtactaatgcttctttgagatcaggatgctgggtagtgcttggctcattcactgccaagttctgtacttcagtcatgatttggattcagttcacagttaaaaagctgttatttgttatggccctttggccctttgggactgctcagggtatgcaagagactaaacgtgacaaaatggaagaattacagtataacttcagggtttttcagccagtatacctaggagtgggcccttctttttaggttagaatgaaaggtattaaagtaaaacttggatataaaagtgattgaggtgaaagaaatatttttgagtgtatcttttgaataaaaaaagtatatggttgattatagaattttgatgagtaatgtttaacatttcaaagaaaaggtattttctttagatttttaaaggaaggataggaaactgagtagtaccctagttgtgtgtgttgttcacaggatttcattcattagtttaaaattattttaaattcctaaaatattttacatttccttcttatatttaactagcaagtagtttatattactgaaattcaatgaattatgccattggcacttcttcagagtagaatattgagttgatagtaccagtgaagtgttaaatttatattcttgctgcatatagtataatttaagttcagtctggatgttggcttgatgtttttcatgactgatataccattttcccaaatttaataatggaaacaaatgaaatggtaggacctagaagcttgatgtgttgcttttttttttttttttttttttttttggtgagatgaagtcttgctgcgatgcccaggctggagtacaatggtgtgatcttggcttaccacaagctccgcctcccgggttcacgccattctccttcctcagcctcccgagtagctgggactacaggcgtgcgccaccactcctggcttatttatttatttttttttgtatttttagtagaggtggggtttcaccttgttggccaggctggtctcaaactcctgacctctagtgatctgcccaccttggcctttcaaagtgtggggattataggcatgagccactgtgcctggcccttgatgtgttactttaaatatatatgatggtttttgtgtgtgtgtgtttttttttttgagatagagtctagctctgtcgcccaggctggggtgcagtggcacgatctcggctcactgcaacctctgcctcctgggttcaagcaattctcctgcctcagactcccgagtagctgggattacaggtgcgcgccaccatgcctgcctaatttttgtatttttagtggagatggggtttcaccatgttagccaggctggtctcgaactcctgacctcatgatctgcccacctctgcctcccaaagtgctgggattataggcatgagccactgcacccgaccaagatatgatatttttaagtcatatcatcaggtctcctttcacagtgtaatttctattattaataggcccacccaaattcaatgggaaggtacataaacctcaccttttatcaggagaggtgtcaaagaatttctggctatcttcagtctacacagtctgtaaaaacacatctctcttccatatccatgcccgtcgcactttcgtgcttttcctaaggagatgacttattttcttataacatccatgaaagtgattgaccttagggaatgctttctaagcaataggtaatgtagtgtgtagaatacaaaatatttactgccatactgcaagacttcttcagtagtttgtcttgttcttctcaaagttcatgaagaagggaagatatccatttaggactccaaatgtgttttcctgtggtgttcaataaatatttcttgggtgaccaagatatattaatgatagtatgtgaaatgaaacaacatgggtattatagcataaaagagtcactgcttatgagctctaggctttggtttaattatttctctgtgcttcattgtcgtttttgtaagatgggataacagtaccacccttcttgtagagctgttgtggtaattaaataatacatgtagaagtctgagaacagtttttggcacatactaatggctcaataagttatctattattattattaatagaattagatgtagtaaataggactgctactactactgtttactttggtttcattgtaattataattgtgtgtgtgtgtgtgtgtgcgtgtgtgtttacttgcctggaagcctaatcactaaccaatataaaaattaacgaaacacattttattaattggtgacttcttactagcaaatgtaatgcttgtttatacagaaagacttgataagtgatagtcataatagtttttattaaatatatctttgatcctatttttaagataaatttatatagaaaactcttgaaactattagtagttctgtattagacacaatgctttacaatttcggtttataatattaaattcaacaccaggaatatttacacagatactttttttttccttgtaggtgatgttttcagtggtattttagaaatcatttgacaggaatcaccagttttttcacaattaaaaatatagaattgattatcttttgacatgtattaagagaattataacattttttgtttttaaggaaattaacagtagaggaaaattatcggttagagaaagaagagaaactttctaaagtagatgaaaagatcagccatgccactgaagagctggagacctataggtattaaatacatttttctggtttcttttttggaatgggaagagtatctaaaaaacttaatgccagaaaaataataaatcaaatgaaaatagaaaacattttaaaatctgacaggtggtacagacaaaaaaataatatatttttgtctcatcacttttcattcagatttcttggtcttgagcaattatacagaaaatataaagaggaaaaatgtttttctttcaggttgtgtgatttttaaaatctctcaaagttgaatatggacaattctattttatgttagtgtcaatatgaatagatattaattttaaggtccttcctcattggttcaaattgagaagaatgtatgtaatattagtgaatcaataggtgtgccacaaaaagaagagtgagccatagagcatttggaagtatttaaaagactataaatctagattttaccttggtttgatccttactagatcccaggaaatagaaaatatagagaaaaaaagattcagcagtatcccaaatagttgtgatacttcattttacctcagaaagagcaagcttgctttttatccaaaataagttatcttgttaatctcacaaaagtaccaagtaacattttacttcacagtggttgctaatttcctagaattctattaagactacccacatctggccgggcatggtggctcacgcctataatccctgtactttgggaggccaaggtgggtggatcatctgaggtcaggaattcgagcccagcctggtcaacatgatgaaaccccatctctactaaaaatacaaaaaattagttggtcgtggtggtaggtgcctgtaatcccagctactcaggagactggtgcaggagaatcatttgaaccctggaggtggaggttgcagtgagccgagattacgccactgcactgcatactgggcaacaagagcgacactctgtttaaaaaaaaaaaaaatgaccaacatctgaataaatcttctaggatcattcttcttaaaaataaaaaaaaaacaacacaatataccacgtaaatatttatgtgactttgggtttaggtaaactcaagtagtagtattaagttgtaatcaatgttaaaattagtttaggaaaaaatatactgtagaacctgtcagaggtgattatttcttaatgtggagttctggagtttttttttttttttttttcatgaagtagagcattctgggttttctaataaatatttttttagtagagagtatgttctgtcatttcatgttatatgttaatagtagaataattattcgttccatttagaaagcgagccaaagatcttgaagaagaattggagagaactattcattcttatcaagggcaggtatatatatatgtgtgtgtgtgtgtgtgtgtgtgtgtatatatatataatttaaaacaattctgatttctttgaattgatgcaggaatataattacttgaccagttgtatacctcttttgaggtgttgcatgtggctgtgggacatttcccaggagccaaagattctgagataagaaatcttatttaaaattgctgtattggctgggtgcagtggctcacaccagtaatcccagcactttgggaagccgaagtgggtggatcacttgaggtcaggagttcgagaccagcctggataacatggcaaaaccctgtctctactaaaaaaaaaaaaaaaaaaaaaaaaaatacaaaaatagccgggtatggtggcacatgcctgtaatctcagctacttgggaggctaaggcaggagaatcacttgaaccctggaggcagaggttgcagtgagctgagatcacgtcacttgcactccagcctgggtgacagagtgagactccgtctcaaaaaaaaaaaaaaataaaataaataaaattgccgtatctcctgctgctttgggaaggtagattgcatcacataaatgtgtatcaacagtggggtctcatactcagtcaggctagttatatgttaactggcaattcctgttgattattacataaagtaaaagtttaccaaacaaaaaatttaattgtctttacattcagtttttgttttaaaatataatagattatgtatacatgaaaatttgctttaaaaatgttgcctactcttcagagatgcttgggatagttttgagttgtgcactacatcatagtggtagatgtgaatgttttttacttaagaaaaataatggtcagtagcattttaattactttctttttcagattatttcccatgagaaaaaagcacatgataattgggtaagtttaaaatttccttaagtctcttttgtcaaattgtatgtttttttcagaagatacgttgtttatttaaattagatgaaaataaatatagtattctaaaaaatcagtttcttttaattttacaagtagtgaaattatgttccttgtgaactagtttgttccaacacagttattagaaaaatctgatttttccttctttgcttttatcacattgcttctttgaaaggagtttatactccatggggaaggtgatataatgttcatggactgattgttccagggcactggattgccactaattagttgtggacaagctacttaaaattctttgggcctatttcctcatttgtgtaacaatgggattagattaagtgatcttagaagccccttctagttctaaaagtcataaaattcagttacctgatcctcagtgttgaattactgggtacacattaagaaaagggtcatcatgagaaatagtgtatttgtgctccagaggaactaactgtgtgaggaagtgatgaggatgcagattttgactaattataagaaagacactgtaacatataggactgttgtagtagctggcctttggagtacttgtcactaggagtcttcagcagtaggcagtttgcacagtgggtgaatacatggagtttggaattaggctgtcttggctcatgtcctggcttcatcacctatcatcagttttcttacgtgtaagatagagatagcagtagtacctatttcatagggttattgtgatgattaaattcatgtaaggttgttgccaaatgcctgacacacagtatacattcagtgaatgttaactgttgttattgttgtagtgaagcttggtaggtatttcttagacatgttggagtggagattccagcctagggtgagagattaggtgtggtgaatgtctaggtcctcctcagttgtaagattctgtatgctttagtattgagggttcaaatgaaaatttgttactaaattaagctgggcttggagatgaatttagttaaccactgctcaccacttgtaaaatacttaggtgtagattactctttgaagatggagaggtccacacacagtcccagggtaagacggtaaccaggctgtttctggaagggcagcaggaacatcttacagatcttacagagacactgacttgtaaagattagaatgaaaaccacaaacaacaatggccaagaagggaatatgctgaggtccagaggtaacaattccacatccctccctcaccgctgcgtatttagtgaagtcttctaaggtagataaaggttatctcagatgacatgggtagaggctacaaagagacagttaagcagttggatataaagatcgggacagccagatgacacctaggatatatctgtcctcacgtgttctagagcacagggcaggcaggaaaacccaaggaaccacaggctaaagaattacatatcaggaaggtcacttgggagaagctccacagacaaggtgtgtttttagctgaattgggattggtagagggaatgaaagtgacactgagcagtagcttgtcacacgctccagagctgagctacccacaggagcagacgggtctgggcagaagacagttaataggagaggctcatattagtttctgaaaagtcacatggtaacagagtttaacttgttttttagggaaaaagtgttcatttcaatgaactaatcacccaatcagatagaacccaggctggctgagtttagagtccatgaggctctgaacgtttgaccccagggtggatggggacaaggacatggctcacactgtcaactttagagatttgagggtagggggataataaagtctcaactacacaaaaaggatgtttattaaaatctcttgtgtcctaggcactgtacttaaaggccttttacatacattacttgttcaatctactcagtaactgtaaagttggtactataatcccagatttatggatgaggaaacagccgaaggtcatggactagagggtaaagagtgggtatagaaattctgatctttcagagtctaagtcttacactttttcttacttcagtgattatgatttgtataccattgttgtgatatatatatatttttaagaaatttaatgaatgtttatattgacatatttatgcttattttttaagtttatataaatatatttttaaaatgtgttattttcttcaagttggcagctcggaatgctgaaagaaacctcaatgatttaaggaaagaaaatgctcacaacagacaaaagtaagtatcttagtgggaacatttaaaattagttattctgttatttcgttaattaggtaatacttttataaggttaagcaagaaaacttgcagtgaatccagcatatcttgtgagatatctattagttttactaggaatgtctagtttgttttgtctgttgaagtacttgtcttaggtcactgaagtggcacttggaggaaactgttaacagattattctgcaaaaagtataactagaattttttttaaaccagtgtagatggatggaggtaaaaatggatggaaagagaaggggtgaatctctctgacatagtaatgcccagaatatcagcctcttttaatggataagtagataggataatattcattaatttctctcatttcctggttttgtagtattgggtgacattgttttacaataataaaatgaaaggtagaataaaagtctacaatgtacaatagcagggaagaataagtgcttttctgtgaagatgataacagtcttcctagagtgttataatttcttgtcacaatgtactgttaacattatccaatattagtttttagtcctcttgcttgtcttttctagtctcagaaattaaaatcaaattattaaatgttttatatctcatgattaagaactagaaataagattcttttaaaatgtcacatttgtaggataaaaagtttacgagtaagatagtaggacaaattaatgggatttccagtgttgtaactggaatcatgagtgtcacgttacaatggaaagcatacatgactcaaagccaggaaccctgtgtcttaatccaggcactttcattgtgaataaatatttaaactcctagcctcagtttccttagttgtaaaatgatagactggttgaccttggaggactcttgtatttcaaaaatttggattctgtgatatagtactcatggtagtctagttttgaagaagaaataaaacaattgtaaggctccacataacatcactatctctagggcagcaagaaactgattaccctagttaataagcagtgggagataaaggtgttttggtcagaataattttagaggatctgtttgttctgtgtagatattaaaatagtgaagagcagcttgtagttggtagaggcattttttcttgtggtgcttctcttggatgagtaacttagagatgtttgttctttatttgcagattaactgaaacagagcttaaatttgaacttttagaaaaagatccttatgcactcgatgttccaaatacagcatttggcagaggtagtctttttttttttacccctcatttaaaatacatattttacatatatatatatattgcacatatagtttctattagtgtaagttaacactgttatttatataaatattttagattttagaaccaaggttctagactaagctttctcatagactcacaagcttctaggttttgtttcctgtgcagtaatgaaaattactgttgcttttatttctcagtgggattttgtaagatgatacatatttagtactttgagctccttgaaaagctaggtgcttggcacatagtaaggtactcattaacaattttctgtgagattgaatgaataaggagtgcttacatggactagcattgtgactgtttatatattaactatactttggaatttgcttgtttaataattaaaaaatagtttctaattatttaaaagtatcaatttaaaatgtgggaaaaactcagtctgaggtttgattgctttaattaccctcaagggaggaccaattttttttgtaagatatatttaatatttctgtccattgttgagttagggtctgcagtgatctcaaactattgcaaacagtttaaattttttcataataattttggttgaattggaattaagcttctaaggtactgaaaaatctatatataggtagaattccattttaataaccttggaaagttataaaaatcacttttgagagtaaaatttcattaaaatgaaagtctgtttctacatttaaaaaatattagattattacgaatttcaggtagtaacaaagtttggattggggtgaagtatatagaaggatttttttttgtctgaatccaacacaaaatttcaagaagggtaactaatgctttgatcttttcttgtagctggtttgaatattataccagctacactcatgttttaaatttaacatgttttaaaaatgttattttggtggtttttgtttgtattttgtttttgatttttgactttggaaacaaaaccattatttgagagtggtgaagtttgtaaagtggtaggtgtcttggctgtatagattatagataaagtgatttagttgataaattagtatttgtaagctgactttttactggtaatgaatcaaaagtaaattgtgatcttgcttcagagtattttatgcatttttctcctcttcataatctgagcattatttaaacaattcatggcccaatacagcctatctggccctgatttaaactgagtacttctatgttgcaactctcaccagctgaaatgtctgggtgcatactgccagtaaaaacaaaccaaaaaaaaatctaactttatgctcctataactctaagatatatctccaatatcctttgcttaatataaatgattatttatcatgatctttttattcccagttcgttgatgtttttattgcttaaagtgtctatttgatagacaaatatcgaaaacaccagggtctgtatttaattctgttctatattagcaaaatcaaaggatacattcaggacatagattaaacttaaattggcaataggatgacctgatggtaattgtcgaaatgggattctaactctgtagtgtagctaagtgaaactatgaatttaaatatgctgttttaattattccagagcattccccatatggtccctcaccattgggttggccttcatctgaaacaagagcttttctctctcctccaactttgttggagggtccactcagactctcacctttgcttccagggggaggaggaagaggtatattgtttaaacatctttattactctagatttcttccttactttatattttcatctcaacttaccttaaaaatgatctgtaaaatatttggaaaatacaggcattccttgcacttactgtagataacttttatttggaaaaggagctctatgacatctaattttgatgtatttttctcttagaaaccgtgctatattagataacattttgatcaaggacttgatgtgtatctttttatttatttttctttttaattttaatttttattttttgagatggagtcttgctctttcacccaggctggagtgcagtggcgcgatcttggctcattgcaggctccacctcccaggttcacgccattctcctgcctcagcctcccgagtagctgggactacaggcgcccgccaccatgcccggctaatttttttttgtatttttagtagagacggggtttcaccatgttagccaggatggtctcgatctcctgacctcgtgatccaccctcctcggcctcccaaagtgctgggattacaggcgtgagccaccacgcctagcctgataacgtatctttttaaaccatatttttgacttcttaaaaactatatattacatgatataatataaaattttgtaagactgcatgaaatataataacagtataacctagcataaaaattatctatgtgtatgtatatatatgtaatttttttttttttttggagactgttttcactcttgttgctcaggctggaatgcagtggcgcgatctcggctcactgcaacctctgcctcccaggtagcttggattctcctgcctcagcctcctgagtagctgggattacaggcacatgccaccacacctggctaatttttttttgtatttttagtagaaaatacaaaaggttgttttgccacattggctggccaggctggtctcgaactcctgaccttaggtgatccacccgcctcagcctcccaaagtgctgggattacaagtgtgaaacaccataaaattatattttgatgaagcattagaatttggaattaaaaaaatttacattagtatcatgatctttttattgtagaaaattagaaagtgaaataatctttttatagactcaaggaaatcagtagtgctcttgtaggcagatttttgatgggaacctttactgtggtctgcatcatttgttaacacactgggggctgggcgtggtggctcatgcctgtaatcccagtattttgggaggccgacgggggcagatcatgaggtcaagagatcaagaccatcctggccaacatggtgaaaccctgtctctactaaaaatacagaaatcagctgggtgtggtggtgggcgcctgtagtcccagctacttgggaggctgaagcaggagaattgcttgaacccgggggacggagattgcagtgagccgagatagtgccactgcactccagcctggcaacagagcgagactccgtctcaaaaaaaaaaaaaaaaaaaagtacattgggaaaccaagccacaattgtctgctgttacccccttataggtacctcaggcctaatcattagctattctacatttatctcatcagcatcaccctggtgttacaaaaggccctagtacctttgaaaactcctgtgtacctggagttttccttttttgatctctcaccatactttctttgtcaagttcctttaaagttttatcttaatttgtggcgaaattcaaagatatagggccttatttatttcaaaatcaaaagtcttacattttcagttccaagtatgtgttttataagagctgatggcattcttcaccagtgaaacattcccaccctttgtatcagtgattttaacagattgaatttgagataggaacataaagtaatgaatctaaataaaaacaccaaattaaatccaacaaatcaaagttcatatactcagatgggtattactcatctaaatagtatctcaggaagtctgtgtacttgttagttgaagctgccattactccacatatttttggaactcttcctttggaattgctttcaaataatatgagaaaatcaacttactactgtatggtcatgagatattctccctttgcccatatcctgtttgtatcctctttctccaccctcattttgcttcacttagaactgttcctgtccacctcccagtccccccagtagattgggccacagcctggggtccctacagagcctctgcttgtgttgattttgaactggaagctcctagggaaagggactgccctatagactgatacttagagccttagggaggctttgcattgagcacttcaggaaagagactgattttgacattgacatgtctgctgcaagcttatgacttagttctctaagtccacccccacccctccattttttaccttggcttacactaagaaatgtattttgtatcatgtcatattgtacactaacataaacatgattgaaatataattgaaaccgctacatgaaatagtacttgccattacagttttgatgctttctattcaattttatcccgtttcattaatttaatcttaattagcattattttttaaacttcacacatcacaaatgagtaggagctagcagtctgaaaaaacagtgccctagaaataagggtataattggctaaactgcaaatatgagtcactggaaattgaattacataagtcaaggattgcttgtagtcaattgaatatttggaatgattaaaatttacatttgatttctcctcttctatttcctctcctatttaatttaaagatacagtgtgtttagattatctgcaagggtgttttaccatttgtttaaaaagctacagaagttctaggtaagttgtcatcgggtcttacagagttgatccgaactaaaagtttctatgatccaccaaaggaggatggagagtacctgttatttttccttacttttattatctttttaatttgaagtttggatgagtggtatatttgaataatactgagtacaagtaaaacaatttcttcttagagtaaattgtatgtaactgggtttgaatagaaaactttaaccattagaacttttaggtttgtaatattcactgggtagtcagttggcctgtagctttggtcttctggaagtaagcaatcaggaaggaaagcctctgaatgtctcctttaaatctctgtgcttcattccagatgaactcagcctaaatgacgacttgcacattttctgctttcccagccttcttcttctaatgagctaattattaggatgaagaagcgagaaggaaagatttggggaacttaatagaatgtatactaataaggaaaaatgatagtttacctcctgatgtaaaagccagttgatctgattctactaaagggagtagatggaaaatttgttttaaagattactatatattaaatgtgaatgcttatgctgatttgtacaagttaccaagaaaagttaaaattaattttgttctcttaaaggaggtactgaaatagagtaagcatttttgttagacttcttttttttttattttttttttttgagatagtctcactgtgttgcccaggctggagtgcagtggcacgatctcggttcactgcaaccccttcctctcaggttcaaatgattcttgttccttagcttcccgagtagctgggattacaggcacgtgccactgtacccagctaatttttgtattttcagtagagatggggtttcaccatgttggccaggctggtttcgaactcctcacctcaggtgatccgcccacctcggcctcccagagtgctaggattacaggcatgagccatcacgcctggctattttagttaggcttctattgaaaaaaaattgttcactgggtgcagtggcttacaactataatcctagtactttgggaggtcaaggtggtgggattgtttgagcccaggagttcaagaccagcctgggcaacatggcaaaaccctgtatctacaaaaaatacaacaattaacaaagcgtggtggcacatgcctgttgtcccagctacttgtaaggctgaggtgggagaattgcttgagcctaggaggcggaggttgcagtgagctgagaatcgcaccactgcactccagtctgggtaacagagtgagtgagaccttgtctcaaaaaaaaaaatgtttttaaagctgttccttgagaataataagcttttgttttctggacaatataattttgagaagaccccccttttccctctcaatgacagataaatgaggtattaatatattttattgaatgttaaatttttttttttttttttttgagatggagtctcgctctatcccccagactggtgtgcagtggcatgatcttggctcactgcaacctcctcctcctgagttcaagccattcttctgcctcagcctcctgagtagctgggactacaggcgcctgccaccatgcccggctaattttttgtatttttagtagagatggggtttcaccttgttagccaggatggtctcgatctcctgaccttgtgacccgcccgccttgacctcccaaagtgctgggattacaggtgtgagccaccgcgcctggccaaaatttttttatatttgtcttttccattttagttgaatatgggttttgttttttgtttttttttgagatggagtctcactctgtcacccaggctggagtgcagtggcacgatcttggctcactgcaacctccacctcctgagttcaagccattcttctgcctcagcctccctagtagctgggattacaggcacctgccaccatgcctggctaacttttgtacttttagtagagacagggtttcaccatgttggccaggcttgtctcaaattcctgatctcaggtggtccaccctcctcgacctcccaaagtgctgggattacaggcatgggccactgcgtccagccctgtatatgggtttttaattaaggtactatcttttctgtggtcgtaagaagggaactttaaaattactcctgtttgtaaatgtaaatatactagattttcttatccaaaagaatgttagctcatttaaagtgattatttcaacagtgctgttgtttttgaaactatcgttttagacttgtcttcagaacttatgaattcttcttttgaatgtgaatttgatatttagaaatcactaaaagccatctagtgccagtttatctgttgtacataatgttttaaatcaggctatttaaaatcattttggggcagaagtatttatcttttttatcttctcattgactcgtaacactattcagtgaatttgggcagaagtagagagtcatgttttaactttgagatgcagttttttacatggctcttaagttaaactgagtacatttccaaaagagtttttctgaaaaatactttagtagcaaaattagtagaatagatatagaactgctaagatgactgttttaaaggaatcatgctcatttggactattgatatattagtttaagcaacaaaatcatttatgctttttatttaatcatttattatattttatatttattttaaatattttatatttattttatattatattttttatttaatcagttcttataattactttataattatcctgttacatcaggcataggaatcatagcaatttactttctacactgttatttttcagactttgtatttataatttatgatttaaccactgattttatgtgtaaaacaagtatataagactttttaagatgaaacagatttgtatgtttttttttctttaattaggctcacgaggcccagggaatcctctggaccatcagattaccaatgaaagaggagaatcaagctgtgataggttaaccgatcctcatagggctccctctgacactgggtctctgtcacctccatgggaccaggaccgtaggatgatgtttcctccgccaggtatgtaaagacaatagttattatttctctttgaaaggcagctgggatgtggaatacacaggaatggaagaagggaggagtatatgtttgttctctcttaagaaaaatcatcgtacatttttgaaaacaacaatgataaataatctaaacagaatgatttgagataattgttcatattatagaaagctgttttctccctaaatggaatgtttttattgtttttgttgcttgtagaggtaataatgcatgtttactttagaaaatccaaacaacacagaaatgtgtaaagaagtgaaaaatcccttttgtcatcttagcgtgtccttcccagaatttagttgtaggtatatatcttttagagatttttttgggtatacatttatacacatagctgttcaaattcttttaatcactctgtgcagttgtaccattcatcctcttttgtaattgtcttttttcactgaccattttatctcaccaaaataaatatatttaccagaagagtcacagcagaatatcttgaaataagataataactgccattcaacagctgcatcatctacattaggtgtttctcctaatgctatcctcccctggccccccacccccagagaggccccggtgtgtgatgttcccctccctgtgcccatatgttctcattattcaactcccacttatgagtgagaacatgcggtgtttggttttctgttcctgtgttagtttgctgagaatgatggtttccagcttcatccatgtaccttgcaaaggacatgaactcattcttttttatggctgcctagtattccatggtgtgtatgtgccacattttctttatgcagtctgacattgatgggcatttgggttggttccaagtctttactatcatgaacagtgccgcaataaatatacatgtgcatgtgtctttatagtagaatgatttataatcctttgggtatatacccagtaatgggatggctgggtcaaatggtatttctagttctagatgcttgaggaatcgccacactgtcttccacaatggttgaactaacttacactcccactaacagtgtaaagcgttcctatttcttcacatcctctgcagcatctgtagtttcctgactttttaatgatcaccattctgactggcgtgagatggtatctcattgtggttttgatttgcatttctctaatgaccagtgatggtgagctttttttcatatgtttgttggctgcataaatgtcttcttttgagaagtgtctgttcatatccttcgcccactttttgttggggttgtttgcttttttcttgtaaatttaagttgcttgtagattgtggatattagccctttgtcagatggatagattgcaaaaattttctcccattctgtaggttgcctgttcactctgatggtagtttcttttgctgtgcagaagctcttcagtttaattatatctcatgtgtcaattttggcttttgttgccattgcttttgttgttttagtcatgaagtctttgcctatgcctgtgtcctgaatggtattgcctaggttttcttgtagggtttttatggttttagttcttatatttaaatccttaatccatcttgagttgatttttgtataaggtgcagggaaggggtccagtttcagttctctgcataaggctagccatttttccgaacgcaatttattaaatagggaatcctttccccattggttgtttttgtcaggtttgtcaaagatcagttggttgtagatgtgttgtgttatttctgaggcctctgttttgttccattgttctatatgtctgtttttgtaccagtaccatgctgttttggctactgtagccttgtagtatagcttgaagtcaggtggtgtgatgtctccagctttgtattttttgcttaggattgtcttggatatatgggcttttttttgcttctatatgaaatttaaagtagttttttctaattctttgaagaaagtcagtggtagcttgatgggaatagcattgaatctataaattactttgggtagtatggccattttcacgatattgattcttcatatccatgagcatggaatgtttcttcttttgtttgtgtcctctcttatttccttgagcagtggtttgtagttctccttgaagaggtccttcacatcccttgtaagttgtattcctagatattttattctctttgtagtaattgcgaatgggagtttggtcatgatttggctctctgttattggtatataggaatgcttgtgatttttgcacattgattttgtatcctgagactttgctgaagttgcttattagcttaaggagtgtttgggctgagatgatggggttttctaaatatacaatcatgtcatctgcaaacagagacaacttgacttcctctcttcctatatgaataccctttatttatttctcttgcctgattgccctggccagaacttccaatactatgttgaataggggtggtgagagagggcatccttgtcttgtgctggttttcaaagggaattcttccagcttttgcccattcagtatgatattgcctgtgagtttgtcataaatagctcttattattttgagatatgttccatcactacctagtttattgagtttttttttttttttttagcatgaaggggtgttggattttatcaaaggccttttctgcatctattgagataatcatgtggtttttgtcattggttctgtttatgtgatgaattacgtttactaatttgcatatgttgaaccagccttgcatcccagggatgaagccaacttgatcgtggtgggtaagctttttaatgtgctgcttgatttggtttgccagtattttattgaggatttttgcatcaatgttcatcagagatattggcctgaaattttctttttttgttgtgtctctgccaggttttggtatcaggatgatgctgacctcataaaatgagctagggaggattccctctttttctgttgattggaatagtttcagaaggaatggtaccagctcctccttgtacctctggtagaatttggctgtgaatccatctggtcctggacttttttggttggtaggctattaattactacgtcaatttcagaacttgttactgatctattcaggaatttgacttcttcctggtttagtcttgtgagggtgtgtgtgtccaggaatttatccatttcttctagattttctagtttgttcacatggagttctttatagtattctctgatggtagtttgtatttctgtgggatcagtggtgatatcccctttatcatttttccttgcatctatttgattcttctctcttttcttccttattagtctggctagtggtctatttattttgttaatcttttcagaacaccagctcatggattttttgaagggttttttgtgtctttatctccttcagttctgccctcatcttagttatttcttgtcttctgctagatttttactttgtttgctcttacttctgtagttcttttaattgtgatgtttgggtgttgattttagatttttcccgcttgatctcctgtgggtattttagtgctgtaaatttccctctaaacactgctttagctgtgtcccagagattctggtatgttgtgtctttgttctcattggtttcaaataacttatttatttctgccttaattttgttatttacctagtagtcattcaggagcaggttgttcagtttccatgtagctgtgcggttttgagtgaatttcttaatcctgagttctaatttgattgcactgtggtgtgagggactgttatgatttccatccttttgcatttgctgaggagtgatttacttccaattatgtggttgattttagaataagtgctatgtggcactgagaaaaatgtatattttgttgatttggggtggagagttctgtagttgtctgttaggtccgcttggtccagagctgaattcaagtcctgaatattgttaattttctgtctcgttgatctgtctaatattgacagtggggtgtcaaagtctcccactattattgtgtgggagtctaagtctctttgtaggtctctaagaacttgctttatgaatctgcatgctcatgtattgggtgcatatataattagggtagttagctcttggtgttgcattgatccctttaccattatgtaatgcccttctttgactttttgatctttgttggtttcaagtcttttttatcagagactaggattacaaccctgcttttttttgctttccatttgcttggtaaatcttcctccatccctttattttgagcctatgtgtgtctatgcacatgagatgggtctcctgaatacagtacaccgatgggtcttgactctttatccaatttgccattctctgtcttttaattggggcatttagcccatttacatttaaggttaatattgttatgtgtgaatttgatcctgttattatgatgctagctggttattttgcccattagttgatgcagtttcttcatcacgttgatggtcttttacgttttgttgtgtttttgcagtggctggtagcggtttttcccttccatatttagtgcttccttcaggagcccttgtaaggcaggcctggtggagccaaaatccctaagcatttgcttttctgtaaaggattttatttttcctttacttataaagcttagtttggctggatatgaaattctgggttgaaaattctttaagaatattgcatattggcccccattctcttctggcttgtagggtttctgcagagagatccgctgttagtctgatgggcttccctttgtggttaacctgacctttctctctggctgcccttaacgttttttccttcatttcaatgttgctgaatctgacgattatgtatcttggggttgttcttctagaagagtgtctttgtatttcgtgaatttgaatgttggcctatcttgctaggttggggaagttctcctggctaatatcctgaagagagttttccaacttgattccattctcccgatcactttcaggtacaccaatcaaatataggtttggtcttttcacatagtcccatatttcttggaggctttgttcattccattttattcttgtttctctaatcttgtcttcacgctttattttagtaagttagtgttcaatctctgatatcctttcttccgactgatcaatttggctatattgatacttgtgtatgcttcatgaagttctcgtgttgtgttttttggctgcatcaggtcatttatgttcttctcgaaattggtttttccagtttgcaattcctctaaccttttatcaatgttcttagcttccttgcattaggttagaatatgctcctttagcttggcggagtttattactcaccttctgaagcctacttctgtccatttgtcgaactcattgtctgtccagttttgttcccttgctgccaaggagttgtgatcctttgaaagacgaggcatcctggtttttggaatttttagcctttttgcctggtttttcctcatcttcctggatttatttaccattggtctttgctgttgatgaccttcggatggagtttttgcttggtccttcacggcacagtccctcatggcttctcttggctaggggaggaaatttcctgaacgcttgtgcttcccaggtgaggtgacgcccaccctgcttctgcttgcagtccgtggactgcacccgctctctaaccagtcccagtgagatgaaccaggtacctcagttggaaatgaagacatcacccgccttctgctttggcctcactgggagctgaagaccggagctgttcctatttcgacgtcttgcctgggaatcaacaatttcttgtgatctatcttcaggtttactgactctttccttgtcatctccattctgttattaagcttatctagtaaaagttttattttagatatatttttcaggtctaaaattaccatttggttcctttttataatttgatttatctgctgagttttttatctttttattcattataagcattttttttaaaccattgagtatattagttttataataactgctttaaagtcattgtatggtaattctaacatcagggtcatcttgaggttggcctctagtgatgatattttcccttaaggatgggtcacattctctttcttgatgagtttgtattggatactagacattgtggcaattctggattctattctattcctctaagagtgttactggtcttgctgtagaagaccattaacttggatgggctcagactgcagccttttcccttctgtggtggggaacagctcaaatattagttcagttatttttgccttagctgaaaactgcttaaatttgccatacacatgtgttgctctggagtcagccatagacttgggcagagattgtacccagaatattgggctctacctttgcggctttctcctttctaggatatcccaatcccattgcctcaggcttgggctctgtgtacttgttcttcaggcaagaaagttttatcgagttttgactgctgtgtgctgcaactcactgtggtcttctatcaggctaaaacataaaaatggaaaactcaccccatacccggttgttactcctttcttcttccaagctctctcttcttttctaagtcctcctgcttttgttgatgcttaagcgcttcaggcagttatttttttgcatattgtctggagtttatacttatgtgtaggagagtcagtctgaatttactctaccatactagaaatggaacctggtctccgtacttttcaatcatttgtgagcttctaaattgataccttcatagaagagatatggtccattctacagagtatctccaaataatgaacctgatccctgtggtttgacagagggccaacctgtgtcaactataatctcaatgtcatagacaagggtaattctacagacacagtaaaggaattttcagtattgttccaaaatttatgatgagtgagaagggctaaatgactcctgaggctctagcatgaattagagtaatgctgataaatgtatttctcagttagcttcattcctacctaaagttaaaaaatattctatgtttgctcttggtatattggtacatgccatttaaatagtcactgaacaggccgggtgtggtggctcatgcctgtgatcccagcactttgggaggccaaggcaggtggatcacctgaggccaggagttcaagaccagcctggctaacatggcaaaaccctgttcctacaaaaaatacaaaaattagctgggtgtggtggcaggcgcctgtaatctcagctactcgggaggctgaggcaggagaattgcttgaacctgggagacagaggttgcagtgagccgagattgcgccactgcactctagtctggcaacagagagagactctctcaaaaaaaaaataaaaaaatggtcactgaacagatttcagggttcttttcttttatgttgtgtttcagttaacgaaatgataatgaatgaggggacttaggctttttttttttgaagtggagtttcacctttgtcatccaggctggggtgcaatggtgccatctcagctcactgcaacctctgcctcccgggttcaagcgattctcctgcctcatcctcccgagtacccgggattacagggcatgtgccaccatgcccagctaatatttgtatttttagtagagacggggtttcaccatgttggccaggcttgtctcgaactcctgacctcaggtgatccacctgccttggcctcccaaagtgctgtgattacaggtgtgagccaccacacctggcctaggctttttaaaccttatcattgctattacttttttgtgtaaccttgagcaataaattttacctgtcatggttttctctctttcaaaatatggtcttctggctgggtgcagtggctcatgcctgtaatcctagcactttgggaggatgaggtaggaggattgcttgaggccaggagttctggagcaagctggccaaaatagtgagattctgtctccacaaaaaaacaaacaaaatagtgacttctgtaaaacagagatggtgatattctaaagtaatctgcctctcttttatgtaaggttgacttattgggactcatgaagagtccttctcactaataattgtctttaagatttttcttaaattttaaaatattttagtttaaaatacttatgttaaaaaaatatgacaactaaaataactaagtttctgaagaatatggattctgcatttgagattatctgtcatttagtctgttaggcataatttataaaatgtatatattttcttaacatgtttctacttggaagaagtgttttagatttccattgacttaagatgagttagcagaaatgattttaaatagttccatatttacaaggaatcatttatttttgcaccgttaaatactttgaaaaaggagaaaactttacttagcttatatagtcagaaaaaactgctctaacttatctcttttctcatatgccctattccagacattcttttaaaaaatattttaataatgttatcttttatttgagattcacagggtacatgtgcaggtttgttacatgggtatattgcatgatactgaagtttggggcgtgactgaattcatcacccagaaagtgagcatagtacccacagtttttcagcccttgcctccctttgtctctcctcgctctactctggtagtccccagtgtctcttgttatcatctttatatccatgtgtacccagtgtttagctaccacttacaagtaagaatgtgttagttttatatttctgcattaattcacttaggataatggcttccagctgcatccatgttgttgcaaaggacataattttattctttcttatggctgtgtagtattctatggtgtatatgtactgcattttctttatccagtccaccgttggtgggtatctgggttgatttcatgtctttgctgttgtgaatagtgttacgataaacatgagtgcttgtgccttttttgtagaacgacttagtttcttttggatatatacccagtaatgggattgctgggtcaaatggtagttctgttttaagttctttgagaaatcttcaaactgatttccacagtggcctaataatttacattccctccaacagtgtataagcattcccttttctctacaaccttggcaacatctgttattttgactttttaatagtagccattctgactagtgtgaggtggaatctcattgtggttttgatccaaacattcttattacttaaaggttttattagcaagtatacacctagtttcttcaagtaatcaacactttattctcattattttcagtagcagactcaatcttataaactaataaggattttaaaacttttaagttttcttttaaaactctgtggttattaaaggttagtacacaaatttggctaccttattaggaaagagctaattctgctgaagcatagtatgtgtacaaagttttgtacagtgttgaacagtctacaatgtatctgttcatctaacattcttatatgtgcttttaattagtttgcatgtttagaacaagactggcttaggtgaaaaagcatttggactggaaatcaagaaatttgctttctggttttcactcctttatcttttagtgtgattttaaaaatttattaaaaaatttttttagagacaggttctcactttgtcacccagctagagtgctgtggtgtgattatagctcactgtagccttgaactcctgatctcaagcaatcctcccctctcagcctcccaagtaactgggactgtaagcacatgccacaatgcctgggtaatttttattttattttaaattgtttttggagacaggtttttgctgtgttacccagtctggtgtcaaactcttggcctcaggtggtcctccctcctcagcctcctgaatagtgggggattacaggcacgagccatcgtgcctggcttttagtgtgatttttaaaacttgtttcatttctttggaccttatatattatatagtgacataaccatataactccataagaaactcattcgaatataatagtataagtaggtggaaagtaaaaggatagaaaagatacaccatgcaaacattaatcgaaagaaaatgaggtcaagaagatatagcaaatgttaaatgtgtgtatgccaacagcagctacaaagtatgggaaacaaaaactgatagcactgagaggaacaaagacaaatccagttataattggagacttcaacacccctctctcggcaattgatggaacaactgaagagaaaattcagcaagtatatagaagaactgaacagtgccctcaaccaacaagacctaactgacatttatagaacaagttacccaacagcagcagaatacacgtgtttttaaagtagcagtggaacattttacaagacagattgtatcctgggccataaaacaaacctcaacacatttaaaagaagtgaaataatatacagtatgttctttgatcacaatggaatcaaactataaataataaactattgatacatgcaacaatttggatgtatctcaatggttgagtgaagaaaaccagtctcaaaagtttacatactgtgttattccatgtatataacattcttttttttttcgagatggagtctcactctgtcacccaggctggagtgctgtggtgtaatctcggctcactgcaacctctgcctcctgggttcaaactgtccttcagcctcagcctcctgagtagctgggacttcaggcacacaccaccatgcccggccaggctaattttaaaatttttagtagagacagggttttgccattttagccaggctggtctcgaacttctgacctcaagtgatccacccacctcggcctcccaaagtgctgggattacaggcgtgagccactgtgcccggccatatataacattcttgaaatgacggtatagaaacagaaaacagattggtggattcaagagtttgagacagtagtggggaggggagtgggtatgactgtaaaggggtggcacgagggaggtgtttttggtggcacaataattctgtatcttgagagtggtagtgattacataaatctacatatgctgtaaaatgtcatagaactagacacgagttgtaccaatgtcagttttctggctgttacaatacactatagttatgaaagacgtaaacattgagtaaagggtgtgcaggatctctctgtagtatttttgcatctttctgtgaatctattttaaaataaaaaagtaaaaatcttattgtatatcatacacatacagggaagtacaaatattaagcatataatgtgattttttttcacaatttgagcacagtgatataactaacactcagataaagggatagttttcagtttggtttttcataagtttaattagaaaacttatttataattttagcagaaaaaatgttcttgaataatgtaagtgagttgataatattcacatatcatatagtaatcacaattaaaattttaacagaaatatgtcctgggaataaccagttcattataaattctttataaatactaacctgcaacaaaaatttatcaatgtgacttaccttgctcagcgcttcagttgttaagaaaaaacacaaaagtgttttcatatttagaatgagaacattacagatcaaagagacttggtaagaaagtagtttaaattgtccatgtaattcttttgccagggttaactgtaacaaaggtgattctcataaaaactttcaagttgtatgtgttggcttgttttgtcttcacttttagaaatgaaagtgaggtatcataatttattaagtagataatgtcactatcctgtagatcagcagtccctaacctttttggcatcagggactggtttcatggagcccagtttttccatggaggttgcagggaggaggatggtttcgggatgaaagtgttcacttcagatcatcaggcattagttagattctcataaggaatgcacaggctagatccctcacatgcgcagttcacagtagggtttgcgcttctatgagaatagaatgcctcagctgacaggaggtggagcttaggtggtaatgctcgcttgccctcctcacctcctgctgtgcaaacagttcctaacagcccgcggaaaggtactggcccgcagcccaggggttagggacccctgctgtagatgactacatacatttatttatttatttccctgtcttatggtgctgattgataactacttctactgtagctcaggttgggatatatagtttgaaaattgttggcatatatttagatagagagatacagtgggttagtagctttcacaaggagaaggaattaaaatgttaactctatattttttgttctaaatatatttttaggatctatgtgctatagtttgtttcatttttacaagaatttctactgaacatcttattcaagatgttgggataaaagataaattattaaaaaggtgtagttatgtatttcaatgatgagttaatataatgaaatgaatgtaatactgaaacagatctttttctacaacagctctgtccaatagagctttctgtaataatagaaatgttttatatctatactgtccagtacagtagccactaggcacatgtggctagtaaatacctaatgtgtctagtacaacttgagaaacagaatttttaatcttattgaattttgtcagttaaaatttatttaattttctttattattttgttttgttttgagacagaatctcactctgtcatccaggctggagtgcagtggcatgaacacagcttactacagcctcgacctcctgggcccaagtgatcctcctgctttagcctcccaagtggctgggactataggcatgcaccactaatgcctaatttttaaattttctgtagagacggggcctcactatgttgcccaggcaggtttcgaaatccttggctcaagcaatcctcccaccttggcctcccaaagtgctgggattacagacgtgagccaccacgccctccttcgtacccttttgagctttagtattcctagttttcattgtttaaaagaacaaggagtgtgtatgtggtttctccttatttttgttggtgcttatcttttactgatttggataatatattttatgtaagcatagcaaagagactaagcaaccataccttggtggtgtaatcatgagttaagtgtggttgctagcctggcatgtttaaaaactctttttcttaaagagctgaacaaataagagacatatagtgtacagctaaattgatgagaacagttttgactctttccttgggaaacaaaagtgtgctaagcagatcaaaataccttggatagctttgaatgcataggcgtagatttttacttcactgactctgattcatagacatttatgctgaccattgtcctacattctgaacagttttttcagacaagactgatttagtagaattatagtttgtcttaaggctcattttgatctctttgatgaaaacttgtggtcttcccaaacttaataaggtgttctgaagtcgtggtatatatgcttttatcctctcagaggatgatatttacttaaagttgttcctaaattttaggctaccagttttttaggaatatatatatcttaatcacttatgtcttatataatgatcctttataaattctaatgattattcagttgataaattgccactgtatgtgtttttataaactttaaaaatctgtgtttaatttgtcagtcttcctgaagagactaggttgtggagagattaagatacagggacaaatgtaaacaactttttgaaaaatttcactttgaatgaaaaagagatggtagctggagggagaggtgttttggtttttaaagatggataatattggctgggcatggtggcttacgcttgtaattccagcactttgggaagctgaggcgggcagatcacctgaggtcagaagttcaagaccaacctggccaacatggtgaaactccgtctctactaaaaatacaaaaattagccgggtgtggtggcacgcgcctgtagtcccagctgctcgggaggctgaggcaggagaattgcttgaccctgggagggagagcttacagtgagctgagaccgcaccgttgcactccagcctgggcaacagagtgagactccctctcaaaaataaataaataaataaatgaataaataaataaataaatgatggataatataacatatttatttgctgatgggaataattcaggctagaaggggaaattaatgatgtttggagaaggtctggttataaaagtgaaaccctggaatattaagcacaaaagatgctatccagagtgtaattgcagaaattgtggtagctgggtcaatttatccattctaaaaagaaggaaggcagagcaagtgagtacagatgtagctgttgggtggagggtaagtggaggtgtccagttgtttcaattttcttgttgtggcaagatcatcagctgaagcaggtggtagaggagaggactgtcagatctgaagagaaaaaaaggtatgcagtagctatttaggagagtggaagaactcaaacattagtaaagtgtagtatgattatagggcattgttgagcatcagtttgaaatttatggtcataaatttgaatgaaaagcagtcaatactatatttttaatatagtttataatcataacaagcttaatttatcatcagatattgataaagctgtatatagaatgtatttgtgtcagactaaatgccttttattaatcattctaacactcttaagagtgttattctgttattcccattttacagatgaagaaacaaaaccacagaaaggttgggtaacttggtgaacaacacaaattgagatttaaaaaaaaaattttattatactctaagttttagggttcatgtgcacaacgtgcaggtttgttacatatgtatacatgtgccatgttggtgtgctacacccattaactagtcatttagcattaggtatctctcctaatgctatccctcccccctccccacaacagtccccggtgtgtgatgttccccttcctgtgtccatgtgttctcattgttcaattcccacctatgagtgagaacatgcagtgtttggttttttgtccttgcgatagtttgctgagaatgatggtttccagcttcatccatgtccctacaaaggacatgaactcatcattttttatggctgcatagtattccatggtgtatatgtgccacattttcttaatccagtctatcgttgttggacatttgggttggttccaagtctttgctattgtgaatagtgcctcaataaacatatgtgtgcatgtgtctttatagcagcatgatttataatcctttgggtatatacccagtaatgggatggctggatcaaatggtagttctagttctagatccctgaggaattgccacactgacttccacaatggttgaaacaaattgagatattatagcacaatcctggatatcacccttgagaatttacatattaatatttgcttcagatatatatgtgtttgtgtgcgtaaatgtgtaaataagacataaaaagaaaaagcacactatttacatgaattgaacactattgcatttcctttcctgggcatattaccttcctctcctagaagcagctattcatgagtttagcgtgtgtaaactttcagttctaataatgattaaaaaaaattaaagttctgttttatcagctttccttatcagccttacctacttgaattctttccatgttagtatatagagagtttatcaccttaattgtggtatggtatttcagtgtataagaaaccacaaaatgtttaaccatttcctgttggtgagcatttagagtgtctccaatatctcaccattactaacagtgctgcagctagcaccctttttgtacatatgttctttcaagattgtccaggaattggaattcctaggtaatagggtatgcacacttttgatcttattttcaatttttatttttttgggacaggatcttgctttgtcgctcaggctggggtgcagtggcgtgatcttggctgactgcaacctccgcctcctgggttcaagcgattcttgtgtctcagcctcccgagtagctgggatcgcaggcctgtgccaccacacctggctaatttttttgtgttttcagtagagatgggatttcaccatgttggccaggccgatcttgaactcttggcctcaagcagtccacctgccttggcctctcaaagtgctgggattacaggcatgagccaccatgcccggcctgtttttggttttaatagatatctccccatcgccctcaacagaagctgtgaatgaagtatatgagagtagctgatttctgcagtataattcttagtttgcaaaactgctttagaatgcccagtacacttattcccactccttattcatttttttcttatctttttttcttccattctttctttctaatcatgtcttctattataagcgtagaatactattatagaaaacaaaagtttgaaagcaaaaaagaaagggacctttcatgtccttactttctgtagttcagttcagtctttaattggtcatatgctttccacatagctgtatcttattatgtgtatatgtgtatgtgtatatgtgcatatgagggtgtgtgtatatgtgtgtatgtatgtgtgtatatgtatatgtgcatttgaccagaatacccttgattacttgttcatctttacttttctttcagggcaagctttactgcctctgactccatttctgattcctgcaatcagaaatagatagtctacctcttatattatgtatatttccttttattaagacattaatcacatggtgtttatgtgtttctatcagaattagactgtaaggacatggggtttatcaaggccaacattgtattgtttgtgcctgacacatactaggccttggtaagatttaaggaatgaattgcttttgccagtggagggcaacatagccatgtagtttataaagtagtaaatttataacaaaatttttttatttctgaggttgttgatgtgtggggatataatttagaagcaaaataatgatgtagtatctggagacctgattaaaaaagagttggtgttcaggtttccttattttatccccttgtccaactccaccatttaattaatcctttgtttgaagtagaaagggaaaactgagtttagatctcagtgattggtattgaccttttctttcattaggctaactcaaaccctttgaaacagctcctccctaggattttgaaagggagtgtaaatgagccttcaaactatttgtatctttctctcctcagtcacatctcccgaccattgggagctcattaaatataattctctttattgactctcgttgatgccaggtggtctctctggttttgtgtaggagagatgatgtgtcaataaggtcccctgtggcagagtcagatgaggagtgatatatccaacactgattctataaagtcaattagaggcaatttggggttgtttacgtatatctgtaataggataggggaaagttacacaattcaccttctttgtcgttctccttatttttggagttggacatatgcatgcctaatctagcagtctgacatcacctttcaagaatgagaaactacctatactttttcaagagtgatgagttccacaaggacccaggaattattaaaccgcaattacttttgcaccaacctaataccatattgtcatcataaatcacccctggggacaaagggtggctgtagaagcacttgagatagttggtgtccaaatttgtgtctctccagatgttcttcgtttcagcagtggtactcatctgttgagtcagagagagctttccatttagtttgttttttatttattttcatttatttatttatttattttgagatagagtcttgctctgtcacccaggttggagtgcagtggcatgatctcggctcactgcaacctctgccccactgggttcaggtgattcttctgcctcagtctcccgagtagctgggattacagactaccatgcctggctaatttttatatttttagtagagacagggtttcaccatgttggccaggctggtctggaactcccgaccttaggtgatccacccgcttcggcctctcaaagtgctggtattacaggtgtgagccaccatacccgtctctttccatttggtttggaatagatactaaattccaaaacgtcaatattactgaaagtttgacaatgatgacatctgaatgatactctttctgctttgatgacaaattatcacctgttctggtaaatttcttgctgtgcttacgttttttctctttactttttccttatgttagtagatgtttcctgggtcttttttgatacattgatgtatttacttccatccattattaaaatggaaagttaatttacatatatataaaactaaattctgttttcacatattctaatttacacatagtaattgaaattttcaaaatccaaagtagcagattatgcttgtgtttactataaaggttattgcctatagtaaaatatgcaattcttctgaaattgtctactgttgtcaaccaagaagatgatgagtttaagtgttagaatacaggtcaaaagtgtaagttcaatacgttaaacttaagtaaacttgatttatatttacattaatgaagacattttaaaaacttattttctaggacaatcatatcctgattcagcccttcctccacaaaggcaagacagattttgttctaattctggtagactgtctggaccagcagaactcagaagttttaatatgccttctttggataaaatgggtaagaagtactttgtgcttttcttctttaaaaattttggtggcacactaaagaactggaagttagaataaagaccaatataattgctatctctagtagttcctaaggccaaaatctctttcctgaaaatgtcctggttttatgtttcttgttatattgtacacagacatggcatccaaatatatgttggtgggttggtttgagcaccatggaaataggtttactccatatacctatgatgataaattttactctgttctatgactaattttctaatttttctagtccacttacatgtgttctgtttagtaatcagggaaataagccaggcaaatgtgaatggatacataaaaacccaccagaaaacaatttagatgcatgctctgttgatattgtaatcagttatattaaacatttcatgcttagatataactaacatgtactgagcaatctactatttgtcaggctgtcttttacttaaactacctcatagcaacccattaaagttgggaaatagatgtatgcagtgtatcaaccagaagtacacaacgttaagaaaataaaaattttttttaaagtcaagatttaaatgtattggtaaaaggtttcctcaggaaaggacatatatttatatattattaaatatatataataaataatgttatatatataattttaaaaatattgattttctgacatagtagactatataatatagctgggactacaggtgtgcaccaccacacatggctaattttttgtaaagatgaggtttcgacatgttgttgaggctggtcttgaactcctgggctcaagcaatccacctgccttggtctcccaaagtgctgggattacaagcatgagacaccttgctcagcctggaaagtcagtattttattttatttattttttaattattatttttgagacagagtctctgttgcccagactggagtgcagtggctccatctcggctccactgcaacctccgcctcctgggttaaagagaaacccaggaggtttcacttgtgtcaagcacaagtgaaaaatgaccagtaagacaaggacatttataactggctgaagtcatggactttggagtctagttagttggggaaggaagtgagggaggaaactcagtggtcagaagcatcagtgacttccaaggacagatgtagtgagaataaatgagaaagctacaagaggagaggtagttgtggtcagagaggattgcatttcttgatgataacaaagttcgggaacatttatttcggaacagtagctaaatttcagtagctagtctctcttacttaatggaggaataaggacggaaggaagaagaggaggaaggagaagaggataggaggcaaacataaaaggagggaggaggaaaagaaggaaggagggagatgcttcctcccagatgtcttcttagcattctgctccagcaggattgcttaggaactagccagagaaataattgccacatgccatcatagaactctgagtctgccagaatttctagggacctcaagctgttcttgtggccgcaatataggatattggtgtccagctggcttatgtgccaacaaggggagtgggaaaataccaattttgtgatctggagatactctaggaataaagtgataaatcatgtacttttcatggtttaacttttatgtctagatgggtcaatgccttcagaaatggaatccagtagaaatgataccaaagatgatcttggtgtaagtattgaaagagtggaattgtatgcatgtattcagaagccttctttttttttttttttttttttttatggagtttcactattgttgcccaagctggagtgcagtggcgctatctcggctcactgcaacctgggttcaagcaattctcctgcctcagcctcctgagtagctgggactacaggcgtgtgccaccacacccagctaatttttgtatatttagtagagacggagtttcaccctgttggcgaggctggtcttgaagtcctgacctcagatgatccactcgccttggcctcccaaagtgctggtattacaggtgtgagctgctgcgcctggccctgagccactgtgcctggcctgtgccttctaatctcatgctttactagaatagaaatatagctaataatctaggttttgatataaagctgattttctctttttgattaatatactttctacttagcgtgaaagctgtttcttttgtagatggtaacctatggtgataaaatacaatttgcagactaggagtttgagttagtttaagattttagttccctccccatccttggatttttatttgaatattttaaagtatatttttgtttattaagatattgatttttggaaaatataaacatagacattttgctttttctttttttccagtatatatttgatacaatagtatatattttagtgctcttgggttaaatttctgttttatctttagccagactgttactttgttggttaaagctgttttctgttgacttaataaaatatttatgataactaaaatgtgatagctgatacattactgtggaaagctgtttgaatctttctctagagctttctaagactatcatggaatgctttctgtctagatgatttcttctaagcctgagattttcgggaaaatgattgcaaatttactgttttagtgactgccatatgtcaatttgttgtagaatttaaatgtgcctgattcatctctccctgctgaaaatgaagccactggccctggctttgttcctccacctcttgctccaatcagaggtccattgtttccagtggatgcaagaggcccattcttgagaagaggacctcctttccccccacctcctccaggagccatgtttggagcttctcgagattattttccaccaggggatttcccaggtccaccacctgctccatttgcaagtatgcttttttaaactttttttttaaagctcaatatgtggtttattaatcggagatttaattttactatctgttaatgtagtaacacagtggaggaaagttttttctagcattctgtgaatctgaaaattctcattacttttccgaattgggaaggcagccagccataagtggactgcaatgaggtttcagcttgattcatcttaataatatagaattatttctgtattttggcagtcaagaaaataatggactttttgcaggtcttacgataaaactaaaattatctgtaccttatttggtagcaactggttattctgacagttagtgaaaataataacttatattctagcattaaaattactggctaagatattttttaaagtctttttcataagtagttctgatgcagtcctacttatttaaaacttaaaatgtatttattacgtttgaccgaatttttggatttattgaattcttttaaagcttcacataagaaaaagggaataatatgttgcttttatattcatactttactgttttgaactatagggttctgcagaataaatatgtggttaccaaatactaggctttgcctatgaatgtctcatatagtctttccttcccttgtttctcttctctttttaaagttaaaggtgaattaaaatgaattttgtttggggaaattttaaggtggcctttgatattactggaaatgttttagtataatatcaaattagaattgggaatcactaatacgaattttaagtttgttgaaaattatattacatgcagatgttttttgaggactttgataatgaaagaaaaaagtgatttacagtaagttttatatattttgaaataattcctcttttttaaaaaacaggtgttaagataggacaaaaattacataaaaattaatgatatttcctttaatcatctgtatttgaagaggtacgtttttctcaatgtaaaaattaatttgttagatcaagtaattatctagtgtcaattttcaaataaaagaataggtaatggaagttataaacttaatgatttattagggcacagtacaggttcttaaagttaaaaaatgtcttttaccaatctctttgaacagtgagaaatgtctatccaccgaggggttttcctccttaccttcccccaagacctggatttttccccccacccccacattctgaaggtagaagtgagttcccctcaggtttgattccaccttcaaatgagcctgctactgaacatccagaaccacagcaagaaacctgacaatatttttgctctcttcaaaagtaattttgactgatctcattttcagtttaagtaactgctgttacttaagtgattacacttttgctcaaattgaagcttaatggaattataattctcaggatagtattttgtaaataaagatgatttaaatatgaatcttatgagtaaattatttcaattttattttagacggtataactatttcaatttgattaatccactattatataaacaatagtgggagttttatatatgtaatctttcaggtggggaggctttaaattctgaagtctgtgtctttatgccaagaactgtatttactgtggttgtggacaaatgtgaaagtaactttatgcttaaataaattatagttgatttaaagatttgtttggcattgataataataaaatcagtagtttttctataactatggctctattaacttttttccttttaccaataactttgaggtgcaaaactcaaacttatgtgggtcttttgtgttcaattatgttatgacaaatgtgctctctttcttgtaaatagacatgagtggcccaaagcaacaaattaatacacttttaaaagtcaaaattgattatattttaaagataaccaggatattatctaatggtgaattgtagaattttgatcttcttattcactgagtttcttgcacggtttctttattgcttttttttccccgcctgttcttttgtaaggtatttactattttctgtggaggatattgagatgtactacaggataactgtagtgaatgatgtgtcatcattttgagctttggactcaatatctttagtgtttccctaaatcagatttgtaggtcatgttaagcttcttgcacattaatatgattatggaaggaaaggcagtgaagcataactaataaacatcataatacttaa

SEQ ID NO: 1186 - DNA, 275830 bp, Homo sapiens
tccatttaaaaatcattttattattaacatcatcttcccatgtagccaagtgtctgtcatgtataaggaatgtcggtaaatattccatttgaagcttctttgtacatatttccctcgataaataaactctgaattcacataaaaaagttaaacttaaataactcatatttccttctcttgtaacaggcatatattggtaaaatataaatattctcggactcaggctttgttctaagtgaggacagtaattgatcacatggtacaattattgacagtaaaaccaagaaattgtcagctggtgtcctggcatggactagtgctgaggtgggagacaggaagttcacatttggtttctgggccaaagtggggcaggaggggtggtggggagaaaaggacagttgttttctttacagctctgataaaaataatctgtgctgccactgaattttaactttgaatatattcttctacatttgctgattaattccataatcattttactgaaaactcagatgtcaactaacaaaatatggcacatgatccattttgaacaatgtcaataggttcagaaactaccattgggctggcaaaaaaaacaagagaaacgcacatggcgagagcgatgattcggggttggtttggttggttcactgtggcccactgaacactcgtccctggcctcagtgtggcagattcatccccttggggcgatggcacaagccctggtgcccggcagggcctctgaggcctgagcggcaggtgaggctggcaggcgcctgctcagagcacgcgggggatgatggtgaagggcacggcggggctgctggcctccagctccaaggctgtcaggaagcactccgtagccgccgcatcgttgccctgagcttggaggacctcgcccagcccgttccagacctcgtgggctgtcgagttcacctgcaccgcgtcccggaggatcttctccgccagactgtagcggcctagctggtgaaggatcagggcctggagaggtcagagagagagagagacagtcagccatggaggcttcaggagctctgcatcctacttgtcctcgagtttccagtcagttcctcggagccgggaatatatcgccattgggctgggcccatagtaagttctccagtatttcctgtgttcaggggcaacagtcaaaatagtcgccaagctgactaatatgaaattgccaatattcagccatgttttgaatataaaaatggcaacttcatatggttcatctgaaaacttaagaaccatgaatgaactaattggaagtccgcagtctgcactgacccagcgcggcgtcagcatgggatgggactatcatccttttctgtttgttttttgtttttgagatggagtctcgctctgtcatccaggctggagtgcagtggcgcgatcttggctcactgcaagctccgcctcccgggttcatgccattctcctgcctcagcctccccagtagctgggactacaggcgcccgccaccacgcccggctaattttttgtatttttagtagagacagggtttcaccatgttagccaggatggtctcgatctcctgacctcgtgatctgcccacctcggcctcccaaagtgctgggattacaggcgtgagccacagggcctggcctgtcgtcttttttttttaaactaaagaaaccattggtggaattatactatgagaatgatgacgacagtttttacattgctcacagccccttccccgaccaaggccctgacctcactgtctctgcttgccccaggctgtgcccagctgtcatcttcgttttccttggttggggtgtacccgtgggtcccacctatttcatcatcattgcgtttccaagctgcgcacctctataagcgatgcgtgtactcgctcatccaatggacactctcactttctcaacctctccctcgggggagaaacatgtaggtcacatccaatctctttgctgttccaaatcgcacagacatgaacatctttccagaaagcacctctttgttctttagatcagtggatttccaatcttttttgtatccctgaaaacctttggttaaatgaaatcttacagagaacacccacacagtctatgtataaacagacaaaaaggaacaacttggtggggtgggtggggtggggaggggagtccagtgtcccccatgagctccttttagtggccctgggggaggatcagtggaacggccttgacaactatttggacatcctccccttagggcaaatctccccaaactagggtctctgggtaagaggatatgactctctttagcactccccaaacattttgcaaattttatccccaaaggttgcctcactttttcagccatcagcagtttctgtggttggtcacctacccccttctatcatgactctatttctgctaatgtcatacatgcagaatgtccctccttgttgaaatctatatttctttaataaccattgaggttaaatatttcccatgcttttgtttaggagcctttcataagattgctattcatctgctaccataatttcccagcttattatttgacttttgagattcttttctttgaaaagttttaagttgcaaaattaaatttattgatctttgatttttttgccacttcaaaacttagaaagttatcctttcaaagagctgacacatgttcaattccatttatcttaattttccctcttttaagtagttgactactttatcttggcagagtgatggattcctcctactttgctagacacaaactagctcatcctccctcccctcactcttgtaaggcactgcctccatcctagagtgaattattacatgaatcaggggccttccactattttccaacaagccacaatatcaaacttctgcatcagcaccacagttttcatttctgttactcccaaaatcatgttttaataggtagagtcagagctttccctcactgctccttgcttttagtatgtttcttgacaatcttaccctgtactattttcgatgaatttcaaaatcagtttcttcattccctttagaagtcaaattgcacttgcattacctctcttggagagtgtggagaagcctgacatctttacaatgtctagtcttcccactgaggaatgagttatggccctctgctctttcaaatctcatcttaaatctcccaataaagccttgccctcgctttaggcagtgtgagcatgtcactcacgaggcaacccagcctgctcacaggccccagcttcaccaacaggcaagagggcagcagggtagctgtcaggagcagaaccagccagtgtgatggcaggaatgtgcctgccttgaagtggcatccaagagcctgagagacaacctggcttccataagcccccaacaggggagctggggtgtccacccaggaggagcacgtggttggggtgacagccaaggagacccatggccgagggcagtgtgtggcccctgtggaggctcagagtggaaggtggaggaaggagacccccagctctgggaggaagaggcagtttagggagctctcctgggtgaggaggaggcggaggccacgctgcctcaggtagagatggctgccctcccccgtctgggaacagcaggcttcagggtcagctctaccttctcaagaacacaacagaaatacccgatgtttcttttcttatgaatatccaaacatgtgtccatgctggagttcctgcatatgaccaggtccttggtggcatctgccagagaaggttccggggtggccaaacagccgagggtagctggccactgcagagccacacctcatgactcctggtgcctgcctgaagggcttctgggtgtggagtccagctgcgggtggcaaataatcacgtccatctcccaggatggtgctctggaccaccttggacctccttaagagggaatctgacaactccacattctcgcttcccaacctcaaaggccagcagaacaaatggtaggccacctacccaggttgcattcagtaggacgcgaggctgaatgagatcctgccccctttctttgaggggaggttatcacctgtgctcacccgagaacgttccaacgtaactatgagggaagggaggtttctgggtagcggccctgagcagcagcctggagagattatggcaggagctcgtcacacgccttcctggcatggctttcttggtgcatcaagatactaaatacacacaacaggtttctgagtggctctcccagcagggagacacatgctgcatgcttctggcaaataggtgatgagcagtaagccactgtgcttacttgttgcaggtggagaatataattcaggtcccactaggctctgccaccgtagcatcagccccgtgctgttttcttcctccaagtggagggtttttccccactgggcaccacgctaggcactgtagctagcccatctcctattactactgctttagatacaagaagacacagttcagaaaggccacgttcttgccccaggtcccagggccaatcaacatcgagctgcagccttgcccaggtctgcttggtcctaaagtggcccatgcttcccacctggtccacattgcctctgtcgctttaagaggcaagccccgggccagcagaggagagctcagtggagctctctcaatgcgggccccagggcactcaggcaataacccagttacatccaagcaacaggaaaggggcgtctgccatgctgtgtcttccctttcatttctctgaccactaactgctgattttattgctccttcccatgttatgatggggaaattgctcctctccaaggcacagcttccctctggctcagatctgtgtcttagaggcatcctgtatatctgctcatggactggagggctccttgcctcaggacagctgtgatcttgaggcttgggaaggctgccacagccaaccgactgggccattctgtccgccagaaagtggatgggtgagatgtggagaccaggaggaccagggccttggcccagtgggatgcagagggctctggtctcggcaccctgctggagtggggagaacccaccagtcccttcctgctgggatttttgtttagaaagtggcaggccactaaatctggccaactgtgggggctgcagggtatgggacaggggcatgtctaactgccctcaaaagtcctgcagagaaccaaccccgaggggctaatctgagccagcaccctccgtgttggccactaagagcctctgcagtgctctggtgttctagggttcttgctggcttggaaatttccagcccatatacctggacttgtagtcctaacgtaggaactgccattttcagatgaccttgaagcttcctgagcaatctgttcagtggaattaattcctaaagctggagctgcttagggagacatcgcagacttgccaggggctgccagctcaggcttggcacaggaatgaaaaataggcctctccccagtgagccaggagcagctcagaaatcagcccatgacgggatcaaccagaacaagctccagctgcagtcagagccactgcctggagccagcacagctagaggactggccagaggtgggcagggacctggctgtgtctggctgtcaggagtgacacaccacccaagccccacagtgctggccagggaccttccttcctttcccttcccttcccttccctgggctccatgtgctcttctgcactgcagccctcatgtcctttccaattctaggggcccggcttgctctctcctccggagatcaaaggcctaactcctgaggttggcatggagctgttgtcagcaccagctgcgtccaaccttccctgggttcagccaggcttgtctgtcagccaacgtgtttctgcaggacgcagccccagccccctcctgcctcccagctgctgtcggtcagcttggggccttcctgctagagcccttgtccatctgcctgaggccataatgcaccccatccctgcagagccaagcagccacactgcccccaaccagcagcgctgcccagcagcacgcagctcctgctcccagccatcagcctgcaggaggcagattccaatgatgacatattaccatatattaccatataacctgccactccctgcccccatatcaaacccaacaaaacccaccgagtgattgcttggtgctggatagagtgggtaagcgcaggcctgctctcaaagagctcggggtccagtgcaaatcaccaacagcgctaagcattaaggtctcattccatcctctctcacctccaggagccagcgctgctggggcttgagtttcacagaccagatgacccgcctacaggtagctagcggcagagctgaggcctgcagctgtgctgcgtgtgcccttgatactgggccctctcccctcccctgtgtgtggagaggatgcgcacacagacttccaccttccccagcactggtgttcctgcagccactatgggttgggagccggctggggctgagcttcagagagctgggaaatcactgaggaagtaacttattagtccctttcttcagacatagatgaaggctgcctcccaagctggtaattatcataatcaggtgttttgtacaaataggatcttgatgatgcaccaaattggcaataagagattaaattaaacctgttatttcaaatgagataaaatggacttggccagtttcagagcaattagcatcttcctcgcttttgcctttaattgctgcccaggggctaaacaccttgccagacctcaagggcgcctgtgccagagccccggaaggctcctgtgtgcaaggtttcctgctgcagccttggtgtaggaggccctcagcagggccggcctgcactatcctctgaggcagaagcctgcaggacagaagccactttggaggctggacactgtggctcacgcctgtaatcccagcagttttggaggctgaggcagatggatcgcttgagcctgggagttcgagaccgacctgggcaacatggtgaaactccgtcgccactaaaaaaatacaaaagttagctgggtgtgctggcgcacattgtgatcccagctacttgggaggctgaggtgggaggattgcttgagcctgggaggcggaggttgcagtgaactatcattgtgccactgcactccatcctgggtgacagagataaaaaaaaaaagctcttttgggagattttggacatccccatggcactctgcacaaaagccaagttagccctttgctgggttcaagagcacatcacagaccactgcttgtccctctaacggtacagatacagggagataacgtccctgaaagcatccttcccaaggagaagccattgctgaaaagaagtcctgtggcccagctctgggtgggggtcagttggtctacctggttattgcttttccccaggcataatgttttggaaatcaagcattcagcagcagggatggaggtgaaccactccaagtgctctctacgccagggcatggctgatgggcaggctcccctgccggtagtgctctcagcttctctgagcagcagtgcagtgttagtgcagagagcagtgagctgtccctcaccacatcacagccggcctggattctgcagagcctgctgggccactccagggccactgatgggtaggaagtctagtgtcagggatggtactggagcacttaaagatctttctgttctgctcctgggtcagaaactccaccattaccctttgcagggggtagaggtgggcatgggtggcttaaggcagtgttgtcaggtggcctctccaaaaacacaagtaaacctgggaggacaaattcatggatcaccaggctctattaagtgtgcatgtgcaagccattatgatcaatgtagtgtatgttttgctgactgcaaagtgcttttgacaccatcttgtgtgacaggtgccacattaattgaggtggcttatctctagctctgttcccccactaggctttgctgtgagtgcctggagggcagggactgggtgaaccccggtcatctctgcacctccaggcctgacactgggcaggtggccagtaacttggggcagaatgaataaatgagcagacccagaaacttgatgagagcagcatactgtttaaagctaccacagactgagcgtgggtctgtctgcctggtccagggcctgtgctctgacccaccacagcttgccatggagagggtgaaagattttctcagcatcggctgggtgcagtggctcatgcctgtaatcctagcactttgggaggccgaggtgggtggatcacaaggtcaggagatcgagaccatcctggctaacacggtgaaaccctgtctctactaaaaaatacaaaaaattagctgggcgtggtggcgggcgcctgtagtcccagctacttggcaggctgaggcaggagaatggtgtgaacccaggaggtggagcttgcagtgagcagaaatcacaccaccgcactacagcctgggcaacagagcaagactccgtctcaaaaaaaaaaaaaaaaagattttcttagcatctgcaagtcagccaccgctcattgcagctggtggaggtcaaacctcactggtggagtgggaccccttctcctccagagggagtgaggcccaaaggcaagggtggtgggggctgaggaccaggatcagtggcttttcccacggctcagcgcccacctgagctgctggggccacctgagtcaaacgggcaccaccacgacttttgaacaaagtcatacagcctcctcgtggtggggtgtcagggactgtggtggcagcttctggggtggaaagcccatcatcccacctttgtctccctttgggaagatgacagtgctgctgagctggctgtggccagagctgcagttgtgctggccacagatggcacactgggggctcagggtgtaggtgaggggcctgaaaggtgctacaggccctggctgctgctggtggcttctgcatggagggacctggctggccacaggggaggggcacgttgctctctgggacagtggagtgtggaggttgggggtgtgagtcctaggctcaccccagcagactgggcttgaatcctagctccaccgtttacttggacaacatactctgagtgtcagatgctttatctgcataagggggagaaatactaaccaaacgggggagttagttggactaactcgtttagtaaggactaaatgaggtcagagtttgcaaggcacttagcagatcgcccagcatatttgtacgccttcagtgggtggcagctctcagcaatattaggattatggctgttctcattaccattgttaaactagagatcataagactgatggaacagactcgctgtgcaataagataccaaatcataaaccagaactaagaccacgacaggcaagggttaagtcacatatccctgaaagaatacaccgccttctaactgccacaaggtttttcttttctctagcagctaaacaagcactggcctcgagataagcaatattgaaacaattgcagctcacctaccccagaccctaactgagctcccattccacaggttgcaactgcagctttgacgggacaagagaccaccaaccacaggctggttctgactggtttagtaagaggctgagcactgtgtgtcttcctgcccctgcctcatctgttgatgtataggaccgaactgtaatgcacctaaatgttatgtctccaccctaaagtgaacatgggatgcatgtaatttgcgtatttgcttatcacacacatgcacacatcccccttttgtgaatattcatagctcctcctataacctgttgaatatgtatacttggccaaccagttccacataaatccctgttccaccctcccctctctcaaagtgcttgcttttggtctctgcctgaggctacatttcccagccagtcaagatggccaccctgaaggctgcaatcctttgtaagaaatgaagtctcttctgcaaatgtatgaacctactgattcctcagttgacactattagtgactccgagaggagggggggcccttccgtgatgccagtagttggctgactcttcacctccatctccctctttaacagcaaggaccaccatgatttgtctttgcatgtacggcacctggagtgggcctggtacagaagaggctcttggggaatgcttgctggatagatggagggatggaggagggatggtgtgggatgctgtggggtagtagggaaggagaagtcccaaagaaagctctggcctcaggtcacccttgtctatgctcccaagtcaggccagcatactcagagcctcctctccttacagagcattagcatgatggtctctgggggatgcgagcaccccctgggagaagatgccctgctcccagctgagcccagtgggctgtatggcttcccctcaggctatttgctcgtacaccacagatctgacactgctctctaagaaaatcccagaacccacccgcagagccaacactcttacagaggagaaaacagagggccagagaggagaacagccttgctgaaggccttgaccctgctggacacagagtggggctagacagcaggctcctgaagggctgagtctggaaagcctggtgcagggcctggcccagggccagcctccaagttttagactccgattacagtgttccaactctgcccttgaccctagctgctttctgcttgtcctgtcaggggctatgtccatggtagaccaggctttctggaagcccaccaggcctctaagagtgggttccctgacctgaggaaaatgaggaccccacaagagctccagccccttcccataagctgcagcacagttggtctggccgtctgcattcgctgaaatgtaggcatgaaatgagaaacaccagcacatgtgagtcaccacttctcgggaatttgaattttccttctagaggatgccattgatcagagggaagcagggtggcagcggtagtgttttcaaaaatatttttcttttaaatcaaaatataaatagactgcaaaccagtaccactctgagaagcccacaggagactggctttgaaagggtttccttggagcagctcaggaacacagagctgagggctgccctgcctcctttcctcccgggcggccctttcttctctggcaagtgtcagaggcactgtcagttttgagtacaagcattttgtgggtgcagctgagggggcagccctgagccccaccccgctttccaacaatgccttgaaaaggaactgaaaacatgcgtgggtggggtgggggctgtgccagcttttccacctggattctagaagctctgggcgaggcctggtctctatggggctctgttttgtgtttcatttctgtttgttctcagtgcttagaaatggcaccagtttgccagggggccaagtgtgtgtgtcttggctaatgacaccagccagaaggctggcctccccaggccagaagctccacaggggccaggtcctggtgttctggctgaggggaggcatccccagccccacagccccacacctcctgcacacctctgcccgtcagagctccaccgtggggtgggactcacacgctgccactcactcagcccctcaccgggccagtcaagagcaagttgaaggaccttctgggcaccaggcaggcccaccttcctgtcagcaggtcacaagttctgggcaggggcaggtgtggggctggtttactcatctggcccattttactcagcactgacccagtttccccaaaggccaaccctaggtcttcctgacagcccgtgcccatctaagcctcatacacagcaggtggccggagcctgcacaaggccctctccccagtgacatgatggctgctgctgtcaccaggtggcctccaatcctgcccacccccaggctctcaggtggggatagaacattcgtgtggccacttcacctccagatccacaaaggccgctgacgtgctggtccaggaacccacacagaagggcagtgcaggaggagggaaggtacctgcagtgtggctcctggggacatgctgccttaagaagggcgtccttctgacagaagccagctcagatgaaggaggagagctccagaagatgtgagcgggagcctggcccccaggccggacaccttttcccttgggcctggggtcgaacacggaaggcaaatctcctccagtccccatggctgccacctccctgctcaaatgtcagaaccgaaacggggtggctgcttcctcactcccttcaagttagccaaacaaacgcccccagttaccagcagccagtcccagtcagacataggggtgtggagccccagagaaaagactgaggcccaaagaacctcaggaaggggagtgatgcttttgtctggggcagggacggggcctgtggtctaggcgcaggccagatgcccccagggggctcttcctcagggagtgtgccgagtattccaggagggagcaggggagacccccagcatgccctctcagagcactggggggaccaagggctgcagcacagccagaggcagccccaggtgcagcacctctgctcacccggaacagctgatggcggcaggggctgcgctatcatggggccccttttccaggtcagacattttatctggagaaatgcaccttctggggtttaggcctttccagcattgaactcaactcagaaggaaaaatactcattttttcaaaaaaacctcttatttttctaagccaactgccaaccagctatggaagcagaactcctcagggtttgggggatgcctgggcctcggctctccgatgcacagcccctgctgctgtccctcatgggcagcaccccctccagggaccaggagcttgtgatttccccgggcagcccacaccatgagaggacagtctgaactgttggttaaatgtggagccctcattgtccttttcatcgaatccccacactttgaagttctctgagtcttctggaaccacgtggaaaagccccgttctctttccacttgatgggccttcaggataggaagaaagcttccagaacagcgcacgctccctctctggggccttggaggcatggcggattcagacctcccgcccactctccccacctccctgaattctgctgcttaacatagctcctcgaaggagacctggctgtgggtccagatgaaggctccgttaagccccaggaaaatatgagcacggctttgacttttgtcttctttttaaagcgtctgactggcagaatctcttaaagctgctttcttccaggatgatctggaatattctggaggagcttattctgcaattagcagtgcagagtaatgggctgtcaggcagtaaacgccagcacctagggtgctggcagcctggccagaagccaaagggcttgatcagccttgcgtgaatctcacagacttggccccccatttccccttggcctaatttctttgaaactgggtgcttcagcattggtgctgacatatccacagactgtggtggcttttagagaaccgttgctggcaatcggtgggacatccggagacggaccgcagcccatctgccagcagcttctgagccccaaagccccacagtcccccacccactctgcggcaggtgtccagagggtggtcggggttgcagtgagcagggcattagagcattccccaaaggaccagccatcctatttgacaggagggcaaacagaagcccggagagggtaagtgtcctgccaagagcacggacgtgagtaaggaacagcatccgggtgttcgggttccgggggtggggctttgttcactctgctccaaccaaagccatttctagttctttcctcccctctacaaacactcgttgagcgcctgtgggtgttctggcaccaatgtcctggtgctgtgccaggtgcggggaactcagtggcacaggctgtcactcgagccacgctcttgccctcgctcaaggctcgggactggaggggctggtttgctgtgggtcctgccccagagcctcagtcattcatgtgtgtagtcccagcatctgccacagagcaaggcttattggcaggaggatgagggaggacatttcaaaagagacaatatgatgctctccccactttgaacaaagaagaaggcggaagctcagggtcagggtgctggttcatggccacacagctgaagagaaggagctgaaacttcaaataggatctgatgtttctgctccaaaagcttcctgtgaacagaggtctcattcttcctggagtggatcgactcttagtgatcacatctgaatgatgtggcgcaggctcctagctctcggcagccctgcctgggaggttgtagtggtgacagggtacctcactccaggtcaggagaaggagggcaagtacctggttcagttaccaagccaggtagacgtcaggtgtcagaacctaggttttgtgaagacccgcttaggtctctttgctccatggcagactactgagatctctagagagggtagcaggcatttagggaccaggaaacacattccaacagtccttccctgatggtcagctgaccctggaccccacggctcagcactccctacaccaacctgggggagaagctccgaggacatgagagtgacgcagccgacttccctgctgttctctgtcagtctgcctggcactgcaggcccttcctctacctggcggctgccagattccgggtgagccagaccacgggctcttgggacccaggtgacataagaggacctagggaaggggggggtgtttgatggggatgtctccctctgggtgacctgaagaatggctgccctatcgcgtgcacgctgaggggtgcaggagggtaatctaaaaagcagacccttcacagtctggattctgctgggaggacaggatggcatggggacagcacggctcccttccctgcaacctgcaccagcgccattctgccgactgtgtctccagcccagccgcctaacccagagtccttttccttgcccttgggattaatggtgtggtgattttgcgagtcaggaaagagagggagaaatggctgtgagaacagaaggatgacttgacctcaacatcagtcatctctcagctcctctctgacttcagctctggagagaccaagggaggcatctgccttctccttggaaaagagcacgaaggcaagctgagagctgcctctgcctagccctgggagtggaataacttggtcacacttgtgtccatgcacctgggtgctgctgctggtagggtcaccggggacccgtcaggggagggtgatggggaatcccggtgccccggggtccacatgagctccctgccggctgcagcctaaggcacagcactcagaaattcagcaaacacactcacaggagcgccagcgcaagcacctccggcgcgccgcgtggtgcactgacctaattgaaagtgtcaggccagcaagtcccacgtaacatcaaaggacagtcagcgagaaaggaaggacaggtccactggcggcagcgctggctgggtgggggccccgtgggggcggagaggagacaggaggaagccttggggtccccagcaatatgtggggatgccaggcatcccccctaccctgaagcctgggcagtccttggtaacattccagagtctccagcctcccctcccccatctgccgtttaaatcacgtgctttgaggcagtgagttttagctcagaggctggctggaacgtggcggtagctgtcagctcataggaggggggaagcttgggtcctgctgctggggggcctgctgcatgccagccagggtcttctgtgggtgctaacacagcccctcttgctggtacttttccactggtaatgggcaagagactcctgttcacttatttctacatttccctggttgacttatttatttttacctatcttccccaacaagaagtcaggcagaaaccaacagcacagagcagcctggaagctggcactcccccatggcccgactgatcctcgtggtggaaagtttagtgctaatcaccccctaaagacccctcctgccctctggggaagccagtgcccctgcactttggggaaggtggcactgtgccccaggccatgtgcgccaggccagggagatgcaggcatcagggatactctgagggaacttggccctgctgcaggcacaggcttcccctggggtcctgggaccactgcctccacaggggagaatagcaggcccaggcagaggctgagctcccccagaagccagggaacgggggggacatgggcagggctatgaccccagggctctggcgagggaagcgtcagacctggaagtgttggagggtctccatggtcagaaagccattcccatgcggccactgcagtgctgcacggggaggcttcctgggagccccacggcctgagacagggggtcctagaaactctgaccccactctttcccaaagaccctgacagagccccatctgccctctgcttctacctgtcctcaggtggggtggggcggggctcatccctttgcgagggcctcactgtactcagggctgatcttttatcactgaacactggcagcaaaggcctgtccccagttatctcagcgagagggctgaaggtatgctccccctgcaggagagcagggctgggagaagtcacgtggggcagagggccacgctcccacccctgctgtgtgacctccatcaactgccacttaggcagaggcttctctctcagcctcagtgttctaatcaagaaaatgaagcagcaaattctagggtttgatctccagctgaaaattctggggtttgatgaaatcttccacccaaggaatatttgttggagcacctactatatccttagtgtgtatctgttcttctaggacttgagtggcagcagccaacgcagccagggagggcttcctggaggagggtccttggcaactcagcctgcaggagcagaggcctggctggagtctccacctccagcagcaacactgagctcaaacaagatggcagccctggaaccccattccctgcctatgctcggggggagagggggaagcgcccctgctctggtgctgcctggggtgtggggaccacgggctcactgagcagtgcagcccaactttctccctgactctctaaaggcaggcagcggagtggagtggtgacagacgatgggctagtggggagttctggaaggcgactggatttacaggaaactctggaaagctcaaaaataccaatggtgcagaggagaagagctgccaggctcctgaagacaggcgctcatcgctgcatctcctgacacctgtgtggtcctgaggacccagtagacactcaataagtggtccttggctaaaagtcactgcagtccccggcacattcttggtataccgtcggcactcgatagatgagtatggaaggggtattatttcccagctgtgctgcagccacgcctgccgtccagcccagggtccacttgggaaggccagcctccgtgccagggtgcccctctggcctggcatggctgcctgggtgggggatggcaggtggtcctcagcaaggctgccagaccctggccgtgaagtccacctggggaggtaagccccgtctagatctccatggagagtgccggctacacaaacagctgccaggacgaccccaggccaaagtcccagcttcaacacacagggggctgagaggatgggctctgctttagggctgcgcccaccaagcccaccccgggcgctgctctgcagcagctggagaggaagtgttttttccacaccgctgtgtgacacaaaggccggatagttcactacctgccacggcgagtccggtcattttggtgagtggcttcccccatcactgccagggtttggcattcactatttttccatttttaaataggaacaaacataaatgataaaacaccttctgatgaagggaggcctggaactgataggccttggaaaatttttttccacaaataacaagagaattcacagccccaaagggcggggtctccccggccagcgctcctctgccctgccggcctctgttcacactgcagggcgattctagtgcattagcgccgacaaacactggttagcaaggaaaacagaaacgggcggcttgccagaaatggggaccttcactcctggagttttttacaaactttctccccagggcccccagggcttggccccaaactcaggcccagggctggagcagaggtgacagcagacaggcagggaacactgtaggggagcaactgccgcctggaaactgcataggggcgcggaaatgatgcttgggtgacggcagagacccagcctggcaccttctttcttcacacaactgagctcttatcagttaccacttcaatatggaataattcagtatcaagaatagagccatttcctcaaaacctccagtcagctgtgacgggcagggcacagtgatgtgaccgcttacccaggccgggcaaacgcggagcttggaggatccacccggccacctgccatgtatgggtcagttaacaaggagcatctccaagtctcctcagaagccagaagcccttgcaggggttcacagaatgggtccaggggcaggggctaaacaatgacttggagggagaccagggaattggaagagtaaaagcaacagcacatattgcttctgcagtgctcgcaggagtctttgcgaatgcagtggcggttctgtgcccagggggccacagaggtggctgcttacagccagagggcactggcggggcagctctggcttctcaggagctgaggagatcagcctccctgcaacccatctgggcaccccttggctctcagattgggacactaggtggaaaagtaggccctttccttctctagagaacggggaagaggcagatctgttacgaggccctaaagcccaccctacatggactcgtggtgggagcctctgtgctacacacacaattctcacaacacacacgattctcacaacacacacgattctcacagccactctgttttgggagaagggaaggcacagaagactaacagctgccgggtacatcctatatgctgggcaggtgctaagaaccgtgttgaacctgtatgacagtgctgctaggttggaattcacttctgtattacagaggttaaatcacacggccacatggccaaggtcctacaaactgccagtgtatggcagagctagaattcaaacaaggggctcttttgctccacaacgcgcgctcccccaccgtgctacccttcctgccaccatcctgggcaattccagggctcgttccttcccccttggcccctgtccctctggaatggcagagaacctccatcagatctgtgccacaagcgccatgtgccccaggagccccgggttagggccatttggcaccgttcttctctgccaatgtccggtgctctcctgactctgctcccgtctcctgtgcctgcctttcccccatcacagttcaaaccatctgagtccagtggtgtcagcaaactgcctctctgaaagagaaaaaggccttgatttgtggcgcctgccaatttccgtggtataaacacttccaccatggccgattccaagctaccgaggtgatgtcattgtgggtggagccagggagaggtgagaggaagggacatactggcatcagctgcactgcatgcaagtgtgaaccagcaggacctgcaagaggcactggcactagagcagagacaacacagaagacacaggtgacactggatgtcacaaaacacactgatcccatcatccaaagcacactgtcgtcttgatggttgaggggagcaacacaaaaatactatccttttcagtgttgaggattcagaaagggaaaggagatacattttcttctatcacagaacaatggaacgaggagaggctcaaagcatcattgaaacatcctcagaacacttcccacatctagaaaaatgagaaggctctgtctcctcccattcaggctccaaacggtggctcagcaacacagccttctgagcttgatttccctacagccaatttccttgtaaactgggctgtgtccatgtcatacttgctggtgggtgtgtgggcgtctgagtggcagtaagggtagctggtgggggctgctggcggcaaggaaggtgagattctagctggctttctttgatcattgcaaaggcagaagcagatttgtcacctttgtgtaatatatcaggcagcaggtaaagaatttaacagcttgtggcagttctaattagagagccaattataactcaattgacctgccttgctttgaaaggcctggaaaaatgcatgttgtcctcaggaagaggcagattttgcttctagtttgttctgggagatccccgcagggatcgctcacttgcgctttggttctggccccatgcatctgtgtggtgcggggtgccctgatgtagagaatgagagagaacctgcagggacactgatcctgcagtgggcatgctccgctcctctgtttatgaagaaagacgcggcatcacatctcactggctcccccgaggggctgggccggcagcttctgcttcactcagaaggtcactggccagcattcaactggatctaatcaagactgaactggcaagggtggaccccaggcatactgtacatgtgtgcacgtgtgtgtgcatgtccaagattcccttcaggagcagtcactgttgttatgggcttggggtcacccactgtcccctgagggatggacacctggcaagagaatcaggtttcaaacaggcataaagaggggacgcttcacatttctcctgagaaccaaggtgcggcatttgttgttagacaccactgaagtctctctggctcacacatgtgatcacatctaattttcccacagcccggtgggatgaacaccatcgtccccacatacagaaagaaaaactgaggcccagagaatcgacatgacttgcccaagggccccagctcctccctgtggaagccgtttctaattcaagccacttctgctcctgacacttatccaagagtgattttgctgagacccttcctgtgcacggtggcttggtggacatcatataaaccatggcagggaagagggctggctacagccctaagctgagagcagactggggctgtggaaacaggagggttggcgagtctggcaaagccagccccaaatgcttgctatagctgggattagcaaggtggactgaaaaaacgtatgaacatcagaacctacctgtcctcaggagcctcatttccctcctgctccccaaacgtgggtgctccttgggttctgtcctaggccctttctctttcctgctctctggaatttatatctcaggcagtcttgtctcctcccatagcttcgggtaccatgtaccagctgctgctgcccccaaaaccatcgccccagcccggccatgccccaacctccagacctaccctggctggaagaggcaacctttccaggaaaaaccccggtcagcccacctccacacagccaaccagacttgccatcacccttcgttcagtaccttcccctccctctgtgtcccctcatgttcgtgaaggcatcttacccaaccaggctcctgaaccatgtgcctgagtcagcctcaaaccctctggttccctcaccaacccttgtgaagtctcccttttcaatactcccaccttggactgtcaacgtgttatgacaagctgagtccagaccttagtgtctcttacttttcacctaacctatcctccacagcttccagtgcaatctctctaaaatgcagacctaatcacattcactcacttgtttaaactgtatcttgaaaaagttccaacctgcagaaaagcagctaacaaaatggacatctctagacctaccacctacatttaacaaccattcatcttttctgtatctgcttcatctgttggaggcaaaggctagtattttaaagtaaattgcaggcactgtgacattttacccctaaatacttcaggatgaatctctaaaaaataaggacatttccttatataaccatgtaaccatatcccacctaacaaaatgaacagtacctccattccatcatccactagcctttccacactcaaacttgcccgaatgtcccatgcataagccacctccaaaagctggcttattgcctatgtcaactccacctgtcttcccacttgtgggagagtctgcgcctctactcggctgccagcacttggcccacaaaccacgagcacagacccgcacctccctcccccaacccctgccgcaccataccctgcacatctgtctatcagagtctccttgacaacccttatcctcacttgtatatgttaacatctctccctatagcctttcagtaccagaggggagggactaggatagagtcatgttaacatcctcaggtcctagtccagtattggactcaaactacattatcttacatgtatcatcccatttaatccctccaacaatcctaggaggctgctatgctgaatcaataactggtgactgagtaaacgtgatgcttaaaggtaaagctcgaaggacacaggcatgtctcggagctaccacaggtgcagctccaggccactgtaatcaatcaaatgtcacaatcgagcaagtcccaggaactttttggtgtcccagtgcacctaaaaggtgtgtttacactacagtgtgtctattaagtgtgtaataccattatacctaaaacaagtgcataacttaattacaaaacatcttgttgctaaaaaatgttaacaatcatgtgaccctcagcaagtgatacgctttttgctggtggatggtctggcctccatgttgatggctgctgactgatcagggtggtggatgctggaaggtgaggccctggggcagtttcctacaataagacaacagtgggtacaataagactcactgatggacccttccttggacaaaagagctctctgtagcatgtgattctgcttaatagcattttacctacagcagaacttctttcaaagttggagtccatcctctctaaccctgctgctgcattatcaatcaagctgatataatattctaaattcaacaatgttcacaatgtcttcaccaggagtagattccatctcacaaaaacactttgttgcctcatccacaagaagcaatgccttatccattcaagttttatgagactgcagtaattcagtcacatctccgggctccattcttgctctcttgctattcccaccacgtctgctgttgtttcctccaacaaagtcttgaccccctcaaagtcatccatgagggtcagaatcaatttcttccaacctcctgttaatgttgatatttagacctcctcccatgaatcatggatgatcttaatggcatctagaatgctgtatcctttctagaaggttttcagtttactttgcccagatccatcagaggaatcactatctatgtctaaatcgctccttgatccatgggctgtaaagtggatgctgtgttagcaggcatgaagataacagtcatctccttgtacaactccagcagagctcttgggtaaccaagtacattgtcactgaacaataatattttgagaggaatctttttctctgaataagtgtcaacagtgggcataaaatagtcattgaaccatgctttaaacaggtgtgccatcatccaggctttcttgttccatttacagagcacaggcagagtcaatttcgcataattcttaagggccctaggattttcaaaacggtgaatgaacactggcttcaactcaaagtcaccaattgcatcagcccctaacaaaagaaccagcatatccattgaagctttgtagccaggcactgacttctcctttgtagctatgaaagtcctagatggcatctttttccaataggaggctgtttcatctacattaaaaaactgctgggctgggcacagtggttcaggcctgtaatttcaacacttttgagaggcagagttgggaggattgcttgaagccaggaatttgagaccagcatgggaaacatagtgagatccctatctgcacaaaaaacttaaaaaattagcgggttgtggtgatacgtgcctatagccctagctacttgggaggctgaggcaggagaatcacttgagcccgggagttcaaggctgcagtgagctatgactgcgctgctgcactccagcttgggaggcagagtgagacctcaaaaaataaataaataaaaataaaaatctgttgttgactatagccaccttcttagctggatcttctggataacttgctgcagcttctctgtctgcacttgttgcttcactttgcacttttatgttatgagacagcttcttaaacctcatgaactaacgtctgctagcttccaacttttcttctgcagattcctcacctctctcagccttcagagaactgaagagagctgggaacttgctctggattaggctttggcttaagggaatattgtggctggtctgatcttctatccagaccactcaaactttctccctatcagcaataaggctgtttcgctttcttatcattggagtattcactggaatagcacttttaatttccttgaacaacttttcctttgtattcgcaacttggctaactggtgcaagaggcctcacttctggcctgtctcagcttttgacatgccttcctcactaagcttaatcctttctagctttttttttttttttttttttgagacggagtcttgctctgttgccaggctagagtgctgtggcgtgatctcggctcactgcaacctccaactccctggttcaagggattctcctgcctctgcctcccgagtagctgggattacaggcatgcgccaccatgcccggctaatttttgtatttttagtagagatggggtttcactgtgttggccaggatggtctcgatctcctgaccccgtgatctgcccgcctcggcctcccaatgtgctgggattacaggcatgagccaccgcgcctggccaatcctttctagcttttgatttaaagtaagaaacatgccactcttcctttcacttgaacactcacaggccattgtaaggttattaatgatcctcatttcaatattactgtgtctcagggaatagggaggtccaaggagagggaaaaagatggcggaacagctggtcagtgtagcagtcaggaccacatttattaagtttgctgtcttatatgggtgtggttcatggtgcccccaaacaattacaatagtaatatcaaagatcacaacagatgtaataataataaaagaattttaaaatattgtgagaatttccaaagtgtgacacagagaaacacagtgagcatgtgctgttggaaaaatggcactgatagaccaggcacggtggctcatgcctgtaatcccagcactttgggaggctgaggtgagcagatcacctgagctcaggagtttgagaccagcctggccaatatgtggaatccctgtctctactaaaaatacaaaaactagctgggcatggtggcaggtgcccagctacttgggaggctgaggcaggagaatcgcttgaacctgggaggcggaggttgcagtgagccaagatcgcaccactgtactccagcatggggaacaaaagtgaaactctatctccaaaaaaaaaaaaagaaggcactgatagatttgctcaatgcaaggttgccacaaatcttcaattagtaaaaaatgagtatctgcaaagtgcaataagacaaagggcaataagacaaggtgtgtctgtgcctgtaccctcctccttcacaagcccttggggtgactgactagttgatgttctgaaagactcaaaaaaagaaaaaaaagaatgaaaacactaacacctggaaaggtattttaagagacagttgttatataaataccacacagatgagaaaacggaggaagccaactggaggagggaagggagagatcacgtgtcgttcatcagtgaacgtggtgggcagtaaagcaggcaaggcccatggggtggggaatttcctactggggcaaagtggtctagagccctggaaccctggcagaggctcccctttagctaaggagttctctaagggcttttccaaagctctcagtgacttggagtgttctggacattgaggccctcagaccttggttggtttgttccattctctcctttccccaggtgattgctgaggcctccgggagccaggtaacagggaaggccacctcctgaccccagactgggcttgcaccaaacgctctgggtggagcctcacacaattgcactctcattccttggtcagctgcactcatcaatttgaaaggggaaggcgggggcggggaggggtggtctccagggccagggcccagagcaggcatccgtggatctgtgcaggggagagaggcctgccttggctccaggtcagcaccccgcaagagcctgagggttttagacttggtgattcttggtagatctgtcttccttcctcctaagcaaccccaccttggcaacatgagtgccaaaggctaacctggaaacttctctgtatccaaatgagctcgtctatcgacgctgaggctggcaactcaggcacgtcctgggctcagggcagctgtgagtgcaggcatgccacacagcagggagagacacatctaggcgggtaaggggcaagaagagacacaaagacttctttctagtggagagcgaaagagaaaggcgccaagctcagtggatgctgcatgaccacgagacctagagctggggctgtctgagcctcggagaacaatgagaaactccccccgtccatcagagtggagacaaagttctctagggcagcgttagccctggaggagttcagagagctgatctcttttacctccatccccacccccatctcaagaaggcaggtgctagtctcccattttacagataggaagagtggacatgaaaccttcaaaagcgatggagtcaggattcctggtgggttggccactcactgctctggacccttggtgagtcccttcccctgtctggcctccgcttccccatctgtaaaagggggtgattagattagcgcatttcaatgggattctcagtctgcagtgcctctaactctctggtgagtgtcaggtccaaaggtttccatctgcaaccggtccgttttagggactcagcctcgatgctgggagagacttcttacaggatattctccctagacctttgggctcagtgatttaaactcggtctgaaggtccagatcacacgtggggttgacacggcccaaagagagcccccgagccctcaatggggagtctctgggaccagcaccaaatggtgggaaagcaattcaggcccaagatgacttggaagcagcaggcccagttggcacagaatgccacattctgagtgacagccatcccctctggctgagttcagaggcaggcggtgtgggggatgggggtggctgaggaatgaaaggcagcagcagggctaaaatccagggaggtgggaagtaaggagcgggaatcgggaccagaatctgagaacacagaacaacccacagaagtgaaaacgaaaggcctgattcaagctagggagcaaagcaggaaggaggtggaacctcaatgtcaaatcacactgaaataacggggcagaatttccaagaataaatggttcggctagagtatgtcagattttaaatgattttagatcataattactaatgacagactgaactgtactgcccgtaattagtcatctaagactccaagacagaaaacagaaataaacacagcattcattttttccttaagctgaagcaaaggaatgcctagtgacaaaaggcaccgcatgcttgcatttcagagcctgccctgggcccatgaagcttctgggtctgtggctttagtcctcggtgaggacagggtggcctggtgccatgcctccctggccagcactgagaaaaatgctgcagtggtaggagaaatccaagcaccaagcagaaaatgtctgcagagactatccctgtgccaaatgatgttgttttgagcaggagggttgctggggagaggtgggcaagtaaccaaacaggagtcatgtggatggacggcagaggttcttattcccagggacattccttttactccaaggaggacacagatgctcaagaaggagaaaatattataagctaaaaaagtgcagtttcaaaaggatgtgaggaaatagcttacatcataagaaaacttccagttacctgattctcacctcacacctgttccaccagtacctccccccactcaatcctctccactgggtttgcccctctgatgggatttgacaggcccatctttaattggttattgccatcgctatcacctgcagcctcaaagacaaggtggcaggcactgcaaacccagtgagacccgcatggtctccatatctcctccccagaggagcccgccctccttaaggcagtggtgaaagccatgaaaaggcctcggtgctgtggaaagcaggggaggctgctttcatctaggtttggggtaagggtggaggcaacagaagaaactccctctccccggaccaggatgggaggaagatcctgccttgtaccgacactgtgatcacaatctacagagggaaccgccatatgcagggctgaggctgtgtcccaagtcaccatccagggatgagagtgtgtcccaacagacgactggggagtgactaatagaaactccactagctgagaattcatctgacctgagggaggaggggcctgatgtctagcctagagggcaagctcctctgtggaggagggcaagagagcacagggggtctggcccaggaaaagtgcaaatccttataaatcatcattttggtttctggttgggaactcagtctgtcaagagtgtgattagtgtgagtctgtttctcagagggggatcttgtctgagtgaactgagagaacagaaggaccaggccttggagtcctgtgaagccaacagacacctgagcctagacatgcctgcacctggacacgcctgcgcctggacatgcctacacagggacataacagccctcaggcaggtgcctgccccctgagcctctctcagctgtgattgcccatgtggacagagagcaagcagccagggacacacatgtggccaggggagactctgcaggctccagcagggcactgttccacagtagtctctgtcgaaggatagtgacgcccatgccttccaaatgggatacagagtctgacaaggaagagtatgcctggggtcaacagggctgagtgtatgaacttgggggtggtggtgactccctccaccaagggccctcaagcacaggctctcctccagccttttcccatgttcaggcccggagtcaacactgcagatcagcctggggacccggctgtacccagcacactgagtgagagccccacttacagcctagcagggcctccctgaggtctggcttgtaatacactgacatcccactgtgctggagtgttccattaatcagcctgaccaagcctcgtgatctcatgtcaaatcacatggctgcatcatccaatcctgcctcgaagtcatttcccgcactcatttggtcagcaaaggctgtgccaaggccaagccagcaaacactcaaagcctctgcaccaaggcaggagccctggctggagagaaacagctggttctgatgacctctgctcaaaatccaacactttctatctccgcctaggaacaaatcaccccaggggcctccaccaatgcactctcccacccttttccacctcaaaaccagggccctggctctgcagaaacaggcagcaagtcacactcaaaagcgaagcatcgtgctcgcggccgaccacgcaccgagatatattctcatttcggctcctccaaccagtgaaagtcagtcacgctggtgcagaaagggaagctccatggggccaggagatgactcactcactgtcaaacagacgcaaaggatctcccagcccaggcgcgacctggattacagagaatgacagcgacactcagagctgatatttgcggagtgtgaggcaccctgctaactcatttaacccgcacagcaacaccaccgggcactgttattactcccatttcactgtcgagaaaaatggaagcacagagagatgaagggacttatctcggggtacgcagttagtaagcgacacagctgggactggaacccaggcagctggcgccagcaccgtgctcccgatctttccaccgcctgtcactgaagctctgggttcctaagggaccacaccaacatacgatttcacgactttcttgttctgcttctgctcctaacttacaggtgacctggggcaggtgaccaacagcagggtccccatcagtaaacaagaaagtcccctctcactgtgtactaggagagcacacgcagcagacacgacatatgaggcttcaaagttctttgtagagaaaggtaatccttaagccaagtatcaataattgttgaaagggcttcacacagctatcgaagaagctaaaactatcaagcagctatcgaagagtgtgtgtcaccagacagaagacagagcaaagatcgaagatgaagtgtccagtaggaggcatccagtaggaggcactactttgtcctcggcactgtgagttggaactgcagttatagcgaggaaaggcaagagagaaatgagggcctgtgcacttttcagggtcctctcaacaagcacatggacgcattggaaggctgggcactaaatacttcataagccttgctctagaggaaaaaaaagttattctcctcaatttggaaaacattttttaattatgaaagaaagcaaaatacaattaacagatgaaaaggccttctcactggactatcatgaagttttgtttcctgccagtcattctttctatgtatggaaagaaaactgatacttcggatgaaagagatccacgtctaaagatggccatttgaaagcgggaagggtatttcaagtctatttcatcagcttaattgggcctgggccttatccagaggaacagaagggttcaaaagatgtcttctgaagacgtttctccaagggaaaactgcagatgtgccaatgcgtgagcctgtcctgcctgtctggatcctgggtagccctcactaggctgatggataaactggacagacacacagacaccgagtgccagtttctggaggagccccctgggaagttcatcatcttcatgctgaatctctcctcccacagggacacaaactggaaaacatggtgccaactaagaaaataggagacagcaatttttcccaaatctcaatgaacagatggacaatttaagagacgagagagagagaaaaacaccagtgttttataatttagcaatgccaggcaagccgaagctcacctttttccctcgattccagccctctctgccatacttccagctcatcacgcataatgggatgagatgttttcacacagcaaacaagcatgtaaactggaagacagtttaaagaaagctccgacttcaggcccctctttgaacttcagaagagccaccttctcagagtggtgtcgttagtcagcagtgtcgttagtcagcctttggagctgttaaaacaactgaaaatgtagtcataatccataagacatatccactgcacctcacatcgtggggccatctcccaaacctaccatcaatctgccgcaccttcgggtatttcataagaaaatgcatttttcaaacagctcggccaatctctgcaagtcttctgctactaatgtagtcccttgaaatagaacggcagagccagtcctcaagtttttatatttgatgttattccagatttctgatgtttcagagaacagaagatcatagaggaactcctcaaagacagcctgtgtatgaaacctttagcctgcagccatcttgattgaactaagaggttttcttgtctcacaatccgtccacagaagacaaaagagcacttttgggcccaccatgcccggaacaaaaagcttattctattattagattgaccccttatggtaacctgaaaaatgtgtttttccaccaagcagcgctcctgatccaagctccctgccaaatgcttcccatgctccactccactcccaacccaccacacctaagacccctccagatgaggcacatggcccccagcgtactctttgggccaactgcctcagcccaacccctagccaccgcccgtctctcctccccatcactttccccttctccttggtgagcttcaccagtggtcttttatcactacttccttggggcgggggttggggggcagtgcgtgaaacacagcccctctgccatcttctcacaaagggctgatggctttctgtccctttccaggccctcagccttgccttggaaacttcatttaaggggatggccccttcatgcttttaatctagatttcgtcacttctcagcattggctgtgaaatataatggcctccgtcctagccttggggaatgctcatcctgcaggtggacgcagcagttctcctccttccccactgcagggtgggggctccatctcactgctgtcccgatgctctttccatggttctcagtgcatggtccctctccggctcacggtccctctcagctcacggtccctctccggctcacaggccctctccggctcacggtccctctccggctcacggtccctctcagctcacggtccctctccggctcacaggccctctccgcctcacggtccctctcagctcacggtccctctccggctcacggtctctctcagctcacggtccctctccggctcacggtccctctccggctcacggtccctctccggctcacggtccctctcagctcacggtccctctctggctcatggtccctttcgggctcatggtccctctctggctcacggtccctctcggcccacaggcctcttcaaagcggcctcaccccacttcactccacttgctgtccactccgccaagccctggctgacccctgccatctgcttctgcttcacaccttttctcaacctgtcaaagggactggaggcggacccgagcctcctgctaatattctccagcacacatttgttccctagcaatacttcccatcctggccttatcagctcccctccacgcaaccttcttggctcccttccatgttcttctctctcctgaaagcccttgttcccttcttactttccaacctcacacttgccctcaaaagcccaggctgacgttatcagagggcaaccagatgtcagtgtttgcacagcctgtccctgtcctggtgattttgtccttggcctgggaatgactgtccagggatgctggttctctgctcctctgtccaccatgagccatgcttctctcctctccccaccccagaacatggaataactgctttggaaaaagttgctctatgtttctttaattcattttgcatactgggagctaaaggctttttaacatagcacacgaataaatgtaaatttatacacttatgcaaaaataatacaaaaatatgcctttagattttctggaaaaagtctggtcagtctatgaattcctccccttgtcaacaacattacttggcaactccttatccctctagcatgctgctcccgtaatacctgcccatcctcagcaatctctgcctcccttgtcttgtgctaactcattattgctaataaacacatgatttctctgctcccttctcactacacatgaatttagacacatacatgaaggctaaagctattagaagatcgtccgtttcctctggggttgaatttacatttctcttgtcaagtctgacctctgatttactgttcatgaatactaaagtcactcttgctttttaacaatactaacaggtttgcatttctgcttaagccatagccctcctgcaagctgctgatctggcacctgctgccacttacaactcctggcataactgttctctgccgtcacatcagccacctgaccaccacctgtgacacagacaatgaggcttccttctccctaacagcccccactgactgcttgtcccctggctccttgccttcctctctgagcatcagggctgctgcaagcacactttctaccctctcccatgatccacgacctgtctcccagttggctccttcccttggagcctccgtagttggctctttgatgctccctagggctctgttctttaaactccttctagtcttgaccttctgaccctggcctccctggcctccccctcgccgctctccctgtgtgccaggcaactgtcaacgctcagctctgtttccgccactctccgccacacaggtcggggccctgcctcctccctggggcttgacctggtaagacagcctctcatctccctgctgacaccttcctcttaactcaggggcttgcaaaccaatccaccttccgtgagggtagagacagaaccttttgtgacttagcaagagatgtcagttcttgggtttaatctgtctgcatgttgtattggcgcggttatcctcatttatatagctgaggaaaatgaggcaccaagagggtgaataacctgtccaaggccccacagcgaatggggccagagctgtgattctaacccaggccagcctggctccagggcctcctcctgggcctctagggtatacgtgaagacccccttcctcccttcctccatcgaagggcacagaaacacagcttccctgtgtagcttgtagggaagaggacagagagggagtgtgatgtctcagggctgaagagcctgtggggtccatgggctgcccctccacaggcaccagagggtcctgcagcaccagtgggaggggggcctgcccttggctgcatggggctccccctggctgtgggctgggctcctggggacaggctggggagaacacaggccaggtgcatcatttagaaaatcaccaagaaggcgtgctcaagctaccttcgggagccacactgatcagtcactgggcaaagtttctgactgcgagactctaaactcctcaaatctgtagtctcgctcttctcatcctgcctccaatctggatggtttttcaatatctcaggatccacggagagaggttttaatagtttattatgatgacccctctctactggcaagatctccaaagcagctcatgtctctgagcctagtaaggctcagtcattgccgatggacccagcaggcggggctcaccatggccctagtctcactcaccagctccctcgtgctgggtcaactgcttgctcctttcagaaaggaaagtgcctggcatgtgtcaggcatctcaggtgtcttgaaaagctccaaaggtgaaacagaaaactctcccggtgcgattttcctatttgatcttttgtctcatgtgttccccttggggatgaacaagaaatacttccctgaataattcatagtccccgagatggaaacatgcagcctctttttaataaaaaggctgggacatggcggggattgtacgtcttctagatgctctcagcaaaagcacagagatctgacaagctctttacaaattcctcttctaatagtgagaaaaaaattaaaagccatgtagtatttttaatcaaacagactaacatttggataatatgtaaaattatttataaatctgtttggggccacagaagactcacaaagggaagttggaaaaaattaagtagctgtaattatggtaaggtttgatttctttttaaaactgaaaatgactgtcttcagtttcctatttcatgagcacctactaggtgccaggaactctgctaagattattatgtaaatcatttcattctttctcacaacatcccactggggtaggagcccaattcacctaaacacaacaaggtgcctaaaggttaagtgacaagtccgagcttccccaggagtcaggaccagggcttagttcgagtgcagatgtaacttgtaagcagacactctttccatggggcctaattcccagtgcatcagcattcttctgctggaaaccagcagttagtgcccagcccctttctacattttgcaacattactatgagaaatggcaagataatgaaggctttgggatgctttggggaacattttacttattagttacaaaaccacatcctattagtcttggacagacacagcctgtctagtcaaatgccttcattttgcagaaaggacactgaggtgctgagagcttaggggcctttcctgaggttaaagagcaagcagctgatgtcgctgggaccagaactgtgtcctcagactccctgtccagtgctcactcttccatatcacacaccaccatctggttatgggtgctaagcctccacgggtgcggacacgaagggccctgagctttataataaaaggctcttctttcctgcggttcatgacatcagcgatgtctactgctaaaaatgaaacaacaattcagaaccaaagcccagcatgcaggcccagggaacgtggcacggcttttcacaagctcctcagaccctggtaacttgtgagtttcaattcagaccctcgcaggaagatgacagaggactgccgaggcagctgcactaacacacgttcataacggacagaaccctcctgagcgagcagtgtccccacctaactgaaaccgacacggccaggtggccggctccagggtctctcaagaatgatccatggcaaggggtgggagcagcagggcaaccccaggcttttggcccaggctgtagacgaaggatgtgcactcgttgagcgccgccacacccctgtgcagtgtggacactagggtgactcatctgcctcccacctctcagggcaacatggccagacacccccgctggtaggatgctccctcccagccaatggcctcagagacatgctggagtctcaggctcccttaaggcaagagagtctcccagtttgtaaagtgttctgactgtcatcctgaagtctccccgggatgtggaaacccccgaaggtggctactgcaagcagcacagaggctgagatgacagtgacaatgccccacggccacaagaatgtctttatcaaacccagagccacagggtggcttagactgctggccaggagaccacagcacctaacaggatgtcgggtagggctgctgaggctatacacagccaactctgggggtgccatttgcataaactatggtagaaacggtgccctctggcttcaggccatgtgacagcctggcaagctaactgcatggggcctttggaagcagaagagggtgtgagggtcatgtgctacctgccgcttccaagggctgtccccatgccagagtaggggccaccgccgggctcgtggactcaccagtcgctgcatgctcttcacgtgggtggggctgatggctaaggcctcttcataccaccgccgcgcctcgtccatgcttccccggagctcagcaatctggccgcgcatgtagaggacattgtgggacattgggaagaggttggcagcttcttgggtacaggctgtggcttctgcaggcttcccgatgccgatatagacttcagctgtgaggagacagcaacggcacatgctttcctggtgcccctctgaggccctgcgagcagccaccactctgatgttcgtgttccctgcacgggagtctggcggggcgcagagccagctgatccctgctccaagtggaaacagctgccgctgacagtccctcctgcccactcctatatggggactggagtcactcgtgttgtgggccttgcagggcaggcataggtcaccaccaggcagggagcagtgaggcctgcctggtccctgccccaacctctgagggcacccaccctcagggcccacccggggctcctcagtgtctggacagaggctggcccggtccaacccttggctctgacccccatagaaaaagggccagaatgaacaagggcacaagcagaccagaggcacccagaccctcagagggcaacggctctgccctctgacccactctcctgatgccaagaagtatgatggggctgcaggctgcagctatcatgttcacaggcgtgatgcaagatggctgccccgccacacctggcccctgagctcacctctgaccaggggaagttgatgcaccctgtaaactcttatctgtgtcacagtgacaaagccctttgacaagccaagctatcgcttttaaaacaagcaggaaaatgaccctgctaccgatccaggcctcaactctctcacctccatgtggagccaaacccctctgcagccctggcctccctgaagagcccttttgagtgtttccaagggcggcctccctgcctcccaggtgcacacttgtcgaatatccagggggaacgtgtcaactggccccgagggcctcttctcctgaggccttgccaattgaggcaccaccatctttctagtcagctgggcctgaggcttcagggacatctgaatcaccccccacccctctccagggccagcagggccacatggtcaagtctgcagcccagagcctcacgcagaggccgcccgctctgtcggggctcatggaccccttctcccacctgcaggccagacccttcctcagcactcttgccttgaccactggcgtatcctgcagtaaaagaggtttgcacccctatctcccagttatgtgtatgtttgtatgaattaatatcttacatgtcatatgatccacaacagcacacaaaatagaaagttaaaagaacaaaaataaaaaaagaaagtttaggcaagttgcggtggcttgtgcctgtaatcctagtactttgggaggccgaggcgggcggatagcttgaggtcaggagttcgaaaccagcctggccaacatggggaaaccccgtctctaccaaaaatacaaaaaattagccgggcgtggtgttgcacacctgtaatcccaactactagggaggctgaggcaagagaatcacttgaacctgggaggtggaggttgcagtgagccaagatcatgccagcctgggtgacagagtgagactccgtctgaaaaacaaaacaaaacaaaaaacaccaaacaacaacaacaacgaaaaaaacaagaaagttttactattttctttgtgcaccttaccctgtcatcccctggagcccactttggaaactgcctcaattatgcagagactcccctccctgcctcctgccctggccatgagcctgtcctccacagctgctgccaggttaaccctgaggccaacctctggggcggcagccacctgctccgaagccctccttcttccctggggcctgtggcttccgcgcctgcccaacaggcagccaggccgaggccctgtgctctgattttctgcacccaccggaatatgggctgtaagcgacatgagggcagggatggtgtctgtgctgctccctgctgcgtccccagggactagaacagtgcctggcacatagtcagagctcactgaatcgctgaatggatgaaaggtaactaacaacagcagtagctgacacttattaaacatgtgctttgtacctagaggccttctcagttctcattttatctacatggtgatccagtaggtactattattttatccccattgtccaaatgaggaaactgaggtgcagaaagcgtgaacaccctgcccaagttctcagggcaaactggaggcagagctgggattagaaccccagccacctggctgggagcctgtgcttgcagcccccacagagaacagcatctcctctggcccagggtgatatccgactcctctgcagccctcgggagcttggcacactgcccttatctgcttcctaccgcctcccggaacccccgggctctggccttgctagtgctgcttctgcacacacagtgggtgtccctgtctccacacttgtgtcaattctatggcctgtgcctgtaaagccatcactgcagcctccttcagggcccagatggatcccgccatcccagggagctctctgaccacccgcctcagctgaaaggaaagcccagcctctgcagctcctgatagccaggtccctgtaagtatttttgtgaggtcttgggtatgccagggatagccctggcaggcgctggggcagatccatctttctggctcccagcttcaggcctgggggcggggaaatggctggtgtgtatctcatggctgtggttagtggcgatgctgctgacctttgacctcaatcagcctggccggtccctccctcgaacatctcactttcctggtgatatttgtaccaacgactgactccccaggccttctctccccaagagaaggccctggaagaagcgggcctcgcctggcccagatgcacacagtgccttctgtctgtacttgtgcctgccagtccctcctcgctagagataacggggcccaggggcttgtggaggggcatactgggtgactcctgcagacacagaaactcgagcaattccagcaccatgcactgagccctgaaggtgaccgcccagccatgcctgcctcctggtctcagaagactcaactcagaaggtaactcctgaacttctatactcacaggggactctatagggacaaagaagacatttctctgtcctttagtttggaccaggcaaaacctctcccttctgggagacaaacaccctcctaatgacaccatcgggctgtctgatgcctttcagtaacacaattccctcaacgccctcaccaaagagtcaaatgtgtgcccactgaggttttggttctcgagtgcagtggcaacacaggggagcaggacagagcgtccctctcattgcacgcctggctcctgcctcactgccaagctgggagtgagttcacttccaagatcccagtcctggagatgctgtgggctggtgaggccgcccagcctctcccagttagagcattatgaacaaaggctgacataggagagcagggatgaacatgtccagaacaagaatcaatgtggagaaagccataaatgccaataagactgtgtgcatgtcattcctgctctccaggggtcctccatgagaccaaatgtgattccaagtatctcactggtcgccaagcctgcctaagcctcaggcctgatgttctcgctcccttcacgtgatggggaaatgggagacacagacggaacgaagtcaggatcatgacggtaagggaaagaatccagcccccatggcacttttcagtgctgtggaagttgctggaggaaacctatggctctgataaggcctgtgaccctgacagatgtgacagcaaaatgcacggcctagggttactcccaaatccctccgttttcagctcaaaaggaaagactgaaggcatgatgtcctgcagtgattttcaaaccatttttgccagtgaaggctgtttcttccaaagggatcttaccccaggatacaaaagactcctgagagtgggcagtgtggctccctcttgtttgcccccctctctctgcctctgaggcgccactgggaacactagggtttccaatttgcaagccacagtgtcatgagaacatggagaacttggttcttggccctgcgcctcatgtgtggccttgggcaagtcaatcaccttctctgggcctgtccacctgtcaggtggggggcctgtgcctagcccatagctctcccagggcagtggcaggcatcagacaacacaggagtggcagggatcaagacaaggccgtgccaagggatcaaccctaggctgagcattttcctgccacatccatcaggagcacaggccttataccagtgccacaggtttcctccagcaacttccattcaccagaaagcctggagcccaaagcgagtcacaaatggtgagggtaagtaactctcagtcaagcctaagctctcttggagaccgcagggtgaggaagctgaggtgcaaagagacaactggactcatttgagccccgcagctctattttgccaggtcagagtatttgggggatccaggtctagcctttccatttcaccatggccccttaagacaatgactctgaatagccattccctctctaagaggaaattacacttgcatggggcacaacgtcttaggctccaggaatgaagctttagtggtggggtttcagacaccaatcaggtagtttgagatggagttggagataaaaaggaaaggatttctaaggtctcccaccacccgtgagatcaccccaggatgtagccttctttgcctaggcatgtggctgggcctctaggacagaacgaggccacaagtattgattatgaacctgcactacttgaaaagccttctttcctgggagtccatagcccaaataaggaccacatattccacccaacctccccagtagcagaggtggggatttgatctccatctgcctccctcatcttcactggttgggaactcaggaagaaaagaatatcatttatactttcccaaagcccctcacatagaaacagtatggctttctcgctaaactgtagacaactcctagccacagtcatttctgtatccctcagcagaggatctacaggctggtcccctaggacacaacttagtaggtgctcaagaaaagtctgcagattactgaatgctgggtgtgggtcagagcagggcagccatttctgtggcacagatcaacaaggacaggtgaaggccagggaagcaacagcaaatgaaatctccctttcctttcaccaaggagtgaattcaatttaaaaaaataaagggccttgtaagcttattaagagatacaagaactggtaccaaaggaacagcagcacagtgaaatgggctctgggaactcaacgccatcagctgccaacaagaacacacttcagcgcaaggtcagtgctccagctgcagggcagggtctggaaggtcactctctgaagaggttccagggacagatattctgtcctggccgctggtggctgactgcctctcaccaaaggcaaggggcgtggatacttcctaccttattttgagagctccataagctctgaatgttctcttaggaacccttggtttgtccctgctattgggttactatgaaaaatgtggataaaatctccccaccgtgtacaaagcttatttggcatgaacataacccaaatgcttttgcttggcatttaaaattcaaaatcagggccctgccgcctttccaacctcctcttttgcctcaaatgcctttcagcttcactctgcccaggaccccccagaaacccagggcaagcacttttcacctttccattcttcctccaccctgcgtgtgctctgggacacccctcgacctcatctgccctgtcacagtgagccgcaagtgtgccaaccctcctgcagggctgggtcaagcctgttccttcctcgcaccctaactctgccttgcgcacagagggcttcctggaatggtttgttgaaccagactggagacgtgatcctaaaagggcaagctactctgtgaaggtttctctctcaaggtgaagtggtgttcctggctgggggacctggtgctagatgcacccagaacctcacgcaggtctagtttcctcgttcattcattcattcattcatcaaatgcttgtcaagcccctgcttcatgtcagctgcaaggggcttgccctgggcttggctgtgcggggtgtgcacaggcactgggctgaggaggctgacaaccagcctgggccccactgcaggctgtgtgcctggacagggctgcaccagcctggaggaatgcaaggaagccctttccttctcacaaagttgtcctccactagccaaggctgctctctctgggggcttagtctattcagaagggacatctttcggaaacgcacacaaaggagcagtctaggctggaggcagccctcagaacggccccgagatcttctacctcacctgcgcctggcagagaaacgtgacggaaaggacgcatggcagtaggtacctcccgacctcgcagctcaagccggcagcctccctgacccctccaaaccatgtcctttacccctgaccctgcctccctaaagagagatgctgtggagggcagaggggtcccacctgatcgcagggtgtctgctagcacagagggtgctcctggagcccaccttctttttcacataaaaatcagcacaagggccaagcagaaagggatcctgtgtcctgatgggtctcctgtcacccttccaagccctcaaggcctagagaggccttcagctctgtcggctctcactggacttagccttaattctttctttgtctgagaagggttagcaagtggaaggaggcagtgattttgtcttcaagtgccgtcctaccctgagcttccctcggccaggccccatgctgggatctgaagtccccaaattgagcacagcccaggctctggcctcattgaaggcccagccaaatgtctttgccagggtcgggctgtgcaactgccattagtctctgagtctgcatctggctgtgtcagtttgtcgagagggatcccttctccaggggctccgtggcacagcaggatgagctcctcctcccctagctgcagcagtgacaggcgctagcccttcctggcctcagccccgctgttctgactcctgacccatcccctccgctgccttgacacatcattcagagagaagtcagaagccagccaagtggaccccgagcctcttctggccaccaaaccaacaactcatctgtgtcctctgttccatccactctgtgtctcttctgacttcgtcactgagagccctctgcctgtgccctggaccccaccacactcttgctggaggaattcatttcacctccacacatcccccctctcttttggatgccgagggcctcatttttacctgatcatccctgtgggcaatcaacgtgctccaatgggcttcagcctcctcagtccctacgcagctccgcacatccaatcaacatgctccaacgggtttcagcccccttcaagccccaggctcccaatcacatccctcattgctgctccagagggattcttcttgcaagaactgtgcaccttctgtgccttaacttcctcacttgccatttgctctgcaacccacaccagatggcatccatctccaccacgccactaaatccagtctcgttaccaacactcccatacatcaggtccagcaaatgcttttgtcgctacattcccaacctctcagcggcactgcccaccggccacatcctccttaaaaatcgttattttagtagttgttatgtgtttgctgttatgtggttgtcctaactctcttcatttaatagaagacatagaggctcagtgggagtgggaatagcttgcccaggtattactgctagtgtgtggcggggccagggttgtaactgatgagccagacccaggttctcgccttcaccgcatgggctccttcctgcccccctggctgccgcgatgccgtctgcgctgctttcctcccgccttgccgaccactccccttcagatgctgtggctcttcctctgctcctcaatctttttttcttttttcaaggtggagtttcgctcttgttgctcaggctggagtgcagtggtgcgatctcggctcattgcaatctccacctcccaggttcaagcgattctcctgcctcagcctcccgagtagctgggattacaggtgcctgccaccacacctggctacttttgtatttttagtagagacggggtttcaccatgttggccaggctggtcttgaactcctgacctcaggtgattgacccgcctcagccttccaaactgctgggattacaggcatgagccactgcacccggctgttccccaagctttaaatgtggaggggctcagtctcagtctggccctttcacttctccacctacattctcttcttaggccgtcttagcacctatcttaggcctttaaagggggctttaaatcccaactcttaaaggtatgtttccagcccagttctgaaatgtagaccggaacatccagccgcctgcctggcatcctgacttccttgtcctcaggcacccgacacttccaagctcaagtgggactctgaagtctctgcctccctgactccaactcatcagttcttccccaggcttcctcattgcagcaaatggtgtcaccagtcacccacagactcaagccccacactcaggtttccttctgtattcctccttttccttcacccctcaacatccaacctacaacaagtcccatcagttctgcctcagaaggcatctcagggtcccctcctcttcatctccattgagaccacagaccaagctgctgtcctctaccacctggaccaatgctcccaatttcctgctctgccggcgtccactttgactgccttccatccattctccacatttagctggagtgattttttttccggagaggggtcttgctatgttgcccaggccggactcaggcaatcctcccacctcagcctcctgagtagtgcccagcttggagtgatcttttgaaagtggtcctttcatgctcctgcttcaagtccctcagtagctttccaatgattttaggattaactaaaatatcttaacatggctgccaggggtgctggcatgacttgagcctgggcccttctcctggctccccttggctgctttactgcttactcctcagggttcatgccccaggggccagtattcctctaacactcagagctcaggctgcccccaggtcttcccacatgctgttctatgcctccatcgtccctgacctggtgctagtcactgctgaggtcactgcccaagtgtgtgcaggccccctctggctcccctggttgggggaggccttgtgttatgaggggtcgcaggggcctacagtgctccccccagcacttggcacagggagttaagtgcttctgtcattgttctgttccacatctgcaaatgccatgaaggccaggagctgtgtctgtcttcataaccataggactccagtgcctcgctccactgtggcaggtggagatgctggacgatactgtgttgacaactgagtgcctactgtgggttggagctagggttctggggccacactgcttgggtttagattgtggctttctaactctttagccacgtaaccttcggcaagtgacctgatagctgtgtctcagtttcttcacctatggaatggggtgaatacgggtatttatacctcataaggttattatgaggactgaacaaattaagacatattaaagtccttggaatagcatctgacacatctacagtgtgtggtaaacgttagctggacgggcttgaccctcagggacgtcgtgttccctctcacaggcgctccctgtacagtgactgcacacaccacctgtctgggaactgtcttcatctcgtcacgaatggggcaaggctacgggattaccccttgaccctgctgatgcaacctctggtgcctgggaggagtctgggcaaaggcgccaggccaggccaggccaggccagggccaaggaatttgtgagagtattacagccttaaatttccagcagaaatcagaaaatctgatcttgcatatctaagaatagccgctggtttcaaccatgagaggtgccaaagtgaaagctgtaattattagtaagtaacaagcagaaattaaccacctaccgcaaagtcatttttagctgccatcccaaggtggaaattgaaaaatgggcaccaagaagctgtttggtttggaaaagaccctggctcagtgctgaagggctgtggacatgcgaatttccaatgccagcagtaaggtgtgcactcaaggaagatgaggaatggctcctgaggaaccatgtcttgaggtgccacatcccatgctctaatggggctctcctgacttctgcatagtgagactgcaaaggtgctcacttctatccagcctgggctcccacattgtaaaaatggagaaaataacctttctctgactttctttacagaatagtatatagacaaatggcactggaacatacctggaacttttaggaaaagaaaccataaacatgaatagttgctttccaaatatcatgggaggcacagatgccgtaagaaaaaattgataaatttattttaaaaaacggcaaaagacaaacaaaaactaaaaaaaaaaaaaaaaaaaacccttggaagatgtttacagcacctatttcagagacaaggcagatttctttgacacacaataagtgcttagaaataaaaaggaaaagctcagtatctaagaagataaatggtcaaaagctacggacagaaaactgaaataccattttctacttgtcagactggaaagatcaaggattctgagaattcattgtgttggcaagggcgtgagaaagtggacgttagcacattgttgactggaatgtaaactggtacaattctgtggaaggcaatggacaaaacttatcaaaattaaagagtacacaccccttcatccatcacttccactgtttagagtttatcttacagataaaaaaaaatacacagtcagccctcagtatccatggggaattggttctgggacctcccttgaataccaaaatccatggatgttctagtccctgatatgaaatggtgcaggatttgcacatcctcctgtgtattttaaattatcctatgcacatcctcctgtgtgttttaaatcatctctagattacttaaaatacctaatacaatgtaaatgctatttaaatagttcttatactgtattgtttagggaataatgacaagaagacaaagtttgtacttgttcagtacagacagatttttttcagatatttttaatgcaaggttggttaaatccgtgggtgcagaacctgagaatgtaaagggtagactgtgtatagggatacttattgaagcattatctgtaatggcaaaatactagagtgggggagctcaaaccacataaggtaaaacccgacagtgcggtgaaagctgttttcttctaaatttacctcttaaaaggctatgtgaaggtatgatatgattctacatcttgactcaagcaaaatcgttgctttgaaagagtcaacatggcacaaattgccataataagctaaatgttatcagctgaatttaagattaaaatctaaatgttaatcagtagagtattggttaaatgatggtctaaccatacagtagacatactctgtagctgtgacaaagtataagtcaccttacaggtgctgatgtgcactgacctaccaggtggcacattcagggggtggtgggggacaaagtacagcatgtgagatttctggaagatgcacagaaccggtgacagtggttgcctgtggtgggggtgactgaggctcagggataagagggagccttttcactttgtggcttttcaattgtgtgccatggacctatggaagggagcacctatcatacagaaagtggggacctgctgtgggcaagcatccctcatctcctgggcctgtccccttacaaagcagctggcggcacaggtgtcctattcactatctccttgtcatatacatgcacagacaagtggcctagggaccctctgctacaatagatttctctgctggaaatccaaggtcatctccgagtgacctttcctgcaagcctcaaatctgggtccacctccactgtgggctcccatcacgagctcccactgtactcagttcaccagaaaaaaccaccaggagagaacaggcccacaaatgtcactcagacaccatggctttgggtgtcaggccttgatctaactaatttcttctaaagcttacaaaacttatgggctctggcagtattgtgggagctgatgatggacacaggaaacagaggttacctggtttccatgaactgccaaaaaattgagtcacatttattttgcctctcagagcagtggagctcaaatcacataaggtaaaatctggcagtgcagtggaaactgtcttctaaattttcctcttgaaggactatgtgaatatatgatacgattctaaatcttgactcaagcaaagtcattgctttgaaacagtcgatatggcacaaattccaaaaagatcctaattgacttcattcattcgtcctacacacaatgctcaccgtatgcatacagcacagtctgctcagggtttacagggtcgacagtcactttccatagttcaattccaccaccttctagaatagtaaagccacacccatttgctaggaaggagaacttgactctgtcctatgggccatgcaatgagaaacggatcttgtgtgattatattaaaattcaaggacagctccaagaaggctgggcacggtgcctcacacctgtaatcctagcactttaggaggctgaggcaggcagatcacctgaggtcaggagttcgagaccaagcctggccaacatggtgaaaccctgtctcttctaaaaatacaaaaatcagtggagcatggtggcaggcacctgtaatcccagctatttgggaggctgaggcaggagaattgcttgaacccagcaggcagaggttgcagtaagctgagatcacaccgttgtactccagcctgggccaaagagtgagactccaaccccccgaaaaaataaaatgaaaggatagctccaagctgaatcttaaccattaagttcttcaatattctaataatcagctacaaaatttcctccccaacagtcacggcaggccacgcaaagtggggcaaagtctctggataactgaattgggggcagcaaggcaccagacagagctctcctggaatatgttgactttcaggtcattaagttttctgagaaacaagcaagagaagcaccaccttcgaggtcaggggggctagttccaccctggagggatggccttcagcccttctagtgttttagactccagctcttcagaaacccaactttgagaccaatttaaaaggcaactctgcccctacaccagccccacaagttcaggtttacctggcctggacactaaaccatactccttccctttctgttctctgtagttgttgttcatgggggtaactgactaggacagccatcagagttctcagccaggaactggacttttgcataagggagctgtggaggaggcgttactgctactccttggccctcagagccagaatgtctgggacctctctaagcaagaggccaaatgctgcaggcgtctgcagcagagaagaacaactgtgaattcatgaatcacccctcttttgtacttctgcttagaagaatataatttgttaatttacggtagtcattatggtgcaattgaagatgccaacacagaaaaggctgactgagctgggctctgcggcatgccaaggccaggtaaatccaaacatgttttcaatgcgaaggcctgccagtggtgtcaaacagggtggaatatcatacgattagccttggcaaaaaaggagtcaacagagggacaattggtggataataagcacccttctcagccaaatgtgggctttcaccacacactgtaagagtcaagcctgagaagacccaggtagggctatacagatgaagtgatgaaacctgaggaggggaattaccttttatgttgaaatataaatatgtaagtaaatccacagccattatttcttggaagcgcagtgtagtgggattctcgttattaaaatgcctgcacaggccaggcgcggtggctcacgcctgtaatcccagcaatttgggaggccaaggtggacggatcacctgaggtcaggagttcgagaccagcctggccaagatggtgaaaccccgtctctactaaaaacacaaaaattagctgggcgtggtggtgggcgcctgtaattccagctacttgggaggctgaggcaggagaatcgcttgaacctgggaggcagaggttgcagtgagccgagattgcaccactgcactccagcctgggtgacagaacaagactctgtctcaaaaaaaaaaaaaagcctggacactgcatttatttttgggctttttagtggtgcagaagcatcgctgagccagcagagtgccctgggaactggggaaggggcactcatgccccccttccgggccagtctccaggtcagaggctgttgctgtctctctatgaaattacagagagagccatcagagaggggcagaggagcataggatcatagggcaccaaacacacagccccttccctggctttataaagacatctgtgtccttaacacctcctggccctctctcagggactccaagaattcactgtcaagatgtgccaggcattgcactcatcaaccctgggagatgggtgctattcctaagcccatcatacagaattggaaactgaggctgagctaaatactttaactcaaatctacccagttggtacagctatgactccaagtcactcacaaagacagtctctacagcacagaccctgcaccccacatggcaaactccccaagaatccttagagtcaatccagaaaactttcctagatgtctgctctgtgccagggcaccgaggcaggggagagggatcgggggatacagagtcacttgcggtttgtgcaaagtagtagtaacattttggtgcatggccgtgaagctttgatctctcctaatgaggggtgtgggctaaacagacaagcgcccaggctctggcacagcagcgggttgtgggtggggcggagcccaggctctggcacagcagcgggttgtgggtgaggcggagggtacctgcatggagccagatctgtgccagcgtcatccaggggtgcagcgggccctgcttaggggcactgctctgcagagacgaagccacttccgacagtgcctgctccactcttgaggctgctaccgatgtggcatggacggagcctgtgagaggtttttgagaagactctatcaggagcgaaagaacagacccaaccaatcaaccccttcccacacagacaagcgcggaacacacacaccccttcccccatgatgtttctaagatttactgtccacagagaaacgcgggcaatcacggcccggggccttagtttccatccttgggctttagctaatctttttgtcaacaaacagagcacatgccccctccaggagctcagcctagcggtgtgagtgctggcagatggggggccagatacacagctgtgatgatactggcgtttaaaaatcaaataaatgaagtgctataaggggacattacaaagcgcccctgtaagggcctaaacctagaaacttaatcagggtggggggaggaatatacttgcctcctggggtagcatttggagtagatgtactggccattctcaagacaaacccagcaacttcccgtttcattagtgcaagcctggccttggagaggtggactacaccctcggtttagaaccatattctaaggcatgacttaaaaactgcagaaaaaagcacacttttgccctgtgtataagcagatgtctatccttaaggctagactagcaggggatgggatggaatgggtttgtagcaaagactcctggggttcagaatatgcacctgcctaattattctgtaaaacctgctgtcctgaaaggctaaggagaggggtcaaccaagcatgttcactagtcaagggttgggggagtgcacaagtcaaaatgcaaaactcatttcttttcacgttgacctctcggaggatcggagaccacctccttaaacagaggcttgcttcccatctctttccaacattcactcttggagatgtggttttagaatcaagagcaggattctcttgatttcaagagagcagttgtttcaaatttgaaactgttaatatttctattcacctgcatcattcttaatgatccatcaaacttcatcaaaaagtttagtatggagataaacataccaacattgagagtggtaactaccaactcatcataaagtttaaaatagtaataatctataaagataaatgcgactacaaaataaatggagttatattcttggtaatacaaaattgtgagcataaaaataatttcagttgcgctttggaatgtacccatcatctataaatttaaagagtattcacggcaatagatgcgccatccatattatgttttgattgctccaatataatggtaacatggatgcttctaaatgcacctgaatcctttggtgaggggttggtggatggaaatcagagtgggccgacagtgcccacaaggacgaccaagaggagagcagcctctggaaaggtctaacaagtcctgctgcacaatacggaactcagaggctgagttaaaagagtctagtggccgggcgcggtggctcacgcctataatcccagcactttgggaggccgaggcgggcagatcaggaggtcaggagatcgagaccatcttggctaacatggtgaaaccctgtctctactaaaaatacaaaaaattagccaggcgcggtggcaggtgcctgtaatcccagctactcaggaggctgaggcaggagaattgcttgaacccaggaggcagagcttgcagtgagccgaggtcgctccattgcactccagcctgggtgacagagtgagactctgtctcaaaaaaataaataaatgcataaataaataaataattaaaaaagagtctaattgatggtatatgaagggggaacctaagaagtgtgctaagaatctatccttgtttagacaaagtatgtctaactactattttttaaaaatctacatagcaaaatgattaaactgctgtcaaaatttcttatttgtcaccttttttatggaaagtaatattttgaactttgataacaaggacttgatgtagtttccctgagatttttagtagcaatgaaagttaaataaatgagtaatctagaggctgttgttgccctattccgccattaccaagttggctaccttctcattggcttgaacagtggttctcaaccttaacttcacatcaaaatcattcgggatttaaaaaatcatgatgttatagctacatcccagaccgaccacatcactcagtctaggggtgaggactggcatctttgttaatcaccccaagtgattccaatgtgccgctaagactgagaaccactcgcttggagagaccggaagcaaatgttaacgaatatttggtcaaaaaaagcctgtacacgggccaggcagcctgagctctcctgcttccctgcagcacaagcgtcacctggggaacagagttccaggaagatcttgttctctagaacaggggttcttagactttttggtctcagaatctcttcagactctaaaaaaatcattgaagaccctaaagaggttgtttatatgttatgtctattgatattcacattagaagtaaaaacatgttttttttaacatgttttaacagacatgtttaaaatattcacttactaattcattaaaaataacaataataaattattgctctggaaacattccacacattttctaccaggttctgtgaatcttttgctacaagagtttgtgacttttggaggggctaattttggtttttggattaactgttttgtttggtccacaaataaataatcagaactactgccaaagtttcttctctttgtggtatttatacacaactaaatcaattaattcctagcacaatatattttactatgaataaggtctggcagatgatgatgatgatggcgatgatgatgacagcagtggtggttgtcagttttagagaacataccatgtttcaggcactgcaattggcactttatatgtactaatctttaaccagaacacaaacactagtctgattccaaatctgtcctctaagtccagctctgatgccacctcctacaggaaggctgctgtgagccttccatttctccctacaataagtgagactctctggtccttggtgcttctatgtggttgtcactaacaatgcacagaccacatgttttaaagttaatgtaactatctcccttattagaccgtgtgggtctagaagatgcgaactacgtcctcagggtagggattttcagggactaacaataccaggcccatactaagtattaggtaaatgagtgtgcagggaatgaacgagtgctgtcaatagacacttcactgtctgaaattcagaagagggcggccccctctctggatgcacgtgtgctctactcttcccctctaacaacagctcagaggccagaacattcacccactcaaaggacacttcagtgcagtgctcatcacttccaacaatccagactaaaaatgacagtggtgaatagttccaattaaacatggacgtttcccctaacgtaaaattaaaatatagagaaggataacaggtttattagaaataatgtttttcttcctagtcaatttcttggtacacacatttcaccagggcagagagccttcatattctgaaccagggataaatgttagggcactcacataataatagcacataactaacaatagtgaaattatataagttggtatctactattcctgaaaataacacaacaaataaaagtcttccattgaattagtattggaaggagggggaaggaaaaacatcactttaatcagaatggatacagctggttaaaaaacaaaccaagcaggccaggcgcggtggctcatgcctgtaaccccagcaccgtgggaggctgaggcaggcggatcacctgaggtcaggagtttgagaccagcctggtcaacatagtgaaaccctgtctctactaaaaatacaaaaagtagcggggcatggtggtgcacacctgtaatcccagctactcaggaggctgaggcaggagaactgcttgaaccccagaggtggaggttgcagtgagctgagactgcgccattgcactccagcctgggcaacaagagtgagattccatctaaaaaaaaaaacaaaacaacaacaacaaaaaaaaccctgtactgtattttattgtttcatagaactgaaatggtaagtgactatatagacactggattttgacttatataggtaaacagctggaaacactggctctaaccagcacatttttaaagaacccctttctttctcaccacggcaaacatgttcctgcatcgtacatcagaatgagagcactattaacttaaggtggaaatgggcaaactgaggcttgaaaaaggaatcagaagttagaatataggacatatttccaatttgaaatccaaggctctgcagaaataagtttccaaataatcaggttcaacaggtaagccagggagagcacctgggccatggtgcatctctcatctgccacccagcttcaagaggtcccgccactgccagagcccacaggactgtgtgctgcgcagcggctgccgtgctccgtctaggagacaatgcgcctctccccgcagtcacaggacacaggggctctgaaaagccactgcaagacccactgtaccaagggctgacgtaggcaggtgagagctcgctctgaaatctagcacaggtctgtcgtcaaacggcccgaatggtgcaagggcgtgtgacgtcctggagcggaggccatctgcatttccacaagccaatggctttccttgccctcccacctagatcctcaatcgaaaatgttatcttggacacctgatacagaggcaaagtgccacctgaagaacattctgagccagggtttccttctaggctcctctctccatcaccatgcatgggggtaaggaggggggaaggcagccgaggacctagaaactgtgatgggaaggcatttcctcacgggccaagaggaccaggaaccaagaggaaccaaggccactgatctcagggcaccatgagtccaagctctgaacccttcctgaggttttctgacccgtgctcctattgtacactgagggctgttgagaaaccctgcctgccccaagtaggacactgggacggctagctcatattgcctttgcaggtgaagcttttccaaaaatcctttttccaatgcacatgacacctatggtgaatttcacatagacctcagctgtggcaatcacatgtgagccctcttccaccaaagttcatcatccaaagggatcccagcaccaataattctgttaagaaaaggcacaggctgggcgtggtggctcacgcctgtaatcccagcactttgggaggctgaggcgggtggatcacttgaggtcaggagtctgagaccaggctggccaacatggtgaaaccctgtctctactaaaaatacaaaaaaaattagccgggcctggtggcgggtgcctgtaatcccagctactcgggaggctgaggcaggagaatcggttgaacccaggaggtggaggttgcagtgagctgagatggcactccagcctgggtgacagagcgagattctgtctcaaacaaaaaaagagaagaaaaagacaaaggaaaaagcataactgataaattaagtggcttagttatgcttcatatccctgtatttgtcacacgcaagtgttgccgaataaataggatatattatattccagctctccttctaactgtctggtggcctcagttaagtggctgcagtctgaaggacccctcgccttccctctcccctcacagcacatagaagatgagctggatctctctcagatggaatcctgcccacccggtgacttggcgagcattccagtgccaggaacgacggacagccacattacatgacgtgtgaaaaacatcctctaccaaaagatgtcagccgaccacctcacatgaggctggcaggatttggggcagctccttgcttcccagccctggagaacccactccatgcctcatgagtgtgaacatgggggaacgatggcacgtggccacaccccaagccccgtctctgtttggcacccacattctttctgcctaatgctgcagcggcagacacctgccctccccacatttttctgacaagtagctgagccactgcagtcgtgggcatgcagaaatcacctgctgctaatgaatttctgctgtacctgttttcccttgaccctgaaatgattccaaattctctgtcaacttattcacaattaaaataatacgaaaaagcagcagttccatctcttaaagaacctgaatattaagcagcaatctgagtgactcagcattctgtgagctagctttgctttagaattttcatttcttaacaggaaaaaaaaaattctgtttctcaagatagggcttggaaataaatcagtccaacactgcagactgctggcagctctgtgcccttctgtctctgtgtgtcacctgtgcttgaagaaccagaatgtcctgggggctgaggacgggaggaggcgaaggagttagtgttgactgtctcttatttcttgaagggagaggaagaggcatgagtgtccactcccacttcggccctcaaagcaggcatatttctccataccttttaaaaaacataactgctgtcccctcatctccctggtgcccgggagttaggacaattcccatctttgctgtagggtagtcctgctttctgaggaggcgactccaggtggtggctccttgcaccgcgctgtcacagctctcctctccatctgctgcttccctgggagctgccctcgcgccttgtgtcccccagtgtgacagcaggggcggggccgctgcccacccagtcccaccaaccatgagggctcctgctgtgggttcctctgataaataaatcaccttggtcaccattctagtagacacttccatttttcaccaagtgaaaaaaggattaagactcatagccccaagacgggatcagtttcccactgactttaacataatatcaagcaccgtttaaacctgacagcacacgtcttgtcctgaaagggggaagctctttccagggaaggaccccagtaaggcagggagggccggggacatgtcatcaccggtgggcatgcggggctagcgcagcatgctgctggtgggtgctggcagggccaggtggtcacacagaaagcatggagggaagccgttcacacgcatgcaggaaggtgccagctgtcagagcgagccgctgccggtggctctgcgctagagacagtaccttctggaggactacattgggcagatgcttccatctccacctgaaccctccctgatgcatattcatgaggctgtgtcttggggtggaagtgccttctgcctggggaaggctctctgagcctccaagtgcctgactgccggcgtcctggggaaagcctcccaggttgggatgatattctaatgctggacacactccccaacttctacctgagtgccacttactgttggcttgtcagtctcctatcattccactcaatcttgtttaaagaaagatactacagaactaattaaggagaattatattaaatttagtttaattaaaatagcaaaaaaaggttctatattagagctgaattttaaaaatcaccacccctcaaaaatggtacagtcatcacagagtgatgctcccatatatacctagatttcttttaaagctactttattctattaagcaggaacagagactaaaaccgcctaattgactagtcacttcctgatcatgatatacattcttgagtgttagaaaatgcagctcaataaaatgcttgccatgatggaaagagaaaaacatcactactgtcttgaattcctttctcactcttattttattttagaggtatgttcttcattaacgtgtttactctcttctcccggtgaattactgctaaagagagcagcaacttcactagaatcagtgataggaaaaatggagccaagaactcaagtcggtaatcttgattttagcatgttcttggagaggggaataaaacatcagcacagatttttctccaaaaaaacaactgctagggcacctgcaggggagcgccccgggtcctctaagaagtgatgagcagcatgcagagagccctgctgcttcgctccaatcctgctcagccacctccactcttctggtcctagctgcccagggtgtaactcagggggaaggcacctgactcgcccttaaaaccaggatccatggctgccaaatcataagggcggtgtacatagaataactatggaatttacatttttacagatgaggaaatgaggcccagggcgatgcggcgagttgccgggtgactccagagctggcccttgatggtgagaggaacctggcagggaaatctcttttatgaagcacctaatgtgtgatgacagcaccaacacatacctcttttctattatggactgcttttaggccagaaataaaggcacatctaggttgagctggatttcagagggtggaatcaactcttaagggtgaggggcagtatttgccataagctaaaggctcaggtcattcaaatgcactggatccccatatccaccagcatttccccaaatgcaatccatgaacactgatttcctagggtggaaaaaacgattacattagtttgggaacactgggtcaaagtgcgggacttctcagaacatttaatgtggttaatgtgaactatgaagcactaggcaggagatggactgtcgtccaaatatatttgaccaaagagaatcagtggtctaagaaacatcctttggcagatgtgacaagtcactaatgacttaaacactgccaaaagcactgttaggctgggcgtgatggctcacgcctgtaatcccagcattttgggaggcgaggtgggaggatcgcttgagcccaggagttggaaaccagcctgggcaacacagtgaggcctcctctctgccaaaaattaaaaaattagctgggtatgatggcgtgtgcatggtgtcccagctgctcaagaggccaaggtgggaggctcacttgagccctggggttccaggcttcagtgagctgtaatcgtgtcattgcactccagcctgatctactaagaccttgtctcaaaaagaaaaaaaaaaaaagcactgatcctacatccagggaattaagcaattcctttaaattttggtagatacatttttaagttttatgatgtctgcttatttttagaaaaattaacagttagaattgctctcctatgcaacaataatggttggattaattacaaaaatttcaagatccaactggttccctctacctaaaatttactggccacccgccttgggaagacggggcatctcatgcttccaatcagtgccaggagtgcttctcaccacccactgcacacccagagttggcctttttccctgcaatgccttcttttgtagtccttctcagatcaatactgcctcctcatatataaacccaagctgcgctgaatgcattaggatctcaggagggatgggctccaggtggcagagtgggcaggcaggtggcagagggatgtccacgtcatctcagcattctcagcactcaacaaccacaatgcacattccgtggtggggggagtgtgattctggaggccctcggaaggattaatagattggtaaactacttactaactgaaaaaagggaaggaaaaccatgaaagtatgcttctggagagttgccttggaacaacagatcaaaccaaaaattaaaaccaagaaacaaaacatttgaaaaatcaaaattaagactaaaaaagcgaacagagttctaataaccttccaactgtaagtctggctgtctagaatcatatttccattcaagagtggcacacatttttccactaacattttttttttaaacaaaagaaaggccaactgggcattcccctatccattgaaatgttcacccagcacatgaaagctgaccaattcatgcaatgtattttgtttccagagcaggaaattccaaagggaagggaaaaataatcaaacaagtgggttttgggtctttccacacattaaccctaatcatgattccagtggtttgtagggttgggctaattttcccttctatgaagtcaaaggtttggagggagaaattcatacaacttcagatcttgactatctgcttatcctaacggaaaagttgggacttaaaatcattacaattttaattaagaaattctgcatttgtcagtatgttttcccccctctaactaaatgctgactctgtgggagggggtggattctcgagagcttcagtcttagttgaaacacctggttactggctagacactccctgaggatggaaagatgacttcagcttattaagaataaacaactgagcactgcccgggacatactccattcagcagaaagcccagtgggtgctcatcaccccagaaagtcactgattaatcagacataaagtgcctcccctgaagagtcaggactgcaatcttcaaaggcttacaggatcacagggctcacaagatgcaacatgaaaaatacgggcaggtgggtctgttgtgcagaaaagagtggacagggaagtgggaacataccatgttattctagaatgggaagatcccattttcagacaataaactcatcaaaagtcaatgtaaagaatttttctagaaaaatcgaagttggcaattgccagtaggcattgtattaagagaaaatgtctattttaagaaatgcatgaaaaacaacatacacggtgtttaaacagtatcttcatcttccatttcataaaactgggattgccattaaagcaaaattcagaacacttaatatgcagataagtacggtcagcgggtttctcggcgtggatggtttattttgaatggtaatctagtttctgccctggctttgtgtgtgtgagagctgaacaaagcgggtgagccatcaaaagatatgcacattagagatagtggttctttctggcagcagttccccttaagagcttttgttcagcacataactgggcatttggaacaaagatgagcccttataaatcacagatatagagattaaattttctagcagtgctggcagtgaacattaaataaatgagcaaaagaaaacaaggatgggctccccgggtcagattcatatttaggtcctatttaagggttttaccaaccagtgttcattttcacacagggatctttcttgttgctgttcatggacaggttctggaactccctaaagccgactttcaaaatttccgtgttatttaaaagcaagattagactaaaatactattcaatttctctgcatagtttcacgacacaaaccctacattttccttcactgcaaatggaaaacagtttacagcactgtttctcaaaatgtggtctaaaacccactggcattggaatcataggggagcaatttataaatccagattcccaggccccacctcaggcctaatgaatataaagttgggggtggggaccaggggatccgctgctttaaaggttttctgtgtggttttaacgcatggtaaagtttgagaaccacatgctgaaagggctgtggccctgatctgtagaatacggccttgatgattatacgctggttgaattcatttctaaattgaaaacgggagtttttgcgcaaaatgtcgtaatttgccttttaataggatttttatgcatttatatcaactccaggaaagcacggaaggacccaaggattagaggcaatattctagaaaaacttctatccgttctgcccagaaggtttcctttactttgcaaagaggaagttgaggcatgggctccaatgcctgcaatctcaggtttccttctgccccaaacagcttttggattttcaaatgagcaagatttctctctgacaagtctgatgaagtttcctctccagcttatcagttaggaagattatcagaaggtaaaacacgcaaatgaagtaggtctcacaagaaaggaaaaaccatgtttacagagagagggttcccggcggggacctgcgtcactgaatgaatgagctgcagggggccacacaaaggtatcgggtttgggagaatgaagatgagaagacacaaacaggtggagaggagattcggttcttgaaagaggagaggaggaggaggaggaatctgacactaaaaaagtgaaagagaaaaaaagggtgaaggcaaaaaaaaaactttagaaacacaaagaaaaaaataaactcgcttttaatatactcacataagctgcaaagaaaatgaggtcatgtaatacacaatcattcctctacctgacaatagaatacaagtgcttttcgaagaaaacaaatttgtttttccactggttatttagttggtccgcaacaacaccatggaataaaaataactcaagatttacctgggcacagattcagcagtgtgatctgctgaaaataatacatctttagcctacaatatccagaacattctagaggaagcaatttgcttttcaactggaaagggttaggacttgactttacatagatttgttttttatgagaagcacttatatacagtttacttgaaaataaggttttccaaggtgcagagtactgaggtgcaacactatgtcatggtcccagcattatgacaagggggtgctaagctttctggggtggcctatggttggggtgtgctggttgggcactttgggaaaaaagccggtatggctgccttcatgtcttacagctggagaaacacatggcaacggggagaccaccgccgctgcaattagaaattttcccaaacaaagtggatcaaactttcaagttaaaatacttattttgcgttggataggtatttgttgatatctatcaattattaaagataaatccccttaccccacatcctgttttaaaggcaaaggaataaaatatttttttcattctctatttaaggaactaccaacttattccaaagaaaagacaatgactcagagcttcaaagtaaagactgtcactctatttgagtcctctttcactggctgggacctatgagatggcagaggtgggaggaagggacgcccaaggtgatacctaaggggaagtcatgttctataaggggggctattttagtttgacatgtctgtttaatgaaacaaaattccactctattagctacagtggacttggccagttcaaagcttatggacgtgggtgactcctcatgttattccacagctctgcatatggacaatttcagaggtaggaaaccgtattccagttaaccaaccacttccaaaatcatgaatactgaggctgcactgtataaggacccaggatatataataatagtattgtagttatatatttttaagctcttatcagttacacatatatcctgaaattttaacaggcaaaataggatattagggactggccttaaaatactctaggaaaagcaagtgtgggacaggagagagagatcgaatgagaatgctgattgctaaaactcactggtgggtaacgggaatattagtatctctgttctggcattttagaaatttttccataatagaaattaaaaaacagaaaaaaaataaatttagttctgggggaaaacaaaacagatccaagaggacttgcggcctcacaaaggaatctgcctgcacagcgggtgatcctgggcctgtgccccagggttggcaggatctcgaaagtggaagttcactgtggctgtggctgtggctgtgcaccctcacggatgctaacactgcagggctctgcttgtgtcggacgcctgtgccctttaaaggggacttagaaaagcagttaagtgtcgggcatgacgctgataagctgccacccgccagggctgggttctcccaggccacatttgatctcagggtcacttctgtttcactgggaaccattctgatctcggataagttccttttctctttgcctctatagcccagtcgcttttctggatgagcagtgttgcagcggatgttcaaagtcagccaggctcttttagcacatgaactgaaaactgttcaaaggcaaagggaggaaaaatgactgcggtcatgctggatggataagaatccagaatgtaaaatccatgtgtcatggaatactatatggctgtaaacaagaataaggcaattctccacagatgggtatggaggcatcttcagatacactgtgaagtgcaaaatggcaggtgctcaaaagcatacacagtgtgtggttgtttatgtaaaggggcagaggaaagatacatatgcttgtttgcatgaaaaaatactggaagggtaaacaaaaagctaataaatacagttatttttaggaacaaataagatggatgggcaggggtggaagccaaacttctctacagcaccttgtgaattagtttttagcttttgaattatgtaaatgtatttcctcttcaaatcaaatcaaggtgagggaataaacaatctgtgttgtgggtggttcgcaaggcgggctctccacacaggtgtgtgaatgacagcatctgccccttcttgactgcaccatgagctgaaccatatgcaactgggctttattaatcaagatggaggcatttttccccatttttaggcaagccttcccaacgtgtaagtttctttgattgacactgtcatttcagaatattttaccctcgtttacaaatatgataaggcctcctaaaatggccttccatttttctgattccctggtctcttggttaaattgtcggcgtgcaaatcagtattttgcagctgcctggttgggtcgggggtggtgtagggctggtggcaggagtctcagaaggactcgcgtggatgactcaacaatgaaaccgtctgtggcagtgcctgggaggctgtggcttccctgttgttgaggaagggcataggagcccgcggtcctgactccaaacacctaggctctctggaagtgaatggtggcccacccgagagactggctgcatcagtaccactaagcagagggggaggaggaagacccgggggccaggcccaacccagggcagtgacaccgcagactgtgtcacacaggcacatcttccctaaacaccatggcatctgagaaagctgaatctgaagagggagactctcaagcactctaggaaaaatgtcccaatgggcaacgggaagaatgaataacaaggacctcatttattttctgacactacctgttctcaatgtgatgtggctttaaagtcttgggacctccagggaaattaaggtccaggccagctggaaggaaagggggtctgaatttagtgtggctgttctcacaggatacttaggagggagaaaagtggggagacggcgctgggtagccacagcagctgttttgaatcagctgaaattgctgctggtgctatagtgagtttcacttccttctcttccccatgtccgagcctcaccttgcagtggctagtcctgacagcctgacctctttcctacaatgacggggcctaaacaggtccctcggcaggagctgggatgatgcagaactctgctgtgctattccagccaggctctctgcctggtgtgcagtctaagcccaccaatgactgctgaactgtttggagagtggtcaggccactccagggggtgagtttctccatggctcagtccacattttaagcagcagctgcaagccagattaaactgcaccaatttacgatttgtgccgcttccagtgcccaaaaatctttttacccaggagctgcaggacttttggatctgatttctcaagctgactttaaatttggtacaagggagcctagggcagaaatgcagtctgcaaggcagctgttggggtgggccaggcttgaacatcacatctggctcccaaaggccctatcccttttagcccacctggataggtttttcccaggacaagccctggcagtgcaagactcagagctgctctcaggctttctttggaaaggttctggcagagctgggatgtggcacaaggacaagaaaataacctcgtggtccctgtcatgcagccagcccataaaagaccaggcatacccagatagaaattcagttgtacacggtcccctgtgggtgggggagaaggaacaggagcaggttccaaatgatgctctagaatgatttttgaggctcaaagaagagcaaatttatatgttttgtgagtctgtcgagtcacccagattacaactgaatcattggtatgggttgagcatccctaatctgaaaacccaaaatctgaaatgctctaaaatcgagatgtttctgagtgttaatacaacacaagtggaaaattccacacctgatttcatgtgatgggctgcagtcaaaatgcagtcaaaactttgtctcatgaacaaaattctttaaaatattgtataaaattgcctaaatttaggctgtgtgtataggtgtatatgaaacagaaatggactttgtgtttagacttgggtccaatcccaggatatctcattatgtttatgcaaatattcccaaacccaacacacttctggtcccgggcatttcgggtaagggacacttcacctgtgtcaccactgtggggtctactcccctgtagttaggtggactcactcccctgtacttaggcaaatgtggaacacacacacgacgaggtgtgcagatttgctcataggcaggaagtgcctcgggcttccacatggggacagtggaacccacctgccaccctacggggtcttgtgctgggtgtatgtgtgtttatatgtgcaactgattagaaagtgaaccttgctttcagcaaggtctgaaacccaaagagagagggagacacagggaagcagaggggaaacctgatggggacagaaaccacctcattttagtttcaaattttaagttccaagagcaaagggggaaatagatttcaaagaaagcactgggctgggcaaatcatatgaccgtccccactgtgaagaaacacttgagaaagacactggagcaatgcacctcggttgagtgtttaaactatttgtgcaagaaatttttccaaccccaacccgatcagtctcatcccatgtcacttggtcccaggcccccacattctccattacaccatttcgtcccctctggctttttattctcacctgtctcgggatcgctgaagtctggcaaagtaattgtattaagctgtcgtctgtcagcaatggttctatctaagaggctgctcccacgtccagaatcactgcaaaacacagctacaaatgtcagtcacctgcaaggtgggaggagggaaggaaagagaggcaaccaatactgactcctgaaggccaatgaatactttctgtgcattttttacgttcttcagcatctttcttatgaaggaggcatcctgcttcctggcttggcctgggctgcgattcctttcagtgttcactatcacaaacagggcataaaccacacccacagaccctggctaattttggcctcttttatgtcattagaagacacaaaaatgaaaacttgaagcttcattttccatccaccttacagggggaaaccgactggcattagcaaccttagaaagtgaagtcttagcaagtgagtccatgaacacgccatccatgaagagttgtcttcatgaaccaatgctccacacctgcgcttctaaaacccaggctgcacggaaaaatcacccaggacatctctaaacaacagacgcctaggtcccactgtgaaccgaacaaatcaaaactcctgggctgatcgacatttttcacagctcctcagatggttctaaggtgcagctgctggattcaagaacccctgacccccttttctgagtgtgatcacagtcatgcactcattctggggtccccagaatgtaggcctttgtgctacatcgtgtggttaactttcctgctggtgtacgagccctgtctagtgttcccaagctggagaaagctggctgatagggacacacagggactgggagagaacatggcagggttttggtggcagcctccataccaccactcctaccagcttcctgcactgcccatctctactgagtcccctctctagcttgtgcctataaaacaggcttggcactgttcacccggtaaagccacacggaaaccacagcgggcctaacagggagagaaactgttaagggatctcatctaacatggatttcttttttaaattctaggaggctcgtaggtaaacactattgctttattcctgtatcgtgatatcctatcaaagcagctccaaaaagaaccacgtctgtctcttgaggtttgaatcttcaatgcttttctttgaatctattttcttttccaatctgggggctttaagagtgattttttgttgtgaagaagttcagattctacaataaggagacacaatttccttcctttatgcagctgttgctaaagcagtacaaacaagatttggcatgaaacttaatacagtttacaggctgcaatttccacgtccagcgatttctctaactacattagagaaatccacaggaagcagaagaaaacttccttcaggacagactatttgtcagcctatacttattacatcatcccagacatgttttttggaaactgctctttcaattgtttccataactgagaaacaatacatgtctgtgaacagaagacaacataaaagtacatgcaaattttcactcatcacaacactgaatatttctggcgcaggtctgtccaggtagcatttttcacataaatactactaagtacaaattatctgaatattgcaatgcccctccacttaggagtttttcagaagatttatctcaaaatacagtgaaacgatgacatattattcaccaccttggggattccaagacacacgatgaggtatcggcattgcaaaggaaggatttgcctgggtttctggtggtccaaatctgaggtttgtttcagacattctcatcttccaggcctctcatctcaccatgttttggtgctgtcactaatgaggaggtcactttgggcaagacagctttccctgtgcctcactgacttccctgatcagatgaagataaggattgttgtcctacacagaactgtgtgaggatgacataaggtcacatagatggagcactctgaagacttacaacttctaggtacatgccaggtgtgtataaaaccacatacctacaacacacatctgaggttaatatggccagccaattcctatagccaacttatccctaggcttctggtgcaattgtaggaggtatggggaagctgagttaaaatgttagaaaccccaaacaaaccatcatctgaattttgaacctcaccccctgacaatggcacaggatccacgttccctccaccagctgggaaacagcgttcagttacatccttagtgtgtctgccttacttcctttggaaaacagtgtgtacgcaacaatcaactattcaacatagagatgcttttgtttccacattcaatgttttctctctaaaaatattagggctgggcacaatggttcatgcctgtcatctcagcactttgggaggctgaggcaggaggatagcttgagctcaggagttcaagatcagcctgggcaacatagcaagacttcatctttattaaaataaaaaaattagccaggcttggcggcatgcacctgtgaccccagctatctgagaggctgaggcaagaggatggcttgagcctgggagacagactgtagtgagctatgatcatgccatggcactccagcctgggcgacagagcaagactgtctcaaaaaaaaaaaattaaaaataattaggtatttgtgaccgattgagaattttactggatgcttgaagcaatttttagttcttcatttacatggtatagagtctttaccaatcaagatttacatttgactcctagaatacaggacaaggggcaaggagaggccttgagcaaccctgagtctccctaacttgctcactctggacagtctctcaggcaagctggaaagtcaccttcctctctccctctgggacacatctgctcaggcacttctgtgaaccacccatttcctcctcatagcccagtcacctcacctcttctctgccgggcccttaggctgccaggagcacttcccaaggagggaggcaggaagggagagaaaaccattcctggtgagtgttgtagtagagcgaaaggaaactggaaggaccccagatccatggtatgtaagcgggagatgcccacatgcgtagatgcgcacatgcagggacttctattccctattatcactgaattgtcatgagagttaaagttataccggctattagaagcctctcttggaaatcctctatcttccacagaggttaaacacgagaggcttggtggtggtggggcgggcttggagtcagaaccctggagctcttgtctcagctgagcctcttcccagctcctggaatagtgcctggcacacagtaaatattgcacctaaaagaagggcctcggctaggaaaccagaacaggggcagatgagagaggaacttctgtttttctccaggtctcttaggcctggatgataagagtcaaggtaagctcccaatatcccggagcctcagttgtctcatcagtaaaatgggtatgagatcacacgaccttggcccattttatggagctgcttcaaagatagaatgaggacatgctttataaaaagaaaagctccacccaaatgctggtgactgtaaggatgaaatgggatctctgactcctaactgaggttagagcaaagaaatgtgaatgtgagtatgtgtgtgtttaaatgctgtttgttggcaagtaactgaaacaggactttgaatcacctggagatgtcacctcatgggtacatgatggagatgggtctagtagcagtgacaagagggggaaagaattggttaacaataaaaaatgaaaagaaactggttgtcagctcaagagaggcagcatgccagtgtggagagagcattgatgttaggcctggggctgaatcactgttctgctacatattcaattggaaaaacttgggcaagttatttagccacttttagcttcaattttattttctgtaaaatggaagtaacggtagctatcttgcaaggctaatgtagggattgaagataacacatcagtggcctagtacagtgctggcatggagaagtttcaataaacgtggttattaccatccctggctgaaatgctgtgagattcagttcagggagcctgctgggaccttctggtgagattctggtcagaattcacactgtcttgagtggctgggtcaatatgcacaaggactgagggagccttacacttcacccagtgacagaagacaaagcatgagacagatttctatcctaaatgcaagcaaaactgcagaccgagagaaatagaatccaggcttctgaaatgacaaacacctcgccaaatgtaagagaatgccacccaccattttgctcacagcaagagacgcatctccaactgcaggtggaacactatttgcaagttttccaatgctcagtttagtgactagctcagtgtaatttttttccccctttaagcaaaaatcgagaagagggaacgggttgctgagaatatgaagctagggtctattctcaatttggccactcactccctgctactgcccacgtcttcctcatcttactgccctggaggcctgtgcagagcctggggtggatctggaagggggtgggaagactgggaaactggcagatagagcagggggcccattacaacccagcatgctcagaagcaaggaagccgggaagtcagcacagaccagctccggggagaagccaaatgctgtctgccaaaatgctttctgctcagttttcattttattttaaagaagccatgattcttaggcgcttgttcatgtagttccaccttcctctaaaacactgtatgccctgatcccagcctctaggctgctggagccactgcggccccactcgggagtgttgcaaggtgtgctgtcccctgaaagacacagcccttccttcaggctttatgctgttgccagggtcacctcttaccgagcaggctggcggggatgactacatttacataatgataagggctacaggagaaacatttatttctatcccagagaaaatcaagttaaaaaaccagacaggatgctccttaataagggctgctcaattcaccactcctccctccaggctttgcggggagccggagggggaattctgagtgaccactggggcctctaccgcccaccccatccgccagtccccaccagacactgcctggagccagggtcctccccactctggccctgaaggaaccttcaggaaatggaggaagtatggacacagcccaggcatttggttaagtatttttaaaaagctttccaattctgctatttttttctcctcacattcaatattcttggttgctaagtgggagggaatgtggggaggtgggagaggtgtggggaactgaggggaaattggcaacacgaagctgatgggtttattttttcatttctaaagggggtacaggcaaaggaaagcgctccggcgccgaggcaacctgcctgggcagcatctcctgctagctggttcggaggcagactcccccaaatcctgaagatttcataggccaggagtgggggctttcaggggagataaatatggacagtttctatttttgcttccagacttagaaatgtagaattttaaaaaaattaaaatgatctttattttgagaacatatccacaaaagggaagaggccagtctcatgattacctttcaccaagcgaagggcgggtgcgcccagcagcacagcgccgcgccgctgttcctgtgcttgggaaggggacttccagctgggggggaggtgggggctggggctgcctggcggtgggcagggcaggggctggacagctcatggctttccaggcagagctctcttccttccaggtgcactgcccgcagggcctggggtcacgggtctgtctatcagtttccagggggtccatccccttaacagggccctgactttgaacatttttttttaactgcagaaacatttgtaaaacaatctcacagggaaccccatctctgttctgctgcctccgtagccctccctccctgctggtctctgcagaccacggccaccagcccactgcccgcctcacccttcgtactcatttatattttaggtgacatatttttaggcccctgactcttaaaagcatgatatcagctgaccagacaccttactaggaaagtaaaaaatactctgagtattggagcagttgtgtgaattcacttgaatcattacatcccttctcattaaatgacttccttcacttagtaatctaaacatatgcaagggaaaactgtgcaagacttggaaatgggcaaataggtgggtgtctgtccgtggaatgctgggggttgaccagcagaccttccccgggttatctgactctaaagggcaggcaccgttgactcacttcccattgacggagctactttacagctctgtaggggtagaaattaacccgcggaaaactgataataaagcaagtgaattttgtttgggggagagacaactgatgtcaccctgcagtaaagaaccccaaacgatatctttcatcatcttataggatgttgtttttgtatctacttgcaaatcatttcagcattcctgcctatgagtatctgttcttcaaactcttctgtgaataggtcttaacattttcctggttcctgcattagttaataaggtaaataaaatctttgacatgtgtttgatagtcgtatgcatcatgattttaactttttcacagtgatattttatgccaatagccacttctcttcttagtagcatgcggcctgatgtctgtgcaggtcttttaaatattgctgcaggaaccccatctggaccacataaatgactggtctatacataaattaccagaaagataagactggtcaaaggagttaggtaaacgggtgttagagagaaactggatagagatccattgtgaactgagtccagtgggtcactatggcagtgaaagcaaaagaaacccaggatctggaggcttcatcagccactgggaaaacagccccttaaacatggagtgtgaagctccactgctatcatctgccacttgtgggggcctggaggtgcacaggggtgacagagttaatgcctgctaaatgccaatcagagaaggcactgataggcagggacccatgcaaaagccacgcaaagcaggccctgctggcctcttacctggggttggtgaggttgtagcaggatttccatatctgcagcatgtgcttacaagtcagcagtgcctcgtccgggcctcggcagagtgactgcaacttcactttggaaaacagtagtctgcagtggggagacaaagggagaaaacaccacggctcaagccacagagtccccatcccagcaagacaagtggtgggcttagacccagaagcagctgtactcatttcagaaagggaacatccacatgtgtggtccaaggaaagcgggattccagaactcctggctcaaggtgttgctttgcacaagtctcaccactaacgcaaatgcaagcacgatgtgactatttgtggtcaggctgaaagcattagagtggccaattttattcagaacacagggaatttattaaaagcatgctttttagaaccaaaccaatttatttgtgaaacctcaaaaactcattaaaagcgaaccttggtttatttacagaattacacaggagatttgactcagttgatataaatatctacagataaccctccacaatgatgctcaccgtcgtgtgagcttcgaaagcctgaacggaagtcccatgaagaagggcagcctccggcataggccctcagctcctgtgtcttcccattcctgctactgagggcctagggctcgttccgcaatcacctaggtctctcttctgtatttttgttaccatcaactactccaccctccatccagaccttctgggcactaagctcagaatgttctctctttcgtggccccacagggtaatgccatttccagattctacttatgtttctctgccgacatcagcctaggtacctgtagacatcagctctcctggcccctggacttgtcaccactatcctagtaaaagtcccagtatgagcccagcttccttcctggtgttcttcctgtcccctgacttacccgctctcacacatcttattataaagatctccaaaaatcattcttttccccaagacggagtcttgctctgtcacccaggctagagtgcagtggcacggtcttggctcactgcaacctctacctcctaggttcaagtgattctcctgcctcagcctcctgagtagctgggattacaggcatccgccaccacgtccggctaatttttgtatttttagtagaggtggggtttcaccatgttggctagactggtcttgagctcctgacctcgtgatcctcccaaagtgctgggattataggcatgagccaccgctcccagcccccaaaaatcatttttgttctcacctcgagaaactacaatgatcccttacttatactgtctgtaataataagtcaaaattctgtatctcatcgtttaaggcactccaccaactagccactcttctttcactgtctcatccgattggaccctttacttctgccaatgtaattcataggccaaatgctacttttctggcacaactctatggctacacatgccacgtccccaacttcaacttctactcatgcacatctttctttaattcttcccaaacccagccaaaaccccacttaaataagtaagtcttcaagttttaaccccttatcttctctactcagtatgtgccatattagctggcatttgttgttaataataaaaagaagaaaaagagagggaggagctcctgctgaccgaaggcatcccacgtgccaggccttgtgtttggcacttcacacgctgtcaatgtccttggaagaagctgtcaaggcaggtggtgtctaacactcttcaacagatatggaaactgaagctctggtgccctttggttgttttctggatgtgattttcttcctgaggacaagagccctgacatctctctctgcctctctgtagcctcacctccagttccaagaattgtgctctgagtttgatgggccttaaatcagcatttactcactgactactttttctataaagcaaggcattttagagatttcagctggacatccaggagaattccttcaccctgcatgatgtgatgtcctcattcaaaggtaccttagaggaggaaagtctctttttcatgtgtgagaggtggaatgaaagtggtcctaacccatcactgcccaagctcaggatgggttcacaccaagcgcccccagcgacccctccaaatggaacataggaagtccagggcggtgcggtgctcccagtggggccacggctgcagcctccccatgcctgggcttgcagaagcctggaatgatgggacgagggccaggtaaagggaggaatgtagtctctgatctacaagcagatgagcataaagagcgaggctagatgtgagaatagggctcagcttctgctcaaaaacatcccaagaagcggaaatgctttggaagccttaccaagactgcctaaatgggatggcagccgctcagggtgcctctgtggggattaaagacaccagaagctggctcctgctgaagcctgcccgagtccagaacaagatgggagtacttttccaccagaatctctcaccaaacaggggtcaactgggagagttgacaaaggaaggagaagctgccaaacaggtcaccattgggtagagagggtggtaaggcatgagtgccaagcaattgcggcaaggggaggccccatggaggactgtggggggtccaggaagccgtgcacgtgctgcacaggctggagctctctgggggccatgccaagaactcccctccaatggcgcctgcccccagaggaggtgcctgccccacagcgggcagtggggtgcctctaatagcaatgaactgtggttcctttaactgtacccaaaggacagaatgccagagtgcgtctctaagcctcagcttgggggaacagttttgagcaagccttcttggctggaaaaagaacttctaattaacataaaataacagctttcaaacacttgactcaggatatggaattgaaaaggtgtgggcttgcatttcagagaaccagacaggaagaacaatggtagagtggctgagcacaaacgatggaaaaaagcacttggaagacctctcaagaggaacagcatgagagaggctggcagagaaaaggagccagggacacagcagggacaaagaggaaagcctgacagctgctgcctaggtacggctgggatgatggggcagaggccacatgggtttggctgggatgatgggcagaggccacacgggttcggctgggacgataggcagaagccacatgggttcggctgggacgataggcagaggccacgtgggtatggctgggacgatgggcagaagccacgcaggtaggccacgtgggtatagccagaatgttgagcagaggccacggggtacagccgggacgataggcagaggccacgcgggtacagccgggacgatgggcagaggccacgcgggtacggccgggacgatgggcagaggccacgcgggtacggccgggacgatgggcagaggccacgtgggtacagccgggatgatgggcagaagccacgtgggtacggccgggacaagtggcagaagccatgcgggtatggctggaattataggcagaagccacgtgggtacggctgggatgatgggcagaagccacgtgggtacggctgggacaagtggcagaagccatgcgagtatggccggaatgataggcagaagccacacaggttcagctgggacaatgggcagaagccacacaattgtaggcagtacaatgggcagaaacacctgccctgcccgtcgccaacactccttgggatgcccaagggaaagcaggaacagagcgtgctgcctttccatcatttcctcaaacctcagcttgtttacaagatacaaaacaatactgaaaacaagcagtgatgctcgtcatcctatttgctgaacctgcttacacacttcaagactgttcaaaaacatctggctgggtgtatgttacattagcacagaaacgaagagtacacaaacaatgatcagcattcatttgctacagctgataccaaaaagatatagattcgatgtgctgaggaaaccctgaggcaaaaagaaaattatggaaaaacttgggaaaagttaacatttaatacatttcaatatgtctaactgtcaacacgatgaagagggcagaggagatgcaggtgagactgtaagctagccacacaaagttcatgattctaatttttttttttttttttttgagacagagtcccactctgttgcccaggctggagtgcggtggtgtgatcttggctcactgtcaacctccgcctcccaggttcaagcaattctcctgcctcagcctcccaaatagctgggaccacaggtgcatgccaccacacttggccaatttttgtatttttagtaaagacagggtttcaccatgttgggcaggctggccttgaactcctgacctcaagtgatctacctgcctcggcctcctgaagtgctgggattacaggcatgagccaccgtgcccagccatgaatctaatttaaaaaatttatatattagccaggcatggtggcttaagcctgtaatcccagcactttgggagctgaggtgggtagatcgcttgagctcacaagttcaagaccagcctgggcaacatggtgaaaccctgtctctacaaaaaaatataaaaattaaccagttgtggtagcgtgcacctgtaatcccagctactcgggaggctgaggtggaaggattgcttgagtcctagaggtcaaggctgcagtgagctgagatcatgccactacaccactctagcctgggtgaaagagtgagaccctgcccccacttccccccaaaagaattattttgttcacagactcattaaaaacttacagaaaattaatgaagaaaagaagaaccttgctaaaataccaatctaactccattactgatgacccaaatctagcatttcatacaatgcctttgcggtctggctcctgtccacccacatgcttagctaccaaaggatttgtccattgcccatcacctacgcccccactcgagccgtggtcagcttcccccatgtgtcactctcctccatgaccctgggtgtttgcacatgctgttccctctgtttggaatattctttccatccatttctgccttttaagcacctactcatccttcaagattcaggtcaaatagcaactcctcactgaagccagccttaagtaataggagttaaaccttccaaatggaaacataattataaaaaacacgagagctcacaactgtgaaatcataagctacaagccaggaaacttctgctttgaagacaagcaaaataataacaataataacagcagctgccagacactttaaatatttaattccagattcttaacgacaaccctgcaaatgaggctgagttaagtaatttgcccaaattaacaccactagttattggtagaatggaaatgtaaacccaaatccatgtgaataagaaacagagaaggatgattgaaaatcccaccatactactggcactaatgaagatagcggcactaaagaagatccattgccaaatatttaaaactccaaaatgtgcaaagctctgtgctggctatgtttaatacaaagtggtataaaatacagtcccttgcttacaaaaaatttacaatccaattggagaaaaagacttgaccactactattgggcaggatttctagttttgggccagatgatggccctgaaacttgagtagggctgcaggtgagcaggcgtttgggctaccagggtgttgctcctgggatctttcatatacagttctttaaagaacaatcacatttggctgggcgctgtggctcacgcctgttgtcccagcaccttgggaggccaaggcaggcagatcacttgaggtcaggtgtttgagaccatcctgaccaacatggtgaaaccccgtctctactaagaatacaaaaattagccagacgtagtggcacacatctgtagtaccagctactcaggaggctgaggcagaagaattgtttggacccaggaggcggaggttgcagtgaaccaagatggcgccactgcactccagcctgagcgacagagacagactctgtctcaaacaacaaaacaaaaacaaaacaaaacaaaacccatgagtgtgcctgtatgcatatgcgtgtgcgtgtatatgtgtgcatgtgtgtgtgcgcgtgcgcgtgtgtgtgttttgtgacttgtctttcatctaaaagtctggtgcacataaaatctggttttttgaaggacctcgttaatcaaagttttacttttcattaaaacaaatagaaatactattttactgtacttctggaatattttaagaatctcaagataactcttgaaataacaactatgtttggatagggcagggcttagaaagaagacacaactgcccctggggaagctctggggcacgcggcattgtgactgtccagtgttcacctcaggaaatgagtcagagcggcacttgtcagggccatgctcggtgtctcatgccattccccaggaagacttcgctgactcgctggaaactgctcccaaccactggacatgcacctctagtacctcacaccctagtttagttttagccttggccccaccccagtgagtcccagacttgggcaggggccaaagatagagtgaaaagggcagatatttctgaattctgagccgtccgaagaactctcgatgaaaataagttagagaagttcagagaaatactaaagtaataattccctcccatcttctgtgtcagtataaaaaatgtgctgattatatcaaggaagaaacacacatattaatacacaaaaccttcactaattaggtgatccgtgaatgctgcagtcttagtaactgctttagaggtaacatcacgggaaccttgaacatttcgtatcttgtgctgatctgtgtttgcgagctcctgggctctgcatgccagggacctgctctttctttgtttatctactgaatgcaggcaggaatgcaaaatggctgtgcagaaaagcatgcgggatctgcccaagcggggcagcggctgagggggccctggataccttccccatctcttgctgcctcctgtccagatcgggggagctggagtgaggctggctgtcaaatatccgaaggaaagtgagcatctgtcaccaggtaagagaaataatggatcaggctgaagggggcagggggcaagtatgttgaaattttaacttgagaaggctgtttggcaactggccaatcagaatggtaagagaagtcaaaagagatgtgccagtagcatgtcgtgaccgggagaaggcagatgggaatgtgaaaccagagaactcggctgggaacagagagtctgagatcagcccagtgctgcccaaggagagggatgtcatcgaatccatcgacccaggccctcagcagggaggagggattcctttcaggttcccatgtggctggaaggaaactgatcgcaattcattttcaccaccatttctgagggcccaccgtatgctgctcttggagccactgctctcctggctgggtttccaaagcaccccaatctcagaaggtgttatatctctgcaaacagcagcctctggtcccaggctgagtcactgtcactgaaaatcaataccgtcactggcccgacctccgccaggtgagcctatgatgctgggatgacagctgtgcacgtcctggagctgggaggcctcaaatcaccccgaggcccctctggcaacagctggaagggatgagaaaggatggaacaggtcatgtgaccattcccactagataccaaatactgcatggggcctcccaaaatgcacatcctcaataatgtcacgtgaataatcgaattcctcaacggttacacaggaaataaacaattcttagatcatctggcttacccaattgctgcattgatgtgctattcattggggttcattagaaaacatatagatgtttccaattaacccaaagctggaaaaggccttgaggtcaaataatactttgctactcagagtgtgtccagggcaggcagcctcagaatcccctgggagcttgcaagaaatagaagaatctccaggttctccactcaccttagacttactgagtcagaatctgcatgtaaccagatcacaaggggattcatgcgcaaatttaacgtcaagaagcaccgctctcattcataactctccatcctaacctgccatggtctgattttaaaaagaaaaaagacttcccagggaagagttctcacagtccctgcacttaggaaattctgtgctcatttcattccaataagaactgggggagcatgtcttggaagacatttttcaggatgtattttgttcttaaattcagtgagaattctgaacaaccatttacattaagcccccaaaggaaggccacccctgcccgtgtcttgaacagaatgcttccttccttctgaagggatcccctggatcacattctgaaggtgctctagccctgcccgggtcctccacacatctccagtgaaggagctggggagtccacaatgtacccactgagggggtaccattcatactgtcacccccataaagggcacctgcttgagtctgcagagcactgagtaaccatccctctcccattgtgggttccccaggggctgagaactcaaatgtcttccaaaacaggcaagtgcgatgaccagaagttcagcaaattcaaacttttttgaaacgtgcactggcctgacacaaccctgctagcagatgccagcttatgggctgccagctggaaaccgtgtctatatgcttttcatccatcaaacctgagtacctggtttctgttacaaaaccccaaccacatgccagccccggtcagtccagtctgccaacagaaccagtgacggggggtttaaagagcatggatgactcctctcctaagcgcgtcttctctaggaatgaagccctggcaaatcactggcctggggagctttttggcaaacttctgtctgggagttatttaaccaccaaggaagttctagaaacttaaccacttttatttatcttgttttgttttgcttgagacagggttttgctctgttgcccaggctaaagtgcagtggctcgagggtcaagaccctcgaccttccagggcttaagagatcctcccgtctcagcctcctgagtggcagggactgcaggcatgcgtcaccatgactggctaattaaaaaaaattttttagtagatatgggggtctcattatgttgcccagcctgttcttgaactcccgggctcaagagatcctcctacctcggcctcccaaattgctgggattacaggtgtgagccactgcacctggcccatgtgaacacatttaatgtctccagctgctggagaaggggtcgcagcacacaaggctggcacatccgggacactcacagggcgttcctgccactccagtctcacccatcagtgtgagcgcaaggctgcatcatcctaacctagactcccagatccactgtcctggaaaaatccaggccacatctatttagcaaaatgaagtttctcagggccaaagtatgatgaggagatacctcgttcttcagaacttagcagcccttatcttagctgggaggctgtggtgagtggcagcgctagggcctgggccgtggccgtcccgggtggtttggctgcgcctcttggtgtcctaatcctccctcttctttatgacaggcaggagctcctgttagagctcatatcagttacattttgcttctcatttcagtcaaagtgtcaacaatctggaatactcccccatccttctagcggtatttttagcacgaacaaacaactgacatagttagctggaataaatcacctcaagaaaccccagtttggctcattttttgctcccacgtcagctattaatctccactcagattggcatccaggagccggcacctaagctggagatgacctggtcaggtgcaactgaaaacacctcttgaaccttactgcccgtgttccaaagacctctccagttcctgtgagtgacattataatgaagggagccatttcatataatgccatccgtgaagccagagagtctacacagccagggctattcccgaaggctacctgagcgcatggtgttagggctgggggcctgcaaagcaagtgaggggcccaaaacccgcccccagatttggaaaatgaattgaacaagtgcctctggaacaggaagtgtcaaatagccatctgctaagtacatacgtgaacaggacatgtttgaaagcaagtcttcctgtcagactactctggctcctaaaataaatacactgttctctctgaactgtgaagctttttggtaatttctgacatttgggaagcaagtcccgggcctcttctgttctgccacccttcctctcctagaggaccttctctctggaggatctctcggtctttatttctggctgagcccccaaggccctgatttctccacatgacccagtttgaggaggggagcacagtgaagaaatgagacattgggacccagttcagcagacaacggcagatgccagaagaatgggaatcccaccacctagacctagaaggggaagggcctgggccacagtgtgatatggacttgatccatgaagctctgtgatatagaaatggcgccttctgcacagtcaggagggaactaggaaggaaggggcctggcagggcactgggaagctcaagcggctctccaggaccagaggtggatgatgtgtctctctgggctccagggccacatgggaccgcgcatccttgcatcaatcagctgctcctgtgaatcctggcctgttttacatttcctgccttctctgccttcatttcctgtgtgtttccatgaggggctgtttggtttcgcatggcttgattccactgtgccaagggacactgaaggcagcacttttgtccatgcctggcctagagctcagaaacagacagccctcctccctgaaggtgagcgattcttcggaggcatagcacgctccagcgtgattctgcctccacatctcactgtgtgctgcgtgaagactgggatggtgccatctccggccttggccctcctgagcctggcaccatgcctggctgaaagcaggcgctctctacccatgaactgggggaggtgttcaaaggacagtgaatctgatcatctgaaggtggcttatcaattctccccagttgttttcagctcaggatccccacaagaatacttataggataaatttggagattctctcatttctcttccctgttctcaggttcctttttttttctttttttttaaatagtaaactttccttactttaaaatgcaaccattacaaatgaactagaattcaattgtgtttggaatatctgattttttttcacagctggctgggtaaccagcaagcaccttataccgcccatttgcagaaagtatggccatcattttatcagacagtgaaacttggcagagtagaaatcaaaatggataacagatgaaacacaggcagacacaagcttagctatgaacgaagagctaccaggctactctgcacggacaaagtttcaagcatgcattgcacagacaggtattaatgtttgtagcaggcagcccggggccaggtgctggggagccagaggtttccaggaaacacctgcaagaagtctcaagaggacactcccatactctgaattgttgaatgagatatggggagaacttggagatcttggaaagaaaagcacaaaaataaataaaccttctggatgccatgactcgcggggagtggctttggtgtgggcctcaccatggtgcccctcctggcccagcctcgcctctcccagctgctcggctttctgagcccccggcggtcagccagtgctctctcctgtggctgacagggaggctgggatgccctgaaggctggttctccagcatctttggaaaaaaaactagaaaagggaacttccctggaaaggaagcagaatatcccatgaggatttaaactgggggacaccagtcatatgcaagcctagtactggttgtgaaaatggggggaggggtttgggccagcaccactcctaatctcaggacatggctgtctccaaccccggagaaaggaggatcctctcataaacaaacgtggcttcaaatacattttcctgccatttcccctcttccagttcttctacttttgcctcataaaccaaatcttcagtttccagacaatttttcattgcatttgggggattttgtccctcttgacaagcatctatgtttagtgaaggcaacagcacagagccaaagcctcacagaaagaggacatccatgcgcgtggggtgctgggaggctgcttccgtggctcagcaagtccatcccagaagaacattggctccgtgatgcagagccggagaatctcaagagcagaagggtcccttgtcatctacgaatgctggaaaccctcctgcagccacacatgttaacaaagggagctcagaaagtttcgtttctttaaaatgtagtaaaatatacgtaacataaaatttgctaatgagctatttttaagcgtacagtttagtggcattgtgtacattcacactgttgtgcaaccatcaccagcctccatttccagtactctattcgtgttgcaaaactgaaaccgcacccactgaacaatagcttcccattccccctcccagccctggcaaccaccattctactttctgtctctatgagtttgactactccacgtacctcatatgagtagagtcacacattatttgtccttttgtgactggcttattgcacttagcataatgtcctcaattttcatctatgttggtacatccatcagaatgtccttctatcttgttttttgttttttttttttttgagatggagtctcactctattgcccaggctggagtgcagtggcatgatctcggctcactgcaagctctgcctcctggcttcacgccattctcctgcctcagcctcccgagtagctgggattacaggcgcctgccaccacgcccagctaattttttgtatttttagtagagacggggtttcactgtgttagctaggatggtctcgatctcctgaccttgtgatctgcctgccttggcctcccaaagtgttgggattacaggcgtgagccactgcacccagccatgtccttccttcttaaggctgaataaaatattccattatatgtgtaaacctcattttgtttaaccattcattcattgataggcacttggcttgttcccaccttttggctattgagaattatgctgctgtgaacacgggtgtatagatctgttcaagtccctgttttcaattcttttgggcagacacccagaagtgggactgctggatcacatgataattctatttttaatgttttgaggaaccaccatactgttttccatagcgtctgcaccaattttttttttttttttttgagacagattctcgctctgtcacccaggctggagtacagtggcatggtctcaactcactgaaacctccgcctcccaggttcaagcgattcttctgccttagccacccgagaagctgagactacaggcacatgttaccacacccggctaattttttatttttagtagagacggggtttcactttgttggccaagctggtctcgaactcctgactttgtgatctgcccatctcagcctcccaaagtgctgggattacaggcatgagccaccctgcccagcctgagtctgcaccattttatattcccactagcaatgcacaagggttcctatttctctacatccttgtcaacacttgtgactttgtttttttgataaaatccatcctactgggtatgaagtggtatctcattgtggttttgatttgcatttccctaatggttagtgatgtagagactcttttcatgtgcttattggctatttgtatatcttctttggagaaacatctatgcaactcctttcctttgcccatttcctaaaggggatggggttttgtttcgttttgttagggttgtggaaagttgattttaaataagctactgcaccactaagtcccactccattgtgacccctgttgtcttccaggctgccaccaactcgcctgtgtccaaaggcctccctccctactggtatccctggggtggttactgtgtgctcactccttccagacatccttcaggtatcagtggatcatttctctagtttaatgagatgaacagcctctttccttgtggtctaacttcttatcaaatgctaatttagtgggcatgttcattgcttcatcactcagctcaggcaaaaaatttgcccacaacccctggtcaatttaaatcaccaaaattgttttaatcactaaatcaaaacattattcaatatgatgtttcaacttaaactgaacttctctgagagtatgtgtgtgtgtgcccgagtgaaaaagaaacattagtctcacttgccaagtaatgatttaaaaaaaaattatatgtatactccactcaagtaaagaatgattataactatgtttcctagttttttgattccaggttaacaggggagatagcataaaactcctgctcatctgggttataagctctaatggagcagaaactgacttgttcacagcagtaatccccaacatctagcatggcccctggcatgtggtagaaactcaatgcttcaaagtcagttcgtggttacgagcacagatggcgaggccagattgcctgggttgaaatcatggctctgcctttttccaggtgtataatcttggacaaattacttaaattctctgtgcctcagtttccttatctacaaaatgaaaataataacaaaactacccaccatagatagttcttgcaaggattagttaaaaatgtgtaaagtgttattaagagtgcctgtcacaatgcggggtataaacattagtggttactaatgctgaaagaatgactgattaaatgaatgaatgttatatatgttcacttcttcccatacagttagtttccactgatgtaaaaagaaatgtgactgtctgataaaatctgtgttgacatgtataagagctgaggccacggacagaagtgttctagaagacctctgtgcctccaatcaggtgactgagggtgtgtctcaatatcatctgatgtcttatagttatgggtcagagaaaacacttcaaacacttgtgcatacagcatcatgatcacatacttatattagtaatcttgagaggtttgctttgtggtgacatctgatgttttcttaagtgtgctattgatttgataacctctctgggagcacatgaataggagtgagtatatgttctatttaaataggaaacaataaaaattcaaatcaattaaaaatctatggaagaattgcataaccacaattgtctcagggcaagaaagttaaattctggcagtggctttccttagcggccattgtaaggcttgctgaatgagaatgcaacctttcagtaacactgaagttcttaaatcccaccataaaagtatgatactatctaatatatattccaaagacaaaaaacaacaaactgtcagttcttaacctgatatttttttctacaaatgaatttcaacagcagaaacacagtctgagggcctgatcaaagctctcgaccaacagtgcctcattgccattgggagagacaattatgtactccaaatatcacctgttaccttctacctttttgggccaatgaggaaaattactaagtaaaatgtattaatgaagggaaatttctacaaagctgtactgcaaaagatgaaaaatcagggctcttgtggcaaatttaatagatagtgaaaccactgaatccatcggaattcatgaacacctttcagtataaaaatgtgtactttgttaatttttttttttttcgggagtggggacggagtcttgctctgtgacccaggctggagtgcagtggcgcggtctcagctcattgcaacctccgcctcccaggttcaagtgattctcctgcttcagctactcccgagtagctgggattacaggcatgcaccaacatgcctggataatttttgtatttttagcagacaaggggttttgccatgttgttcaggctggtcttaaactcctgacctcaggtgatccacctgcctcggcctcccaaagtgctgggactataggcatgagccaccgcgcctggcccattgttaatttttcccaaacttacagtgtgtcgagataattattacataatcagttaacattaacttttcatccttttgtttagatatttaatagttcaggggtttaaaaaataatttttcaacaaaaagaaggcagattaagaggagcaacaaaacgacaagacacatgaaaatggcagatgtgaatccagccatagcattaattatattaaatgtgaatggaccaaacacttgagacagaaggcagaggttatcagactaagtaaaaaaaaaaagacctatctgctatttattatataagaagagagggaggccgggtggggtgggtcaggcctgtaatcccagtattgtgggaggctgtggcgggtgaatcacctgaggtcaggagttcaagaccagcccggccaacatggcaaaaccccgtctatactaaaaatacaaaaattagccaggtgtggtgacatgtgcctgtagtcccacctactcgggcggtcgaggcacaagaatcgcttgaacccgagaggcagaggttgcagtgagctgagatcatgccactgcacaccagcctgggagacagaacaagactgtctcaaaaaaacaaaacaaaacaaaaaagaagagaagtaatatatgaagaaagaatagctgggaacttcttggaaatgataaataatacaaacaataccaatacagttttaaacagcccagtgaatactgaacaggattcacccctagatgtgtcatagcaaaagtgtacaatagcagtaacaacagcaattataagcagccagagagaaaagacagaggacgttaaaatgaactacaagtaaacaaatagttgacttcttaacaactacaaaaggagcaagatcacttgtgctccttttgtcattgaggagtcaactatttgtgagaaaatgtttgagcctagaattgtacatccaatttgaaaaacttctttggacagcaatgccaagtacacttttagatacagtctaagaaagtctgccagcaatagaccctcactaaaatttcttgggtaatcactaaagaagaagagctaaaagagaatgtttcttttccatattagcagagaaaaaatgtatcataaaaatataatcgatctaaaagaaagcagaaaaggagaggatacgatatggaacaagaggcaagtcaaatagaaagcataaatagcatggtagacacaaatataaatatgtcagtatttacaataaatagaaatgaactaaatattccagataccataagcctgggttttaaaaaattatcagtatatataggccgggcgcagtggttcacgcctgtaatcccagcactttgggaggccgaggtgggaggatcatgagatcaggagatcgagaccatcctggctaacacagtgaaaccccatctctactaaaaatacaaaaaattagccaggtatggtggtggacacctgtagtcccagctacttgggaggctgaggcaggaggatggcgtgaacccaggaggcagagctttcagtgagccgagattgcgccactgcactccagcctgggcgacagagtcagactctgtctcaaaaaaaaaaaaaaaaaattatctatatataataagcagaagagtacatccaaaacgtattttaaaaattcaaaaagtggccgagtgcggtggctcacgtctgtaatcccagcactttgggaggccgaggcaggcagatctcttgaggtcaggagttcgagaccagcctggccaacatggtgaaaccccgtctctactaaaaaatacaaaaattagctgggtgtggtggtgcgcacctgtaatcccaagtactcaggaggctgaggcaggagactcacttgaacccaggaggcagaggttgcagtgagctgagattgtgcctctgcactacagcctgggcaacagagtgagactccatctcaaaaaaaaaaaaaaagttcaaaaagaatggaaaatgatagtccaagtctatatatgtgtatatgtatacatgtgtgtatactcacacacatgcacacacatatatgtacagatatatggctacacatatatatgtatgtggccatatgtatatcatacaaaatagactttgaagcaaaatgccttgtatcttacaacataatcataaaaggttgaatgtaccataatacacagcaactctaaatttatatgcaactaatagcacagctttaaaatatagaaaggaaaaactgctataacgatgtggtaaaaaaaaaaaaaaaaaaaagccaatccgccatcccagtggtagatttcaacatacctcctctcaacaaatgataaagtagaaaaaacctctataaaaacaaaaaagctctgatagcataattaacaactcaaactaataaaacatataaaaatttcctcaacaaatgcagaaaacattcttttcaggcacacatggaatatttacaagaagtaaccactgggccacaaaataagttcgaccaatttcaaatgtatatatagtctttaaacataatttaatgaagttaaaagctcataacaaaagataagttgaaaaaactcatatttgacaattgtaaaacacagttcaaagacaactaatggatcaaaaagaaaataacagaaatttcaaaatatttagaattatacaataataaaaatttcaaatattgaaacttgtagtttacagctacagcagcatttagaggaaaatttttagtcttaaatgcttatgtcagaaaataaggcaaaaaatgaatgaacacccaactaagagattaagaaaaaaaaaaaacccaaaatacaacaagacagaacttagagaaaacagaagatagaaaataatgaaaatgagaacagaaattcatgaaagagaaagtaaacccacaagtgagttgacaaaaaagttactggttgtttgaaaggatccatgtaacagacaagtatctggcaagactattcaagaaaagaaataaggtgcattaaacaatattagaattgaaaaaaacttaaccaacaaatgccatatgaaaaataaacattatgaattatcttatgccaataaaatttaaaatttagatgaaatggacaaatccttacatataatataattacagcttatacattatacatagcttaataaaaaaaaagaaatagaagacctgaatagactataattatttttaaaaagcatcagaaatcttcccacagagaaaaacccccccccagccccacatggttttacagatgcattctaccaaaacttaatattctcagaacaaataattccaaaacatgcaaaaagaaaaagtactactccaactcactttatgaggctgggctgaccttgatgccaaaatctggcaagaacagaaggagaaaggaaaagaataggcctattttgcaaatgtacacaaacgcgaagttctctaaaaaataagtaaagtgaatccataaaaaagctaatttatcacaatcaagttgggcttattccaagtatacaaggtgagtttaacatttaaaaatataaattaatatataacattcatagatgaaaggaataaagtcatataatcatctcaatagatatagaaaaggcatttgataaaatctgctatcgtttcatcattaacaaaacaactcttaataaaccaggaagaaggaaacttctttaatctcttaaatagtacctacaaacaaacctgtaacaagcacaattctttttttctgaggcagggcctcgctctgttgcccaggctggagtgtagtggtgcagccttgacttcctgggctcaactgatcctcccacgtcagccttctgagtggctgggaccacaggtacacgccatcacatctggctaccctttttttttttttatctagagatggggtctcacaatgttgcccaggctggtcttgaactcctgagctcaagcgatcctcctgccttagcctctcaaagtgctggcattacaggcgtggaccactgcacccagctaaatgtaattcttaatggtaaaacattgaaagaattttctcatttaactactaggtcctaactagtacagtaagacaagttaaaaaaatggaaagattagagaaaaagaaacaattttaatcacctcagaaaaaaagtcattatgtatgtagaaattccaaactgagttatatatgtcattagacttattaagaatttagctgggtcaagaagaatgtgcaaaaaccagttacctttctataccttcgcaacaagtacatagtaaatttgattacaaaaatattctgtatacaatagtgcatataaaagcatgaaaaattttttcaggtaactagaaataagtctagtaaaaaatgggcaaaatatttattaaaaaattataaaaacatccaaaaatacttgtaaaggcctaaataattagggagctataatggctatggattagaaaacctactgtcataaatatacaattctccccaaactaagctattaaattaaactaattccaaaatctccagaagttttctgtggaactggacgagctgatttgaaaatttatgtgaaagttcaaaggcccaagacaagccatggcaacctaaagagcaggatacagagagggacccaccttacatataatgaagctatgacagtgacaagacagtggcaatcacatgggactggcacgatggccaatggaacaaaacaggaaacttagaaacaactgcggacatttggttgatgacaaaggtggaactgtggagcaacagggcaaagaatcttttcagcgtttgatgctgggacaattgaatatcctatggggaaaatcacattggctggctcataccatacacacataaaacagtccattctaggtgggcccttaggtttcagtgtgaaagatagcacaagagagcttttagaagatgatttaggagactaccttcatgatcttggagaagggaaaggtttcttcaactagacatagaaagtactgtccataaaggaaacgacttctactttctattactttaaaattaagaacttctgtttatcaaaagacatcatgaagagaaagcaaaacaaaatcacagcttgggagaagatttctgcaacacatataactaagaaaaagacttgtaaccaaaatacataaagaaatattattaaggaaaagaccatccaataaaaaagaaggaatttcacatacacttcacaaaagagaaaaggtgaatgaccaatagacaaataaaaagatgtccaaactcattagtaatgagggatgcgcaacttaaactcacaaggtgacatcattaaccagcaaccattctgccaaaaatatgaagtcgggcagcaccaagtattggtgtatggaaccacagggctcttgagcgctgctgatgggagtgtaaactaatacaacccctttgaaaaacagtttggaattatttggtaaagttgaagatacacaaatcctacgacctaactatttcactcatagagaaatccttgaacgtgtgcaccaggagccctgtaaagaagatttacaagcactgttcataatagctaaaacctgaaaacaacccacgtatctattcacagtagactaagtaaggaaatcttagtgcatttacacaataaatactattcattcatgcaaaccaaagagtcactgctgcgtgcaacaaggaggagcctcaggaacgggatgttaagcaatgaacgcaagcagcataaggacatattcagtctgattccattttctaccaaaagtttaaaacaggcaaaacacaatttttattatttaggagtacacgccgggtgcggtagctcaggcctgtaatcccagcactttgggaggccgaggcgcatggatcgcttgagctcaggagtttgagcccagcctggccaacgtggtgaaaccccatcactacaaaaaatacaaaaatgagctgggtatggtggcacacgcctgtgctcccagctactcgggaggctgaaggatccattgagctgggagtttgagaatgcagtgagctgtgactgtaccactgcactccagcctgggtgacagagtgaggccctgtctcaaaacaaaaaaaaaagagagagagaaagaaaaagcacaatatacatggtatagaaacatgagagaatgattaacatagaatttagaatggtcattaacctgtcaggtgacaggcaaaaggacaggatacagagaaaaatcattggcaatattacacgaaaaatccatatacctaggaaatacatacacatgtttaagatacgtgtaagtatatatgtataaataaatctacacaggaaattcacaggtaatattaatgttcttttttctaaactacgaataggcaaacacatatgttcattgtatgattttagatatatttaataaacattcatttgattttattccatatttaagaacaattctaaaggattctaaaataccatatttgaacatacttcagtagtattggtagtaatagtcatagtaatatgagtttctaccaattattacgtgattaccaggtacaatgcctcaaatgcaccagctaaatcaattctgaccacaactgtctgagatggatattttattattcacattttgtagatgaggaaatgagactcagagagatttagtgacttgctcaaggtcacacaacttaaaagtgaaggatctggagtcctaaactcaacttgtcccattgtaagactgcactctcaaccactacaaaaaaagccttcctcgttcctttccttccatactggactaaccctataacacttccaaaaatgcctgcttctccagagtagtgagcctattttgggggttccctgaagaaagaattcctgattctcacaaatccctacggttagaaacatcttctcaattgttgattctactgttgtctcagccctgcttggagtgacaaagtggctgagatggtacctctcagcttagaactttttggaccctgttaagcttattcaaagtacttaaacagcaagttttatcatttcatggtgacaggaatgtaacgctggagggaccagctgctcctccaagggccttcagctgtctcctctactaactgcccaacaggtggacagagctgaccctcacggagggaaggtttcacctccatcaaggcctgactacccatcagctatgtcctccactcccaggcttcagggagtctacagttctgctgcagacaagcttgtcacaaacaaacagataatactacatggcagttgcaacaagtgcccacttaatcttgtttcggttggtgttgaaatgttttagccaggttgggaagaaaccatgggatccactgattacatctggccccaacttttaataaagtattcttgggaagaagtttcccatcgcaaagaaatacaaatatttaaaaagcaaacaagtcacggactgctctcagacctgctgccatatgctttgcttttttgagcttacggcttaacattaaaataacagccttgcattcctcaaatatctccactgctgttccttacttccactacttgaaaaggctgtcagctgctgtcacttggaggcattaccatattagccaccactgtttactgcttaccatgtggtatggctattagtttaataagcctcctcttggatgacaccctaggctatggaagaaggaaccataccctggagtccaatgcctaatgaaagagcttgtgtgtgtgtgcgtgtgtgtgtgtgtgtgtgtgtgtgtgttggagggtgagacacggaatgaagctttataaatattgatgagagacactgaattcaattgcatcaggttgtactttaccgatggttaaaggatcgaatattttttaaagtgctttaaccattttaaggttccatgggataaacagcttggggtaaaatccagaaatatagttggtgtacaaaagagcaagtttgagatctgcaagaagtaaaacactgcagcaaagctctttaattcactctgcataaatagctgagcctacaaaagaaatctctagtcagaggtttcctggattataacaagaattctctcgatgggaagaagtgcccttttcacttgaagacaaagaaatgtttgtaatggaaatgtgtgaaccaattttccaaggagagctgctgaaaagcactgattaaaaacacagcgaggtgatgaggcagtgaaataaagccagagctgacccacttaaagtttgtggctgcacttccttctgaaagtgaagagagcaaccctgggccaccttctacattctttcccttctccccaaccccaagcagtccctgccccattactgaccctgcaactctgtagacaatcagaaccttccagcgtgcaggaatgtttactatttctggccattgtgtactggttactaagctactgccactgaggatgaaatggtaacccagtagcccaaaagacaaagtccttctcaacaaagcctaaccaacaggcaatggattatagtgattcagaggaaagataagaaggtaggtagatgattctagcatatgacagtttacagtgatagttcttaggttacgtataatattgattgtttaagaacttccatttcctagagaataaaactaagacacagagagggaagctatcttgatcaaaattgcctaaaataggagaatcaccgagagctagtggaagccctcagtaactcaggacaaacaagctataaagccctgtttcccagatttcacccactggagttcaacatcacttctgccatatccaagtatatctggcagaagttacttaatatttacttaatatttttctttaaattgacttggaaaattcttaatagccccctgagcaataattttcatcaaatcactacattctaatgtacatttaagaatgtgtaactaggctgggcacagtggctcatgcctgtaatcccagcactttgggagaccaaggagggcagatcgtgaggtcaggagttcaaggccagcctgaccaacatggtgaaaccccgtctctactaaaaatacaaaaaattagctgggtgtggtggcaggcgcctgtagtcccagctactagggaagctgagacaggaaaatcgcttgaacccgggaagtggaggttgcagtgagccgagaccatgccactgcactacagactgggcaacagagtgatattccgtctcaaaaaaaaaaaggaatgtataactattaaaaatgttcatccacagtccatctaaaattgtctcatgtgctccaatggtacacattgggaaagagtggataaagtattttaaaaaaataaggatgaccttatgttaggatgacctaacagcctaagttttttgtttgtttgtttgtttgtttgttttttgagacggaatctcgctctgtcgcccaggctggaatgcagtgcaggggtacaatctccactgactgcaacctctgcctcccaggttcaagcaattctcctccctcagcctcccgaggagctgggattacaggcgcccgccaccacacccagctacattttatattttcagtagaaacagggcttcaccatattgtccaggctggtctcaaactcctgacctcaggtgatccacccacctcggcctcccaaagtgctgggattatagatgtgagccacggcgcccagccctaagtttgtttttaatatcaggaaaaaataacagtaaaggggattttatattattgactgccagggtgtccatgagggacttagacagattggaaagaaggcaggggaagaagtaaatttaataacttctgagtaagggaaaaccaaagcccaggatcacttacatgaaattttctgggtattcactcagggccatgtcgatgatgttcagagcgtcatggtaatgcttctgtgctgacagcaggagggcaaggaggtgcagggagttggcatcgtcaccttgaagctgaagagcttggcggacataccccagagcctctgggatctggtttaaaacaaaaccaaaaaaggttttacatacacacatgcacacgcacacacacacacacacacacacgcgcgaaagaagccatcttttcaatgtctgcttctcttcaaatattgagttgtttcacattgtgcctcattcacattttaagccaaatctttatggcagccccaggatattaaccacaaacatgaaagcagaagccaccttcaaaagacattctgactgatagagtgatacaggagaccctgtttctctacgtagctgccaatactgctccaagtctttcccttctccctgagtaaacactttctcattctttccacaaaactgatctacttttgattatgcccaagatgattttgctctaagtggagacacatacaaagtgtcagagatttttagtggaattaaactgccttagctgaactgttctcattttttcaagtattactgaaattaaagtgcttaataagttacaaaacctttaacagagctttccgagtgatcagaggcctgtgattcttttcaggttcctttgtcttggacctccactagacatcaaggaaacatgccaaaaaagtaaacaacaaaggcccccacacctttccaaactacaacccaaaataagttgatctgagaaacaaattgcaatgccgcatgcaaagcagatgtgtccaaattcatgtaggaccagacacatcctgaacctttcagtgcaacagctgttcaagactttcttcaaaatcatccaagcacaagggttgataaaatacacacaaaatgggtatgtgacaccctggattccatgcaggtttggcagtaaccagggagaattagaacccgaagctagatttcgaaatagagctctggactgaagcattcttgcacaaccatcccacagatggcttccggtctcgctccaactccagtcctctgtggggcctcttctcagctctcctgctttttcccaaaccctcagtaacctccctccttagtagaaggctatgacttctctttcccaaaccaattacttttcctcaatgaacttcttttcttgatggatttaggttataactgctggctgtggaggctttctgctttggaaccatagaatcacagctctcacagttggaagagagaccattcaccccaatccttcagttacagggaggaagctgaagtcccgggaggtgaaatggcttgggaaaggtcacccagctattgagtgtctgacaagagagtgattcctgtccatcctctcctcctggtcaaaccccctcccctggggaagcagggaaacactccctcggagctctggtgttctgacactacatgcccacaaaggctgctgccacacccacaaggctccatttactcatccttccccaggtgacaacctactatgtgaatagcactcaacctggtattgatgggtgggtcgaaaggcaaagcataggcatgatgttgatttgcagggatgaccagagcaaccagggacaaactgatacagggatcaaaacgatgtctttaagggatagctgccttgaaggaattcaaagctggttccttcatttagcgagtattcctgagtgctgaacacatgtcaggtggcattccaagtgccagggtaaagcaatgacaatgatgggcatgggttcctggaacctacagtccagtgagaaagacagatactgaacaagaaagctgggcaaaaggaagaagtgcaggctgctacaggagcaaggcttcatggaggaggcgagagaagctgtcagcgtaggggagagatcagatggtcaatcaatgcccacacctgctgcagaagcccagctgtgagccacagtcaggtgacaggacctttacagggaggtatcctggtttccttagtccctaggttgccaatggaagccacttctcaatgccattcccaagcaaccaggaagacaggtgcatacctcagcccaggcctgccaggggaatggcatgtctggagagctgacctttgaatcaccctcccagtcagcactcaggaatgtgctggggttaccaccagtgtcttgcacctggtgggtggccaggcatgtggccaacatccccagaacagctgggaggggataggagggtttcgggaatggcagaggcagcatctaaaagctgcctttgggaagatgaaggccgacaaaacttgcccctcccgcaaggagatagtgttaagtcccctttttcgagtagccacggtgtgtaactgttcatgttttccacgtattgtaaaggacctggttcttttgtctctgcctgctggcatcttcctgccaatcaatgacacccttatgacaaccagacgccaatcagggctaaatccccaccatgcagctcagcactgggttctgctacctggttcctgttggcaagggacagaggctctttgatgactcctgggttcagggtatatgccatgtgctgctccccaggttgccatctgaccctagcttgggccctccagctgtgtggatttaatgtccaatagcagagcctggaactcctgtgtcttcacagctgatgctcaaaccaaccaaaacaccaggctctttgctgaaacctctgagaagggttcctggctccaggtcagcctcaatggaataaaggaagatcacctaccacttcaaactgaagagctgaaggagttgtatcaagatacagagtgcagcaagtataggaaacattagagaaactgacctgtctggagatggcaagctgcagagccaggtagaaagctgcttggtgatctgtgggtgacaggctgtgggccctgaaaaagtatttacggctattagtacatgggagaggaggccatttttactttccctatcaagcaagtcttctccacatttgcattcttatactaagggcccgtatttatttaactatgtaatgcttcatttaaactcttcttctttgtccacctacacatgtaaaccatttccctcttaccactgtataaaggtacagaataggagtgcatttctgtgttttgtctagcatctaaaatggcagctgaagcttgtcggctttgcggagggcctcgaggtgaagaatccataggccctgaggtctgatctccccagcagatgggtctctgtgtcgtgctgggacgcagtgaagccatgtgtgcacttggcaaggcgatggctgctttggttaagtttggcttggccttccttaatgctactttatccaaatttctagatttcagagaaaccatatgaaaatcaaagacccagctttgcttataaaatgaggtttgggtttttggtgaaaaaagggaagagaaaggcactcattcagtcttttgaagcttctacaaaattccatgccgttcactgatttattgcagataactgtcgtgtaagagtgtggtgagacactaggctcagttttaagaactggcctttgacgtcagacaggaagggaccatactggcctcctagctgattgcaaacgtggtcttctctgcttctatgtggaagtcatttgtatttcagcataagcaactcaaaatttgactacatactagacataattctgtgtttaactgctgggaagagaaaaacaaacttctactttctttaaaaggcaccatggagcagactaattaggtgggacccagatagtaaacaaaacttcatgctgttctgtcaacattctgtgattaaaggaggatcttctaccagcagaaaacaaattcgagataaaaaagaaaaccaaatcattatggattcaactgtggcaaacaggccaaagatggctttctacaataataaggccttttaattggactgtctgctgcagggaagggagctaacaaacctcccaggtgtttgccatccagaaaatatgctaaattcactaatttaggtcattgtttatgcaaatgtaatagctcatatgcaggtccagggtgaggcaaagctaatctctgtccttatattaatcttaggagcaaagcacatagacttccattccaggggactcttcacttggcctcaagacatagcctcaggacttttcttagcttagttgaagaggctgaagctgatattgcctgtgttacccttttacatgtcttatttctctttttttttctttttctttttcagacagggtcttactctatcacccaggctggagtgcagtggcatgatcactgctcattgcagcctcaacctcccagggcccaagcgatcctcccatcttagcctcccaaggtgctgggaccacaggcgtgctccccacgcccagctaatttatagaattttttgtagacccggggtttcaacatgctatccaggctagtctggaactactaggctcaagtgatcctcccactttggcatcccaaaaccctgggattacaggcataagccaccacgcccagctactaaatggcttatttctaaggtccactcagtatatagcagcttttataattttacaaatattggctttccatgaatttgtacatcaaagaatatttttctttggtgtttataaaagtgagattgaaaaatcatggtttctctcataattattcaggaaaaataatacacaattatgaagaaatttttagatttattttatcttctttcacaaataataaatttacagaaccctcaaaaagaacttcttagaattataattttctcagttcaattcatattcttcacgaataaatcaagtcatggttgcctctatgcaataccaaccaactgaaaagctggcaatgatctgttgagttgagggtgtacataaagatagttctggctaaaggccccatgctggcctcatcaaatgatttttctctgttaaccacagcaccgtgaaaggaacaaaccagaagtgctagaaatcttggtatttctggagtgcattagggcaacatctgaaggatttccaacttggctaatgatgcatattcaactgccaaatttctaatgaggcacaactgaaacatatacattttaaaaaccttatttctacaacttggctaatgaattcaactgaccacttcaccctctgaaggaaataaggcaaatgccaaacaaaacaagaaaaagctccctgtgttgatctcaagtagatgctaaaatacttgcttcccgtggagcaacttcagcagctaagcttcctgtgggaaagcccctttggtatgccacaggcaactcgccggacagaaatcctcaggccaggcagatgagagagaggacattagtgatcagaaaaattgcaagccttctgaactctgtaaatgaatctaaagcagcctcataaactccgtgcccataaactgaacacctggctagactgctcagaaatacctaaaagacctaaaaatgtcaccacaaggatgctcacaaaatgcttcccttatcaaagcacctccacataattaattcagtttctctcccatgaagaagaacccactcatccttttatccacttacccacccatccacccagccaaccacccacccatccacctatccatccatccaccatccaaccatccacctacccatccatccaccatccacccatccacattatgcaatatctataatgtgatgccaggccctatgctaacttctggggagcatggagatgaatcatgctagtgcctttccttgatgagctcccacccccgccccagagggagagacccagaatgaccatcatcatcgtgcagtgggagcagtgcccagagataggcatgctgggctgctactggaaagcatcggatgggcttcccagatcacctggctagaacccaaggatgttgtggcatctaacccagggctctcttagattccatttccaacattctctagagctgaaccaagaatatagagaaggctgatcaatgctgaccctagtccataagacacatatcttgtaacaatagtaactacaatttgtgaagttatcgactattacgcttcttgtccaagaacagccagcaaatgagagaaagccagaaccttgctgccttgtttagccaattctccttgaatttcccttcagtcctgattacaggggccatgggattcgtgcattaagttttttaaaaagtgcaaaccctggttaaatctattgctcaggaatctctcgttagttactcacacagggtgaccaacttgtcctggtttgtccaggatgttcctgattttagcactgcaagtcccatgttctgggaaaacgctcagtcctcaagagattgggatggctgatcaccctatatgcacacatcataccacacttaaactcaagctaggacagaaaggggaaagcaaagcaagatcgtgtaccctgtgccacaatgagtgataaacaaacaccaccatgccacccctgcctcctggagcaccaggctttatgcatactgtgggccatgcaatgaaaggtgctctcaactgttttcaggatggcttttctcagtaggatgtgagagcctgcagaagaagcaagtcatatcaattcagcatcttcagaagctttgcaaacaatattatgttcttcttcactatactttagtacagggcaaatgaattggttcagctgcctgggttgagcttatgagtgtaggaacaggtgagggtctcacattcagatgcagccacccaacctggatgtcttcaaaaatcacctctttggatccactagagaacaaatatgtctgaattctggcagtcataattaagagttaactttcttgtgctatatctgcaaccccatcccttcctgaattgtgttttctttttaaacaaaaaatgcaaaacattagtataaacagaattgtggggagaatatttaaaacaaatagtagagaaagtacttctcatcaaagtagttttaaattatccatttacatttaagaagtaatacaaatcattttcacttacttaaaatctttcccttaaagatttttgttaggactgcaattcactagaatagtcctagttaatgtgtacttgaaataaaatgaaaaacattctatatttcacacaaattctaatttaggttagccttctgcaatatcatcagttaggttagcgggattttattactctttattcccatatgaactaatattttaaaaatctcttcgaatttaaacttaagcaaaagatgaacaaaaaagaattcaggccaatggagcagctgttatataacatgaagttatactggcagctcaaggcagaccaccactgtggctgtttttagagagccagtaagatgtgctgatttaagaaaagtgaaacagatgtaatgaccactttcttaagcatccatgtgtgggttttacaaactaggactggagaatttaaaactccaaatcatttgaaatggaaatgctttccacactccgtgctgaggaacatcaacaaaagcttagcacagagacaggagatctgtttgcagatgtcagttggtactttttgtcaatacccagactggggctggcaacctgaagtagctaccggcaagcctgctaggaaacagaaatgagacggaagagtttcagactcactgaaaccactgatcatgatttcatgaaaaaaggcatacggacaccatgataaatcagtaggcagccccagttctaaggaaagagtctaacgaagcttgtcaggtattgggaaggcctcatgaaatattcgtaactaagtttctaatacagttccaagaaatcagtgtaactcagatatatttaaagtgacaggatcaatacccatgctggatttcacatcatggggctatgcttccagatgatttcatttttgtgattatacctgtaacaagaataaaatgagggcagtgtagtatggtggggcaggagaaactgtgttagagccaggagaccctgactgcatactgacttcaacagctgcgggaccggcagctcctgtaactcctgcgcctcagtccctgacctgcaagggacatactgcctgtccgtcttcctcacttgtgtgtggtaagcaacaaattaaataagggatgtgaaggcacgctgtgacactcgagcattttataattgcaaggccttctcctaatttcctgagaggcacaatgacagagagaagcacaaggtgttatggaacaaggtgggggcggggagtttggggctgactgtcttcactcagtatttcggagacttcctgaaatcggccttctcattcctttatacaaaaacctgcagtttgacatgttttttttaaaaaaaaaaaaaagctagaaaagaataatctcttctctagatgatgacaaatgtctttaataaaggactcatctcccttggcatacaaaatacctatcttttttgagctgaaatcactttattaggaatgaataaaatgtgcccaaatggataaacagattaagagtgcagattgacacagcaacaagtgatacagcagggtttgtgtgctgtgtgttcggtgctcaggacgaaagactctcaggggtaaaacactgtttacataatctttataaatatctcttctttttatactcatcatactttggtgtcattatgtacagccgagtgaaaagatgaactcccactcacctctgaaatgcaagaagcgcctttctctgtaggacctcctgcatccctcgcaaagaagctaagaaaagggttcaattagtcagtggcatgggggatcagggaattttgacaaatacaaaacccatcacaaaacctgtacattcaactggattaaaagcaacaatgtctgagtgcctacgtgcccagtcctgcaccaggccctggagaagataggaaacagagcccagtcctacccccaaggtgcctgcactcattaggtgtgactgtggaacaatgccaaggggacagtgtgagttgggtggtcactcttggtactcccaggcatatgggggccatttgcaaaagaccagttgggaactccagaaggagcacgactgccctctcaagtgtaggcatgtaactcaggggaacgacaagctctatgaagatggggtgggagggttgcaagcaccggcagtgttgattttgacagccttgccttcagagttccttctgccactgagaagctgcagtcctgggccaccgacagtagcttgctgccttgaaaggccagcttggttcacactgggcaatggccaggacctttaacaccttcatgtgaacacaaggaatggagtaggcaaacctaacactgatcatggaaaatgagctcaaaagcatgaggccacctcgctgtgaatcaacacttcccctgtgcagagcatgtgagaaatggccccttaaacctggctaggaatgaaaaaggtactttttactagggcaagagaaaaagtcctggaggaaactgtttatggctggaactgcaagaggccattacctaacgcctccaacatggcacctcccagcctggcatgagactgagagcagtgaaaggctgccagggggtcaatgtggctggagaccatggctaacttagaacagcagtgacacagctagagagaacctcagaaaggacccaactgacccaagaatggaaaaggaagccccatagggtcaagcaactctcccaaagttgcaggagtaatgaggggtagagtctgaagaatttacatgggttaatatgtggcattaaatttgcccctcactcaaagtctactatgtcaaaagctatgtgctgggtattgccaatgtaccatgtgtatatggaaaattagcaagtaatccatattgaaaagtaattaatatgcacaactttcccaggacctttgatattttagggcagaggaaagaatttggagtaatttgtaaaataaattacaacaaaaccataaagaaaaaatgaagtattacaaaagccaggatagtatttcctcgtaagggagagaagggagtttgtgattgggaggggcacacggagggctccccagggggctggcaaggttctagctcctcagcagggtaatgactacaggatattttgccttatactaattaaaattcattaaattaaccatgtgtttctgggatttttgttttgcatttgtgttatatttaacaacaacatgataaaagaatagtaacagttcaggaaaagtttgttaaattttctgcaaatatcactgaaaacttaagtatacaagattttttcttagctagaatcccatccatcagaactctaagcacatccaaaaatcactgcgcccaagacccctaggtgtcttgtgagctgctgcactgcacatgtacatatctacaaattaaaatgtgcaaatggagaaggggcatttcctgaccagtcaagggaagcttcctggaagtgtctggccctgactcttccacattcctgtacctaagatccagcatcccttcacacaggacagcccagaccaagtggtgggacaggggcaggtgcaaggctaggtggatgaatcatccctcaaagcgcagtgaggtgcccagtgtgccaccagcataatgtacctaaaaatgaggcctgggagccctggcacagggccttcctccctgccctcccattctcccatcagaccaagcaaagaggacagcagcaccaggggccccaccggatggcacaccagaatgccccagcttctgcaccctcctgagacagaaggggactgtgggaatcccgcagggtagacttaggtagtccagccctgcagctcagcagctgtgggggtgggacgtctctcaccgtcagtggcctgcagactgtacgtgagccccagagctaagtagcctttggccttgaactctgacgttttctctcccacatcaacgacagttttggcaaacttttcagcctcttccaactgaaaaatgagacaagttaaaaacaacaacaacctgcagaatttctaacatgagttcccataagcgtctgctgccaaaattggatttctgatgagtcactttgaaaatgactctcaaatctcccaatcccactctggtgattctgttttctttcttgagctctctaacagttcgcaggattcctaccttgctttttctccttaaagtttttcttactgcttatttgccttcttttccaaagttgctttcatatttggtgggggtctatctttttcatctttattttttactgactggttctataatgaagttgtgctaggtatgcagaagttgaactgaatatatttgtaaagaatcaagttcttgaaatgttttatgtttgagcctttctttccccccctacccaggatataaagaatccatttaggcttggattctctttgccatgagctgttataaatttcaaaactccatccacttattttacaaaccacaacacatgtaccttgtgccagcagattccaatgagaaaatgtgcacctgtaaactacacccacaataagacctggtgcacaattcattagaggcaaaaagagtaagatttgttccattgaagtatggcaaatgttgatgatattgaagttgggtgataagacactggagttcatatactcttgagttttgtggtatttggaaattttaataataaaaatgcaagaaaaaatatacagaaaagatttgttactcttattttttttaaaaaaaagaggtctatttaaggcatttcaagatgtatatgttacagtaataaataaagccagagctgggaggagggcagtagtcactgctgggaactggcacgttccaaatgcaaaggttgtgtccactcctccgcctgcccactcctggaaccgcctgcaccatccccttgcctgctcacagccccaaactgtcaaaacccacgtgaccaaactacactttcacagctgtgtgtttcaggtgagagcctgtgctttcaaaacatcttttctacattttcccaagcaaaatggaactaaagtggaacactcttcactaggcttacttttctcctgctgggtgagaatacatggaaaaaccaaagagcaaggatataagggtgaacaacctgagtttgtaagatgcttcggtcttttttgagcaaatcctttttattgctaatcttgacatgaagttaaagaaaagaaattagaaccctatcgtatgtggcaattatctataccaccatctcggcaattagactgagttttctattttctactcaaatgatgtattttctgaggtactagaattgttacaaatcagggtattgccaaattcaaatctgaacaagaatatttgaagaaaaacgcgtatgtgaaggaatagaaatgaagacagttgaatttaacatatgagctgaaatatagggtgactccttgctctgtagaaagtcccaggctcccagcctaggcaacagagtaagaccctgtctctacaaaaaaattaaaaaattagccgggtgcagtggagcacacctgtagtcccagctactcagaaggctgaggtgaaaggatgactcgagcccaaaaggttgaggctgcagtgagctctgatcgtgcactccagcctgggtgacagagcaagaccctgtctcaaaaacaaaaacaaaagcaaaaacaaaccaggttcagccagggatgctaattcagtgacgtgtctcttctcagtcccacattgcttgaataaagcaagatgtatgggagtatgaattataattctgtcttattatcattattcctgaagcacaatcccataggaaaaaacccctggagtaccccagagtactcctcagtccttgggggagtggatgaggcctgaggaggccaggggcccaggcccagggtccgtggctctacacagtcttgtctttgtacagctgatgaatcaccctcgctttctctctgtgcctcgacatgaaaaaaatgggcagtcctggcccagagtcctctgcaggagcggggaggggggcgcccctactcacccagtgcagggagcccatgcagagcttggcagcgaggagagggatggtggcatcgtctggcttcaggcggatacactctttcagcaccttcacggcacgggcagacttggcaagagaagattatttccgtgaaactcaaagtgtttgacagaaccgaatactacagccttctcagaggggtttttggtcagggtgacctcctcgtgggcttgtccaactttaagcccaagcaagcgggggcctgaggtgcatgaaaaccagagcctgcggcttctgagtgactggggagtacactgggttaaaagccagcaggaatgcttctctggcgccacctgaatttcattccatacttgtgtagctattggaaaattaagaaaaacataaagatggtggaagtttgttcttataaaaggtaaatatctaatttaaggcacaaaatactgaatttctgaattcacttagctcaaataatcttccatctcaggcttcattcgctaaatggcccaaattagcaagaaaaacaatagctacgacctctgttgagtgtatacacagcaaggagcgtgcctctaaacacctctggtgtagcatctcattctcctgataacacatctatggagcaggtgctgttcttactccattttaccgaggaaactgagctgctcagtaacttgcctgggtcactcagctgggagagcagcatcaagcttctatcctgccgttggactccctcagcccacattttcatccagtatcatgcactgcctaatataacacattgctcaagataaccaacaggtttcccctccaggaatcagcttaactctcagatgagtggaggtgtctgtgtaaaacatcagctctagtttaagccatgtccatgacacctgatgaagtcacaatgactggaaaaagacaaatatttcagaatttttcttctcagtgataagtccatcttggctccccaaacaattaaatctgattgttcactgagaacggaccacgatagtttctcagagtggctcgaaagacttccacaaagtctatcattccgtgcaattccatgacattcaactctttggccttaataggaaaggcataaaaaactgcccatcacaaaagggactcacttttccagcagccatcagggacagagcaaactggtaccacaggtggaattcctcaaaggcaaacttcatggctctttctaggcactggttgggaaagaaaaacaaatgcagacatctgagaatcactggtgccacaactgcacaagtgtgagtttgtatctatgcacactaaggtaagtcccataaaatctgcttcccttgaatgcttaaaacataatccaccaccaaacggctcctacggagtccccacacaggatgatgcaccatgccggtggccaggacaacctacaactgaccagagctgtgacaatccctgccctcgagtagctttgtatctggcacaggaaaagaggcaaatacaccaacaacacaaagacaaagacaaactcaggagtgcccccagggcgagaaacaggactgtggtgaggtgatcccaggaatcaggaatggcatcagggagaatagaaactgagctgggccttccccagcccagccccactatgagacaccatcaaaggcagaaaccacaacttctttatcttctcagtactggtgcattgcctgccgtggtgagtaatctacaaacggacttccctctcagtcagcgaggagcctctggtccctgcacagagtgacatgatgacgttagagctttaggaagatcgtgggggactggggtgagtggggtgaggtggaagaccctgatggaggcaggccaggaacaaagtggatagaatggtccaggggtttcagaatcaagaaatgtgtccgaggtcaaatcagcaaggatgggtcacctgtggaagcatgcggggactggggaggcacaggaggtgcccagagtttctggcttgcatacctgggggagaatccatgccacagaaggcccttgtgtatgcacgagtgtgattgtgtgtgtgtgtgtgtgagagagagagagtgtgtggagtgtgtgtgtgtgtgtttgagagagagggagagaaggggaggtgtttttttttaggagaaagggagaatggggaaggaagctgtcatgaatgagtttagcacgggaaatactgagttcaaggcatcatgaggtaatttaccaaagacattctgggacctcaagaaaaagatctaacagaagacaaacatttgagaaaagagctgaagttactagaagagatcagatcagtccagaagagtattcagaggcaaggcagtggggccagaccatggaaagggagagaaaagggatctggaaaggagggcgaagaagggatctgggtgggagggcatgcagcagtgtcacaacacagagagggacccgagaaggggccaatggggccagcggcaacggaggccaagaagccaccacaatcaatcaggtgacgagctccgcacgtgtggctttaggggacacgggaggagaacacaggccatggggaccaataagcaaagaaaagatggagatgaggtatgaaggaaggatgtgtggggtgaagaaaggttatctatgtgttaatttttcatagaggcaactcaagcctctcgctaacatgagcagaaccagcatgcagagtgaagactctggggagataaattaggtcccagaagactagagagagccaggtccccggaacaaatgtatccctgctgagaggccttctcctacagaggcaagatcctccagataaggaggagagaatggcaggtggtgtcgggcccagccagttttctctgtaaagatggaatgaggtgggtgctgggaggaaaagaaaagaataatggcaggaggttttaaaaagaacagaggcggctgggcgcagtggctcacacctgtaatctcagcactagggaggctgaggcaggaggatcacttgaggccaggagttcgagaccagctaaggcaacatagcgagacccctgtctctacaaaaaaaaattagtaaaaattagctgggtatggtagtgcacacctgtagtcccagttactcaggaggctgaggagggagaatagcttgagcccaggaggccgaggctgcagcgagctgtgatcgtcgtaccactgcattccagcctgggcaacagagcaagaccaccctgtctcaaaaaaaaaaaaaaaaaaaaaaaaaagaaaagaaaagaaaagaaaaagaaaaacaatgcaaaaaatagaaaaggtttaaacaacaacaaaatccccctccaccaaaggggagagaaggctcacagcagggtcagctcagagactggtgcaaccacgcagtggagcctgcaccactgtgttgccaccttctcttgtgctgctaggaggccagtgcaggagcacaggaaaatgatgggatgttcaggattcacggacagtgaaggaaggagggcaaggagctgcagtgaaggtgacaaatgggtaaaggtaaagtgaggtggtgggagaggagagaaaagaattctagaattttaaatgatatatacagaggtcacacagtaaatatcacgctagttggtttactgtgaaaagctgttctgacaaaaacatattctatttaaaagcaaagtaataagcattaacaagcacctagtgcttggcgatggcacagggtgggcatccgaagaccttgagcaaggtgagcacgggcaatgtgttcagctcagggctggctgcgggcctcatcctacgccatgggacatcggcaggagtggctgggcgaggcctccaggagagtcctttaaaagcagggcattctctgccagcacacactttgccctcagccctgccccttcacagccggaagtagggtggccaggaacactgagcagaaagagaaagcgcgtggccctgatgccatgaggcgctgcagctgctgcaccagcctctcacaggcttcttgcagggggaaccaaataaattcctctttggctaagccactgcatgccggttttgttaattacatctgaatatactcctcactagtgcggacaccaagcagcagacctggaatctgaacctgaacccagggccctcttagctgctttgctgtactgaggaaggtgtcactgtgcctttaaggagcacagcggggaggcagaaatgaaagcagcatgctgagaccaagtaggcaagacagggtggcgggagagacgtaacccaggtctgggaggcatgggctgggactaagtaggggaggacaagtgtgatggaggatgctaagcagtgaaaagctagcaatacctagaaactgacttggggatggggatgagggacgatggaggaggaggagatgagaatgatcactgtggctgaaataagacacgggagccggtatgtggagagatggtagataatcaaaaataaggattattctaacagccctactcaaccaatacattgcaataacaccaccaagtacttcaatatacttagtaagtacttaaacactaagtacttaaacatttatatgtttaaatggtttttttgtcctccttttgctaagaggaatgataaatatcaactgttttcctgatcaacaaaaggagctctgcagctgaaacagcctgttctgaatcaaaaagctagatgctataaataagtatgcacccttcttttcttgcatgccaaaggctaacagcctcattaaactctgtgaagcacattcaccggaggtctaattggtatagaactgcattccaggtgctacaggaaagaaaaacagccccagtcctcatcaggagtagaatcacgggatcctgtggctggagatcacttggggagcatctagttgaagccctcaaaggagagggcccttgtcattctggctgcctgttacttcaaaactcttctgattttggcaggggggacgagcaggcactcccaagaagagaagcgataggaatgtggcacacgcgtggcacgcagacagccaatcacaggctcctgccagcctctgaatctgcaggtagggaggcagggaaggggcctctggacctcgttccaagcaacctgagtgagctgggacctcccaaattggggcagggcccttgtctccctgaatctgttccagtctcttcttcagcctctggtggaactggtgagcttagcagtgcagatggataagttacttttctgcttaacaagtccggttccgtcacctacagccaaggccccgaaggtacgcccattcaaacacttcaggctcctcctgtaacaacccttaccttccagcccccaacaagttgtagagcttctgcctgagaccccttcagaatagggaatacacaacctgaatggcagctagaaatacagtttcaaggtgcacaacagattgggtgtgtgaattcaggcaagcaattaaccactgtgtgcctagattccccactgtaaaatgggaactatgacagtaattaatgcagagagttactaagattaaattagttactacatacaatgccacaggaaatagctcctcagaaacaggctagtgagtactaaacaaaagttagctattattcctttttaaaaattttaacattcttatattaggaatggaaacacaacaaattgtatcatacctatcactttacccagattcaatgtatgaaaactcaaatttacaatgcattatatcagaaataaatatctttacaaaatatttacagaactttgtgaaatgtttcctcattttagaaaaggattcaatctgagacccttgagaagagggcacaactttacagaactggaccggaatgtacgcttattctttattactttaacaagtgtggtaacacttactctgtagccaggcactattttaattactttacaagcatcgcctcatcgggtgaccctaaggaccctgcaaagtacaaggcaggtaggcccctttatcatcgtccatttgcaggtgaggaaactgagatgcagagttgttaagggggtacgcgggcctcagagttggtggtggagccagctgggagtgaagcggtctgcttccagagactgagctcttcaccacaacactactgcctctgaaactttaattatattgtgccactcacacttcatttatcaggcccactcatgctgcagaaagcaaaggacaactaaataaaaggcccctaaaaaggccacatgcttcttgaactgtttcagagactcagcgatatggttttttttttgctgctaatggggacccttgcttgaggctactaaggactgagacctttccagctagtagaagtgtcaatcaactttactgatcccacgatatccaccagcaccacggcagccagtggtgccacgtctccagcccatcgcaaagttctcaatcgacaaagattacatgagtcctgtgtttcctctacaggcagcatctctcccagttccctcctagtttggacctctttctcataatgataacaacccacctcccctaacaagccatgagggtgtcctaaagagagttaggaaatctgggtcaattacagattagccctccaccccaattcagaggtgtgtgagctctggcatcacagccgatggcgctgcctgccagtgggctcttggcatcttatgagatacagtgacggcacgccggctttggaaaagcacccagacagcttcagatgctcctgaaatgctgatgccaagcatgctgcctggatatataacatgtcctcccctatgtttctgtaaacatgaagattacataaacccctaagcagctcaggtcaaccatacctcaactacaaaaggagactccctgccaaaaaaatgcacccatggtaaaaaggaatgtgggttgtcactgggggcttttgctatccacaaccgtcgccccttaggctgtttgctcatcccagttatgtttgcctatccctttttaagaaccctaccgtatgtgtatgggacagagtaaaaaactgcagttttaatgttgtggggagatggagaacataaaataaaagcattcacattttttatttttttaatatttatttattttgagacagggtcttgctctgtcacccaggctggagtgtggtagcataatcttagctcagtgcaagctccgcctcctgggatcaagcgattcgcctgcctcagcctccggagtagctgggattacaggtgcccgccaccaggcccagctaattttttgtatttttagtagagatggggtttcaccatgttggtcaggctggtcttggactcctgacctcaggcaatccgcccgcctcggcctcccaaagtgctgggattacaggcttgggccaccatacccagctgcattcacattttaataatggttccagtgaaaaagatgcattgatgaaaacggacttttcagaagatggcaggtgttctgtgcatggggggcatataagagagtgctttaatcactcaagcccagctcgcagggcgtgaggacaaaaagagcagtcacatggtaaaggcactggttctggggccaggctgcctaggcttaatccaagctcctcactcccagccatggggttgtaatgggggttaaatgcagaaatacatgtgaaatgctcaaaagagtggcccacaatgaaggctatcaatgggttggcttttatgaaacaaagcaagagtagatcttcagggttctgaagggcagatgaaggggagaatgagaacccctgggaatgagggtgggcatgccagtggatggcaaaggcagtgtgaataggagtctttgagtggcatgagctagattctggccccttttccacttgtggagtccagcagagggatggcagtgtgggcctaggaagggaagtggggccagtccaggctgcagatccctgagtcacccacacaaaacagcaggtgacatctccaaatcacctccctcacaagaaaagaagatggatttggcagtggtattatttctaccaggaaagataggtccattcgctgtaatcacatgactgccacctctctaatcccagataacattcatttaataccatgaatatttggtagaacaataattagactctaaatggcatcctaatcatttaagtgcgagtcaaaatgtcacttgcgaaaacgtttccttttggtagcaagagcttatgcctttccagtctctttttccagcttttcataaatcagccatctctgagggggctccaggaatgagaagcttttctggcatcagaaagggatttagcaattacctccctagtacacaaagcccagttacacaaactgggtgcgcggcagcgacagctgtacagtaccacaagcacagcaaagccaaagtctatttttggaattcaagagtaagattctgcatccaaatcccactggggagggggcagaaataaaataatcagatacccctcaaatttagcctgaagtctacgtccaaaattcatcactattaaaagacaacaaatagcatagtgaactgtcatcattatttacctcatagacaggtcagccatatcctaaaagttcttatgacatagatccttcagttcttcagggagactttctcttccacatcgtgtatacttcacgagtcagttaatcaaattccttgcagttgtgtaactgattgtttttaaacatgatatatacaaaatatttcactttgttaacttttagcaataaaaacctctgtaagctattcagacattttgggccatcaccttatacccacagactgacagaatcacagagcaatttgaggcctttgagattatctgatcccattcttactttacagatatcgaaactaagacccagagaggagacaggacctccccagggctgcacacagtggcagacctagagtcagagccaacatctcatgatcctcagttcagagctcttactcctaaattttttattgttgttgttagatagagttttgctcttgttgcctaggctggagtgcaatggcgtgatctcggctcactgcaacctccacctcctgggttcaagtgattctcctgcctcagcctcccaaatagctgggattacaggcgtgcgccaccacgcctggctaattttgtatttttagtagagacagggtttcactatgttgactgggctggtctcaacctcctgacctcaggtgatatgcctgccttggcctcccaaagtgctgggattacaggtgtgagccaccacactcggcactcctaaattaactaaaaatgaaagtacaaattaaaatggagtttgagaggtctatctacaggagcctgggtccaggaaaagcttctaaaaggcatatttatgggactctcagctacaaataaaagtccccctccttgccccaagtttggagaaaacatagacatcaaagcttgctcaagttttctctccttatgttggaaataaagcaaatgtatccatgccccacctcttcccatttctctttttgctttaaaacagcaatactgctccaagcagggaagtctcagagttttattgctttggcaaacacttaaaggatatcattgcctctggccacagtgagaggagtagagtgggttgttttcaaaggtcacagattttattatagaatttgaatgctggatgcggttttctggcatgctctcctctcaactctacgaatcaagtagaccaagcttgcacattgagtaaggggtctccggggtcctactcaaatactactccatctgctgctttgccaatgtagctgttccttgcaaaatgcagtgaattcacaaaatgggcattccattcctcctgtctcctcaattgcctctcaccttttggtcttttcagtctctcttccctggcttggggcactgggttttaacccttcaaccatggctgccacttagcccatgccaggactaagggaggaagtaaggagttgagagtgcggcagcctgggacataccacgtacaaaatagttgcatggtaaatgcttgaatgaaggctggacagagaattgggatccattcttttggagatcctttaaggagggccacagcaaacatggaggcagggaggagtactggagttgccaagactggagacaacgacatagcagaaaggacagaagcagggtcgctgagctatggcctgagggcccattatgacctactgcttgcttttagagcccaaaagttaagaattgcgtttatagctgaacatacaccatcaatttggtgagagggggtattaactttaaacccaaattaagcaaaatgttatcccctacccccgcaaacaaccccattcttctcatgcatggatctatattacaaaagttgtactcattatattttgagtttcattgattaaaattttgcagaaatttgttttctctcgttatacctacatgctattcttggttttgtctcttagcctttgaagcctaaaatatttagcatctgacgctttaatttgctgacccttgttctaaaggaactgggggcactttaggctgaaggaaaaaagacaatatgacaactgtcttcaaaatttggtggactcaatagggagaaggagccatccattaccagggcatctttactatggaacattctcccacctgtgaaaagaggcagatctagacacatgaatctggtacaatcttcaggatagatcaccagctggataaaacatagattttatgtcctgtggcatgctacttttgcactgaaggggaacacacacatatgcatagtggcctgtggattcatagtcagtctttagaagaatacacaagtaacttcttcttcatgtttccccttggctctgttgtaatacttcccttgtgcaaatattacctgctcaaaatagataataagaccaaccaaaaaaaaaaaaaaaattggtagactgtcagtgaggtggggctggacttgccctactgctccaaaaagacagaataggtagaaattacaaggaaactcattttagatcaatcctttctaataaccaaagaggaatcgaacaatatatattacccatcaattgctgtgctagctacattatagccattatcttattgagcttcctaacagtctctgaggtaggagctcagagtagccaagtatatttctcaaagtctcacagctaggaaagggcagagccagaatttgaacacagatctccctgactccagggctgaattttttttactgtacaatgggtacttccctatataagggtcaaggatcatctgccagagttattatttcatacaaaggagatttttacattagaaagcagattattaatgccaccaataacaatagtaacatgcacttcttgcagtaacatacattatctctttaatcatcacaataacattccaaggtagatcttattattatctatgttttccatataaggggacaggttcagcgaggtaatggaatctgttcaagttcatattcagcatgtaaagtagcagaactgagattatcacacaggtctgatgttaaactatgaggcattgttgagacggcaatgtcatccaaagtgatctataaattcaatgcatccctatcaaaatttcaactttttttttttttttttttttttttttgcagtaatggaaaagccaatcctcaaactcatatggaattgtaagggatccagaaacaaactggaaaaagaacaaagttaaaggactcatactttctgatttcaaagcttactactaagctacagaaattaaaatagtatggtattacataaagatacatatacagaccaaaggaacagaattaagattccaggaaaaaattcataaatttatggccaattggtttttgataagggtgccaagtccattgaatagggcaaagaatagttttttcaacaaatggtgctaggacaactggatttccacatgcaaaagaatggagttggactcctacctcacaccatatacaaaaaaactataaatggacaaacagctcaaatataagagcaaaattgtaaaatccttagaggaaaacaaagaattaaaccttcatgaccttggatttggcaatggattcttagttatgacaccaaaggcataagcaacaaaataaaaaatagatacactggacttaatcaagatttaaaacttttgcacatcaaaagacatttcaagaaagtgaagctgggcatggtagctcatgcctgtaatcctagcactttaggaagccaagacgggaggatcacttgaggccaagagtctgagaccagcccaagctgatttctacagtctcgtctctacaaaaaaaaaaaaaagcaggtgtggtatctctaaaaatatagctgaccagagtttattatttagactttaaaattggcaaaagacttgaatagtagtttcaccaaagaagatatacaaatggccaataagcacataaaaagatgctcaacatcattagttatcagggaaaagaaaatcaatcccacaatgagatatcacatcacacctaccagaatgtctatattaataataatttaaaaataacaagtgctggtgaagaagtggagaaattagaaacctgtgtattgctggtaggaatgtaaaaatggtacagtcactgtgaaaaacagtctggcagttcctcaaaaagttaaacatagaattatcatatgaccaagcaattccactcctaggtgcaaacccaaaagaactgaaaaaaggaactcggaaaacatgctgtgtctttatgtgcaagtgttgatgttggctggggacaggagaaggaaggaaagtccaaggacagtattcactgcagcattattcacaatagccaaaaggtggacacaacccaggtgtccattgacagatgaagggataaacaaaatgtaacatatacatacaatggaatattattcagtcatgaaaaggaatgaagttctgattaatgccatcagatatattgttataacatggctgaatcttgaaaacattaggctaagtgaagcaagccagacataaaagagcaagtattgcctgattccttttatatgaggtacccaaaataagcaaattcataaagacaaaaattagattagagtttactagggtatcgggaaggagagaatgaaaagttattgcttgatgggtacagaatttctgtttgggatgatggaaaaatgtggaaatagatagtgatgatggttgcacaacatcgtgaatgtaattaaatgcaacggaattttacactttaaaaaggttaacatggcatattaaaaaaaaattttaaacaaagaactaaaacaaaaccatgaggtatatacctagattccttgtttctctgaactatgctaccctaagagtttaaaccccttccattcctcccaaacgtgttggcattttcattgaggaccacgttaagaaagcaatgcttaattcaaaagaacatttccataatggtgagaatggagatcccaggggccatgtcagaggctgacattctttggggcagggtgtcatgaaaaaatggtaaagatggttcctattgagccgactcacaaagctggaccagagctgggaactgtccaggtgctctgccccaagccaggcccatcccttactctgctgcccattttccactcaatgacctttaacctttgggcctgcctggggaagatacactccttgcacatctagggacctctaaaaccaaaggaaagggggcaggatgagggtgcacactggctttgaagcactggtgcattcagcaagttgttatgaaccacctagcattagccaaacaccctgccttgatttctcagaagtctacggatccatttgtgtcatgcccactgataccttctagaaaccttggcacgtagctcaaggctgggtttctacagtacaagcaggactgcacgcaatgctgaactttaaacaaatggtgggcctggcaagcagacgttgttagatgtgcaatgcttttcactgtgctccctgattaaataagcatttaggttagggaggtgtaaatgtccttttggtacaatcactagtcagacagttctacccacagaactatggtgttgttgagatttaccacaaacacatgaatatgagttcaacaggaaagataaaaataccattcctgtctttaaagctgccttgcctatggaggggggacacacacaaccttctaaaaggaccccataatatcctgtcgaaatggagccattaatagtcaaattcaagagacaaacctccttagcagcttgggttcattctgaaaaacagaggaagcggtgcttgctgctttacttttaatagcgcaggttgtcatgccaactagtgctgctgtttaaaatgaagaggaaaaaaagaagtgttccttcctacacaaacctttcagcagggctcacaattagtctttaaaaacacaaaaactcacagcactggagatatggtaaacattgtgcttctatttaaacctgtcagaatgaggatgtgataaacctttggtctgtgtctcctttgtacaatgctctttggccagcatctggctgaaaagtccataaggaaagaaaggcacgatgatgtggtgcacacagaggcggccggtcttgagatgggagagcagccttccatcttgaataagcataagagaaaggccagcttccttgagaaagagaggctctgctcccacttacccctgtgagcacagttattaaaaggctgggtctgcacaacgctgcacaacacacccactgcacaagggtgccaaggacaggagagagaggaacatgtgctggcagtggcagcagaggcgcccccaccctctgtggtgcccgtgggcccaggtcagccaaggagaggagccaagaagcaggaagacatgctgtgccctgacgtgtaagtgttaatgctggttggggacaagagaaggaaggaaagcacaaggacagggtgagaaggagttaagacctcttctctctctcacaattgactgatggttttatgaactcttctgtccacaaaagcttccacccatgtaaaagaagatctagcaaggtttctgaggcaaagaggacttactcacacacgagccacacggtgatatgtctagatcgcatcttcaaggggcacatgtaaagtctgccaacaggttgtggtgctgacaatcaggccccacactttctttccaagctcctctcctcccacttctccatgagagcaagccctgggttcctgttcccttgggtccagtgccttcacagctccgcaagcttaaggatgaagagggtctctctcctcctagaccacttaatgcctatcaggccttgaagagccaattcatatatccattgttcataatctcttactggcactcccaacctataaactctgctgcaattggcctattccattcacctgccaattaacatgctttgcactattatgtattctctaatttgattatctttttgtttgtttctatgtggtctccctaactagaatggaaatttcttgaaggcaaaagatctttttgtatcctttgttgcttcccctgtgcctagtaactcctgtatatacagtggtagtaactgcagcagcatacagttgcctcttaacgagctctaagtgctgggctctgttctgagtactttacatggattaatgaatatgcatctcccaactgtctgagatatacatgcacacaattattacccctatttaacaggaaaagaaactgatgcataggaggttaatgatgtgcctaggctcacacgactggtacatagcagacccagagctcaaaccaaagctctctgactctagagcctgtgacacactatgttgatgacctgagtttggggttgaggaggcagagatgggtgaggtgccagtggaggagagaagagagatagggaatatccacaataaaatgtgcaagatactgtcccattcaacaaaacttacataatgcacaatttattcataaagacagatgtaaagattgcctctaaaatgtcaattagtcaactatctcaggagagctggattctaaggcacttttctttccttttccatattttgcatgtattgtttgattctccaaggagcatgcaggactattgcatatggcgaaaagataaacagtgaagtcaatttcattatgggcggaaaggaaaacaaaacaaaaagagaaaaaagaaggagcgcgggtctgtcgaatatttctgaacagaaggatggcatgtctattcctgtgtctcagaaagatcgccctgctgacagtggaggaaatgaagacagggaaatataacatatctctaagacaaatgataaaaatgataattactaacatttatggagctcagagaaaggtaatataggaagtttaaaatccagttatcctcacaacaacactgttcatagtagccaaaaggtagaaacaacccacatttccatcagctaatgaatggaaaaacaaattgtggtagatctgtacaacggaatactattcagccataaaaagaaatattgatccatgttataatgtggataaccttgaaaacattatgctatgtgaaagaagccagacaccaaagcccaaatattggctatttatatttatatgaaataccccaaatcagtatccatagaaaaaaaaagcagattaatagttgacaggaacttggtgggagtgaggaatggagagtggctgcttaatgggtatagggtttcttatagggtgaggaaaaggttttgcaatttgaggtgatggttgcacagtggtatgaacgtactaaatgccactgaattctacactttaaaatggttaggtttgttacgtgaattgtacttcaattaaaaaaaaaatccagttactcttttaaattaaagtcctgagaaaatggaaaggcagatgaggaggaaaaaaaagtggattcagaaaaaccccagtaaatgaggaagtaagacaagtgggacacccagagtaggatgtggcctcggacagagggagggagagagggcccacactcagcaaagggtggacctaacccctatcttcagtaactgagctatccaaccatgggccaggcagccttgagatgctgtgagctttcatctttctcctacaacatcgaccgttttagtcggatgatctgagacaacacagttggtgaatgctcgctccaattgcctaagtggtaggcacaggcaaggctgaagccaagtatccaacccctagataaggcatgcagagcttgtgctgggcccgcccccgtcagcacatgggccacagctgcttgtcacacctggcagctccaggctgggggcagcttgtgagcaggggccacaccttgctcctggctgtatccctggccttaatcagagcccctggcacagaagaggtgatagtacatacatgtgttgaagaaataaacatcttccatttcatatatttcatcagttggttgagatttttagaagataaaacacagatatggtataaaattcaaaaggctctgggggagatacagtaacaaatttgcctttcttctaccctcctattccagcttccccgaggcaacctttggcactgcaccaccttttgcaatgtgactaggggagtgaagttctgacttgcaaaggttcccgcaactacactacccagtcatttgggaggcaggtgaccaccacgaggtgggagctacatatgatatcaagacagaagtcatctgggtgaaaacaaggtcctagtattctgtgccaggagcaggcacaggccccggagccacagcttgcagaggaaaccaccagggtgatgaccaccccctagaacgttcacagaacaatgggaagcccaggggcagagaccacccagccagtcaacagggccagacacctcaagctcctcactcttgttttggacctaggagatttcgagctggggaaaggcaacattgctacccaataggatggaagtagatgtgtgcgtaccactgtcatccttgaacctagagaggtgataatgtgttttgtctggaggaacgaattcaccttaaaggaattcaactgtgagctgggtggcatggtccccagtgacaggctttgtggtggacacagctgacaggaacttaggtggtggggagaaggggggtccaggaaatcaaggtaccgggagaggttcgatccatttagtgatgagcaacctaggccaatcctaagcctggactgagtcccggggctgagccgcatgtggtgggggcatctgcacacactgctttgtcaggccagattgtgaggctgagtaaccactgccctgtagagtcaccaaaccatggactaaaaaaagattcaagccacacaggctcatctgtttccccaaggttcctgcctaatgtggcgatgcactggcaggctagagggtgagtcgggcacttatctgatttcagccaatctgttactgtatttcattccctgtcctcgtgcccagaggctgttgcaatgggtataaatttagaaagagaaagataaataacatggaaaagttccttttaaaaaatagggatttttttttctctattttgctaaagaaaagataaagtgatcttcttgttatttatttagccttaccatggtagaatttgatattttgggcaggaacctaataatgcataaccatagcccaggatgaaccagcttctcctgaaactgtgaaagaggcaagcctccatcctaagcgtttcttagaaactgagggagtgagaagatgacagtaccttgcacaagatctgaaatccacgagggtcccttctgaacaagcaaaagactctgaaagaagactgtctcctttatatgaaacggtctataccagctaacataacacactgtgcctgaaattgtcaggccactggcgatttcactgtacacattgatactttaaaggaaacctgttctatgaggaaattaatatcacagatgggagattttcagttggtggaaagagaaactgcttgagaaatgtttgccttccctcacacacaaactcacagcctggtgggttatggaactctcatggtaaaagactagatcaattccaccacctaatcatttagcccaaggcccattctacaggggagaaaaccaaagttaagtgactggcccaagatcacatggctgccactaatagaggggggcccaggaccaggtctcacagcgcttccctggggtcaccgtgcaactgccacccaccacctggatgtcaaccagactcagcagctgtacctctgacagcatctcatactggcctcttcttccaagagcaatggtgagtaagtcatagaccacagatgcactctgcagactgatgaggcggtcactcttgtgttcaggtatcctgctcagcacagcgtcccggttggcctgaaaaaacatggaatagagaagcagatggagagagaacctagtgctgcatggcggggagtccacctaggccctcctgcccctaccaatttgcgaagggaatggagacaagggtaggaatgagcagaggcctgtcatcttgggttatttattcaaaatcccctgggcaccgcagaacatgatatacgggatgatccaaacactgaagtcctggaagtgtgaacctagagggcacctgtacctgtcgacaggcatctggaggaagccttggcagccgatacaaagttttccctggcctcgggttcatagccagcctcatagaagacgcagctgcgctctagagcagccgaatcatccatcaagtgaggccctgctgcacctcactcgtgaatcctgcttctgctctacattaaagagtgggagaaaattcccagccctgcatttcccaacacccaattgtgtcatcaagttccatgagtcctacagagatatatcttacttttcctctatcaccaagcaacattcaaatccctatatgacatcttcactggaacagaacacaaagatgagttcaatcttgtttaaggaagcacaacacagatatataagagaaaacaagaagaaagcagatttttactttaaaagatattaacacagaggactcaagagaacaccgtcaattttctatgcttagcacagaaatacatcaggcacattcaaacttattaatctcatctatccagaaatcaaatgctctttacagcaacttgtttccattacttctaaaatttaatttctctacagattcctccaaatatatcacatgtctgagactcaacagctagctcattttcctcttttccctaataggaagttcagaatcaacaaagttagatttcgcctgcctttttccctctgctaattaacagaagtctgcagatccatctgtctgtaggagcagagaaaggcccccccagtctttcctgtgaaagtggtacatgaggttccggggtcacttgtcccggcaggctgacgttgatcttccccctgacattcagaaaggccacacacacaccttccctctcactaatgagacaaaatgcattttctttgtgtgtgagtccaaggcatttacttttagccacccatcagtacttactcactttaaaactccttgctgttaaatgtcaaagacaaataagaatatataagacaggccacttcctacaaagtgagtcatctcttacggaaacaagcctgcttttgaagatttcattctaagtttttcttgttaggagtccctcttgagcccaaaaaaagcagctctgaaggaaacaggggcctgttgcaaatggtctcattttatttatttgctatatatgttccatactgagaccaatgcctggaagagaacaaaacaaacatactatttatgagagactttcaagttatactaaatgcattcttttcatttttagagaaagtatcagtatcttttgattaaaaaggtacaatatagaacctcaaacagacccacaaataataaatatcccagaatattgcctcagtggtagttctgcaaatcaagttcttataatcccattctcctaggggaaactaatttgatttgtagttagaaaacagcacaattctaaatgataccttgtaggtggagaagcgacggacaaattcatgcttctgaattaaagtcagtaccaacaaagaacacaattttctgacatccaaaaaacacagcaattttcattttggttttgaaattgagcacattcattttctgtctaaaaactaaacaatcgagaagtcaaaggatatggaaaaaaggcttccaaaggcaatttcatttagatttctacctacattttctgaaatgatttacaggaagaacataatcattttggttagaaacctcatccttcatatccactgatgacatcactggatttcaacatcccctgaagagatttttctggcaattacataccatagagccaaatctgactgtctcaaagggatctcaatgtttgagtattattagtttctatcacttcaattaagaagcaggagagttggagatatcattccaaagacatctccacttagtgcaagcattttagagaggtggccatgttttccaaattgcagactggaacacatcatctgacagtggaacataatgttttcaatcagaattgtccaggtaatctaaaatgtacagtcatcatgctttcagaacttttacaccataaccaaccaagtttgcccaaagggaactacctgccaaggacccaacttgggatgagggaatgctgaccaggaggccaagatgagctggctccatggatgacccggtggggaagcctgtggagactcgttcacttgaatgccacctagtgccagcctgctcacctatgtgcttccctgattgcaccaaggcaagtagagaatgtaaatgacaccaccctaagttatcagctgactatcgggcaacctgcttccttgagaggaagtaagcccaatgacaccaaagagcctccagatcaaaagaggtggtaactcaagcagacttgctcttgtaaacatcagtggaccattcaaagttttaatcaaaggcaagaaagctgccctctcatgagttctggcctcttctgaaccctccttctctccgcgcatgtacgttattatgctcagaccccatgtctatactcacctgagtccattttatacctcccattaaacagtatgtgtggggagggcaaaaagggaaatgccttctcttgctttagttatgattcccttctctcccctgggctgccccgggggttggcggtaagcggtgacaactatggggagggggcagtacaatctcctagcaggaacaggagaccactgcgtgatgcacgcattccgcctgctctaggcctcaggttcctcatgtataaaacgagggaaggggacgcgagccctcaagatcttttgattccaggagcccacccattctgctcaggtgctcagtatacatcacttttctgctgaggaattcactattactacacacatgatcctgaaggttttaagccagggccacagcgcctagtgatagatacacagggcagaaacccaataaatgatgagtggtgaaatagacctaaaattctatattctggccaaatactaagaaaatgtttcaaaggaatcagagggtctggcaaaaactccctcacaatagcagtgacaagtgagctctcacggcctgggactttacagtgtctggcaaagccaggagctggaagagacaacaagggcaggaggatgagagtttcatcaagctcctgctgtgaagaccagagctttatagatccaacaaatgacttatcccaaaattctcgcccactccagggcaaattgagaggcttataaaggtcaccctttgggggcctctttctccttttaaggttcctccagtggtcattttagctgtggtttacctagatacaactgcaataatgttcagccaatactgggtggatgaatgaatgaactaagatacgtgcttcaagatagaagatagagaagctccaagctccaggctaaccaagggacattgctagctggtccaggaattaagaaacaaccctctttttaaacctctactgttttttcccatccaggtataccctctagaaagtattttctcttaagaaaaagagtcatgatactggcagaatggctatatcaaaaaagggtctacagggccaggggaaagaacgatgtaaaaacacattccacttaccattgattcactaatcagcaataacaacagggcttcttccgtattttcttgaggacaaaaaatgctgcagttgaaagaaaactgactttgatatatggcagtttcaaaatatacaaatacaagcagaactgaacactaaaagcttccagaattttatataatacccatgaaaaatactgtataatttggacacttgaattaatttgcctatttctatggtaatctatggaattcatacattttagctatgcattttagtggtaggcagaagggtaaagtaaagctgtaaaaaccaagttaaaagcccaaataacatatgtacatattacagaggcagaattttagatttcaataaattgacattatctaaataatacaagctttctcctaaacctattagagaggtataaattgcaggcatttcactaaacagtactcttcttacctcttacctgctaactggcatatcttatactgtcgtttagatgaaataagagattagaagcaattttagagtttgaataatttctctaatactgtaagaatttagtgaactatcttatttagacacataagttttattatggggtagcatgcaagagctcttattaatctattttatggaatttggctgaactcctaaatcttggattaaaagaaagagctttttaagctcaatgttgctcaggattagagaataataaaaagtcagcagaaccccaatctgtattctctatagcctattttctgtgttgtgagcaattgcagcattttttctcctgttctaaagctctagaatcctttgagcagaattgtgaatgttatcaccaattgggtcaaactcaatattttttcatgaaatggacgaagagagtgcaataaataaaaatgaacttggtttaaaaaaaactcctagatatcttgaagatgactaaaaacaactaagtttatgtcttcccagggataatattacaatcatgtaattgaagggatttccccacacccccaataaaaggcaaaaaaaaaaaaggatttccacataattacaaacatttgttttctttgaagtgctggcaatttttgtactgcatcttaggatgataaagagcaagacaggaggaatgcagcgcctggtattctcgttacaatgctgataccgctggaggtaaggaagccacctgcaggatggtttctatcattcttctgaggctaaaattttatgaaaaggctggcctgagaatgaggagcaagattcggggatgtgcagtgacttgcttcagaagtcagcttgagatgatctgggtttttcagatgggacacttctttccccttagattctggaatagagcctaaaggctctgaattaagtgtctcccaaacaaccacctcagtatgttgttgttgttgttgtgtgtgtgtgtatgtgtgtgtgcatgtacatgcacactcgtgccccacaatcatttcctgatatcctggcttgtggttacatgcaattgggaccttgcaaataaagcagtaacatgaaccattgtgtgtatgtgtgcacgcacacacccatatgtgcacacccatgcccagcaatcatttcctgatatcctggcttgtggttacatgcaactaggatcttgcaaataaagcagtaacatgaatcattttttttttcatggctagccggttctgcattatccagaccaattgaaaagacagacagcctatgctaattgtgacttaacagcagtcaattcagtccatggctaatctccaaattctgtttgagccatccagcctgcttaaatgctagtttgtgttatttttaccatagttgctaacaagtggcacattaaccgaatccagctccacttcctctaccctccctatttgtggcaggcaaggtgggtactcaggagcactgcaaagctcccaaggccagcaggagccgggggagaaaaggtagttttaagagacatacctaaacaactacacattagaaggctccctctcaatcattatgaattctctagacccatttccggccaattccttccctcttgtttgctcagggaagcatggatggagctcagggtgaacgggtcaaaactgttggggccttccttttgtggccttctcctctttggggcccacgagcctcagggggagatactggggtacccaggcctcagccttgaagagtgggaaaactggggccctagatccagaggaagttgcgtgaaggggaaggtgggggacgaaaggggacaagaagaaaacagggctcagcaggcatgaggacaagctcccaagagctggcaggctggcaaaggaggcggcagtggggcagctgctgcgctgagaatgggagggtgcgtcctcgtcccagccatgccaccaactcactgggtgacctttaggcaaactgcccattttcttactttggatgaatttaccaactcattttctgattctacagaagacatagggaacaagggtgagaattctcaggtataagtagtaatcatcatcttgccagggctcccacataatagctttttcttaaaaatttcctccgaaaggtagaaactttaccttaatggtagacacaatcatacaaaagaaattaatccaactttacccaactgcatttcatctcttctgtcatcgttagccattatataactaatgacaagttgaggtctaaaggtcaccggcatcccctaaaattctctatttaggtgcagggagggccttgaacactgccaacccacgagaaagttgatttgtaaataatgacaacatcaactctaaggtctagtaatggttcctttataattttaatatgtctggctgagatactaccaggaaattcctggagaaacacagcctctgaaccacagccagccaggtaagagctgaggcatggaggccaagaatggctgaagtcccaccccgaccccaagtcacactgtctgcaaacatgccaaggcagaatctactgtcgatcccaggtttatgtggataaatgggtatcaaaaaaggaataggacttaaattgaaaattaagagtgcatcttgattattagggatcagctagtctgatgtaaggactatcgaggcctcaccacgcttccattttgtgtcaattcatataggtcaaaaatctccccatgacaaagaaagaagggtccctcacgcagcccagtgcaggtccactgggctacactctgctgagtgggtcaggtgaatcccacatagaacatcaccttgcacaagtgtttccatgttcctgctgagaggacgggcctctccacaactccaaggtgggctgtgtacaccagaggcaaggagatgacaggcagccaacggtgtagctggtcgtttacacagctttggttcggccatcaagaagtcatcctgacccttcaacatccctctgctttccattttattttatttatttatttttgcaagctcttgaggatttattgtgtccacggaagggcctggccagtgcctggctcgggatgttctgccctccccggccaagacccctccattttccattttaaacagcattcccatccttaccaaaaactggaaaccaggaggttcagatctacactcaatattccatgataattaccttttccgccgagacctacaaaggagtttagacagtgcctggcactcactagcattcaatgaatcttttcatcatctgcttcttggaagtattatccaatattaaccagtatccacaatagctgtttttaatcttctgctttactttgtgttaactatctagtctaatgtgcatttaattgtcgaagctacctcaactgcttcttacaagaagaaatacaatgaaaaaaagtatgcctgactgactgaaacacacacacatatatatatacacattaagaaacatgtagatgcagggggaaaaaagaaacacgtacaagactcttcacagaagcactgttcctattagccccaaatgggaaacaactcaaactcacaacacaagcagaatgggtcaatatattggaggacagtcataaaatgaaatacctcgcagcaatgaaaaacactgctacatgaagaaatatgggtgaatagttcaaatataaagttagacaaaagaagttaaacattagagagtgcatatcgtatgattccatgtatataaatttcaaaaaggggccagactaattattgtgacagaagtcaggagagtgctgccctggatgggggtggtgactggaagaggccacgggagggcgtgtagggctccagtagtgtcctttcctgaccaaatgctacttacatggatatgttgatgaacttggtggaagttcatcaagtttcatacttttgatttatttttctctatgtatggtgtgtatccaaaaaagcttactctaaaaaataagtaaactaaagctgatacaattcttcacagaaaccacccagaaggaaagaaagcaaggaagcctatgacaggtgatccctcttctcattccatccaggattttctacattgtatttcctttcaaattcaagatgggcagagtgagcatcctgtatgcatttcacgttcaggtctctttgacctggggtgcagcttcctggcagggattgtttttcagttatgttccattacaaccaactcttctgaatggtccttgtggttttctggagctagagggatctctgccatctaaattttgcttgacacttattatacttctcataagagactgtggagaaggagactgttagccaaaatgaggtttgcacattatctacggattccctttcccacctccaaaccagcataactgaatggtgagaatgtgctttctgccaatgtgaatgggtcagagtccagccttggtaagaagggaacctccaaacaagaataactcccacagctgttcctctttactaatattctaagaagtagagctctgaacccacaaaattacaaagctaaaaactgatggtgataaatgaaggcataggattcatgtggaaatcgatgaaacagagaacagaatcacaacagaaaaaagtcaaaacccaaagttggttcctcaaaaagatcaacaaaattgacaaaacttttagttagactgactctaaaaaagagaaaaacgacttaaattactaaaatgagaaatgagagaacatgacaaccaaccctgtagaaatacaaaaaaattataaaggaatgctatgaacaactgtacggaagcaacttaggtaatttacatgaagcagacacatttctagaaagatgcaaactattcaaactgattcaagaagaaatagaaaatacaaatagacctaaaataagtaaagagattgaattagcatttaaaaaaaaacaaaaaaaacttcctacaaagaaagcctaggtccaggtggcttcactggtgaagtctaccaaagatttaaaggattaataccaattctccacaaactctttcaaaaagaagaggagggaatagtctccaactcattttatgaggccaatattactctaataccaaaaccagacaaagacatcataagaaaactgcagaatagtatcctttataaatatagatgtaaaaatctttaacaaaatatcagcaaatagaacccagcaataataaaaaggagtatataccatgacttggacagggatgcaggttggcttaatgtgtgaaaatcaattaatgtatacaccacagcattagaataaagggcaaaacccacattatcatttcaattgatgcagaaaaagcagttgacaaaattcaacacccattaataataaaaataacaaactagaaataggaagccctttacttaacctgatgaagggcatctataaaagcccacagtgaacaccatactctgtgaaagactagataatttcccccgcctgagatcaggaatgagacaaggatatccatgcttgccacttctatttaacattgtactggaagttctagccaggacaattaaggaagaaaataaaataaaatgcatctaggttagaaaggaaaaagtaaaaccatctatattagtattaatagatgacacaatcttgatatagaaaatcctaaggaatccaaaaaaactattaggaccaataaacaaattcagcaaggttacagtacacaagatcaatttacaaaatctgttgtatttccatatacttgcagtgagcaatccaaaaatgaaattaagaaaacaactctatttataatagcatcaaaaagaataatgcatatttgcatgcacacatgtgcacgcacgtgtgcacacacatttaggaataagcgtaacaaaagaaatacaagctttatatcctgaaaaatacaaatcattgttgaaagaaattaaagacaacctaaatagatggaaagatatctcatgttcatggatcagaagacttaatatttttaatatggaactattcctcaaattgatctacaaattcaatgcaattcctattaaaatcccagctgcctattttttttttttttcaaaaatggacaagctaaaattcatatggaaatgcaagggcttgggagacaggaaggtgacagctaagaggtgctgggttcattttgggggtaataaaaatgttccaatcatggcgatggatgcacaactaggcaagtatattaaaagccactgaattgcacaccttcaatggatgaattgtataatatgtgaattatgtttcaataaaacagtttttttaaaagctgatcacgtgtatccatgtgaactgaaacttgtgactcagtagacagtgctactacgggaatgctccctttaatgactgcattttctggagctgtattttgcttctataattctccttgtacacatgggaaagctgacattagaaaagtgacaaaatctgagtggttcaggaaatggagaaatggccagcactgtgagcttctctgccttcaaggggtgaggccatactggatggcacccaaagagacacagagctctggccatgtgtcaaagtggactgggggaagagggtgagaatggaggtccttaatgcacctggcaccttggttattaagaagcatctaaagcaggggaaaactttagagtctatttttatgatataaatatcacttaaaaatgaaccccaaacctgcttcacaatgaggggtcagcattttaaaaataagagcattgaaaattgctagaacagatgttctatgaatccagataaggactaaagagtaaacacatattgtgaattaagcaaactcatggttcaacaaggctgtagaaaagggggatgaaaactaaattacgataagccgagggaaaaacctaagaatatgctaactcatctgaatccatgtaagaaacacaaacttgaacaagaaggtgacaagagagagaaatgcaagggtcaacttaagaggattattaagaggtggcaaccttgaagaaatgccgactcctctgaaagtacaacagtcattttcagatgtttgaaatcttgatcttcagatggagaaagcgtgtagtcacgccatctctattagtgctttctctgggacttcagaagcagccacctcatcctctcagctgtttttctaatttgaaaacatggaaaaggtcttcaatatttattcatgtgtgttcccctttccttcacacagagattctgaaaagccatcatgtcttgtccttacaagaacaggcaaaggccagagtggtggctcatgcctgtaatcccaacactttgggaggccaaagtgggcagatcacctgaggtcaggaattcaagaccagcctggccaacatagtgaaaccctgtctctactaaaaatacaaaaattgtcccagcgtggtggctcacacctgtaatcccagcactttgggaggacaaggcgggtggatcatgaggtcaggagatcgagaccatactggccaacatggtaaaaccccgtctctactaaaatacaaaaaattagccaggcatggtggcacgcacctgtagtcccagctacttgggaggctgaggcaggggaatcacttgaacccaggaggtggaggttgcagtgagccaacatcacgccactgcactccagcctggtgacagagagaggctctgtctcaaaaaaaaaaaaaaaaaaaaaaaaaaaaaaaaaaaaattagctaggtgtggtggtatgtgcctgtaatctcagctacttgggaggctgaggcaggagaatcacttgaacctggaaggcagaggttgcagattgcgccactgcactccagcatggacaaaagagcctgactctatctcaaaaaaataaaaaataaaaaaaatttaaaaatttaaaagagcaggaaaatatgggaattcaagacttgaatgggaggcattgagaatgagtcaacaaccattccagcctcccagcccttctccttgtctctccctcctctgtctggcttcccctggcctggggaaggctcatgctaagtctatagtgattctctggcccattatcctccaaggtgatcaagtctcaaatttaaaacttaaaaaagataaagaagttctaaagacacatcaccttccaatcacttgcaaatattagattctccttcttatatctagttccatttagaacaagattttaaacaaaaggatcaaggaattgctgaagaaaagaaatgttagatgggtgagatcgatgttagatgttagatggcttacagatagctttatttctgattgctgtctgatgctgaggtcttataataaatggaaagaaaattccaaaagccaatagtgatggctgcaaatggcacccaagcactgagatgagagcattctcctacttaaaatgtccctgctagtgcacagatatttgctgaagttacgaaaagtaatgaggaatctctactaaactggaaaatgacacttgttcatttgattttcttttaaggaaaaaatctactcttgtacttctcatcatccttgaattttcccaagttttcctcccaacccataacctacaagtgaggacatcaactttcatacttctctcctgagtagacacgggctctccgagtgagagtgtaggtttttgtgtttgctcctttgcggagaggatcgtccagaggtgactggcacggtggatcctccagagggttccagtagctctgctcacacataccccgcaacaagatctctgccagctgcctggctattgtctgggaacataaacgaggaaaagcatagccatgaatctatcttgtattagtcattcattcagtcagtcaataaatatttatatcatcacattgtgctaagcactactgcaaggctcataattaaaaatttttcctttacgatggtaatcataccagtttatgacaagaaagaaaagaaaatatgattcactaagatgtttgaacacttaaaaggttcatgtacttcaaatgccaccccacctgtcacactctggaatactaaacatgttttatacctgaaacaactgaaacttttggctaagccctttcccaagagctcttataaataacaggtgagctgcagatattagcatcactaatgatgtgtgcttaacctcaagcctggcaaaatgcttgtactcagcttagataacgctatccctgaaaaaattatcctcactgacaatccgatgtccactgtagacgtcttctttcttacatgtaccaatggcagggcctaatcatcccacccccgaggactcagcacctgagtgtctactctcagtgcatcctgggctcctggcccagaggttttcactggccttgtgcaatagggaaggcaaagtgggaaatggttcccgatcaagaaagacctttctttaaagctggatgggtatccccttcttcacagtgaaaacccagaaacatctggatcctgtcctccaagttagatgcagattaatatgcttcccaaacttctgtaattccactgcctaaaacagtacgatgtataatataatgtatgggggaaaagaatgtgtggtatgtactaagaagtgttttgttgactgatgtatgtcagttcacttagcttgtaatcttccagtaacaaagaagaggataagtaatttaaaaaaaaatccctctgaaaagagaagcactgcatcccagggtagttcactctacccatgatcagccagaggtggcatcataaaccagcatggttttctaccaggttttagcattctttgaagatgcagacaaagactgctgatcttctgagaaggagacttttttaaaaaaataagtaaatgtttcagaagagggctttgctaagctttcatccatatgaaatctcttaaaacaccacaaggaaaattaaatccaaccaaatcactaacagagtggtttctgataaccactgggtaaaggcaaattttcttgattattcccaagtaagacccattggcattaaatgtctataaaaatgtgaaattaaatgcactctgatcatccccaactgagcaatctgtaaagatctcataagaacacaattttcaggacctaaacagctcctgaactggtttcttaaaccttccattatagtttcattttgatctcattgcagtcatataagctaatgacttttgctggaaacttcaactggcaaaaataacttccactcactatagctgagaaataagtgttaaaaggaaaaaaaatgaacgaggaatttcattttctgaatacatttgccatggagggattttaaagttgtaaaaatttctgccctaaacagtttgcttgttcactactagatagctcatgctaggtctcattttctctcagggtattaaccttcctgagagattttttaaacgtggggttttgatgtgattgcatattctgaagacatcacttcaccagttctctacctattaagaaggccatttggttatgtccactgaaagctcaaatgaagttcagaaaaaaacaataaatatgaaattaccagcaagatcaccaatatctagaatactttttactttttaaactcaacctacatttagcctgtagtttaaatgcatccaattgttggtaactataaaataaattcaggatcaaaggagagaaaggtgggaagtgggcctgaaataagacctggatgtttatgtacaaatttggtcattaaatgccctttttgtgtgtgtatgtgttttaaaacttgtgatgaaattcacataacataaaagccaccactttaattatttaaagtgtacaatccaacagcattcaggacactcacaatgttgtgcaaccattagcactatctagttccagaacattttcatcaccccagaaggaaaccctatatcctttaggcaatcactccccacttcccctccctctcagactctgggaacaaccaacatgctttctggctccatggatttgcctattttggacattttatataaattaaagtatgcgatatgggtctttttgtgaccagcttccgttacttagcataaagttttcaaggttcatcagtatcatcgtgtatgtatcagtacttcattcttttttatggctgaatgatattccattgcatcgataaaccacatgctgcttatccattcttcagttctagacatgtgtattgcttccaacttttggctatcataaatagtgctgctacgaacatccatgtacaagtttttgtttgaacatctgtggttttttttgtttgttttgaaacagggtctcactctgtcacccaggctggagtgcagtggtgcaatcacacatagctcactgcagaacacctgtttttaattatttggagtatatacctaagagtggaactgttgaaaatatactttcaaatccttctctgctatgatctcacaccagatagagtttacaaagcaacttttccatctcataagaatattataaatttgcaattatcagctaatcttaaaaaatcatagtttttaaggctgatggaaacactgcttatgaatgtcattagatggagaaactttctaacgtccaatgtaaatcaagataccagtgagagtcaacaatatgaacaaatgctccatacttaagcaattttgaaaaactgactttttaaatgcgcttttaaaacaattacgaaaacacttgccaattcagtcagttactttcattgtgcttccaaatcttggaagaagctgttcatattgaccagttgggaagttttatgaatactgagaagaggtaaatttgagagaaaagacagctggcaacaacttttatccatattcttgtaggttcttttgccttgaagaatcctaaaaatggaaatattttgtttgaacttcttaaggcacctataaatcacattgatatttaagtaaattttgaaggccaactgagctcttggtggtggtgatggcagggtgtgtgtgtgtgtgtgtgaagttgtccatcctgtctcacccccataattctaggaaagcccagcttggccatctggccccatgagttgtacgtccacctcttaaaactctgcagacaccacaatgaagtcatttcctatgacatgaatctcttagccatgcccaactgaataatctcctacagcatttaaaggattcatgataaagaaaggacaaaagtatgggcaataaaagataaattgcaatcttacatgaggttgttacatcaactgtgacatgtggcatttgcttagttttaataagcaccagtcctccactcaagcacccactggctatggctgtgtagggcaagttatagaggtctacctaatgaacgtccctagataggaaagtgaaaggattaaaaaaagaaaagaaagaattcaagtcaacaggagagtcaaattgctaaccaaccagttaatttaactatgttgtatatttttcttccaagttttatagtcaatataattagccaaacaactagcagccctcgggatccaatctgccttattctgtctgggtttggtatgaatcataagcatacaccaacccctcaacaccctggcagccacgagggcctacattctgcctgccttaacaggtgcaattctcaggtttcagcagagaacgctgccaacaacacaggaaaggatgctcaaaatcattagccatcaaggaagtgccaatcaaaccacaatggaatatcaccacactcccaccaggatggttacacctaaaaagataataacaactgttgttgagggtgtggagaaattggaaccctcataactgctggtgggaatgtaatatggtacagctgctttggaaaacagtctggcagcacctcaaattgttaaacacagttaccatatgacccagcaattccacttctaagtatacagccaagagaaagaacacataagtccacacaaaaacttgtacatgaatgttcgtagcagcattacttgtacttgcccaaaagtagaaacaacccaatgtccatcagctgatgaatggacaaataaaatgtgatatatccacacaatggaatattatttggcaataaaaaggaaagaaatactgatcatgctgtgacccagaggaagcttgaaagcattatgctaagtgaagaaagccaatcacaaaaagactacaaattagtcaggtgtggtgatgcgcacctgtagtcccagctactcggaggctggggcaggaggcaatgagccaagattgtgcgattgcactccaacctgggcaacagagcgagactctatctcaaaacaaaaaaacaaaaccacgaatggtatcattccagttatagcaaatgccccaaataggcaaatccatagaaacagaaagtaaattagtggttgccagggactagggggaggggaaaatggggattgactactaacgagtatagagtttcttttgggggtgattaagatgtcctgaaattaaatattagtgatagctggacaattctgtgaatatgctaaaaactttaaatgagtaaactgctatttatatattataaatatatgtcacgtaaatatccattatgacacagaagtgaaagggcttgcgcaagttcacaagcccagtgacatatatgtataatacatatatgtcacatatattataaatatatgtataatatatgtcacatatatttataacacatatgtcacatatatttattataaatatatgtatatttttattttattataaaatatattttattttattataaaataggtatattttatatacattttattttatataaaataaataaatatacatataaaatatgtatattttatatacattttattataaaacatgtatattttatatacatatatatgtcacacatacaatatatgtgacatatatgtacataaatatatgtcacatatatttataacacatatatgtcacatatatttattataaatatatgtataatatgtcacatatatttattataaatatatgtataatatatgtcacatatatttataacacatatgccacatatatttattataaatatatgtatattttttattttattataaaatatattttattttattataaaatatattttattttattataaaatatattttattttattataaaataggtatattttatatacattttattttatataaaataaataaatatacatataaaatatgtatattttatatacattttagtataaaacatgtatattttatatacattttattataaaacatgtatattttatatacatatatatgtcacacatacaatatatgtgacatatatgtacataaatatatgtcacatatatttataacacatatatgtcacatatatttattataaatatatgtataatgcatatatgtcacatatatttataacacatatatgtcacatatatttataatacataaatgtaaaaaaatatgaatgtaaatacctatgagacaagtgccctgctggcctcaatcaagtcactgttcacacttaccattcgcaggttttgagtcgttcttgtttcaactgctctgagaagctctctaaatcttccgactcctcttgtcaagttcctgtgtggacacagaatttgacggttttcatctggcatgtattaatattaaatattttatatgcacgtttcaatgcattttgtctgcataaaagctgttggctagattttaagcaaacgattactctgcacatgcctagccatctttggttaaatgaaacatttgacctaagattgatggccttttgtgttttctaacccctagcacattttctctaaaaaataaaaatttgaaaatcagttgaagccaacaaattaaaaagcaagataccttagaagagtctgtgttcaaactctcaatggctctatagagtgggactgaaatctatattttcatttaaaaggtgggagacaacactgggcaacagggcacaggaatatgagcaagcaccgtgtgcaacatgggtaaggataaaatatgaagatggaaggcacaaaaaaacaggaactccaccaagcaaccactctgcatctttgagaacataaacttatcaaacccagtaaattcatcaaaccaaccctcctccaaaccccacactgacgaaaaagaagcaaagggtcagaggccccttctgagagcgagcatgtgacaactggaacccgagctccctgagtgtgagcagagcacacctcatctcgctgccactcacaccccacagggacacatttggtgacatgtttcattaagagacaaataattattttgtaacatcctggtcaatattttcaagccccacttgtcctctctgaaagctgcatccagcctgctgagctgggaacgctccccagctggtccctttacattaagcacggccaccacctatgacataactcggcgatatttataacctgctcattagaacatatctcatctttccaaaaagccacagtgtgggtcagccagtgcaaacgtgtcagccagcctctgcaggccgtggcagatgctctaggtatttggctctcttcttggacgacattttgaatcatgcaaagatattaaatcaaactgaatgtgggttctgtaagttacaagcactcatgagggctattaattcgcatcttatacctacatgacatcccagggctctcatgcacaagaatggccccagaactttaagataatgatttattggcataggtacataaatactcccatagtcctctcacccacacatatcagatgatatcagatcagaagcttgatggtggcataaaaagagaagctgtgctcaggatgccaagcagcactaaaggaaacctaacagagacgtgaataaagattaggtaacaggccctgggacatgcaatctactctgctttctccttcatttgtttttatgggatccatgttcacaggcaacaaagtacatttgctttggactgaagctcagttctcttaagtaacacggcgggaaggaaatagctacagctaaacaaaggatgggaatggatatggtagtctaactttgttccagaatcacggattaaactcctactgggtacagaagggatggtactttgaattgtatgaaataagctgtgactgaggcaacataagtggagaccctggttgaaggggctgatttaccaggtagaaatcaggcctggaataagcaggatcaaacctaaatattgtaacccagggaagcctacaaataggaactggtcattcagaatgtttccagtgtcctaggaaacagagtaagctacttagacagttacagaagcacagaattttccagctataaatgatccaacagaatctggtccgttatgacacagaagtgaagggcctgctcaagctcacaggcccagtgagagagtgagctgggagctttctaccgtactctgttaccttcctgggtacacataagctctaaaacagaagtgtaactctagaggaaggaacaaaatatgaatccaagagttcaggtctatgttttgcatcattaatatgcaaattacttcatatatttataacataaattctgtgtgtcccagtgatgacagctaataagatactcattactggtccaaaactggaaagaaaatccgttggcccaggtgaagaagtccagtgaatgcgggtaatgccctgggctgccgaaagagatcaatgacgggtagagaaattcaattcccccgttaaggtgcaagacggtttctcccatgcaggaccgaggccctctggtggaggaacggaggaagtctccgccccgaaggaggccaggcaggatgaggcaacaccagccactgggtgcgtattcccaattaagcctttgaagcaaatacaagtttttctcaaactgtttccagtttattcctggagagagtttaagattcagaagcaaattcttcctcaatctgggaagcatctgcttgtaaacaaagaagccacagtaaccacagagctgagaaggcctgaagctacaacccattgcaatgaatgcggcacccagaagggtgcccgccccaccacagatcaatcggacagcaagaagaggtgaaacaggcacatcttaaagtgcccaaatgtaaaagcatgattcccaggaaatcctgtcttccaaacatgtttaaatcacataatcataattttattcaactaatcgcttccactgttgccatgagagcagaaaaggaaaaatgttcaagtacacggataatcagaacaaaaaaaagaggaagttaacttgcaagaattctattccaaatgctatgagataacccaatttgagagaggcaaacaaaacccacacgattgctttcatatcttcaaactgttagttaattcttaaaatgttgagatcaattaaacatctaagaaggaactgttgcttaaaactccactcaaaatgaagataagagagccaaggaatctcccaatctccctgttttgagggtttccacaaatccctgacattaggtcatttattccatttcaacacccttgcctgagagagtgcaatgatgtcagaattcattatggtaaactattctcaaaacaaatgttcctgccagcattcactcagcgggcactctggcaagctgtcagaacttggggttcatctcctgcactttacttcacaagcttcctgagctgggtgcatttccttccacttggaatcgttcccaacagctcggctgggaccaaggaggaaagggcctgcaggtccccggagcaccagctgctcgttccgcctgacaggcaaagctctgcttccgctcaccaacatcactgtcctcagcccattatggagagctcaggccagagtcccacagccttgctctcattcaaatccttgtttttccactggcaggaaagcctaccacttttcatggggacatagtctactcttcccttgacctacttccatcttttcttctctcctatcttttctatctggttttatcctcctcctgctgaacctccttccagggcttgtctgctgattcgccagcattcaaccctccctctcgaccctctgtcctggcgataggttccagttcccccttgggccccatggcagcacctttccaggctctgaaatgtacattctaacgtacaagcttaccgcacctggtttcgtcctgttctatgactctgaaccacattctcggctctttaatattgccatctgtccctctgtgatcaaaccaaggaggaaatgtaaatgggaagaaggccagagctccaaaatcaaaatggaaaaccaaggctagagaaatttggggacatgagaatcatttcagcttgtaatgagtggctacttcaataataagctcaatacatttttgttgtgttgttatttctccttttatttcttgggagtagggtgggaaaagacaattcttccctttaacttgtccttccaaattatcttcagacctcaaaatctgacctaggcaccaatacacttaaattcaatatcacctgtcattgtcgtggaaactcaaagtagtagtgtgaataaaagactgggtcaatttcctgggtaatgaggaaaaggaggcctgctagagtctattcaatatttttttctcttatgtggctgagaatcttataactaaagatcaaacacaataagtcaacccagtagatctcaaagagcaaagaaaccgtctgcctttctccatgttttcttctcaccaaccagcactcctgaaatgctgaagcactaggttacttccacaatgactgagcaatgtttctcagccaaggccaggttggtccctgaggacacactgttgagcaggggacaccgtccctgcctcagggagcttagatggcttcacatccccacaaaaatgtaagtgcctccaagacagaggccttggctttattcactgacataacccaagcctctgaaacggagcctggcatacaggaagcacccaattaatatttgttgaatgaaaaagaaccatcatgagccgaatgaaccaagacaatgaggggatacatttcctacccgtttcttttctccttctttctcactgaacacagttcagcaggcagcaaagcactgcactctcttaactagaacagcctagtatgccctcgggggctttgcttatagcgtggagacctgggggagcagtactcctacaccagtggcatgcccagcctagcagtttctagagagctacgtggataatggagattttgaggttttttaaagaaaagttccaggcatttcagggaaactttcctgcccttgtgccttcacacttgctcctctgtctgcagggtcaagacccagggctgaggccagcctagatagcactttatacctttccatactgattttcatttgagtttatatctgttcaccaaccaaactgcaatcattgtgaaggcaaaggccccctgtgtacccaccactccttgtctcaactgccttacagggccagccagtaccagtgacgtttaacaagctgggcacccccaaaagaaagaaaagagtgagcaccatcttatattcccagacccctttccccatctccttgctgaaaagagttatctcagttacaaagggaacaactaaagcaggtacttggtataccatgagatacatcccatcatcatatacgtatacccttatggtatgtatctgcttttccagagttgtaagtgttgacaaagacaatgtcattctggatattgtcaacacttacaactccggaaaagcagatacataccatgtatcttctaggtccatcacttttagttctcaggcttgagaatttacgtaacccttagtatcatctatcttgaaaaaggctgaaatcaaaaccagatacccagatctggaaagtgggagaagaacagatacccttcacagtccaaaaggacactgtggccggctgtcagggagctgtttttcccagaatggagtccagcttccccctctgtacatactctcctcctcatatccaatgacacgcatttgtgaagacagatggcttgctgcagtcaggggccagggatcaaacccacaaccttggcctcgttagcgaagggctctctcttacccatggagcaagccagctgcagcctggatatagtgacggagggtgtgacagccatccacgccgagatgagaacaagcaggcgaggcttccggatgtctcacctcaaaccttatgagagctgtactgggcttaacaacattttttggactacctcagcaattgaggcttcctcgtgacaaaagcagagtcaattatacatttggtcagccggccaggcagcacacagtacagggagtagggactacggcccaggcagtgtaagtggcaccagacacataaagtcaaagaagtcacagagagtggcttcttggagttcatacttcaggggccaggacaggaacacataaacaagtccttccaacaggcgtgcacaaggcctaagaatgaaaagtggccagactgctctgacagcccagccagaagagcaactcgcctgcccttcacctgtcccctccactcccctaagctccgagtctctgagaaacaggaagtgtagaaagccttgccccatctcacatccttcctttcaacctctgggaatgagtcaaagaatatcagtactcattccaaaagaaacgtatatatatatatatatatacacacacacaaatatatatttctctctccatatatatctgtgtgtgtgtgtatatatgtgtatatatgtatatgtgtgtgtgtgtgtatatatatatatatatatatatatggaaagagagagagagaacactcatacctactatgcactaagaagtgaggcacagtgaacgcaatggtaagccagtcagcagacgtgagtcctcatgaacttgtattttaatgatgttcagtttaaccctaatggtatccaaacacacttggactcctcaacctaataatacttaaaacaaaccaatccgaacttatctatcatataaggattgtccttcacccgggaatccatatgtttatctatatacccgaatgtaaagagacaaaatagagtcatggttacagaccctggagccggacagcatgagttcaagtccaagctttgccatttattaattgttgaccttgggcaagtgcctgtgccacagtttccttataaaatggaaataacaactgtacccacctcatttaaccatacccacctcactgctgtaagaattaaactagtcagtaacaactgtattgccctcattgggtaactgtacccacctcactgttgtaagaattaaactagtcagtaacaactgtacccacctcattgagtaactgtacccacctcactgtcgtaagaattaaactagtcagtaacaactgtatccacctcattgatttgttgtaagaattaaactagtcagtaaatgtaggaagtgctttttaagtatttgccattattacttctgttagcctcaaaactctatcattgttttaaaaaaaaaaaacttttggaattctggaatctgttttccagtcaatttatagcatatgaaaatctgctttacttctttgaagtcatttaattttgaaggaaaaaagatattccccagtttgattcattgatcctctttgctatttactgaaagtctaccatgtcccaggaactccctatgtaattcccaggtctggctcacaatgacaaaagacaacccatgtcaggtaagaacagtaaaaaactttctctggggccttgtggtcaccctcctgggaaatgatgtgacatctcctaagagtgctggtgcccctgacgggggcaggggaacagtctccagccacggctttggggtggggcacggacagatgaccgcgtgtctggcaggtgtgaatcctgactgctccatcacacttagcacagtgagcgtgtggagactgttctgagttcatcaagaagggccagatcacactaaaaaatttgaactcaaaagtgaaccactaaagctttatgagcccataacacaaagctggagaggaaagctcgccacttccactggggaagtgtctgctccagacctggccagagctggaagacaagcatgagggcggggtccccgtcagcctgcttcataagacggggctcaattagctgcacagaacactgatgggcacaggccaacaatattcgtttttaatagtccagaaaagtgcagaaaaaagacaatctggaaggtaaaaatgtcctgctaacaaaatgacttcattcatcaattctgagtggcaaagtcacataggaaaagaacttctggccaccctgtccatcccctcgactgggctatggagaggaaaaaaaggcagaaaggatgtcaaggggaggaaagtccctccaaacgcaccacaagcacttgagctggaagttcgagtgtgaggataagagtgcaacgttcacttccattcaattgacaggagaactgcatttccaacacaactctggcgaccacatttcaaagctagaacagtgagaaaaaaatccaaggggatcatttgaaagaaagggaaaaaaaaagaccattacatgtgcaggggtcagcagtccaaatggctgcagaagccaagcaggtagcagaggtgggtgaagacagactgtgggacgacaggcgtcgcaagcctacaggcctccagttcaaaaccataacatagaaactcaacagggaagggaggctctttgccattaaattggtaaataaaagcctctgatatttttcttggggaaacaaagcagtgctgctcagtttgaggcagcacagtgccgatgggattgtcacacattctcaggagtgggaccagataacccgcttgggcctgggaaaggcaaatctgctggggagagaagacaaaaagggcaaaggttgaggaggctcatgagaagaaggactggaagtgagcatggaatgtgagccatctgggaacatggcaaggggaacaagtaccagatgccaggcatgcactgagatggggaaggactggccaacgggcttcaccttgtctcttcctcatctgcaaaataggactaacacctacttgccatatgcaatgagatggcacctggaaagcttctgactccatgctcaaaaacacgtgaatcctccgcctttccccaaccagctgctacgtcccaccatccggcccttcattccacatacaaacatttactggctaaaagccaaaagcagccactggtgtgattgtgaacctttggtttaatagaaaacagtgcagaatctgaaccggtttctacgatgtactacaccaaactcttcttctcaattgtagctttatacatgaggaaacacaggcttagaaataacagggaacatgcccatgatcacacagcccacagcagaagagctgggatttgaactcaggccctatctgatgccagtgctaagggaaggtgaagatgatccctgtcgtgcagaagcctgcagtcaaactggaaaatgtgactacctcctatgacgcaaaacaaaggcatcccagggacaggagagcagcctgggaaggctcccagcggcacaggccagctgaagtctctgaacctagacacatctggctgcaaagaacgggatgggatcccactgggagtgggtgacaaaggggtagcagagaatttatgctgaggcgtctgagcttcacagcagaaacaggactcagaagaaagatggtgtcggggaaaaagactaacattgataagatggcgacaacacagaagacgctctgaccagaagtcaaccctctgaagtcagttctttcatcgcacagcacctcatttatttggctttcccagtcagagttcacactcactcactccgacgcgaagctcaggtttaccttggctctatctacagaaaagaaaaagctttgctaagcacatcagcagagcaaacatgatctgtgaggagaatatttaatttgctcaggggaataagctatttcaagcccctctaagccatccagaggagctgccatttactaacaaaccactgacatggtaattaaaattatttcactctctcatcaagaaagtccccacaagagactgggcttcttcaggacagagactgggtccctcccactaggatggagtatgatccagctgcacacctactcatgtagctgttgtgaggatgaaaggtcacagtcactgcccaggaaaggtcagccatcatcttcttctgagataccactaactggttccatgccattccccaactcattattccagatgatctgccagccaacctagtgacacaggcaggaattcgttactcgcaactgataaggagggaaactgagtcccagagagagaagaagggagtctggcccaacagctctaggaggggctgagccaggacctgattcccacccggcctctgggttcccagggcagggattccctcccctgccctctgctgggtactgttctagcccatatttcattgaccccctcaattctttcttaatattttattcgataaaatatagataccgaaagccatataaaacaattgtatggcgtaagggactattagaaggcacacaccatgtaaccaccaccaaaaaaaataaagacaccgccattcaccacatgccaatgaacagccccctccaactaaaagtaacaactaccctgacttttctggttaattgctttgttcctcacgtaggcatccctaccctatagccttgtccactttttttcacttgacgattcttcaaaatcgctcctactttacaccttccccactacctctttttcttacaacttatctgctagagaaaacctgaactgttcagcctatagagtttcccactggctagaaaactgcacattcatgctacagttcaatacatgcctctgttctctgtatttcctgcaatttggcagctagatccgcaggcttgatcaattcagggtcgatccctttggcaagacttcagcagtgttgtgctcttgttctgacattagcagcccttggtattcaacactttcagcatcaatctcccgggagttactaagtggtgacattctaattctcccactgcattttcatttattagctggaataattttttttttttttttttttgagatggagtctcgctctgttgcccaggctgggtgcagtggcgcaatctcggctcactgcaagctccacctcccgggttcacaccattctcctgcctcagcctcctgagtagctgggactacaggcacctgccaccacacctggctaatttttttgtatttttagtagagatggggtttcactgtgttaaccaggatggtctcgatctcctgacctcatgatccacccgcctcagcctcccaaagtgctgggattacaggggtgagccaccacacccagccctggaataatttttataagatgtttcatctaatatttggctttccagtggcttagtacacatagtaaaatgttttatgttttccatttatttgcttagttttcaaaatactgaattagaactcatgaacttaagctcatttgattagtctattgcaatttttacccttcttgaaattcaaactatcctatatttgacccgagtccttttaaaatgacctaggaatctttgatagcttcttcgctatacggatgtaggtaaaggtgttccaggctcatcttatacatttcctgccccagaactggcatgaggtttcttttattgaaagctgatacttcaagatcaaatctaggagctagggatgttcactgctaatggttcggtcaccttagcgagaactctctctctcacatataaacacatacacacatacatgtacatatgtgtgtatatgcacatgcatatacatacacacacatacatagacacaaatacctcagatttcatactgatatttccaatttgattattcaaattcaggactacagtttttcctagactacttctatcttaaatctgctttttcctttcttccatagcaagaatattcattctcaaggacacaggggatgatggaattagaacattccataactactcagttgctttattccgtgttatatgagaagtttcagaataatactaataataccaccatcaattattttcatcatctgttatcagtgatctttgataataccataattgtttgggggtgccacaaaccatgcccacctaagatggcaaacttgatcaataaatgttgtatatgtgccccactgaccagccatttccccatctctctccctttccttggtcttccctattccctgagacataatattgaaatgaggccaattaacaaccctacaatggcctttaaagttcaagtgaaaggaagaattgcacatctcttactttaaatcaaaagctggaaataattaagattagtgaggaaggtctgccaaaagccaagatgggctgaaagtggggccttttgtaccaaacacttagtcaagttgaaaatgcaaaggaagactgcttgaagaaaattaaaagtgcctactccagtcaacacacaaatgataaaaataattttttaaaaaaagcaaaagagccttattgctgatagggaaaaagtctgcatggtctggatagaagattaaagcagcctcaacattcccttaaaccaaagcctaatctagagcaaggccctaattctcttcaattctttgaaggctgagagaggtgaagaagatgcagaggaaaagtttgaacctggcagaggctggtttatgaggttgaaggaaagaagctgtttctatgatataaaagtgcaaggtggaaaggtgtggtggctcacgcctgtaatcccagcactttgggaggccgaggcgggcggatcacgaggttaggagctcgagaccagcctggccaacatagtgaaaccccacatctactaaaaatacaaaaaattagccaggcgtggtgatgggtgcctgtaatcccagctactccagaggctgaggcaggagaacagctagaacccaggaggtggaggttgcagtgagccaaggtcacaccactgcactccagcccaggcgacagtgcgagactccatctcaaaaaaaaaaaaaaaaaaaaaaaaagtgcaaggtgaagcagcaagtgttgatatagaagctacagaaagttatccagaagttctagctgaggtcattaatgaaggtgcctatagtaaacaacagattttcaatgtagatgaaacagccttctattggaagaaaatgttatctacgactttcgtagctacagagaagtcaacgcctggctacaaagcttcaaaggacaggctgactctcttgcaggagctaatgcaactggtgactttgagttgaaaccaatgctcatttaccattttgaaaatcctagggcccttaagaattatgctaaattgactctgcctgtgctctgtaaatggaacaataaagcctggatgaaagcacatctgtttacagcatggttcactgaatatttgaagcccactgttcagatgcactcaaaagaaaggattcctttccagatattactgctcattgacaatgtacctggtcacccaagagctctgatggagatgtataaggagataaaagttgttttcatgcctgctaacacaacatccattctgtagcccaagggtcaaggagtaattctgacttactgtttaccatagatagtgattcctctgatggatctgggaaaagcaaattgaaaacctctggaaaggaatctacaatgaactcaaacaaatttacaagaaaaaaacaaacaaccccatcaaaaagtgggtgaaggatatgaacagacacttctcaaaagaagacatttatgcagccaaaaaacacatgaaaaaatgctcaccatcactggccatcagagaaatgcaaatcaaaaccacaatgagataccatctcacaccagttagaatggcgatcattaaaaagtcaggaaacaacaggtgctggagaggatgtggagaaataggaacacttttacactgttggtgggactgtaaactagttcaaccattgtggaagttggtgtggtgattcctcagggatctagaactagaaataccatttgacccagccatcccattaccgggtatatacccaaaggattataaatcatgctgctataaagacacatgcacacgtatgtttattgcggcactattcacaatagcaaagacttggaaccaacccaaatgtccaacaatgatagactggattcagaaaatgtggcacatatacaccatggaatactatgcagccataaaaaatgatgagttcatgtcctttgtagggacatggatgaagctggaaaccatcattctcagcaaactatcacaaggacaaaaaaccaaacaccacacgttctcactcataggtgggaattgaacaatgagaacacatggacacaggaaggggaacatcacacaccggggactgttgtggggtggggggaggggggagggatagcattaggagatatacctaatgctaaatgacgagttaatgggtgcagcacaccaacatggcacaagtatacatatgtaacaaacctgcacattgtgcacatgtaccctaaaacataaagtataataataaaataataataataatttctcaacctgaaaaaaaagaatatttatgagcaattacataatttgtatcttaaagagtggtattattttataatgcttttgtcatggcataagtctagcataatattaattgacatcaacccttatttatatataatttatgtttgagggctcaaatctaaccagtggcaaatccaagtttatgtaaaaattaaatctcttctaatgagtgcaatttcatgtgcatttttatagtttctctttcgttaaaaaaaaaaaaaccttatgtgccagaaaaaaaaaaaaaagaaaagaaattgtattttcaggctgctaactgtcaatattttggataaacttttctacttgaaaaaaaaaaaaaaagaaaacctctggaaaggattcaccattctagataccactaagaacacttgtgattcatgggaggacatccaaatatcaagaagaactggagcttggaataaattgtttctagctctcatgaatgactttgagggcttcaaatcttcagtggaggaagtaactgcaggcatggtgataatagcaagagaactagaattagaagtggggcctgaagatgtgactgaactgtggcaatctcatgatgaaacttgaatggatgaggaattgctcttacagatatacaaagaaataagtttcttgaaatggaatctactcctggtgaagattctgtgaacactgtggtaataacaacaaaggattcagaatagtatatcaacttagttgataagacagcagtagggtttgagaggattgattccaattttgaaaaagttctactgtgggtaaaatgctatgaaacagcattgcatgctacagagaaatcttttatgaaaggaagagtccatcaatgtggtacacttcattgttgtcttattttaagaaattgccacagccaccccaaacttcagcaaccaccaccccatcagtcagcaggtattaacatcaaagcaaaaccctctaccagcaaaaagatatgacttgctgaacgctcagacgactgagcattttttagcaataaagtattttttaactaaggtatgtactcttttctggacataatgttattgcatacttaacagaatacagtatagtgtaaatataacttttatatgtgctgggaaaccaaaaaattcatgtgacttgttttattgacattattgtatggtctgaaaccaaacctacaatatctctgaggtaggtattcaaacttctgaagaaaaaacaaaaacaacaacaccttgtcaatcaagaattctatatccagtaaaactatccttcaaaaatgaggaaaaaataaaaacattcccacctaagcaaaaagtgagagaattcattgttagtagacctgcccaatacaaaattttagggaagccttcagatgacaagcaaatgatatcagagggtcataggaatatataggaataaactaataaaagcaccagagatgtaaatatgtgggtaaatataaaagactgtataaatattgttttatcttttcttcttttaatatctttaaaaaataacattgtgtaaagggaaaattaatatattacattgtttttataacacaaagaagacgggggaaatgaagctatattggagcaaagttgctagtactgaaattaagtcaatactaacttgaagttgactgtgatagtttaaagatatatattataatccatagagaaaacagaattattttttctcccgatggagtctcgctctgttgcccaggctggagtgcactggtgcaatatcagctcactgcaacctctgcctcgctggttcaagcaattctcatgcctcagccccccaagtagctgggattacaggtgcccaccaccatgcccagataacttttgtattcttagtgaagacggggttttgccatgttggccaggctggtctcaaacttctggcctcaggtgatccacccgcctttgccccccaaagtgctgggattacaggcgtgagccactgtgcccagctgaaaacagaaaattttttccaaaaaaatgcagttaaaaatcaacagaggaatttaaatggtatactaaaaaactattttttaacaaccattaaaaagggtagaaaggaggaatgaagaatcaaaaaagacataagacatacagaaacaaagggcaaaaatagtaggtgtaaatccaatcatatcaatagttacattaaatgtgtatgtatacaatccattcaaaaggcaaaaaggtttatactagattaaaaaaccaagatccacccatatgctatgtataagagatagagacactttaattcaaagacacaaataggttgaaaataaaaggacaaaaaaatatattatgtaaacagtaaccataagagaagtagtgtggctatattaatacctggtaagacagactttaaatcaaagaatattactagagacaagaggcatctatcaaaaacctacagctaacatcatacttaatggtgaaagactgaatgctttctaagatcaggaatacaataaggatgtctgctcttgccacttttattcaacattgtactggagattctcgacaatgcaataaggcaataaatagaaataaaagggatcgagattgaacagaaaaaagtaaaattgtttatattcacagatgacatgatcctatatgtaaaaatcctaagcaatctattacaaaattataaaaattaattcaagagattagtcagtttgcaggatacaacatccatatataaaaatcaaaagttttcaataacaaaaaataatttgaaaatgaaattaagaaagcaattcacaatcacatgaagtgaatgaaatacttaggaatggatttaacagaaaatacaaaagctgaaaactacaaaacatttttgagagaaatcaaagaagatctaaataaatggagagaggttggattagaatatttgctactgtgaatctggcaattctgcccaaattgatctaaagattcagtaccacctttatcaaaacgctggcaggcttttttttttcttttttgacagaaattggcaagctgattctaaattttatgggggaatgtcaaagcctgaaaatagccaaaataatttttaaaaagaactaagttggaggacttatactacctaatttcaaaacttactataaagctactatattcaagacagtgtggtattggcttaaagacagacatacagatcaatgaaacaaaatagagactccagaaacaaacctttatgtttatgttaaattatttttttttactaacgtgtcaatgcaatccaacgtgaaaagaacagacttttcaacaactaaatgagaagacaacaatccaattgaaaacagggcaaaagttttgaacagacatttcaccacagaggaatactaagaataccttttttttgagacggagactcattctgtcacccgggctggagtacagtagagcaatctcggctcactgcatcctccacctcccaggttcaagcaattcttgtgcctcagcctcccaagtagctgagactacaagtgcacaccaccatgccccactaatttttgtatttttagtagagacagggtttcaccattttggccaggctggtcttaaactcctgacctcaggtgatccgctcacctcagcttcccaaagttcagggattacaggcatgagccactgcgcccagcaagaatgctcagaagcacatgaaaatttgctgaactttgttaatcattagaaaaatgtaaattaattaaaatcacaatgggatactactgatactactacaaacttactagaatggctctaattcaaaaaactgacaatgccaagagctaaagagaaaaaaagctggagctctcatacattgccggcaggaacgtaaaatggtaccatgggatggtttcctaaaaagtgaaacacaaacttaccatatgacccatcaatcccactcctatgaatctacccaagggaagtgaaaacacatgtttacaaaaagatcagcccatgaatgttcacagcagcttcattcataatagtcaaaaagcaagaacaatccaaatgtccatcagttggtaaataaataaacaaaaatgtagtatatccatacaatgtaataataatgacagctccacaataaaaaggaatgacctgctgatacatgctacgatgggagtgaacctcaacaacagtatgccaagtgaaagaagtgagacacaggccgggtgcggtggctcacgcctgtaatcccagcactttgggaggtggaggcaggcagatcacctgaggtcgggagttcgagaccagcctgactaacatggagaaactttgtctctattaaaaacacaaaaaaattagctgagcgtggtggcacatgcctataatcccagctacttgggaggctgaagcaggagaatcacttgaatccaggaggcggagtttgcagtgagccgagatcacgtcatcacactccagcctgggcaacaagagcgaaactctgtctcaaaaaaagaaaaaaaaagtgagacacaatcaactacgtattctatgattacatttatgcaaaatttctagaaaaggcgaatctatagacacagagccacagagcaaataagtggttgcctggggcagggggtggcagaaggaattgacgaacaggcacaaggaacttttcgagctaaagggaatgttctgaaactgaattgtgaagatgattgcacagctgtataaatttttttttttttttttagagatagtctcactcttgtcgctcaggctggagtgcaatggcgcaatcttggctcactgcaacctctacctcccgggttcaagagattctcctgcctcagcctctcgagtacttgggattacaggcggctgtcaccaagcctggctaatttttgtatttttagtagagatggggtttcaccatgctggccaggctggtcttgaactcctgacatcaggtgatccacccacctcggcctcccaaagtgctgagattataggcgtgagccaccatgccccgcctatatacatttattaaaaacaaccaaattgtataattattatagggtttttaaatatgtgaattatacacaaagctgcttttaaaaatatagcagcttcctctatgacaattcctggctatctccccctccccaattttcatctctattttctcattctttcacctcttacatcacttcttgatcaattttcactctgctctcagcagtttctcttgtagcagggcccagtcccagaacagagccctagtgagtcagtttcaagtcatcagaagggcctgactgctctggccccttagaccttgctgggcaaaaatcctctcattttcagctgcttatctcaaattggccagacaagcttcccagtaaatagttgatggctattttagggtctcctgttcccagacccatccgatgccctgttgcacacaaatgcaaataatatgccagctgtgaagctgttggtagtgtgtccccatcagctggtatgttggggctcatgaggatactctgccacctagtctagctctaaatgttgttcctgagcttttgggtctgctctctagtcgctgtgtctttttttacgtggatataggagaagacccagaactacgctgccactggtgctgccaccttctcagatttcttagctgcaaattcttgcctttccctctatgggagctggaaaccctctactctgtagggtttgatttatttatttatcaaacccttacatagtacttgctatgtgtaatgataatgtgttcaaagcacattaaaattactctctaaatcagcctaataatcctatgaagcaggtcctattattatccccagttacagatgaagaaactgaaacagagagaaagtgaagggacttgccaaggtcacactgctggtcaacaggagaccaagcatgtgaacccaggagcaggatccagagtcagtgctgcacaactctgcctctcacgagcacgtaaagtgtatctggccttgtagattcagcactcaaccatgaccaccaccccacccacttctcccaagacccctgtcagatggtatgttttatccctccttcaaagaccaagtccaaatgttaattcttctaagaaacctaatgaattcacccaagtagttaactacaatacttccgccttcctcctctcctttctccttctcccccagtacagaccttcattatactgcctttcacagggtgatataattatttgttgtgttaaagaaaaaattattcaatgatacttgttaaggcagagtaaggactttgttcaggtccgtcacgataggcagagggaccactgcaactgggtcttgcagtgggagggaaggagtggctagactccaagtacagcctaaacaggtgaagctttacagccaagaaggagggtgggggtcagtgggtggaaaatcactaagaggaaacatgaggagtaggaaagattctggctaaaccgatctaacaggattcttgctgaagacgggccagggtgatcagatagcaactgggggatggtagtggctgaggaacccaatcagacactgaggatgatcaggtattagagaatgggggattctggctaaaatgacttcacagattcttttgctaaaactggattttacatggaagtgtacagatgggcctagcagaagatttcgaagtgtggctaaagtttggccaagcaaggaatctttgtccattgacatccttgtctttcccatagctcagagaatgcttctgttcatcttatatccccagagcttacccagcaggctctcaataaacattcatggaattgagtaggcaacagttttttgtttgtttttgtgtgtgtgtatgtgtgtttaatttactagctcaaaatgtacttgaaagcagtataattgcatcttttaaaaagatctgtaattcaggttttactaagcctggctaatgagtttttctgggtattcttcagaaaaaatatagctttagattcttcctggtattttaactgcttatttccaggatgcagggatcactgcttctgttgctaatttgccagggagattcagaggagaaccagctaccacaaccatcagtcagccagaacagagagacagaagacgcaaattatgccagggggaggcagaaggaggaagagctagcagaaaaaaagatacagcgtgtccacaccagacctggagaaccatcaccagaaggcattcacaaataaaaagtaaaaattcaaacccaaaatacagaggaaggtggaaaaaacaaatgtcaattaagaaataatccagccaggcgtggtgactcacgcctgtaatcccagcactttgggaggccgaggcaggcagatcacgaggtcaggtgatcgagaccatcctggctaacatggtgaaaccctgtctctactaaaaatacaaaaaattagccgggcatggtggcgggcgcctgtagttccagctactcaggaggctgaggcaggagaatggcgtgaacccgggaggcggagcttgcagtgagctgagatcgcacccctgcaccccagcctgggcaacagagagggactccatctcaaaaaaaaaaaaaaagaaaagaaataatccgtgacttttctaaaccctgtaatttaatgcaggaatttgctatgagaacatacaatcatattacagatttctttattggtgggcaggtctatggcagacattgccatacaaatataaaggtgggtacttttagaaaaatttatatcccctctcattttcaatagaaggctctagtgtatcctaagaaaagtcataaattatcccaagatgtctcagtcattttctgggctttagctcaatctctctgcaattttctctaacagttgactaaaaatatcactgcaaaaaaagaatagagaggaaaaggatgattttttaaaaacaggtaggaaatatcccttgaaaagagctaggtccccacccccagcccaccttcgtgtaaaatactaatgcatttgacacctaaacccgggaagggaaaaggcaggtaggtgattgagcttttgctctgggccagagccagaacaggggtgcatgcttccccctcctctccttcccatccaccctgcttccccaacagatacatctggaccccctctgtgatgcagatgtcactaaattaccaagacagctccccacagtctgacaggctcagagagggtgaaacttggcttccttcttgaccagacaggatatgaattccttcttccccacactcatgtgttatttcaatggtctgcccttgaggggcggcctgcagaggccacacttaaactctcttgtgggcttctctgtccagctgcaccccatgaggtttcaacttgaagagctacatatttgaagtcttaaaaaagttcaagtctgggaggctgtgggagcaaatgttctcaacaactaaaccagggaagatgatagctccctttcctgctgcgggaactctggaatcccatccagatgtgtgggttaggcaccctcctcggaaggaggcctacaagaccaaacttccactgggctaggatcttcccagaaaagactctttcagagccagcttgaggcacttaataaagccaccgttattgtatttccctccaaccacaaagacagggtagaaagcagaggtctctatgatctttccagaaaatgtgttatttcttgctaaggtcaaggaaattgtttgatgcctggcactcaccattctcctttaacagaatgagatcatatccaggaagacctaggtggtcgtagtgtatctcccgctttaccacaaagaaacaagaataggagccgtaagttccatgaagccggtctgggctgtcctattcggccttagatccccagcacctagcacaacgtgcacaggtgttacatcaactacttttacagacaatatgcaactctcagatagacatctatgagccacagccgtctcagctgaaaatgaaaagtacatccatttattcattcattcatggatgcacaactatacaccagacactggggcatacaggtacagatctgttcccacgcaaaattgaccaaaattcctgcccaagtggaacttaggttctactgatgggagacaactgtaaacaaattaaataagacaaaatacaaatgggggcaaagggttaaattccttccctcttcttttgagaatttaacctcaggttggccgggcacagtggcttgcgcctgtaatcccagcactttgggaggtccaggtgggcagatcacttgagcccaggagttcgagaccagcctgggcaatgtggtgaaaccccgtcgctacaaacaaacaaacaaacaaaaaaacaaaaattagctgggcctggtggcacgcacctgcagtcccagctatttgaggttgacatgggaggattgcttagccctgggaggtcaaggctgcagtgggccgtgactgcaccactgcactccagcttgggtgacaaagcaagaccctgcctcaaaaaaacaaacaaaaacaacaaaaataacctgaggttaactttccagttttgtttccctagaaagcctaaaaagataaaatgtcaattatgttactaggcaacacttcctatgataaaaatggcccctgattgataacttgcagccagactgggaggaactgtaaatacctgataggaacactgtgtctttgggcttccctgagtgtgctgattcttacaactgagcatatcccttggaagaccctgaagacgtggggcctgagatgttaagccagggcagatggcaaacctacccaatgtgagtctcattccctagcacctgagctgtcacttgaggtgaaaaggaacaaacagagcagctcctgggtggctgtagggactgctgggagaactcatgtggaaagaagcccctgacctttccctgctggcaatttgtggttctgtcctatatctatctaagtagatgggtgtcaagggcagcctatgaaattcttgtgagttggaatctttcactaaacctaacaaattccctggcttatagtgtatttgatgccagttaaatgctaaggagtaaaataaagcagagaataaaggatgagttggctggacaagatgcctttgaggattcttttgggtctaaaccaagcttgttcaacctgtggcccacatgcgacccaggatgactttgaatgctgcccaacacaaattcacaaactttcttgaaacattatgagatttatgcacagaccttttttttttttttaagctcatcagcttacattcatgttagtgtattttacgtgtggcccaagacaattcttcttccaatgtggcccagggaagccaaaagactggacgcccctgactaaacaataagatcaccactcccttcaccccacctcacctttgccagttagctcctactttccaattcatcttcaggtttctgctcagtcacttcctcaggaaaaccccccatgaccaccaattgtaggttaatttcattttaaaatggactctcagaaatgggtacctttcctcctcaatgctgtaactatcttaggctatagttatacatccaagagtataacgatctgatttctctctgacagcaaaagcctgtctggctgctcaccattttatccccagcacccaaagaatgcctggctcagagtggaagctgataaacactggtagaacaagtgaatgccgtaacacatcatctgaaaccaacagcggagggcagtatccctcagaccacatggtgtgttcctgcagtgtgttcattcacgatactcccatccagagcatgagcaagagctgctctgaaaatactgccgtctgataaggtcttatatcagcaattcccagggcatgaatctcccgttatgtcaagaggtaccaggagatgctacaaaaattaactctgacttttagacacgaaattatataaccatctttctaaaagaaaagctgcaggtgaaaagctaaggtaagaaaagaaaatagtattatcttcccctttcctaaaggcatagcccactggtaatttacttgttttttcttctcctgctggactagaaattccacagggaccatttgctgtctcgaccctagttcctgacacgtaaatatttgacagatgaataaatatgtgaatggataaacaaacaagcacggaatctattcctccactcctgctcccattaaaactgaaaaccactacccaagacaaatgctaaccagttcatctgtcaaggaattccagtttcttggtggtgattaaaggaactgtagcctgccttccaagaggcagcatatcaccggtaaaccatgcagggaggggcctttgggagatacaattaaatgccaatcactaacctcctccccgactttggaagcttagaatgacccaccccatttttctgctgaaaccaaggagagatcaacacaaacgcacccatcttgctgaatgctgaggaagctttctgacggcatcagatctctaaccctcactaagtgctagcacttgtgaagtacactgaaagtaattacctgtctccacaattcatcactgaaaagaggggtttcggaatttcataattaaaatcgttagagattcttttgtttccacactaaggttttgatggcattaagggatgagcaagacctagcccacatttaaacagaacagataagatcgggctgatgctttttattcatacataattacgtctagacttgctttatctttatttttttaattacgtgagaccaattagaagacgatagactagctttttaaggtccttaattttcaagtgtaatatattgctatgctgctcctgactccattttcaagaaggtactgacagggcatggtcagtatggcccaactgatgagaggactgaactggaagacaggagcaagaggacaggtcccagctctgccctagtcagttgtgtgaccctgaagaaaatcatattaccttgctaatcaactgtttccccaatgatacataaactccataaagccagcgactgggtctgactcattcacttagaacagtatttggcactagtaagtaacctagtaagggtctccatcaatgtttgttgaataattagtgaacaggatttctctgaatctcatgtatcaagagaagtgatggaaacaaatgctctctaacagctgttggagcttccggattttccgaatagaaactgcaccatcagttcaactattacgaagatctcccttcaaagtgaaatgactcatatgaagagcgtggaacagcgatctaggtgagtcaagtcttccagacatgtgagtgcccaggcgacatgtggcatccccaagttggccttagctggccaggctgcaggaaggcgccctatatctcacgctactccatcaacttccattctgaagctgttaaagcagctctcacacagactccctcctggctctgtccctcccggctctatccctccctccatcatccccaccttcctagtatggttcctgctgaggttaaaatgtagcctgtggccaaaaaccaagtaaaatgaacctgatcctactaaaatgggggacgtggctctggtggcactagattcctggtggccaaatgaactaccctgttcttgacccttcccaaaaccccaccttccagatccaatggcttctccacacctagagaatgaattccctattccttagcctgctgtttaatcttccaccatcattctgccatcggtccttccagcatgaactccaccttagaaaagaaaatggaaggggaagaacatttctaggaagtggcctgtatacagagctgcaattcatcctgtatcatctgctcctcaacttcccctgtccagcttctgctcttaccactccaccaagtttgttcagggtcacagatgtcttccatggtatctgatccaggggtcacaatttggtcttctttattaacatctaagcagcattcagcacaggtgaccacttcctctttcctagcacaggttcccgttttggctttcacaaggacacaccctcacgatttcccttccacctctggcagttccttcacaggatcctcctcctttactcaacttccaactcttgcaggtcttcaggccaagtcctgggctgtcttctctctttactctctgccccttcactgatctcattcaatcctgtggccttaaatataatcaatatgctgaaattccccatttataactcaagtcaaacccgtcttctggtcatgttgacacttccacttagacatctcacaggcatcttaaacctaacatgccaaaggcaaattcttgatttctccttttccagatctgatcctctccttgtctccacgcatctaaccaatggttcaaggctgaaactggggagtcatctctggttcctccatttcccttaccctctgtcccccaaatccaatccaccagcagtcctaactctagtagttctaacagacatctcaaatgcatccacttctcttggtctctataccctttgttatctctaagatacacatctaatgtcttcaccacctagtatcacctaccctttgtcctggtgactcagggacttttctttggacaaccatcactctcccactatatgctgcacagtggaccttccttcttctgggtaagccagactgagacagtttgtgaccctcctccttccaatgcttctactacattggactcctttctgattcttgaacactccaagctctttcccgggtcaagacctctgcacattttgcacccactccttggagctctctttcccctgtgcttgacctggttagttccttctcaccctgcaagtcttggtctcatctcaatgtcacctcctccggagacctggccaggccaccctatctaagcaggggccttctgttatttgctttcactgcacccattcacttcctagcacctattccaatttgtaattatatatgaccagtacttacatattatctgtctccctcactagactgtctcctccctgagagcctggactatgtctcttatattggccaacatatactagtactgagcacagtacttggtacttagcagaactcaacaaatactcgttgaataactgaccaaacccactgcatgccaggtcccatgctgaaagctttataggaacatccccagatgtctacagaaaccatcactccagccagactggtctcatatcctgtagaatacacacaataccgagtacagttctaactccacactctaccaaccactggaacgtccctctggtgcttccccatctgtaggcatctacaccatctcaagcccacttttccaaatcttcactcccctttccaaatcacatggcccttccagcagagcagtgctcctgtttgcttctatggcaaccttgacttccccagtgataacacatacaactatcctgaaatggcttattttaattcctaattctccatgagactcagttctccatgaattctaggagggcagggactttgtctcttctcttcaccactcgtccccacaacctaatgtaggccctgtgatatggtttggatgtgtgtctctacccaaatctcatattgaaatgtaatccccaatgtcggaaatggggcctggtagggggtgactggaccgtaggggtgaatttctcatgaatggtttagcaccatcacccttggtactcctcatgataacgagtgagttctcatgcgaactgttcgtttaaaagtatgtggcaccctgcctcgccctcactctcttgctcctgctctggccatgtgatggccctgctccccctttgccttccatcatgattgcaaatttcttggggcctccccataagccaagcagatgtcagcatcatgcttcctgtagagcctgtggaactgtaagccaattaaacctcttttctttataaaatacccggtctcaggtatttctttatagcaatgagagaacgggctaacacagccctggcacggatggtacacaatgaatcctcattaactgaatgaacaaatgaccctactcgaatgcatgaataaatgggcctggaatcttcagctcatttaaagtgatctggtgttctttcattgtttatgcttttacagaaccatgtcataacctttaaaggtactaatgtttatgtcttcatcttttttcttttctctaccatctgccagatgacaaggcccatttccttttcatctccgtatctcttgaagagggttgcatacaaaaaagtggtggttattaaatgcttacaggaaacgtgtgtgaattctcttatgttcactgcagtggactcctactgtcaaaagtagtgtgcagttttaaacgtgaacacttgctaccactgcaagagggaagatgacctccagaaggccagaatgcaaaggctaagttgctcaagcaccaagagagacaactgcatccagcaaagcatgctcacgtcctggcgggcgccctcaccatgatcacctccccacaatcacatgggatgtgggagcctgtctgctgctgctgctgttgtatctgagacataagcccaggaagcaccctcctcagcagcccataggatacagaagggcctcttggactccttttcctgccttctaagtctaggttacactgagcagggctaaacaattgcaaagagattatatgggaagattgaaagctttttaaagtagatgcatagtggtgatgagtggtctatttgtttgattataaaaacagaggtccaaaagcccttccataccactttattccctggcttggctgcaagtacctgaggggagcccaaggtctgaaccatccctgcctgacttcctgctttctgagtcaaggcctcccatgcagcactcggtgatgtaacctagaaaatggtacaaccccatgggtgcatctcccggctgacagtcatttgccttttgcatcaatttatctccaccccacctgaattaaaatcaattcaaagccagtgaaaacacactacaatccgttttgcctacccaggacacctgacacagctaacaagaagcaaggttactttaaatgtgctttgctaccctttgtttacaaaagatgggtaaatattcctaaagcaacctgcagtaactaattggcatcccagctgggcacagtggcacatgcctataatcccaacactttgggaggccaaggcaggaggatcacttgagcccaggagttcgaggctgcagtgagctaggatcgtaccactgcattccagcctgggccatagaataagaccttgactctacaaagaggtaaaaatccaaaattgattgacatgcccaaatcaagcttctctggcaattctggcggcaatgactcaagtagggagtaacattatcttctcagaaggccgaggggaacccgagggtgaggccgtttctctgctgctagctgggctgtgaaatgaatacccagtgccaccgcggtcagaccagtcagtcccacctattttctctgaaagtgattagaatgttatccaagcccatggttatgcaccttgagcagcattgccttaagccagcgccactgtaaagaaatgccctgcctccaagccctggcaatgtccggctcggtcatctacttctccacaagctcccactgcaaccaggacgtgacctgaatctggtcccactttcagctggtaagtcagccaggcgtcgtcaccattggaagtcacaatttacctcctgctgtttgcctgacaccccaccaggtgcttccatgtgcatatttttatttgctcctcactactgctctccgaggtgactgatattcaccctactacacagataaagaacctgagactcagaggaagaaagggctggttccaaacccagcacctgagctgccctcacacaagcgcttgctttggcgaggcgacttggagccctcagaggcggcaatcctggccctctgaggctactgttctgctttcaccctctgcggagcctcaacaagatgttttttcagccttaacaggcttgttgctgccacccagagggataagagaaatagatgtgaaatggatctgggtacattccaagtcagaccgcgcccagagactcgggactgggaggtggaggaagttaccggcctggatgacaactagctgttctctcctgcctcataaggaaagagggagcccaggaagggaggaactaggaaggaagggaaggaaaagatgtgaaggagaagaaaaagaggggtgggagagggaagaggacgagccagaaagggaggccgggagaggagggcgaggagaaagagatgctttgtgacgcgctgtagatgagacacgggggaaagccttaggagaaatcacccaaccaacagaggctgggaactgtctgtgggcgatgtcctgtccggggtcaagtgctccctcacagagggagggtgatggacagtcaatccctcccatcgactccatccacaccgagccacagcgcttcccacacagtggcacagtggtgaaaggactggagcccaaggaactgtgtgactgcagcaaggcacatcccctgtgagtctaaatttttctaaacaataggggcaatactgctcacattgcccactgcacatggtggagcggcaacgctgtgaggaccagtgaccatgaaggacaagtgtttaagccaaacttaaaagcagcccttggatctaacacatcagaaggggcttaggaactggtcctggcatcaggttttctgaaagagatgcccaagtccaccagttccgcagtgacttctggaaaagatgggagagttctagaagaatcagattcaagactataattcagtgagtcctcaggaatgacagctaaaaagctgagtatacatttaagtatatttctaaagaaaaacattgtgtttcatcaattccatctcttattgccaaactctagtgtattttcctactactgaaaatcagtcaatcctgtccattatatcctttcagatacacagaagaaaactgcagaagagcaaaaggagtgagacaactgggagcaagtacctcacaaggaagcgtgggaagctgctggtgcttagggacagcagttacctccattctgtccccgcttgctgtaggcatccagtgacaaatgagccctggctgtggccctcaggccctgcgtagcccactggtatgggtcaagcagccctgacagcacttggcatgttcaaaacctcccaacggtttttctccttggggtatattctgtggcccccaaactggccctcacctccacctcctaaaagtaattcctcactactgttgcaccgtcccagccttgagctagttgcaccagcagggactgcagctaacagggacctttgagagtacctggcccagggctgggagtggtggctcatgccggtaatcctaacacttagggaggccaaggcaggcagatcccttgagctcaggagttcaagaccagcctgggcaacatagcaagacctcgtcccccccgcaaaaaaaaaaaaaaaaaaaaaaaaaaagaatgagagtacctggcccaatcccatcactggtctttagagcccagagagaagagcaagaggacaagagaagagaaaaagcttcaaagttaagcagtcccttaaggctacatcaacaggcatttccttgaactcgaataaagtaaaataaaatgagaaatgagtcagtaagcaatccatggcatgtaatccatcacctagtgcaaacctctcattattattttttagttggattccagtgggcagccagtgtctcagggcccagtagtcttcctttctccccaaagaacaggcttcaaagatgcaaataaattacccaacccactcttattaatctcacacaaaacattttcaactgaacgtatgggtatggtacccctgggacctccagggggattaattcccgggtccggacctccatattaacacatacagacacaggtcagagagaaggagggcaagggccgggagctcctccgtgatgaccaccatttatcgtgaaaagggaaaagaaacatcactagaaaaatattccatgttccctctcttctccttctatttataacaacaaagaaaacagaacttcatcttagcttaggggacgtgcaccgttgctcaaatgatctcaatcagtggcagatgagatcgaatgcaagagcatctttgtgccaaggccattgagctgctgcaaaccttggggtgtgtgtcacagccttttgtaggccatgtggacctcagccagaggcctctggaccaaagcaggccttctctcacaagcagtttaataggacttgaaaaataggcatttattttcaactaatgggaaatggacgcatgcggctctgggccaccaggcagatgaaatcccaatttcaagagccatgccccaaggtttgaagctcttaaaaatgaagagggagcaactccattgttcatttttccagaggctggggcttgggtcccctctgccattcaaagcactactggactactctagaggaggggaacgggcctctaggggcctcccatgcaaagcctacgggggtgctacagaggaaccagatacctactgttggtcttcatgcacatctatcctgcagcacaatgtcaaaacaagggataactgaagagatttggaacagaatcagcacatttctcacaagagcaacacaaaaaggaaaacaaacatcaaatgcactcgagagctgtccctcccgttcatgtccttcaacctttcttaaaagccttttcaaagccacactcactttcataaaaactggctgagatttggcaaatccaattccctgaatgatcagccactgaaagggcgatgctcctgtgtgccaggatttccaattcattaactttttccttaacaaatggggaggccgatgcagagccattcatggagggagggcatgggaaggcatggctcccatcaggcccaccccactggtcttgaggctgtgtacttttgacttgggttccctccctcccttctcccaccttcacatctcatgggaaagcaagagagccaggtagagaagagacaaaaacagccaatgttcattctttaaaagaaaaaaaaagttccaatggtagttcatatttaaaattcctttattataataactaaactggagacagcattgtaaggctttctactttccttctttaggaagtggatttaaaaaaatgaagatggcttacccatttttgaaatagaggacatgggctctctgaagtcctgtttctaggaaaaaacctagttcttgatcgtggggagcagggccaggcttagggcttctgttttgaatattagaaagtattacctagaaggggagaaaattggaaaactaatcagatgcacatccaagcctacttccttcaaaccctatctctaaatgtactgctcgacctaaaaaaccaacttcctcaggcaaatatcagtgcagaggcacaggtgtagaagtgcaagcattagaaaagcagagagaatggttctactagacaggaagcaacaagcaacccaggggcacacagggccctcctggtaccgaaagctgaggagtcgggggtgctgatgagcaggtggtgctgtaagaagcactagaggcggagaggccctgctgaatgccaggatactgacaggaaggctggggacacggaagcgggtcctagcaaagggcggaaatagttgtgatccaccaatggccgaggtcactcacaggcagactgcagctgcagccctgcatgagcttgatgagctccaagatgagctgatgagtgctgtgatctgcactagccctggaatcaaccagaaaaaggcagactcaccaggctccagagctgagggacattgcagctttgcaacctggtgaggttgggctgcgtggcagtcctctattctcaaagggagagctgagcaaaacaccctctctccccaaacttgacttcttagcttatcaacagataatggggtttttaaaggtttaattttttagccctgcacaaaagactgccaactaatcaggaggaagacttgcaagttgggttgggtatactgaagtgtaaacatgtagctgctactcttttttctgagacagagtctcgctctgtcgcccaggctggagtgcagtggcacaatctcagctcactgcacgctccgcctcccgggttcacgccattctcctgcctcagcctcccaagtagctgggactacaggtgcccaccaccacacttagctaatttttttttttgtatttttagtagagacgggggtttcaccacgttagccaggatggtctcgatctcctgaccttgtgatctgcctgccttggcctcccaaagtgctgggattacaggcgtgagcccctgcgcccggcctgctgctactctctttaaactcacaagtcaaagcatttctcagaggaaagcctacttgtggctcacataaaaaccaatgttctccaaacatgccgtccacatttgctgaaagtcagcagctcttcaaaagacccagttgtttgccaaaccccaaacatcctagaggtcttgaaaccttagtctccaaacagagtggaagtaattattagttccctaacccacaagctttggggaaaagaaaggtagaaggtacatgataaacgagacatcgaggaatgaaacccaggtgggcaacccttgcatgtgaaccggatcccagcatcttatagaaattgcccagctccgtcctgacttagccctcagctctgcacccctgactctccgggagttcctcctctctgggaacctcatttccacccactacaggctcctcctccactcatccgtcaagtgccagagatgcacgcggcaccatcggagccacactcctttctctcttaggtctcttgagatgaccgcatccatccctaagagcttcaaaatcatcagtatgctgccaacgcccaagtttatagctgtagtcaagactttctctgtgaatttccaactcacatatccaactgctgcacttggaggtccaacacggaaacttttaaaaatcatccttcatttgcttttcagcatagttttaattttgacatgccatgattattttaaagtaaaaaattcagtacagcacaaaaaagaaaataaaaaaatcacctcacaattccatcacacaaaaataaccacagttaacatttattgaacgacaatccagatatctttgtggacacatgtatcaagcagagaaagataaaaatcattttacaaaaaaatgagatcatgttatatatgctagttttaaatttaaatcattatatttaatttagttaaatttaacagaaggaactaaagtgtaaccaaagttacactttagaaagtttgtccctcctaattatttctcaactatgtctgtgactatccatttctactaccattacatcatccgagctgccaggacttcctgttagatttctacaacagcctcctgaatggagtctccacgtcctctcttgcttccctatttccctcactctctataagcagcctgaataatttctgtcacccaagctggagggcagtggcatgaccatggctccctgcagcctcaacctcgcaggctcaaacgatcctcccacctcagcctcccaagtagctgggactacaggtgtgtgccaccatactcggctaattcttgtattttttgtagagatgaggtttcaccatgctgcccaggctggtcttgaactcctgagctcaagaaatccaactgcctcggcctgccaaagtgctgagattacaggcatgagccactgcgcctggctcctgaaaaatttttcataatccagtctggatcatgagccactgcgcccggctcctgaataatttttcataatccagtctggatcatgagccactgcgcccagctcctgaataatttttcataatccaatctggattatgttgctcttaagctccttttcctctttctcatctctcagatatcagcttgcttctgcttcttgcttcctccgaagggccttttctaacaatcggcattaaggaagtctgccctattcgcctgcccacagcatcctttcctattccttcattacatttgccattgttatttcttcacttgatttctggctgtctctctccactgtgctacaaattccacaaagtcagaggccacgcctattttacttacccagtgtctagtgcaggataagcattcaatatacatagtaaatgaataaactttcaaggccaatcataaatgcagagaaaaggcaacaggaaagtaacccactgtgtcttaggcaccatgtgggtacatcgctatctcatgtattcctccacaaaaacccaccgagatacacaccattgtcctctctttaccagaggggaagcggagactgctccaccaagtgaggtgcccgaatcatgtggcttgagagcggtggagctggtgcagaaacccagatccccctgactccacagcccggctccttctccttcatctgtgtctgcttgcagagcaaagtccaaaacacaagggcagccaggaggtggcttaaggttataaatgggagaatgggaaagacgcaagagaagccttggagggactagcatagctcagggcttaccctgaagtctaagcatcttgaacttaatcccttcctcacaaagagcctccaacacatgggcctgggcagaagcattgtttggcagtgctgaagccaccacttgttctgtggataaacacttccagcgaggagactgccaacaagcgtccttaacaagcgcagctggctctggcagaagcaagtacccaatgactgaggaagcacggggaaggggctgaagattttagtcaaaagaccgaggcgcgaggtctggttctgacactgctcacccaccattcgcggacttaggacaacacctctgacctcacagaccttcactgccctcatctatacaatggggataataatacctacctcacaaggttggtttgaattgcaaatgagaaacttcacttcatgagcaaataccatacattattatacaaatattataatccttaatggagttatattaactgcatgaacaaatattatacattattgtacaaatagtataatccttaatggagctatattaaagagttacctttaagtagaaacaaaataaaaatctttatttcttaacatcgttttataaattatggcaataaggcatgagacatataagatggaaaatattcgaaaggaggaaacaggccaggcgtggtggctcatgcttgtaatcacagcattatgggaggctgaggtgggtggattcctcgagctcaggagttcaagaccagcctggccaacatggcaaaaccccgtctctactaaaaatacaaaaacttagccaggtgtggtggcacgtgcctgtagacccagctactcagtaggctgaggcatgagaattgcttgaacctgggaggcggagaatgcagtgagccaagattgcgccactgcacaccagcctgagtgacagagtgagactctgtctcccaaaaaaaaaaaaaaagaaaggaggaaacaacgacaaaaatcattccacctcatagatctataggctgcaatgagctatgatcactatcatgctttgaaaagcatcaactctgtttctatagaagacttcagtattatggacaataaacaccatccttgccatcctcgacactgctatccttgtcagccttcaagatgctgctcaggcatcatctcttccaggagacatccctgaactcccacactggcccaaggccttttctggagctctcagagttctctgagaattcccaccacagcactcctcctggctaaggacctgtgtcctcatgagcttctttttaaatttttatttattttattatttatttatttatttattttggagacggagtttctgtcgcccaggctagagtacagtggcacgatctcggctcactgcaacctctgcctcccaggttcaagtgattctcctgcctcagcctcctgagtagctgggattacaggcatgcgccaccacgcccagctaatttttaaatttttagtatagacaagatttcaccatgttggccaggctagtcttgaactcctgacctcaggtgatccacctgcctcggcctcccaaagtgctaggattacaggtgtgaaccacttaagggcaggctctgtgacatacccattctagtgcccctgcagtcaaacagtatccagaacatggaaggcactcaatacatgattgtgcaagtgaattaaaacatcacaggcacatttatatgttaaaatataatttcaaaaatgatctaggccaggcacggtggctcacgcctgtaatcccaacactttgagaggccaagaaaggtggaatgcttgagaccaggagtttgagaccagtctgggcaacatggtgagaccctggtctctacgaaaatgttaaaaattagccaggtgtggtggtgtgtacctgtagtccaaactactggggatgctgaggcggaaggattgcttaagtccaagagcttgaggttgcagtgagctatgatcacaccactgcactccagcctgggtgacagagtgagaccttgtctcaaaaaaaaaaaaaagatcctattcataaagcaataaaaatagaaaagatctgagaataaaaccacctactggccaggtgcagtggctcacgcctgtaatctcagcactttggaaggccaaggtgggtggatcgcttgaggtcaggagttcgagaccagcctgggcaacacagcgaaacctcatcactttttttaaatattttttttttttaaaaaacctactaaagtctatagaacaaaaaaatcttgacaaaataggaagagggtcatagatgacaggagactaaatataattctccaaattaatgtatggaattaaaaattcaaccaaatcccaaaaggatttttcttgaactcaacaaaattattctaaaatttacctgaaagtattagaatgagataagaacaaaggataacctgaaaaataaaagtaatgagtagttactaatcatttaaatgttaaaacctatcataaagaagtgcctattaaacagtgtcatgttggtacaacacaattaaaaagccagaattttattgaatgactaaaaatatatgacagaaaatatgaaaaggaaagatcatcttaaagtagcactgaaatttggaaatttgggaaattttaattgagaaaaattaatttagagctatatatatatatatataccacaatgaaccccaactacatttggaaattaaaagttttttgtatgtttgtttttgtttgtttttaaaggtttctctgtacatagtgaaaaaatttttgttttctgtttttttaaaaaaaggggaggaggtcgggtgcagtgcctgtaatcacagcactttgggaggccaaggcaggtgaatcacgtggtcaggagttcgagaacagcctggccaacatggtgaaactccgtctctactaaaaatacaaaaaaataactgggcgtagtggtgggcacctgtaatcccagctacttaggaggctaaggcaggagaatcacttgaacccaggaggcggaggtagccgtgagccaagatcactccactgcactccagccctggcaacagagtgagactccgtctcagaaaaaaaagggggggtgggtaggaaatgaggccaggcttggtggcttatgcatgtaatcacagtactttgggagactaaggcaggaggattgcttgaagccaggagttcaagaccagcctgggcaacaaagtgagaacctgtctacaaaaaatttaaaaataggccgggcatagtggcatgcggctgtagtcccagctaactgggaggctggggcaggagggacaggaggatctcttgagcccaggagtttgagggtgcaacgagctatgatcaccccactacactccagcctgagcaacagagcaagaccatgtctcttaaaaaaaaaaaaaaaaaaaaaagtatatatacgtatatacacacatacatatatatggaaaatggttgaaagttatcaaatcctagggaagtttattccaacattcaagctttaaaaacagtaaaataaaatataattaaaaagataatcagattcaactatatacagattcaaaatttatgagcaacttaaacatggaaaattactggttaggaaaatattcagagcaaatatgataaagagttaacatacttatgacatagtttattcaaactgtaagaaaacaacacttccaaaaattagacaaaaaggataagcagacaaaaaagggttaaacataaagttaccacatgacccagaaattccactggtaaatatactcaagaaaactgaaaacatatgtctacacaggaacctgcatacaaatatttatagcagcatcattcacaatagccaaaaagtaaaagcaacccaaatgcatatcaattggtgaatggataaataccatgtagcacatatccacacaatggcacaattatttaacaatgtaaagaaacaaagtactgatatatgctactacatgaatgaattttcagaacgtgatgctatgccaaagaagccagccataaaagatcatatattgtatgattctgtttttttttttttttttttttttttgagatggagtctcgctctgtcacccaggctggagtgcagtggcacaatctcagctcactgcaacctccacctgccagttcaagcaattttcctgcctcagcctcagcctcccaagtagctgggactgcaggtgcacaccaccacgcccgaccaatttttgtatttttagtagagacggggtttcaccatattggccaggctggtcttgaactcctgactttgtgatccacccacctcggcctcccaaagtgctaggattataggcgtgagccactgcacccaatgtatgattctatttctatgaaatgtccagaatatgcaaatctacagagacagacagcagattaatagtttcctagggctggggaggctggccataaaatggggattgactgctgagtgcaaggtttctttctgaggtgatgaaaatctagaattaaatattggtgatggttactgaactctggaaatatgttaaaaaccactgtacaatttaaatgggtgaattgtatggtaacagtaatgctatttttgagaaaagaaaatagaaatataactagtatatactactagtaataactagtattaaaaaaatttcaacctcactggtaatccaaaaaatgtgaactaaacttgcaaggtaccattttcatctagcaatttcggcaaaataacttttaaacaatagcagccctgtcaaggttgcaaagaaaccactactctcccatacagccataggtagagaaagttagtagaggccgggcacggtggctcatgcctataatcccagcattttcggaggccaagctctcgaatcacctgaggtcaggagttcaagaccagcctagccaacatgatgaaaccctgtctctactaaaaatacaaaaattagccaggtgtggtagcaggcacctgtaatcccagctactcgaggcttaggcaggagaatcacttgaacccgggaggcggaggttgcagtgtgccaagactgcgccattgcactcaagtctgggagacaagagcaaaactctggctcaaaaaaaaaaaagaggttagtataacttgtagaaagcaactggacacaatacagagtaacaagaatagtaaaaatatcctcacttctgagaatttgtccttaggaaataatgtgaagcaagagaaaaagtaacccaaaggaagttggcgtggaagcattatttacaacagcttatacacaacaatacgttcatcgtatcgcagaggccacacacgtgataccagcctgggcaacacagagagaccttgtttctacaaaaataaaaaaattagttgggcatggtggtgcgtgcctgtggtcccagctacttgggaggctgaggtaagaggatcgcttcggcctgcgaggttaaagctgcagtgagccaagattgcaccactgcactccagcctgggcgacagagcaaaaccctgcctcaaaacacaacaaaaaaacacagacaggaaatatacaaaaattaaaataagcacttgctcttgcctggtatccagactctcccaactcagttttcactgcgttgtaacctcctactccaggctcccagataaagggctcaaagtcagaagtgcctagagcagaagcacctgcctagccagtcagtttctggacatctcttaaggaaatattacatcaagctatgaactgtccccttctggctttggcctgagtgaaaaggtaggcctgaaacgggaaggaaaggaggaattggccttttctttattgtctcacattttaaagtcagaagcacaatcacctggccctctggagccacagccccacctttctcagcagcagcactgagtgcttttcctaggacacctggttccagttcaagaccggcagtaacctgcatctaatccagtttggaatccaacacctcagcgacatcactgcaaatccctcctgccgggagaacataatccactcaaggcatggccaggctgccagtgaacagccccttcatgaacacgggaagtctaggtggggcactgtaatatttggggacctggtgtttcttctagaaactttagcactaaaacagccaataaaatgtcatgggtaccccataacttagcattaacttcttttctaaaatagggtgtagagaaatgaactgtcagcagaaggtcaagttccaccctggctctactcctgctcaagagagccataaccagctggttggctgatgcatgcaaaggacagagacaggattatttcatctgccaacagcagggctcatattatggtatccaagggtgaagtcatctttattcccatcactgcaccactagaagctccttgcagggcggataactttatttactgttggcacaatgccgtcatctgaagataaactaatcaaggccatcctatgccatttctatctgctctaatgtaatttatttggttaaattattttatatgctcaattttaggggtagtttatctgttattccccttcggaaaacaaactatcagagactattcgtaggtgtccctgtgactctgatataacaaggacaacattaaacaaatatttgatgcacatagctttcatttattcccattttcttggccccgcctctgggtctggaactagagggcagaggaacacctggaaagctcctaggtactgcctggcacatgctgctgctctcagcaagggccacttctctagccccagaaaaccaggcaagtcaggcagaatgagcaccgccccggaagcacacagaaacaaaccaaggtcaaacgaccaggagtgaacagagaagtccagacacggggacaccaggcaaaacgttgttccactggcttcagcacaagaaagggaaaagcaaattctcccgaaaaagttactgcataaacattcccctgaaattctttgactttttttttttttttttttttttttgagatggagtctcactctgttccccaggctagagtgcagtggtgcgatctcggctcactgcaacgtccacctcccaggttcatgcgattctcctgcctcagtctcccgagtagctggtattacaggctcctgccaccatgcctggctaatttttgtattttcagtggagacggggtttcaccttgttggccaggctggtctcgaactcctgacatcaggtgatccgcccacctcatcctcccaaaatgctgggattacaggtgtgagccaccacacccggcctctttaacatttttaatgaaacagtatgtttataatattccagattttaacctaaatatctgaaattgtccgaggttaggaaagattccacagccaggtgacacaggaacagataagggcaagagagctgacatttactgcatgctgacaatgtgctgggaggcacatgagttaacccacctcacctcacagcagcctcatggcaactaggactgcggttttacagacgaggatcctgagatacagagaggctgagcaactgcccaaagtcccacagctaaagggggcaaggccagggtcccaacactggcagtcactcacccgcagtgctctgcagcctcccacagcttctgtcagctccctcgaggggaagccaggtcagtcctcgttctgaagtgtcactgcccttcaggaacccaacaactcagaacatcccagaacatcactgaacatccccactactagagaaactcagagaacggcactccctcagaagcacaattatgaaaagtcactggtcacgacactcctaactgtctccaaaaaccctccccaaattttactcttgctagtgaataaagttaaacgccaggactaataaataaaaggcccacaggccccagcgagcagaagtttcttcactacagaatggcggggaagtgacagggcaccatggagaggccacctctgcccagcggagcaaacaggaacagcgtgtgtgatttcctacctggcagggctgatcccaaaataaagccctatttgccttggattgctcaaggctttgatcagattccatccccttttctgttttcaattcaacataattcttactgagttcaaaattaagtcaattaagttcaacatttaaaaaaagaaaaaggccaatcaagtatctcttgcataacacacaactatcttgccacataaaaacctgcaaactttccaccaagcccattggtcacctaaggaaggttattctcctcgctagccttctgcttaatcaacagttagtttcttgagtacttactacagtcaaaacagatgttgggttcattcaatctctctcattgctaatatctcagcttgctgaaatctggggaggtccaaactggttttccaaaaaagaaaacgccagagccagaaatttgaaaatcagagccagaaatttgaaaatcgtgtacctacgctgagatttaaccttaggctaaagaagctgcttcccaaatgctaccaaaagctaaagcttacttggtcaaataaaacatatttattgacttttttttttaagtgcagtggtacaatcatagctcactgcaacctcgaacttctgggctcaagcaatcctcccacctaagcctcccaagtagctgggactacaggcacttgccaccatgcctagctagtttcgtttcatttcgtttcgttcgcttctttctttcttcctttctttcttttttttcttttgtttctctctctctccttccctcccttcctccctccctcctttctctttctctttctctctctctctctttctctcttcctttctttcttcatttgtagagacaaggtctcactctgttgaccaggctgatcttaaacttctggcctcaggtgatcctcctgtctcggcctctcaaagtgctgggattacaggcatgagccatcacacccagccttattgagcactttctctaagtaagagtgtggagaaatgtcatgctttttctttgtttgcagcagcctgggagaataaagtgagccagcactaagctaggtgtcgtgtgagtggagttctaaaactagttttggcctaactttctgtgtgcctgggctctccctttctagacctcaagtttcttctcaaaatccaacatcttatgatcaccatttccccaaaatcaaagaaaaggatttcttttaaatcctacgactatacaagcctccttgatgttcctgctgaagaacccagcactgaatggggtgttgtgagtgaacataacagaagtgtattcagatctaccaattcctacatcactacagacacatgtaacacatgagcctcctttctcccagccgggagaagacggctccaaagtgacagggctggacaacagtggagagtaagcagcaagatagggccctaagtggccagggctgtgtagtcagctggaacaactcagatgggataagcagacttctcgactgccaagcacggtccatcaaggaggcagacagtggaaataatggaggtttttaaaggagcctggatgatcattcctttaaagatcatatcgtaaattctgaataacaacaacaaattctcttctcatagcaaccttctgatagaacataattctggcaagacagacatgtatcttcctgaattcccagatatcttaaaccatggcttataatccattctggttgaggccaggtcaaatgttattcccatcactctctccacctctcctgctgtgattctcactctaatctccctgcctcctaaaaaggcaattctgatgcatatcatatgcaccaacacatgacaatatgatttatgaaaaaaagttacttcctgtctgttcatttataaagtaacaaaagctagggagactttggcagtctctctctattctaatctttacaaaaacaaggagcccagaaaattgctggaaaacaagacctccaatcattttcaaagtctcataggatttctaatcatttcaaacactcttgtagggtacatctctgggtctgaaggggtcaatagcagtgtccttggtgagaactccaggaaacactgccagcaacagcaactgctaggagctattgttattaataaaaataagtgacatttaccaagaatccaatatgttcacgaatctgggctaagtgcctttattcacaagaccttatgtaatcctcacaaaagcttcatgaagtaggaactatgattatgttctttttatggacggaaaaaatcgaggctgagaggtgaagaaacttagtaaagagtagaacccaaagatgagaatctgaaacaggcatgttgcctccacctccctggccccatccagcctccagcctccaacctcctctgtctgaggctgcgagcttagaaccccgagctcactcgttctctgctcagaggccctcttgtcagctgctcgtttccatcacccacaccacaggcgaagcactgaaggctgagaccatccctgatggtctccggggatacccgatgtactcagctcggtctacttcggtccacgtccccagcacctttgccatatctgtcaaggtaaggcctcccaagccccagatgaacaggtcttggcacagagtccatacaagtacaaatgaagctcaacccattttattaggaagacaggggtggctggccagcttcagggtgctgaaggtatgaacagatgcacactgtcatttctgctcagaggatgctaaaatgcttcacaaacactgaaccatctatttttctttctttctttctttcttttttttatgagatggagttttgctcaatggcccaggctagagtgaagtggtgcaatcttggctcactgcaacctccatctcctgggttcaagcaattctgcctcaacctcccaagtagctgattatagatgcccgccaccatgcccagctaatttttgtattttaagtagagatggggtttcaccatgttggccaggctggtctcaaactcctgacctcagaagatccacctgcctcagcctcccaaagtgctaggattacaggtgtgagccaccacgctggcccaaccatctatttttcataagctacagcaatcactaccacactctccttagctttaaggagtacaagtaaagctttgcacacagagacagacaagttgaaagcttcctagagattaatctcagttgtccactatctgatttgagggaaaaagttatcaggaacaaacacgtggtcctcacttaccctttctatctcttggagatacaggagtgcgatgtcccctgctttctcataacaggtgatgacatcctgttcccggtccacatggagattactggtagaagaagaaataggcagcttctccaaacaaagtccttaaaaaaatatcagacacaaaaactgagtgaattttttttcataaggcttcatttttaaatattgctctagagggccagaagatggctgtagaatatcatgttgtttgcaaatagacagtttacttcctccttttcaatctggatgctttttatttctattgattgccttattgcactggcaggaatctccagtaccatgctgaatagaaggggtgacagcaaccgccagctgtggtggcacctacctgtgatcccagctacttgggaggctgaggtaggaggatcacttgagcccaggagtttgagactgcagtgagccatgactgcaccactgcactccagcctgggcaatagatggagaccctgtctcccaaaaaaaaaaaaaaaaaagaagaagaagaagaagaagtggtgagaataaatatccctatcttattcctgatattagggagaaagcattcagtcagaaagcattaagtttgagattataagtttttcttagacgccctttaccaggttgaagaaggtgccttctacaccagttttgctgagagtttctattaagaatcaatgttggatttgctcaaatcctttctccatgttcattgagataatcatatagcttttttgcttttagtttttaaatgtggttacatcgactgatcatcaaatgttaaaccaaccttcctttcccagcaaaaataccacttggccagatgaattatccttttttatatttttggatttgatttgttaaaatttgccttcaatttttgtttttcttttttttttttttggagatgtagtctcgctctgtcacccaggctggagtgcagcagtgcgacctcggctcactgcaatgtccacctcctgagttcaagagattcttctgtctcagcctcccaggtagctgggactacgggcgcattccaccacacctggccaatttttttttttagtagagatggggtttcaccatgttggccagtctggtctcgaactcctgacctcaggtgatctgcccgactcagcctcccaaagtgccgggattacaggtgtgagccactgtgcctggcctcaaattttgtcatttatgtttctgaggaatatttgcctaaagtttccttcaaatgcctccatatctggttttgatattaggtaaataccaacctcataaaatgagaaatattccctctctttcgattttctgagagtgtttgtgtagagttgatattattttgtccttaaatgtttgatagaattcaccagtaaagccatctggacctggagttttctttatgagcagcttttcaattacaaattctatttcttcgatatagggtcattcagattgtctctttcttcttgagtaagctttagtagtttatatcttccaaatagtttgtccatttcttttgagttgtcaaatttattggtatagagctgtccataatattctataatcctttagtacctgtagaatctttagtagatggcacctctctcattcctgataattggcaatttctatcttttcttcctgatatcagaggtttatcaattttactgaaattctcagtaaagattccttgatttcattgactttggtttcattgatttttctctatccttcttctgttttcgatttcatttatttccactctgatctttattatgtcctttcttctgaatacattgggctttatttgcacttcctattctagtttcttgaggtggaaattattaattttggacctttttatttactaatataggtatttagtgtcagcaatttctccgtaaggtctgctttagcagcatcctacaaattttgatattcagttcacaatattttctaatttaacttttgctttcttctttagaagtgtattatttagtttccaaatatttgggagttttccaaaggtctttcttttactgatttccaagttaattccatcatgatctgtgcagtaaagggctgacttagagccttgggatgttcaaaccctgtacattccaaaggaaggactggcccttaccagttcctgggagaaaaactcttaagccctcagaatatcctacctgacaagtgtctttgtttatttggagccttgagccataccagatagtttatgctaacaatgttattaatggcagaggactagggccatgctatatcagtctgatctctgcaggggctggagactgactaaggtcagtaacatgggtgctccatgcctatgtgactgacccctaacaaaatccctaggcaccaaggtagctcaggtaatcttccttgattggcaatatttcaaaagtactgtcacactccgttgcagggagaattaagcactgtctataggactcgactgggagaagaaaaccagaagcttgagcctggtctctcctgaattctgccctatgtgcctttttgcttttactgattgtaatctgtatccatttgctgtaataaactgtaaccatgagtataacagcttttctaagctatgggagtctttccagtatatcaatgcctgatggtagtcttcaggacctctgacacagtccagagaacacacccgaagtctcctaattttgttaaaacttgtttctgaccctgtatatggtcaatcttggtaaatgttacatttgaaaagaatgtgactctgttgttgttgggtggaatgtcatataaatgtcgattaggtcaagttggtatattgtgttgtcccaaggcatctatatccttaccaatcatctgtccacttgttttatcatttattgaaacatggatattgcaatccccaagcataactgtgcatttgcctatttctccttgaagtgctatcagtttttgtttcatgtattttagaactctgttattaagatcataaacctttggaattgttatattcttttgatggattgacatcattgctctaaaacctgcttcgtctgatattaatatagatactacagccttgaattgattagtgttagcatttaaattttttcatccctttacttttaatctttacttttaatcatccctttacttttaatctatacttttaatctattgtgtcttggtatttaaagtgtatttcttgtagacaacagagttgagttttgcttattttttccaatctgacaatctctaacttttaaatagggtatttaaatcatttatatttaatgtaattttttaaacagataggtttaaatctaccactttgctgtttgttttttatttgtcccatctgttctatttttcctttttctcctttttttctgtcatctatttgagtatttttacattttattttacttattggcttagtcactaaaatttttattttccatatcagtgattgcttcaaggtttaatttggcatagtctactttgttttgtttgtttgggacagagtctcactctgttgcccaggctggagtacagtggcgcgatcttggctcactgcaacctccacctcctgggttcaagcgattctcgtgcctcagcctcccagtagctgggactacaggtgcacaccaccacacatggctaattttttttttttagtagagacagggtttcacaatgttggccagtctggtctcgaactcctgacctcaagtgatctgcccatgttggcctcccaaagtgctgggattacaggcttgagccaccatgcccagctcctactttaaatgatattatactacttcacatatatatagtataagacctttacaattacatacttccatttctcccctcccagcctttattatcttatgtacattttacttttacacaggttaaaaaccttaccctatgtggttattatttttgtttagtcatttttttaacatttagatcataaggaaaaattcttgtatattcaccaaattataatttccagctctctttgttctcttgtgtaaattcatatttcctcctggtatcaacatttcttgtagggtagttctgctcctgctgatttctttcagctactatctgccttgaaaatacttaatttagctctaattttagagagaaatttcatggagtatggaattcaggttaacagtttgcttttttccccctccattactctcaaaggtgctgcttcaccgtattctcacttgcatggtttctgacaataattctgctatcacccttacgtttgttcatttgtatataatatgtcttttttcctggctgcttttaagattttatctttatcactggttgtgagtaatttagattatgaagtgcttgggctttgttgagcttcctggaactgatggtttatagtttccataaaatttgaaaaacatccagccattttatcttcaaaaatgtttatgtcaccctcctccttccttaggggactttacgcacatattaggccatgtgaagttgtcctacagatcacttatggtctttccacttaaaatataataatttttcttttttttttttttttttttgagacagagtttcgctcttgttgcccaggctgaagtgcaatggcgcaatctcagctcactgcaacctccacctcccaggttcaagtgattctcctgcttcagcctcccgagtagctgggattgcaggcatgcaccaccacgcctggctaattttgtatttttagcagagatggggtttctccatgttggtcaggctggtctcgaactcctgacctcaggcaatccacctgcctcggcctcccaaagtgctgggattacaggcatgagccaccgcacctggccaataataataatttttctttctttcattttggataatttctattgctatgtcttcaagttcactaatcttttcttttgcaatgtctaatctgccattaatcacatccagtgtacttttcatatcagacatggtagttttcatctctagaaatttgatgtaggtctatttttaccatccacgtctttactaaactttctgaaataaggaatacggttctaataactttcaatggccctccagcctaggttctcaatattcattttctttccagttagcaccaatgttgtttatgcaattgaaaataatcaataagtagcctctctctagtgtgaactgttataacctcttgacattttcattggaagagaatataaataaaatgaacaaattcaccatttgccagaatagttccaaagctactcaaaagcaaatcgcagatttggaagcattaccttcccaaatatgctttaagtgctcacttgcgcaaaattaaaaccaccaaaaacaacacaaagagatagatcatttcatagtctgccttctgcttatatgaaaagcaagaatactgtgcaagttgatatcagggatttaatatttaaaaaactaattccccagagtatgtcaaagggtcaggaaaaattgagtgtacttttaggcattttgtactgcttcaggctggactctgaccactaatgctcatgaaaatgaccaaggctctcagagacctgccaagccagtgaatcaaagaaaggccaaatccagttcaacataattttactatcatctatattttatcatgttcttaaaatacttgaaaaccaatcatctagggcagcaatccacagtcatgtatggtcagtaagaagattcaaaccagctacacaacttaatcctccacagtgaggagaaactagtgtttcctgtgggttcatgttctaattaggcaggtatgtggacactcaaagtctcagctggcaaattgattcctagcaataagtccattcttgagcagaaggccctttaaggtattaaattaattaagtattgttcctttccctctcccacatgctatggcatttattccatgtacacatttattccatggacacatctcagagcaatggcagagtcttgatttatcacagtgagtttgtgcctatgcagctcagttccagaaaatttagctctctgtcagaagctatttacaggccctctggactggtctataaattttcgagtgtccaggatcatatcaacactgtctgagaagcagagtcctgaggtcatggacaaaattggtccccattaaaatgtcagatgatgtactgtcaatttgggaagctatcatcaataatgtttttacttattttcttttttccagagacatgcctgacaaaaataagtgaaaagcagacttgaaaaacagtggtatgacagcaatgcctagtaaacatctcaataagatctacatctccaaagttaaagtgatgtacaaaaagggtggaaattcagtgctttctcaccaaccatgaccagctgtaaagcatgagtgctaaaagtggctgactgagttgtgtgatttaaagaacaatgaattgccacgcaacccaaaatttatctccctgccacacaagagcgctcccacagataaactcacttctgaaatgccctttctaagaagagtaacaccttttactttatttttaagagatagggttttactctgtctaccaggctgcagtacagtggcataatcacagctcactgcagccttgaattcctgggctcaaagcaatcctcccgcctcagcctcctgagtagctgggactacaggtgcatgccaccacaccttgctaatttctttttatttatttttttattttttattttttatttttattttttgtagagacagtgtctcactgtgttgtccaagctggtctcaaactcctgacctcaagagatgctcctgccttggcctcccaaagtgttgggattatagacatgagccactggccccagcctaggtaacacattttaaataaattaatgatgataaaattataattacacttgctttcaaaccccttccatgtgcctgtttggtcctgttcaataggtactattctcctctctatctcgtgggaaaagaataagagtctcagaaaagttaagtgacttgcccaaggtccatgcaggagtcagaagtggaagccccttataagggagcccattagctggggccaatgcatctgctctgggtaatgtcctagaggggcaacaaggactgctgagtgcacagggtggagtgtggaaagcaaaggtgctagacagaagccagcagaccaatgggacatcacacggggaggggtgctgggcagctagctgagtagcaggctgaggaccctctatacttttaaaagctcaaacatgcccagcctctgaactgttctatgtagatgtaactaacagaatatagtataacaaaccggactctccactccttgcttcctttcacatcaagattaagggtcaggtgcagtggctcatgcctgtaatcttagcactttgggaggccaaggtgggagcattgcttgagcccaagagttcgagaccagcctgcctaacatagtgagaccccatctctacaaaaaatttaatttaaaaaaagaaagattcaggctcaatacctctgacagggagctattttctctccccaaggcctgtagattctctggaagtttggctgaggacgtggagaaagctacacatctcattgcctgaaaattcagtgatcactgaggggttagcaccccaaattctttcaggtctgtctagatttgagatccctcagctaggagccttatctgggtatgtaagacttcagtttcaataataataaaggttgatttatcaaagccctactcagcacccagcactatgcctgggatatgacaggcactatttctaattcccacagccaccctgagaggaaggtgttaacaccaccttatagataagactgaattaagggctccacagctagtaaatgataaagccaggttccgacccctggtctatctgactacaaagtgttgctcacaatctcctgtctcactgagctgttgacagcagcctattcagtgttcaataacagcaatgacaacaaaaatgaatttcaaattgaaaaggcaagaaatcaaagtctagaactttagggtgctgattttctttcctaccaagaactgcatcaccctaggcaattccccagatcgctgggcctcctattctttgtctgtgtcatgaagagttgaactactgagatactgccttgagctgtacaagtctaagagactaacagctaaaacaaatattttgatttttttgaactgcattgaaatggacaggaaattaatttcttataaagctatgtaatgcaagaaaagactataaaatataatgacatgaactatgtactataactctaagcactgcttcctcatttatctcaaccacatctctggaagccaggcctgggacaggtacaccctgatgctttgccataacatgacccacaggggtgtttataactgaaagtaccagaaagcctttattataatggtaagtttctgacaacccagccccatggtatagccttcaaaggtgataagacaacgtccaagggtctcaatttccaaggctgaaaagagactcaagaaaagagattcaagagacacaaagcaaagccttggcaagggcagccccgatggctggtcttgtgttcttgcctctataaaggctgggctcccacaggtgtcagatagacttagctcaataggaggacaaggccctgtgcaggggtgtagaggggaggagaagatgccaatggaaaccaccaagtgctggggggaagcagagggacagggacgccggcctggatcccctgtgaggtccctgtcaatccagagcatctatgatttaggaaagtctcttggctgggagccacagttggtcccttctgagtgctttcctgaattgctgttttcctgccagagacagcatatccttcttaggaggtgtgctcacaggtacacacacaaacacacacacatccctcataaaagaagaggatgccagccttggattagacattcccctgctagagcagatggtctttcaatgtcccttccagctccacaattctgtgagcaaatgagatgctagctcaacctgaaatgctcactaactgagagtttgcaacttgaatttatgctctttcagtctctatttagtaaccctataatagtaataaagataacatgtattgggtgctagttacatgtcagatactgttctcagagtttgtgataattcatctataaatgctatgagggaaccctgtgtgaaaaccctacgaggggggatttactaaaatctccacattggagataaggaaactagggctctagtctgtcaagtaactcacccaagagtgtacaactggtaagtaagtggcagagctaggattccaacccagacagcctaactcctgagttctcgttctcagcctctacctcacactctcgtctctatgatgtatctgtctttatacgtaaagcagtacagcagagtagctaagactgtgggatctgaagccagactccttgctttctaatccacagctgattttatatgcaaaaatgctaagtgtttagaacagtgcctggcatatagcagacacacagaaaacagtaactctgattattattatttattacctcactattagatttaggcaacagtaggctggaaagtctccaagtagaagaattgtatttgtttattatattacttttgtatatattaaataacagcttgattgagatattattcacataccataaaattcacccattaaaagtgtacagttcggtggttttagtatgttcacatagtcgccactagctaattccagaacattttcatcaccccttgaaaagccccatctctatcagcagttcctccctattctacccttctcccagcccccgggaaccgccaatctgctttctgtctgtctgtatttgcctcttctggatggttcacagaaatgaaattgtaaggtatgtgatctttcatatgtggcttctttgacttagcataatgttttcaagattcatagctgttataacaaatatcagaacttcatccttttttttcaattgaggtgaaattcacataacataaaattaatcattttaaactgatcacttcagtagcatttagcacattcacagttattacacaaccatgccctctgtctaactcaaaaccttccttcctttctattgccgaataatattccattatacggatacaccactttctatttacgcattcatcagctgatgaacaatggggctgtctccactttggggatgtatgaagaatgctgctatgagcattgaggtattggctcttgtgtgggcacacatttccacttctcttagatatacacctagggacggaattagacatatacctagggtggaccacgtggtaacctgtcttgttatattatttttcatctttcttctaaaaatcacctctactatgtaactgctgaactgctgggtcaaatattaagagtgacaatgcagagctgggcacagtggctcatgcctgtaaccctagtgttctgggaggtcaaggcaagaggattacttggggccaggagtttgagaccagcctgggcaacatagtgagacctcatctttaaaagaaataataattttttgtttgtattagctgtgcatggtagtgcacacatgtagtcccagctactcaagaggctgagatgggaggatcacttgagcccaggagttcaagattacagtgagccatgatcacgccactgcactccagcctgggcaaaagggcaagaccctgtcactaaaaaaaacaaaaaaacaaacaaacaaaaaaaaaaaacaagaaaatgtctgggcttctgacagacctggatgcaaacccttgcttctccatttaccagctctgtgatttgcagcaagctgcttaacatcacacagactctgttcctcatcaagcgaatgagcaaaatagcacttgtttcaactgactgttagaaggctcggcccagtgcctggcatgcagtaaatactcaataagtactcttctcattatatgtctttcctgggacaatgataatcctcctcaatttgttttgaggggtagctgaaaaatgcagaaaagcatcaagaagacaataacaaccacccatattcccaccgttcaaaatcaaacacagttcacattttggcacagagccacaaccttactaacacatgatgccttgtaattttggtcttggttctagtttccttcctaagaagaggggactcatcactggtgtgatgagtaagtgtagcctctgaggtccccaactatagcaaggagtgagagcagccagtgaacaggagtcctgtgcttgctccattccacaaattctcactaggcaccaactgcgggcagcactctgggctaggggtgggcttcacagaacaggactctgcccttaagaaatctctttgtccttgagaaatttcacctctagtggaagagaaagatgttttattttattttcttctttttttttttgttttttttttttgtttttttgtttttttgagacagtttcagtcttgtcacctaggctggagtgcaatggcgcgatctcggctcactgcaacttccgccttctgggttcaagcgattctcctgcctcagcctcccgagtagctgggactacaggcgtgcgccaccacacccagctaattttttgtatttttagtagaaacggggtttcaccatgttagccaggctggtctcaaactcctgacctcaggtgatctgcctgcctcggcctcccaaagtgctgggattacaggtgtgagccaccgcgcctggccgagaaatgttttcaaaacaatgttaaaaatgcagtgactgagacagacatggtgtcacagaagaattaagaacaagcacctcagccaacctgaactaaagctccagccctctgagcttcctctggactctctaagtccctgcttgcttccaaaaagagaaccaatgaggagccgactaacacaagcaacattaaatatgaatatgggtcagtggcaataaaagggttcttactcttcttacactctctaaatataaacaggaagctttgaccagcaacctgagatgagcggccacatgcaatacacccatctagccgcccaccatgagcagaatccagaatgggaagaggcagaagagatcatggagtcagagacaaacagttagcagaaggcttaacgtggtggatctccaccaggcatggccccacagcgccccctcacaacccctactaccacatctctgggtttcctacataggcaaaagaaagcaccccggaaagctcccctgaaccaccccgttccctccactcatggacttttctataaaactacttgtttcactgcacccgaagtgatctcaatgtttccaaaaatgaaaagcagtcctggcgcggtggctcacatctgtattcccagcactttgggaggacaaggtaggagtatcatttgagcccaggagtttggggctgcagggagctatgatcgcactactgcactccagcctgggtgacagggcaggaccctgtctctaaaaaaagaaagaaagaaaagaaaagcagattctcaaggaaaaaagatcgagctctatcttctctcctgtcctctctttgcaaatgaggagattcaagctcagagatgatttgcccaaggtcacatgggcaaatcctgatccaatgagcttactaccacagcaggtccacagcagttgccacacagctcccaacagactggagactttttctgccggggaaaaggcaatgtcagtggtcacttgtctgtcctacggctctaggatgacacctagaagatcatggtcattagcaaatatccaattcataaagactgggattagatctcacttgaagacatgaatctctcaaggaacactccaggaaaatcctctttgggcttttatagtccttatgaccaggaattttcggtccacgaaaaatatgacgtacttcaattcctgctaaagcaggaaacgcacctttacatcctttctctttgtaaatacccacgcattgaatgtttaacgtattaaatgctgtcagcttctacgagagtctctataaatatggtctcagaaaacaataaaggggcacatcggtgaaggctcagctgctgcctgcgaacagccagggcctgtgagtgtgaacgcctcccagagagctcggcttggtgagtccctaagaaggctcactaatgcgaggttaatcaagagagttggcaagtttgcctttcttctccatccctgaactcgagttgaatcgcggaatcaacccaagtacaggggcttcaaatggtcagccggccttggggcaccactgtcccggtggccgcggcaggaaccagtcctgcagtcctgcggcggcacctgcgcgagatgcagggcactggctccaggacggcggggcggggcggggcggggcgcggcggggcgagagcgcaaggaggggcggggcgagacggggcaagagagtggggcggggcggggtcggggacagcagtgagcggggcggggcgaaacgcgaggggaggggagatgggcggggcggggcagggggggcacggtcccaaggccgacccggccgaggacgcccggagcagctccgcgcatgcgcaactgtggcgcgcgactgcgctagaacgcggctcccgcgacccctggcggcggctgccgaggggctgcgggacgaccttgggcggcagctagcagcgagtcctagctgatgtggccctgagtcagcttttagaggtcccaagactcgttcacaggccgctaaacgcaaactaaggcacctcccagcacaccaggatcgacgtgtcctccttcagtccggactcggcggaatctgcacctgggagcccctccccaaatgacctgctagccgcagtccaggaagcaggcacccctcactccccttctcaaatgggggctctattcctgtctctagctctggagttgttgtgaggataaagggaggtaagggacaagtgcttagaacagtgtctagaaggaattattttaatgctgtagtcattattaataatgtattatatttttacaattccagaacctggcacacagtaggcactcaacaaaccgttcctctgtctgtcttgagagactgcggtgggccctgcagggcagctgcctgcctctgcctggttcgaggaaggcccagccaggccggccccagcttccttcctgctcttctgtcccactccgacccactccggagagccacgctctgagccgcacatgactctctccttctccacagaacaatctgtgttctgctcccgcccccgagagagttctgagctttccaaatatggatgctttttgcattcccaaagcatcacgaacatttgggagaagaaaatgaacaccagacatggtttggaaacgatggaagccaagggatgggtggtgacggaacaagcaccgtactaggagttttaaaatataaaacacgagtctggcctaggtgatgtcttacaaccttactagctttgtagcagtctaggccccaaagagatcctagaagtaagcacccaaaccctaagaataaaaactacagcggccaccaccacacattgcagaggcgaaaactgcattaaggaggcccagagagtcacctgctgtcagaggaaatgagcagtgggaggcagtcccttgagagccaaacagcttgaaagttgacaaattgagatgaaccagctcgtcggtgagtgtaggcagaagaggcattagacacaagagtatttgtttttatatcaggcccaaaccaaaacctattctgaaatggagtggatctcagaatatactgagaagtttgcccttttgcttaggcaccttgtgtgttattcagctagagtttatcttcaatagtgtgcccctggatgccagggcaaaatgttaaagaatggccccgtcacaggcacccctgtgcagcaggcactgttgtccctggcgcacatgcagggagataaagcaggcagcttagatatgacacagcctcaacacccaacccagaataagcactcacatatttgctgatttaatgaattaattaattatacagtctagtttgagagaggcaaatggcagatgtgaaataattaaaatctgaatgccaaattagatggtactagctataaatagaggtggaatcagaggatggagagattggtgtggacaaacggggctggagaggtctgtatgcaacaacgggtgtcaccaagggcggactcagcacagggaagagatgactcccagatggatggagaagataaacagaggtggggggttggcctggcaggggtgagggcaggtgggcaaggaggcaggcagcctggagcagaggatgggtgggacacagcaggacatgcagccagcctgccaagactaggacatatcctccacagtctgcagaggtgcatgccatacctagacctgccagggttagcaggaggacttgaactcgagattcaagcaataagggagaggatgactcttttttcgagataattagctcctgattatctcaacatgatacatttaaacctcacactggcttgtcctgacactcaggccactatttacactcttcaccacattttaacatcaccttaactgagaatgtaaatccggcacaaatgtccaaatgctcatgtatttcaggcattgtaaaccccaggggaaagctctgtgtcatcggcatccctccaccccttcactagcccagagccctggggggcattgtgcttataggtggagctgtcttgttacttgctggggccttgcagggcccagcctctagccatgccctccaaatgagcttcagccactcctgggttttaaccaagtcctgcacctatacgcagacctattcctgaatcctgaccaacaagccaatagcctggaaacctatatgctgagcactagccaagaattccaatgtttccccaggatagcaccctcttgtggacaaagagattccaccatgttcaaccaatccagtatcttccctctaccctccaaggaaaatgggctccttctcctgaaatcgcctttgcaaaaattgtaacagtgagaaaattatgacagtgaaagaaatctgatctaaccaacccctatcttgccattaacccccaaactatggtattcctgggcttaggtcaagctaactttaggagatatttagtttatagtttaaatgataataacacttccccaaaactcaactgccaatgaaggaccaccaggttaggaggatgagagaagcctgaattctgctaaggcataagtgattaccagccattgttccaaaggtcacaagatttgcaacttcccgaattactcctgcagataacatcactactgtagaacctaagattggccttttgaggtatctcttcaggttttcacatttctgacaaccatcacccccaccagatccaccacagggccatgccttgtggccccacccagaagcagactcagcacatgaagaccattttccacacccctatgattgcatccccaacaaatcagcagcacccattcccttgcctgccacactatccttgaaaaactctagcctccgaattttcagagattgatttgattaataactccatcacccatgtggcacagctagcctcatgtcagttaaactctttattgcaatgccctggtctcagtgagttggttttgtctgtgcagtgggcaggaagaatgcaatgggcgattacactcctgcagtcttcacttggtttgacaacatcattacctgcccagtgagctaagctaaaaatttcactgtcatctggattcctccctcaaccaccttcccataccaactcccaacacacacagcctatctctctggcctactgcttctctttcaaatgactctggattctcacttgcctgcccctgccttggttcagccctttgtacttggaatctaggcttttgcaatacctctgatatctgtcaggatacagttaggataatgaaaacattctagttctttcaaataaagggaattgaatgtatggaattgtctgcataggagatgaaagagataagaggccaaacaggatggttttgtaccccagaattctgaaatagcaggaagccactaacatccctaggactggaaagaacatggggaggaggcagagttaagagcccagaagctggggccatagagagccaaaacccagaggaagctccctaatgggcactaaaactacagagaaaggtttcatctgacaggagctaggacaactgaagagacaccattgctggcaaaggtgctgcctgaggcagagagaaataccctggcttatctgtctcttccaatttcctaccagtgcctctgcttgaccaaacccaggcagaaaccactgacttgggcacctgggaaaaagcctgcagaattcagcccactgaaatacagaacagagaaagggcccaaatccaactaacccccttaaccagtctccttcgctagaatctttaattctttctaatctattctccactctgtgccagaaagatctttcttgcttaaaaacttaattaagtcattcctcctgcttaaaacttgtcaggggctggcagtttcctggcagaaaaaaataggacttatccaccaggctgattttgtcaatcaattgcaaatataggaagtattgcttcccttgactatgacatgtatcgggtttgctctataatatgagatgggctcctattcaaagtattgctgtagaacagaatagagactactcctcaaagccatcacgcctgaaactgggaaataactaaagataactacttttggatcagggctgtttgccatgaccaagaggctaagggctccaatgaaaacataccatacaaaagaacagggagagcaagtaaaggctattaaaatctattaaaacaacagggtaactagagattgaattagcaatcaaacaatgtctacaaagaaaagcccagggtcagatggcttccttggtgaactgtaccaaatacttaaagaactaccaccaattcttcacaaactcctccaaaaagcagaaaaggagggaacacttcacaactcatcctatgacaccagcgtaacattgacactaaaaccaaaggcatcacaagaataccaccaatatctattatgaatataggtattaaaatcccctacaaaatattagcatatggaacctagcaatgcattaaaaaatcatataccatgaccaaatgggatttaattcaggaatgcaaggttggtttaatatatgaaaatcattcaacgtaaaatgcaatatttaaaaaataaagcacaaaaattacacgaacaatgcaataaaaaaattagacagtgtctaaaccctataatgataaaaacactcaacaaactagaaatagaaaagagcttcttcaagttgataaaggctatctatgaaaacgccactgctaacatcttagtggtgaaaaactgaaagctttccccctaaaataaggatgtccactctggtcatttctaatcaacattgtactggagatactatccagcacaattaggcaatacaaagcaacaaagtcatccagattggaaaggaaaatgtaaaattatctttatttgcaaatgccatgatcttacatattttaaagccctaaagaatccacaaaaacaatataatagctaataaatgagctcagcagggttaaaggatacaagattaataaacaaaaatgagctgtatttctataccttagtaatgagcaatctgaaatttaaaaaatagtttcacttataataacataaaaaagaactcttagaataaatttaacaaaaggaatgtaagacttgaatgccaaaaaaatctacaaaacatttttgaaagaaattaaagaagatatcccatgttcatggattggaagacctgatattgttaagaaagcaatacttcccaaatcaatctacagattcaacacaatccctaccaagaattatttcttacactaatttacaacctgaccctaaaatttatatgaaatgtaagccaaaaaaatcttgtaaaagaagaacaaagttagaaaacacactccccaaactcaaaacttactacaaagctacagtaataaagacagtgtggtactggcataagcacagacatacagaccagtggtacagacagagagtccagaaataaacacttacatatatgctcaactaattttcaacaaggatgccaagacaattcaatggagaaagaacagtattttcaaaaaattgggctgaaacaactgaagatccacatacaaaaagaatgaagttggatgctgacctcacaaaaatatacaaaaattaactcaaaatggatcagacacctaaatttaagagtaaaaactataaaactcatagaagaaatcacaagagtaaatcttcataaacttgactaggcaatggtttcttagatacaaaaccaaaacaacaaaaataataaaagaaaaaaaaatgaactggacttaatcaaaatgaaaaatgtttgcatttcaaaggacatcacttagaaagtgaaagacaacccacaaaattgtagaaaatatttacaaaccatatatctgtaaaagaaattatatttaggatatataaagaactactacaactcaataatggaaagacaaataacccaattaaaaatgggcaaagaatctgaatagatatttctccaaagaagatatacaaatggccaataagcacatgaaaaattgcttaataccacttatcattagggaaatgcaaataaaaaccacaatgagataccatttcatacactctaggatggctataatcaaaaagacagataacaacaagtgttgatgaggatgtgaagaaattagaaccttcatgcaggtgagctgctttggaaaacagcttgcagttcctcaaaaacttacactcagagttaccatgtaatccaataatcccacccctaagtatacatccaagataaatgaaaacccaaaatgttttggatgggattatgttcaccaaaaaacctgtacacaaatgttcatagcagcattattaataatagtcaaataatagaaataacctgctgtccaccaactgatgaatggattaacaaaatatgcaaaatggtatatccatacaatgtaatattcagtcacaaaaagaaatgacacatgcagcaacatataaggacctttaaaactttatgctaaatgaaaagaagccagatacaaaaagtcaagtgcatgatttcatttatacaaaatttctagactaggcaaatctatagagacagggtatagattagtggttgactagggctatagagttggggtgggggttcaggaaatgggaagtgactgctaatgggtaaaggtttcttttttggagtaataaaaattttctgaaattgattgtggtgatggttgcacaactctgaatatactaaaacccactgaattgtacactttaaagggttgaattgtatggtatatgagttatatatcaataaatctgttatttaaaaagctataaacagaattccgggaagatggtggactatgaagcaccaggaatctatcttcccacatagacaactattgtactggcacaatctgttcaatataactattttggaactccagggtctcttgaaggcttacaatttccaggggaaagcttgatggtaaattgcagttaatttcagcttttagcatagtagaagctgtgaacacattcctagagaagcaaatataaagcttgcaggagctagggtgggcaaagagcaccctgtcctccaaatattgggtatctgtgttctgatcactgactgctgcttctgatcacaggggtgcagaaaagaggcagtagccattgttgctgcacctcccttcattattgcaagccaccccacatacaccaacagaagtgacatccagaggatttaaagggccagtgccctttcccccagcctcatttttctctttctcccttttgagggccagacattcaagactagagcattcaaaggcaactacatacatggggaaaattagatggttgaccatgcatgcccatggaaaggcacagactcagagaagacctaagaagacctcaaatatataccccaggctgatccttggcacaaagacagcctacaacgtttttttttttttttaataaacaaaaacagcaaaccctgagaatggggagaatcctatttccagagttaccacattattagattcaaatgtctatttttcaacaacatcaaaaaaaaatcagaaggcacacacacaaaaatggaaagagcagcctattcagaggaaaagtatatatcaactgaaactgtccttgaaaaagacctgatggcagatctaccagacaaagaaacacccattttaaagatgctcaagagactaaaggaagatgtggtgaaagtcaagaaaatgatgtatgaacaaaattgaaatgtcaaaaaggacatagaaaacctaaaaagaagccaataagaaattctggacaggaggcctacgtgccacctcttgtactgccgccatgtctctagtgatccctgaaaagttccagcatattttgtgagtactcaacaccatcatcgatgggcagtggaaaacagcctttaccatccctgccattaagggtgtgggccaaagatatgttcatgtggtgttgaggaaagcagacattgactgcaccaagagggcgggagaactcactgaggatgaggtggaacgtgtgatcaccattatgcagaatccatgccagtacaagatcccagactggttcttgaacacacagaaggatgtaaaggatggaaaatatagccaggtcctagccaatggtctggacaacaagctccatgaagacctggagcgactgaagaagattcgggcccatagagggctgtgccactcctggggccttcatgtccaaagtcagcacaccaagaccactggccgccatggccgcactgtgggtgtgtccaagaagaaataagtctgtaggccttgtctgttaataaatagtttatataccaaaaaaaaaaaaaaaaagaaagaaaggaagaaaagaaattctgggctgggtgcagtagctcacacctgtaactgcagcactttgggaggctgaggcaggagcatcgcttgagcccaggagctcaaggttacagtgagctgtgatagtgccacagcgttcaatcctgggtgacagagcaagaccgtgtctcaataaaaaatagaagtgaaattctagagctgaaaaagtacaataagtgaaatgaaaaattcactagagggcttcaaaggcaaacttgagcaggcagtaaccttgaagacaggacaatagaaattattgagaataagtgctatggtttgaatgtgtcccattaaaaggatgtactcaagacttaatccccattgcaacagtgttgggaggtagggcctaatgagaggtgaccataccatgaagacagagtgagtgattaatgccattatcttgggagtagattcattataagagaggaagtccagcccccttttccttctttctctcaccctctcaccttccaccatgggaagataaggcaagaagacacttgccagatgctagaaccttcatattggccttcctagcctccaggaatgtgagaaataaattcttttctttataagctacccagtttcttgtgttatatgacagcagcacaaaaataactaagacactgaagaacaaacagaaaaaaagattgaagaaaagtgaacagagcctaagaaacatgtggaacaccatcaagagaactaacatatgtattgtgggaattatagaaggaaaagagggagagaaaggagcagagaggatatttgaagaaatagtgactgaaaacttttgaaatttggtgaaagatattaagtgaaaagtacaattatcatttattgtactttttcagctccagaatataaacatccaagaagcttaacaaactccaaataaaaggaactgagaaagacccataccaaggcacattatagtaaaacttttgaaggacaaagggagaatcttaaaagcaacaagaagcaacttgtcacatacaagggatcctcaataaaattatcagcagatttctcatcagaaacataagaggccagattgcaataggctgatatattcaaagtgctgaaagaaacagactcttaaccaatgtattagtccattttcacactgctataaagaacttccttgagcctgtgtaatttataaaggaaagaggattaattgactcacagttccacatagctggggagacctcaggagacttacaatcatggtggaaggggatgcagccaccttctttacaaggcagtgggggagagagagagagagagtgaaggagaaacttccaaacacttacaaaaccatcagatcacatgataactcactcactttcaggagaacagcatggggaaaaccgtacccatgaacaaatcacctccctcccttgatacatggggaatacagatccctccctcaacacatgggtattacaatttaaaatgagatctgaatggggacacagagcaaaccatatcaaccaagaatcccatatctgccaaagctatccttcaaaagtgagagataaattaagaaattcccaagtaaacacaaaagctgaggagtttttttaccactagaactgccctgcaagaaatgctcacagaagccacacaaggtgaaatgaaaggacactaagcaataactctaagctatataaagaactaaggatctcaataaaagtgaatacattagcaattataaaactagtattattgtaacaatagtttgtaactccactttttattatctgcatgacttaagagactaatatatttttaaaattattactcaaaaactagtattattataactttggcttgtaattccatgctttgtttcctatataatttaagagacaatgcacttaaaagaattattagcttatgttttggggtatacaatgggtaaagatataattttgtgacatcggtaacagaaaggggtggggatagagctttacaggaatggagtctttgtatgttagtcaagctggtatacatttaagttagagtgttaaactttaagatatcaaatggaatcttcatggtaaccacaaagaaaatagctagcaaatatacacaaaaggaaatgagaaatttaaatatttcgctacaaaaaaaatcaactaacaaaagaagacaataatgcagaaagcaagggataaaaaagctataaggcatgtagaaaatatagcaaattacagaagtaagtcccttatcagtacctactttaaatggaaatggattaaactctccaatcaaaagatggagattgacagaatggatttaaaaaacatgatccaactatatgccgtctacaagaaactctagatccacagacataaatacgttgaaagtgaaagaatggaaaaagatattccgactggacaaagtggctcacatttcagatcctagcactcagggaggctgaggtgggaggattgcttaagcccaggaattcaagaccagcctgagcaacacagtaagacttcatctctacaaaataaaatttaaaaattagccagacatggtggcatgagcctttagtcccagctactcgggaggctgaggcaagaggatcacttgaactcaggaggttgaggctgcagtgagctgtaatcacaccactgtgctgcagcctggatgacacagcgagactctgtctcaaaacaaacaaacaaaaagatattcatgcaaatagtaaccaagagagcagggatggctatactgatatccaacaaaatagactttaaattaaaaaaggcgttgagtgtggtggcatgcttctgtaatctcagctatccagggggctgaggcaggagagtcatttgatacgaggagtttgagaccatcctgggcaacatagtgagaccccatctctacaaaaaataaaaaaattagtaggggtatgatggtacacatctgtagttccagctactcgggaggctgaagcaggagatctcttgagcccaggagttcaaagttacagtgagctatgatagcaccactgcaatccagcctgggcgacagaatgagactccatctctgaaaataagtaaacaaataagagacaaagaaggatgttatatattaataaagagtcaatacagtaagaagatacaacagttataaacatttacacatgtaattacagaccatcaaaatacatgaagcaaaaaattcacacattgaattgaagggagaaacagagaattctataatagtagttggaaacttcaataaccctctcttaagaatgaatagaacaaccaggccaggcgcggtggctcacgcctgtaatcccatcactttaggaggctgaggcgggcagatcacctgaggtcgggagttcaagaccagcctgaccaacatggagaaaccccgtccctactaaaaatacaaaattagctgggcgtggtggcgcatgcctgtaatcccaacttgggaggctgaggcaggagaatcgcttgaacccaggaggcagaggttgcggtgagccgagatcacgccattgcactccagcctgggcaacaagagtgaaactccatctcaaaaaaaaaaaaaaagaacaaccagacagaagtaaggacatagaggacttaaaacacaataaaccaactagacctaagagacataaacagtcactctacccaattttcttctcaagtatgcatgggacattttccaggacagaccatgtgttaggtcacaaattgagtcaaaacgtggtacatgcacacaatagagtattattttgcatgcagacgaaagaaaattctgacacatgttacaacatggatgaaccttgaggacattatgttaagtgaaacgtaagccaatcacaaaaaggcaaataccacatgactccacttatatgagctacctagagtaggcaaaatcagacagacagaaagtagaatggtgtcttccagtggctgggggtgggaggggaatggggagttattgtttcatgagtttttaaaagggaaagagttctggagacggatggtggtgacagttgcacagcaatgtgaagaatacatttaatctcactgaactgtgcacttaaaaataatgaagatgggaaattttgttatacgtgttttaccaaaataaaataaactggggagaaaagctatagagtatatttataatataaaaactgaaatgacctagatgtttcatgggcagctattacaaaaatattcataggcccggcaccgtggctcacgtctgtaatcccagcactttgagaggtcaaggcgggaggctcgcttaagcccaggagttcaagaccagcctgggcaacgtccaaaccccatctctacaaaaaatacaaaaattaaccaggtgtggtggcacatgcctgtagcctcagctacttgtgggggctgaggcaggaggatctcttgagcctggtgcaggggatggaggttgcagtgagctgagattgcgccactgcactccaacctgggcgacaaagcaagaccccgtctcaaaaaaagaaaaaaatccataaggcacaccaccgtgcagcctttacaaactaagttttcaaaaatatttaatgacgtggaaaaataattgtacacacatacacacacacagaatgaaaaaagaatataaaatagtatataaagcataatctcaattgtatataaaaatagtaaatacatataatgcgtgtgtgtgcacgtgtgtgtgtgtaacagtggttaaccagctcaagtaacagtatggtacctgactttatttataaatatttaaaaataaatattaagtatatacatatatatgtatatatttctttattttatatataaatatatatttatatgtataaattttatataaatatataattatatatataatttatgtatatatttataatatatatattataaataaagaaatatatatatatttctttattttccaaacagcctacactcaatacacagctaaagaataaatgctcatttttaaatcgaagggattgcattcagtgttggctggaatgggaggaggctggttcctcacactacaggaaggaaagcatacaggtaccaccgttctgcagggcaatctggaaatacctcccttcaacccagaaactcaatttcaggaaacctctcctagggaaatcattaagaacaggcacagagaccaggctgacagggtactcatcacagcctcgtgtataacagtgaaaagctgaaaacaacctacatgtccaaaaatagaggctttagttaaatagattatacttcatccatactatgaaatgttatacagctgcttaaatgttgcagaaagttatatactgtcatggaaagtgtttacgatctatagtgaagtagaaaaagcaggtcacaaagcagtatatgtggtataatcccacttttatataaaaaaattcacacatacaggaggtgtagagaagatctggaaggaaatgcactgtagtgttaacagcaactgccttgagtagatgggtaatggatatctttatgttcttttgattagtcatcatttctgaattttatataaaacacatgtattttgtctatattaagaacaataaagccgggtgcagtggctcatgcctgtaatcccagcactttgggaggccaaggcaggaggatctcttgagttcaggagttcgggaccagcctgggcaacatggcaaaacctcatctctagaaaaaataccaaaaattagctaggcaggatggtgcatgcctgtagtcccagctgaggtgggaagatcgcttgagcctgggagacagaggttgcagtgagccgagatcacaccagcctggcaacggagcgtgaccctgtttcaaaaaagtaaataaataataaattttttaaaagaacaataaaataaaattgtgggggatgaaacaagagatcaatactagggacagctagaagtattgctggctagctcagctaaggagcgtggcaggcagggccttcagggacaggaggggcaaggccatcacagccacctgctgctcccagcctcagctgtccatgagatctgactattcaaatccccttccactgaccttggatttataaattcaaagcatcttcccattttgtcttatttagtcttctcagtactcttgtgagagtattattagctctgttttgcagataagaaaagtcagacttaaatcactcacaaatcacagaacacaatcaaggctaagcaggttatctcacaccagaatcgcatcaaccatatcctcactcacaatgagtgattatgctcccactgacaggcagctcagtaaagtggaaagagtatggatgctggagtccacaggccttgctttgaatcccatctcaactctgaaaagcagcctcttaacccctccgcagggaacgataatactagggtccgggattgttctcaggataagcacaatcacgcaggtaaatcaccacgcaccatgccagactctccatcagcgctcaataaatgctcaggcacagggaacccctgcctctccatgcagctgagctctctggcagctgtgaggttagaaattggcttctgtaaatgggactaacactgaacttcatgcagtttccagtgcccggctctggtcctgtccctgaggccaaaacagaccgagtctttcttcctccaagagccctccacacaggtgaggcctgctcctccacccctggaggctgctcttcccccaaaaagccccattccttcagtgttgatcggcctcacacggtctggtcccaaggtcacctctagtccacagtgaccctctcacagagcagtcacctggctgctccctgattttcccttctcttcttccctgcaggggccacctcaaagaaaaaaataaagagccctggacctatatgatgaaaggcttctattcagaggagccactgctgtggacatctgtcatggacactggacactgccctacctctgatccccctaatgggaccagcccctcttcaccatggtcactggatcaaggatgagaatgtgatccagttggggccaataagacacaacaagaacccgaccgagatgtctgaggatcacacccaggacaatgacagtctgtagccgctccgctcacctggggcctgagatggaaagcaacaagaggggaggggaaacagagaggaagaatccatgtctttgagccctgaagccagctgccactgaagtcagtttaaactgggttttctttcacctacagctgaaaaggccctaatgcacagattttggcagaaactagaaaatggatctgcagcatggcttgggcggtcagcgctgcatacaccgtttacccctctgcatatgcctaaggcaggagcttaggccctgccctcagaaagccctgtgggatggagttgtcgaggctgacttggatttgcactgccccctccaccccctctgtgaacagagcacacctgctcactccatctgcctgccaagcatctggctggagctgggcagaagggatgatgtgggtagcttctccagctgcccctgacttctaggtactccccatcctccaacatcagcaacaactttcccttccctaagccgcactccaggcctctgatcttcatgtgatcttcccctaaagagtcccccgctaggctgggcgcggtggctcacgcctgtaatcccagcactttgggaggccgaggcgggtggatcatctgaggtcaagagtttgagaccagcctagccaacatggtgaaaccctgtctctactaagaatataaaaacaattagccaggcgtggttgcacgcacctgtaatcccagctgcttgggaggctgaggcaggagaatcacttgaacgcgggaggcagaagttacagtgagccgagattgcgccactgcactccagcctgggcaacaagagtgaaattctgtctcaaaaaaaaaaaaaaaattctccccgtaaatgtagggatcccaggtcccacttcctgatggtcaaaccctctgcctgacaaagcagatccactaaggcaccaatgtattcatggaaaaaagccggcctctcccctctccccataaccagatgttgttacctggggcatctgaagaggccaatcatttgtggtcaaacccaagggatacataagaataaaaataacacatttgttgatctgccgggcattgtgctaagtgctttacatgtattcacccattccctgcacaaccctgtaaggtagatattattattatctccatttacagatgagaaaacagacccagtggggtgaaaataatttgcccaagaccctttagctagtaagtgacaaagccagaggtcaaacctggacagcctgaccccaagcttcatgcccttaaccactgcatggaagagcaatttccaccccagcagcagggaggaatggagaaggtaaaggagctctgtaaaccgcccgacatggtgctttacacctgggcacctcctcctgggcacaggaggagcccagctcctccacctgggcacagaggttactcagcttgacggaaaaatttcctgccaagaaacatccccacatcttggtcctggattgtgtgacatagggcaagtcccttctcctctctggcacagtctcccctactgggaaataaaatgtctgcatgggagatgactgtgctggtgggagatgaccgtgctggccccatttgctcttcagagccagtcctctgctttggtgccatgcaatctggaaaagaagttaattcccctgctgtttccaggccccatttttaaaatttccggtttaaaaattttaaattttaaaatttccggtttaaaaattttattttactaaaaagggaactgttcattttgtctcttttattaattatgtttctgtttataaagcagagataggtgcttactttcctctgtgtatgcagaaaagaaggccacagaaaatgctgaggaaggcaagtagccctgttatagtaggcagttagtcaggcatgagcagggcaggagagggccccccgtgacacacacacacacacacacacacacacacacacacgccaggaatgtcaggtgaccatcaggtgatggtcaggcagttgttaactgtttctctaaaataataattggtagcagcctgcatcaggaaaaagcagcctcccagcagatagaagaaactcgaaattggtgatcagcagcttcccaactagttctcaggagttgggcgaggggctcaagcatgcgcactaaggggcaaaatggcggagtgtaactggtagatgaccttcttctaggaatgctagattggcaagggaaggacgccttaagtgagcatgcgtacaactccagtcatttcttacataattctaatgtactgtgctacgacaacatcaaatatcattgactcttcccagggggcttcagagaagacagcaatatgagctggaaggacagaacttacaggaggaaacccggcaaaggtgaggcattaaggtagaggaaccaagggcaggagtacaaatctagggtattctcgagtgacctgaatgttttctccctgaagaaaccttacccagcccaagtgagttccagtccatgtgccagtagaagagagcaattaggaacatgggtgtcagactgagaccccattctgccactcagaggagagaacaagggccctagagccagtctctgaggtcaagtcctggctcaaccacttcctagctgtaggaccctgggcaagtttacctaacctccctgtgccccaggtttcttttctgtaaaatggaaagaataatggtgtttacctcataggtggtggcaaagactgaatgaaggctgggcatggtggctcatgcctttaatcccaatactttgggaggccgaggtgggtggatcacctgagatcaggagttcgagaccagcctggccaacatggtgaaaccctgtctctactaaaaaaaaatacaaaaattagccaggtgtgatagtgcacacctgtaatcccaactacttgtgaggctgaggcagaagaatcacttgaacctgggaagcggaggttgcagtgggccgagattgtgccattgcactccagcctgggcaatagagcgagactccgtttttttatttttatttttttttaaaagagtgaatgagatactgggataaagggcatcacacctggcacgcaggaatctctcagtacaccgtggccactgctacgcttctgcataacctcacctcctctcatttctctcttctgtaaatttggggtttggagagttaaagagacaggaaatcccctaacatagtgctggcccataggaggttctgggagctgaaccatgcaggcttccgattcccaatcagcaaaggctaacgttggctggccaggggaagggactctatctgaaaaccctggccaactcagacctcaggtcaccagggaaaagttgaggtgacaaagtgtgcaggtcaattgcactgcctagagcagtgtgcacatagcctaggggagggaccaacattcagagaaccccctgacagcagcctccccttaaaaatcctgagggaccttggtgaagaaagaagggccaagaatattcctacacagagctaggactgagggcctcttgaactcctcagagagcaggcctgtctctgggcatctccatgaattgggcccgcaattgccctgttagtacaagtcacttctagtccctcagggcccacccaacactcagcttcagctgacatttacgttgcgctcactatgtgtcggcactgtagaagcattttatgtgtgctatctcatgcagtcctcgtgacaagccaatgagagcttgatgggcggggaaacaggggcagagagaggctaaggaacttgcacaaggccccagagccagcatgtgacacactgagtaggacccaggcagatggtcagggccgatgctcataaccgtccctctacactgtctctcacctggcccaccaggctctccagggcctggagcccccaggctgctggccacttcctctaggcagaagtgacccttccctctcccagtatacatgtgactctacctgcactcacagaagtcagaaactagccagagccaggtctcccgtgagccagcaggtgtcccaagagccaatgccacaacctcatgggcggggtgaccacatatcacccagggccaggctcggggcccaagttgcctgtcctccttgcccacctttcatggcagccaaaagactgagctggcagtgacacctgtagacagcctgcctccattaaactatctcagaaccaatcctaggacgtgggctctgggtactgggcaggccccaaagccacctcccacccccaaataggaagccaactcctggtacaactcaccagccccagggcagttgggcaggtggaaattgccagatgatgctttgctgtgcttccagaatgctgttgctggccacacacacacacacacagctgctgaggcacgtgaggtagctgggtgaacaccagggaggaaagagcgtggctgtgtggcacagaccccagcactccccgtagctcagacagatgcaaacaaagccgaatgctgtcaggaccccagaggcagcctcaaaggggcgtgcccattaaactgccagagtgccctgtcgagagcaagggcattttttcctagcccatggggacgtttagaagattaattagaggagcctggcagtactcaagggtccccagggaactgggtgaatatatcacccccttcacaaagctcttaacaagtgtgccccgggctgggtctttgttcaacactgcagaagacaactaagtcagacaggctggaccacctgtagccccctcatctcagccagaaagtgctggcagcactcaatggccagctcatgactgtgctggagggacgcgccacccagggccctggtctctgccagccacagtcagtcacggaacgtggtttgaacagcagatggccagaaggacaggagccactccagatagtccacttcttgccatggccttaagaagtcccattcaaagtgtccctcttcctctaggaagccttcctggccctgctggcctgaagtgacctctccgtattacccatccctagcttttactatttgctgccatgtttggggttgagattttattttttatttttttaatttttttgagatggagtctcgctcttgtcgcacaggctggagtgcaatggcgcgatctcagctcactgcaacctctgcctcccgggtttccagcaattctcctgcctcagcttcctgagtagctgggattacaggcacctgccaccacacccggctaatttttgtacttttagtagagacagggtttcaccatgttggccaggctggtctcgaactcctgacctcaggtgatctgcccgccttggcctccaaagtgctgggattacaggcgtgagctaccgcacctggtcgagattttaaaatatcatttatgcagcatttagaatgtgccaggtaccacaatcaatgctttacatacattatttgacttaatcctcctaagagccccatgaagtgggtgtgattatgcccattacagattgaggaagcagcagcttggaacggtccgatcatctgtgtgtcctgtgcttccagactttttcttcccatgagattgcattatctcacactagagtgcaaactgcttcatggcagtgagatatttacacgttcttcttgtccctgaataggtacacagttaactaagagaggactgattgctagtgattgctgtgtgtcaactgattagccttaatgaacccagaggtggcattaatgaataaaaacatcatcagccatgtggccaactgaccatatgatatgaatccctacatgctgtgcaggattttaattaccaagaaaggcccctgctgaagttgcatactacttatcaagaaactttgctgaagctgggcgcggtggctcatgcctgtaatcccagcactttgggaggctgaggtgggcggatcacctgatgtcaggagttcgagaccagcctgaccaacatggagaaaccccctctctactaaaaatacaaaattagctgggtgtggtggcgcatgcctgtaatcccagctactcgggaggttgaggcaggagaatcacttaaacctgggaggcggaggttgcggtaagccaagatcacaccattgcactccagcctgggcaacaagagcaaaactccatctcaaaaaaaaagaaagagagaaagaaacagagaaagaaagaaagaaagaaagagagagagagagaaggaaagaaaagaaagaaagaaagaaaaagaaagaaagaaagaaaggaaagaaactttgctgaaatgtttttccttcatccccttcagtgacagctgatggccactggcttggagggacaaatccctgctgggcttagcatgacccagcatgtgctgcagggcggccccagcagccttgctgggaactgccaggttcatcaccagccaagggccaagggtcaaataggcagctccgaagaggcgctgctggctccaggtcacgggacactgtgttagaaggcacgggcctcacctttggtagcgtaggcttctgcgatcacccgcagcctgtagggcgggacagctgtcagtggcagatcgtccaggcccacccgggcgtaaatgttcagagcttctttataatcaccttccacataattcaacttggccatgatcagattggattcttgtaggaattctgactagaagcaaaaggagagaaagaaaagcattttcctacaatatcaggcatgatgctccctcagagtctggccagctgctgccgtaaaaccccacagctccccgcacaagagcttggacgtgaatgttctgagcagtgttatccacaatagccaaacagtggaaacaacccaaatgtccaccaaaatgtgggctagccataaaatggaatattgctcagttgtagtaaagaatgaagtactgttatgctacaacatagacgaaccctaaaaacatgatgccaagtgaaaaatccagtcacaaaaggccacatattgtatgcttccacgtgtatgaaatgtccaggatagtcaagtctagagttagaaaacagattagtcttggctaggaatgggaggtggctgctggtgataatggggtttctttgggaggtgatgaaaatgttctagaattcattgtggtgatggttgcacaacttcatgaatatactaaaaatcactgaagtggacactctgaatgggtgagttgtatggtatgtgaatcacacttcaataaagctgttgcaaaaaccaaaccaaaacaaaaccctgcggctcccttcatcaggcctgtggctgggctgggccggctgggaaggaaggaatgcttcataagttaaacatacaagcacctgtctcagaaaaggaagcggccagacatcctggtgggtctggccatggcactggagatgcaccacaaccctgtaacccaaataaccaaggagagccttcccaaatggatgtgaagatcaggacttgcttgctttccagggcgaagtttctcactgagccattgaagtttctaaactgaggtgacctggtaccctccctagaggctaagggctggaagttctctgtgggccccccttcctcccagtcagcaaggctggcctggccagtccccctctccccaaagcctcatcattgccttcctccctgacccgtcctccggcacctagggaaagaacaggccaccctgccacctatataaggaaacagatttatcttctgtggccagaccttctcctcagagcccaagcggttcaaagctgaggtttttgcttacagaagcacaccatgaaaccgcactatttatactgtaacctagagctttgatgagtggacaacacggccaggtagccaggtacagcgtgttacagcagctatctcagccagcgtggtcggcttccaggcatttcttggaagagggagggacatcaggcagcattggaaaggatggtgcagtggacaagcaggactgatgggagcaaaagtgtttatgggtggcccaagggagaggcaccagaggaattagaattacatctggagacagagaaatcaaagcagactcagaaaagagaaaaaaagcatccaggccgagtgcggtggctcacacctataatcccagcactttgggaggccgaggcaggcagatcacttgacgccagaagttcgtgaccagcctggccaacatggtgaaaccccatctctactaaaaatacaaaaattagtggggcatggtggtgcacacctgtaatcccagctactcaggaggctaaggcacaagaatcacttgaacccaggaggcggaggttgcagtgagccaagatcacgccattgcactccagcctggatgacagagcgagactctgtctcaaaaaaaagcatccaccacaggggttctccacccaggtaggggacaggccaggcttgggtattttgaaaacatttcctaggacattctgggaagtctaccctccttccccaagcttctagcctctaagaaccgttggattaaaggcgaattgaaagaggagggggaatgaggagttagcattaatggacacatcacaagaggttcgctctgggaagatgcaaagagtcctggagatggagggtggtgacggctgagtgacaatggtaatatacttaacgccactacactgtacacttacaaagagctataatgttaggttgtaagttatgtatattttaccaaaagggaaaaaaaaaaaggttaacaaaagcaaactggagagccaggtggagaaaacgcttgaagaaaattgcaagcctagaggcacagcttggacacactgggagagcctccctgggcgagtccagtctccacccaagtacaggaaacagcttggccagggcgcctcggctgcctgggcagtgggagaacagccccaacacagtgtcaggggccaccttgctcacaataaggaccattttcttgccttgaatcacaagccagatgtcctgactcctagtccaggactctttccatcccactacatgcctggctggctctggtcttcccagcctcaattcacttaagacaagctggacttaagctcaaggaaagagaaagtttcacattagttggtgtgagtaggacagcacacccatgcaaaagatgtacggctttggaacattctttataagatggaggaaggtgaaaaagagcaatgggagaaaaaaattctctaggtagaactaataacatagcaagaaatgatgtgtatctagtgctatacagctttgaaagaatttctccatttgagcctcaaaacaatcctgggttaagtaggcctgcagctgagaaacatgaagctcagagaggttaagtaacgtcccaagatcacacagcttataaatccagaactggactcagactcaagcattttaacttgaattaaattcaacagctgggtgcagtggctcaggcctgtaatcccagcactttcggaggccgacgcaggcagatcacctgaggtcagcagttcgagaccagcctggccaacatggtaaaaccacgtctctattaaaaatacaaaaattagccaggtgtggtggcatgcggctgtagtcacagctactcaggaggctgaggcataagaattgcttgaacctgggaggtggaggttgcagtgagccaagatggtgtctggatgacagaacaacactctgtctcaaaataaataaataaataaaaaataaaataaattcaatgggcttactaccacactgcattgtagaggatggaaagcaaaacctatcagcacctggtgaaatgaaaagtgaatttttcaagatgaagttggggggcgggtagacgggggaaagaaacaagccagatctctcccctcacacctcccagcaggacacttgagtctggctggccatcactgtgagctgtggcccatgtgcctgctgtcccttcactctctcctgctgatcaagacctaccacctgtgtccccagatcaagacctacccctgtgtccacctgtgtcatcatgtcatcggttaagaacatatgagatgaggccgggagcggtggctcacgcctgtaatcccagcactttgggaggctgaggtgggcggatcacgaggtgaggagattgagaccatcctggctaacacggtgaaaccctgtctctactaaaaatacaaaaaattagccgggcgtggtggcgggtgcctgtagtcccagctagtcaggaggctgaggcaggagaatggcatgagcgcgggaggcagagcttgcagtgagcgaagatcacgccactgcactctagcctgggtgacagagccagactccatctcgaaaaaaaaaaaacatatgagatggatgagatggagatggggtttcgccatgttggccaggctggtattgaactcctggcctcaagtgatctgccacacaccaaagtgtggcatggcccttacagagaaactgaatggggaaagagaagacctggtttttgaagcccaaatgcagcagggagtctttaagtacctgggatccctatgctgagctgacctctccagccaccccctaggggcctggggcaagatccctgtgttgagatgacgctctccagccacctcctagcggcctggagctgtgtcccgtgcatacaacatacacagagacaattttgaaagcagctctctatcagggtttccagaagcctgttgctgcacaactgaccaacaccaatactaacttactcaaaggttgcccaggccctccattgcagcagggccaaggaggtggccagatgaccaagaggaggaacagctcaaattgaaagctcacaggcttagaacatgcaggagccgggaaggtccaagctcacccctttaagagcccaccccattcaaacctaaagaaactgagctgcagagaggcgagtaacctccccggggtcacacagcaagtcgggagcaggctggagtttgcagtacagatatgaaatgtaaagccaaagaaagcatggcttcccggggggaagcgtgcacacacaaacaagaataaagaccaaaaatggagtctcagaggattccgagacaggaagagaagaaaaatgagaaagaagtcatcaaagttaaaaggaaacggaagtcagagctccagaagttcaccaaagactgtcctcagtgggaaatacatcctggggaagacaggcagcatggagcgggccacagacagccatctgaactaggggaagcatctagagccaggggagtgtgagccacctgggaggcagaagggcagggcgggaagaggagatgacccccatgaaaagcaaaaggaactgatgaggagtccaagaagaaaggaaggaaagccacgtgagagggaatggaaacctgggtgtaatgagaccggaaaacagaatggacagatagggggcagcacctaagattccttgtgcctgagggtgagggttcttgctgagacgtggggaagttcctggccccctcccaactgtgacgccaggcctgctggcaccagtatggaacctcccacagctctgggccacagtggcttcttacattgatgagcaggaagctgtgcgctgagcatccttctgattaacttctctcttttctagaactgcgtaacatgtcaggttaagctctgggttatatcggatagctttagttcaagcgtctgagagataagtggcattgtgcagatgacgtgtcattgaagactctcatcagagagaccctattggcccagaagcccccacagtggtcagccagcctagagattggcacatccacccaactgggagctggcccgcttctaagaagacaagccctggcagtgtgcaggtgagctccaaacgtcacccggctcaaccctgggcacccttctcaaccccacactgtccaaaggaagtgtcgcctcagcccagaggcccatggtaccttaaggttccctcggtccagggcggcggtcagatgcttgcggacctcagtcagctggggcttggggcctcggggactggccccctgcctcagggggtgttccttcaggtactgctccagcttcgactccccgaggagaagctctgccatgtcatctacaaaaacaaagtgagaacaaagtgggagcaaggaatggcctgcatgtaggaccccctcactcaagggaccccagaaccaccaccctccgaggctccaggcccccagcaaggtccttctggaacttcatagccttcatagggtctaagtgggcaccacctcatagtgaattcagttcatttaaagaatgttccagtagcatgtactcaaataggtgttggctcaaacactccatcatttctttgccagtagatactttttttttttgagatggagtttcgctcttgttgctcaggctggagtgcaatagcacgatctcggctcaccgcaacctccacctcccgggttcaagcgattctcctgcctcagcttcccgagtagctgggattacaggcacctgccatcacgcccgactacttttttgtgtttttagtaaaaacagggtttcaccatgttagccaggctggtctcaaactcctgacctcaggtgatccgcccacctcgacctccaaaagtgctgggattacaggcatgagccactgcgcctggctgccggtagatacacattaacgtggagagagttcaagttcagtaggaaaaaaacaaaggtggcttatgatgtgttcattatgatctttataaaacacacacaaaccccagtgttacgtattttcaagagtggcgcgatgaaatccccagctctggtgctgtattctatgcagctggtggaatgtctgtacagccagatcttaagatgagtctgtgtcaaaatgacctgaacgcaagtctgtattcttgcagagtaacagagtgttcgtctgtttctgtctaaaagtcataactatacagatatctgggaatgcttgcatgaagcttttactcccgagagcatactactacttacggttataacttgttgatgtctatattggcttaattcaaatgaaaagttcactccaggagcagctctttgtaatccacaccaccccccagactcttctgaataaacccagaacaactcatacaccagcctaagcatggtctatttttctgggatgggacagaacataattgtattaaaatataaaatcagttttaaaaggtctggaaggacatatcttaaggccatgatagtagttacagctggggtgctggggaggggacctcaactggggttggtggcaaaaatggactttagctttgtctttaacatcctggtcctaaaaagaagactagatttacctattatatatgcaatctaaaattaattcaaaaagtcatcagcgaggacccccctaagattctgggtggtaagtccaccaaaggccaagagctaaaacaaaagccttttccacatgttctgagaagttggcccaaaactgctgaatctataggtcttagcatgctctatctatgtactgggaagcctaaaataaccttttagagatgagacctagagttctgggaggagccaattaacacgaaaacagggctgagttcaggtactgaactcaagaactcattagacatgcaagaagaaaaagcaagtctggccagccatggtggtttatgcctgtaatcccaacactttgggaggctgaggcaggggaatcacctgaggtcaggagtttgagaccagcctggccaatgtggtgaaacccggtatctactaaaaatacaggaaaactagccaggcatggtggtgtgcacctgtaatcccagctactagggaggctgaggcaagagaatcacttgaacccaggagtggaagttgcagtgagccgatattgcatcactgtaccccagcctgggcgacagagtgggactctgactcaaaaaaaagaggaaatcaggcaaggccacagcagcatccaatgccagaagacaatgaagtggcgcatacagagtacactggggtacaaagtgcgactccagtgcgtggggccggtccagacaccagccaggcaccaaggcaacaagcagcttcctcccagacacacaagcccttctcaagaaatgaaacccagctcataaagaaacccaggactcaggaacgaaggacatgtaggcaaaggcctgagtgtttcttacagaatactaaatgcccacaagaattagagccacagaacaaatatgaatgtcagaaagcaatacgttgcaaaaacaatcatatatccgaaattgggaggagcttcggagtgtcatgcctttatctttcaaaacactgtaccatgtgctcttaaaaaaaaaaatcaatctaatcttttactatttttcaaaaatttgtttaaattttagtgaactctcaggaaataatgaagaaccatttatttagagctcaaaaattcctttaggcagggcgcagtggctcacacctgtaatcccagcactttgggaggccaaggtgggcagatcacgaggtcaagagattgagatcaacctggcaaacatggtgaaactctgtctctactaaaaatacaaaaattagctgtgcatggtggtgtgcacctgtaatcccagctacttggcaggctgaggcaggagaatcgcttgaacccaggaggcagaggttgcagtgagccaagatcatgccactgcactccagcttggcaacagagtgagactccatctcaaaaaaaaaaaaattcctctaaattcattttcattttttccttttaatatttatgaataaacttattaatactataataatagaccagtgctgttcaatagaaatatatgcaagccacatacataatttaaaaattttgttttgttttgtttttcttgagacagagtttcgctcttgtcgcccaggctggagtgcaatggcacaatctcagctcactgcaaccttcgcctgggttcaagcaattctcctgcctcagcctccagagtagctgggattacaggcacccaccaccatgcccagctaattttgtatttttagtagagacggagtttcgccatgttggccaggctggtcttgaactcctgacctcaggtgatccgcctgacttggcctccccaagtgctgggattacaggcatgagccactatacccggccttaatttataaattttaatagccatgttaaaaaaggaaaagaaggcagggctcggtggctcatgcctataatctcaacactttaggaggcctagacaggtggatcacttgagcccgagagtttgagaccagcctggacaacatcgcaagaaaaaaaaagtggaattaatttaaataacattttatttaactaaatataaccaaaatactatcaggtcagccgggcgcgtggctcacagctgtaatcccagcacttttaggaggccagggcaggtggatcatgaggtcaggagatcaagaccatcctggctaacacggtgaaaccccgtctctactaaaaatacaaaaaattagccgggcgtggtggtgggtgtgtgtagtcccagctagtcgggaggctgaggcaggagaatggcgtgaacctggggggtggagcttgcagtaagcggagatcgcgccactgcactgcagcctgggcaacagagcgagactctgtctcaaaaaaaaaaaaaaaaaatactatcaggtcaacatgcaatcatatttttaaaatattaatgagaccttacattcttttttcatattaagttttccaaatcttgtgtgtattttacactcacagcacatgtcagctctaacctgtacatttcaagtggtcaatagctacatgtagctaggggatatcatattggacagcaatatgatcactgtttatagaagtctgtctaaatatctacctttatatctgtctgtgtccctacaaagatgtctaaaatgatcatcacttagtgtaaacaataggaatttctgaatgataagatttgggataatttttaaattctcatctttgtggtttaaattatttacattgagcaaaattcttttatatcacttttagaaaaaaaaaaaagtaactcttctttaaaaactggaagtatatataccaggatattaatagtggttacttctgagtggtaagactatccatctatgtagaacttcttttctgtatatttttaaattccaaaaaacaaaataaaatagaacttgggattcagagtcctagatttaaacccaaatttgtcactcggtgactttggcccaatgatttaacttcattgattctgggaagcaattccaagaaagcacctctttcggcctgagcggaggactcctctctccccacccctcctcacgacctcacccctcctcgcctccctgccacagggaccctgcatctgaaaatggctcctctgggcagaatctccaagccagggagcagaaacaacgggagatcaggacccctgctacctattctagctgtgggggcacatgacttaccctctcagagccacaattccatttacagactgtgggctagagctactgagttctcagtgggaaaactctatggcccagagtgaacacacctcccagctgggcctcagaggatgagtaggacctgggctggcaaaaagcagagggaagggcaaaccaggctgaaggaacagcacaaccaaagccacagcacagagcccaggaaagcggagagaaccaagtggcaggggaataggatgtggatagaaagctggagaatcaagctgggatcagaatgcccagatgtcaatgcttcccgctcctgacctcccgactcagcacccccaccacagggagacatccaaagccctcagcaatggaaaacaggtcctggccaagtgtcacatgtgccacccctttggaatgttctggcatcctgaggacaccattcaccgctacttagtgaacacctacgaatattccaagcgctgcagacctctcctccaggtgcctcatcccaaaccacctcgagcagccccaggaaccctgagcaccctgggtgttcatcagtctgtctgccccttctagactgtaaggaggaggcctaaaggaagaacctgtgtgttgtgcacaatatctggcacagagtccatgctcaataaatggtgaattaattagatgatagggaaggcatctgcatcttccccagggttagggcggtcattgcctgtggcagagtctgcttgttgtcccagaatattcactctccctttcttcctttagtattaaaattcccatgttttatcagagcacgcggctgcccagttaaagactacacatcccaggctccctgatggcgacatgctgccccgtgactacgttatgacgatgggatgggagcagaggtgttgcacgcagcttctgggcttggcctttagagggaataggcttgcccgccagtccctgttcaccctcccccataggctggaccttggcagtgctgatggaaaatggcacgcccatctgagaccacaagctggaagccacctattgaggatgagcagagcagagcagcgccacacaaggcttgctagatccccaacaccaggagctgccaccgagcccccgactgcttatgtgagagtgaaacatgaacttctatcctgatctactttctaagtcactgtgatctttgttacaggggccaaactggaatcttaaccagatctcccaaacaagaaaccagcttcaggctgagaactcctatctggaaacaccccatcaacctcaagtcctcaagtttaccggtctccaaacagaattcccagaacccaactgagggcctttgcagaatccgcagaccctgcacttctcctgctgctttggttttacatcccaggcttgccaaatttttatttaaacaatgggtttcatagttgcagagaggtgtaaaaactgctacccaagtgctatgcggattcagggcctttgtgtttctctgatctcctgatgctgggggaatgcgccagagtcgtgatgccaagatgtggagagcgctcagttccatcagcagcaactgggggcagggtgcggtggctcacgcctgtaatctcagcactttgggaggccgaggcaggtggatcgcttgaggtcaggagttcaagaccagcttggccaatatgcagaaaccctgtccctactaaaaatacaaaaattagccaggcatggtggtgcacgcctgtaatcccagctactctggaggctgaggcaggagaatcacttgaaactgggaagcagaggttgcagtgagctgagattgtgccactgcactccagcctgggcagcagagcaagactctgtctcaacaacaacaacaacaaaagcagcaactgggagagcacggtgcaggaaaatgatcaacggagaaaaaagtttttcctcagaattaggagacacagtcccttccctcacgacaccccagtctctcaagaccattcaacacaatacaggctctaatgaagatgtgtacagtattggatgggggtgggagaggagacaaagcttgcaccaagaatgtgatgctacacatttgcaagatggaaaatgtggggaaaagaattgcagacagaaggaatagaatatgcaaaggtatggcatgccctactcgtttggggaattacaagtcgtttgttagaaccaaaccatgaagtgctgggagagtgatatggtttggctctgtgtccccacctaaatctcatctcaaattgtaatccccacctgtcaaaggagggacctggtaggaggtgattggatcatgaggcagttcccccatgctgttctcatgagactgtgttctcacgagacctgatggttttataagtggtgatttcccctgtgctttttctctctctcttgtttgccgccttctgaagaaagtccttgcttcccatttaccttccaccatgactgtgagtttcctgagacctccccagccatgtggaactgtgagtcaattaaacctctttcctggccaggcacagtggctcatgcctgtaatcccagcactttgggaggccaaggtgggcggatcacctgaggtcaggagttcgagaccagcttggccaacatggcaaaaccccgtctctactaaaaatacaaaaattagccaggcgtggtggcaggtgcctgtaatcccagctactcaggaggctgaggcaggaagaatcgcttgaacccaagaggcggaggttatagtgagctgagattgtgccattgcactccagccttggcgaaagagcaagactctgtctcaaaaaaaaaaaaaaagaatctctttcctttataaattacccagtctcaggtatttcttttgtttgtttgtttgtttttttctttttttcttttttttttttgagatggagttttgctcttgttgcccaggctggagtgcaatggcacgtcttctgctcaccgcaacctccacctcctgggttcaagcaattctcctgcctcagcctcccgagtagctgggattacaggcatgcaccactatgcccagctaattttgtatttttagtagagacagggtttctccatgttggtcaggctggtctcgaactcccaacctcaggtgatccgcccgcctcggcctcccaaagtgctgggattataggcgtgagccaccgcgcccggccttgtttgttttcttcgaaacagtctcattctatcacccaggctggagtgcagtggcaccacctcggctcactacagcctccgcctcccaggttcaagcaagtctcatgcctcagcctcctgagtagctgggattacaggcacgcgccaccatacctggctagtttttgtatttttagtagagacagggtttcaccatgttggccaggctggtctcaaactcctggcctcaagtgatccacccaccttggcctcccaaagtgctgggattacaagtgtgagccactgcacctggctgggtatttcttttttttttttttttttttttttttgagacggagtctcgctctgtcaccaggccggagtgctggagtgcagtggcgcaatctcggctcactgcaacctccacctcccgggttcaagtgattctcctacctcagcctcccgagtagctgggactacaggcgcctgccaccacacccggctaattttttgtattttcagtagagatggcgtttcaccatgttggccaggatggtctcaatctcttcacctcgtgatccacctgtctcggcctcccaaagtgctgggattataggcatgagccaccgcacccagccctggctgggtatttctttatagcagtgtgagaatggactaatacagagagaaagggggaaccgtcaggggagtttcctgctaggcaggtaggtatcggctcctcagttccaaaaggagctgcctgctctgagcagggaagttacaatctcatttgaaattgagcatggtggctgcaaaacaatttccgaaatttttcaaaagtccaggcgctaagttaatctcccaacaaattatgttttctttgcttccctcaaaaaaggtgaattccctgccactcactctcccaatcaggagggcagagatattaaaaacatcaagagtcaggccaaagaaatcatccagaggctgcatagttcagtcctaaatgatagaggggcactgggtggtgtgaccaacactccatgagcactgcctgcccttgtcagggacctcgtgggctcccaattcagaacccactagcaagaaaagacatcacctaaccagcatttattacctaataacgtgtccagctgcaaggtagaacagtgtgacaagagggaaaaaaggcactccagggcatacgagaaaattaattccagatagattaaagaattaaatataaaacaagatcaaaacattaaagctagacttttacttccagccaagaaagagtaatagggaccaaatttactctcctatctgagactaccacaaaaacaagacaaaaaaaaaatgttttcaagacattgggcatcaggcaacaaagaacagtgacccgtgagagctgggtaacaaacaaggtgagcccactacggccttgagagcttccaggtgcaacacagaagcggggaccttacactcgaattgtgcgcaggaaaggcttaaatcccccatgtgcctatgcactcaccaggcagagtgtggcacacagctggtcgtggagcagccggactgcaaagtggggccagaagtgcagtttacagaaaggagaggccacagctagtgcaatgcaggggaaagagctttggcctctggcagccctgggcttaaatcccacctcccttgctcgctagccgtgtggcactgggcaagacacttaacctctctgagccttagttttctcacttgggtatcatgaggattagagataatatgtaacgcacatagtctgaagtaagtggtgaataaacattagctactgttattaccatccatttaggattgactatttcccagaatagttatgttggatcttgtggggccagaaagctctaggagacacaagctccgtgttcaacaggcctgcaatgtagcaggaggatatgaatgctgtgtgagtcattaatagcccagccatgctgagctcatacgaagtgccatgcagtatggtgagcagtttacccgatcctgatagtcctggaaacaatactaggatgctattatcatctccatctcacaaacagggaaccaggcaggagaggggagcagcatccctaaggccacagagctggttcatcctggagctgcgtttgaacgcaggcagtctccctacactctctccggcacgccatgcacaaactataccatcagcctccagaaggggcccagcttccctcccaaccagctgggtgaccccggcccacttaacccctctggggcagaggctggatggatggttttgaagtccctctccttcacttgctaggattctcaggggacaggggtaaagagggactcaagggtacccagggctggcttcgcttttctcttgggcattatttgggggttaagtgaggctgcagtaactagctccccaatggcttatatagggataaagcctgaagccaaagagagaccactagtgagaccctcaccaaggagatatggggaatgagccaccctgcaggggggtccgtgccctggctcagcacaacagagccagtcccctgagccctgtggctggcacagttcaatgcccacaggcacttggcctccttgatcccccccacccggggaaggtggggctgtggcctttgcctctggaagggactgcccttcctcctagttcctcctttgctggataagcagctgacatgcagagatgtgatcagatgaggaagaaaaaaagactcttctctattcctgggagtacttgacaccaacacaaaaaattctcaacaactcagtttctatgtcaatagagaagtatttagatctattcaaaccattcctgctgcagctggcatccaggaggaagaaacacaccgctattcagggaggagttggctcctcagtgtcccctttgttgccccaaaacacagccaggttctccatttctttttctttttttctttttttttttgagacagtctcgctctgtcacccaggctggagtgcagtggcacaatctcagcccgttgcaacctgactcccaggctcaagcaattctcctgcctcagcctcccgagtagctgggattacaggcgcgcaccaccacaccaggctaatttttgtattttagtagagacaatgttttcccatgttggccaagctggtctggaactcctggtgtcaagtgatctgcccgccttggcctcccaaagtgctgggattacaggcacaagccaacttgcctgacccaggttctccatttcttaaggctcagaaggccaggtgcagtggctcacacctgtaatcccagcactttggggggccaaggtgggtggatcatgaggtcaggagttcaagaccagcctggccaatatggtaaaaccccatctctactaaaaaaaaatacaaaaattatctgggtatggtggcacacacctgttaatcccagctactcgggaggctaaggcaggagaatcacttgaacctgggaggcagaggttacagtgagccgagatgtctccactgtactccagcctgggcaacagagtgagacttagtctaaagaaaaaaaaagcctcagaatgaccagagtgaactccagctcctcgtttactgggcttcctgtaatcccgggtaacccagcatttgcagtatttgtgatccccctgcctccagagtgctaacaggaaaacagacactgctgtgtcatgctggtgggggtataaattagcatgagtgtctccagggggcaatgtagcaatttctacaaagcaactgacatactcccataccagctgacccagaaattccagttttaagtggttatcccacagatatatgcaatcttcagcacaaagatgtacagatagggatgtttactacatacagccctactggtcatagcaaaagatacgagacaacctataaggtccttgacaggatacctgttaactgagttatggtgcaccccatgcagcaggaccgtgcacccataaacacatggagcagatctccatacgactctgtggtggcctggctgtacgaaaggccatgtcttcacgtttcctgaatcccatgctctgtggcctcttgcactgtccctgggcttgaccccagggcttgctctgactgatggaacagtggaaatgttaatgcacgcagaggcttagaaaagggcttacgcactttttccctcttgcttctctgtgaccgccacgagaacgtgcctaggccagcccatacctagcccaggccaacctgctgaacgataaaaggccacgtggcgcagagctgagctgtctaggcaagactccataagcgtaagagagcccagccaagagcagcaaagtcaccgggctgacccatagcaggccactgatggatgagcgagccctggcaagcccagaatcatgagaaataataaaaggtgattgctttaaggcactaagctttgggatggtttgttatgcagtaatagctgacaatcacaaagatagctgaaaaaagcaagacacaaaagagggtatatagtcactattgtgtgtaaaaaacaataggccggactaggtggctcacacctgtaatcccaacactcgcctgaggtcaagagttcgagaccagcctggccaacatggcaaaaccccgtttctactaaaaatacaaaagttagctggtatggtggcaggtgcctgtaatcccagctactggggaggctgaggcaggagaattgcttgaacctgggaggcagaggttgcaatgagctgagatcgtgccactacactccagtctgggcgacagagtgagactccatctcaaaaaaaaaaaaaaaaaaaaaaacacgcaataacatgttttcttataaatgtgcagatattcagaataattcctaaaggagcccctggaaagtctaaagagtggctgttcctatggaagggagcaagaggacatggacacgatgtaggaggctgtttttcaccatataccctataattcgatttttactaccatgtacattcattacctacaaaaaacatgaaccagataatttaaaaagaagaaagatgacccatgtcactgtgtgctcttggtctagagtggctattctggccaccccagaggggttcccgtggctcagtccatcatctcagagccaaggaaggagttttacatctgcgatcactaccgagagcccatctcccactctccctgggcctccagcctcacgcacccgtgctccaggtcctcagcatctttccaaggccacggccatctgactcacccaagggtgcttggacatgtcatgcctccctcccttctcctgccaatatcccaggcatcctttaagacacatttcaggtcagcttggagcagcttcccttgctccctcggcctgggccatcagggtcctggtggcactttgcacatcacccccattcattcagcacctgccagcaccaaggacttacagctatgaacaggacctagtgggtctctaccctcaaggaccttacactctagacagggaagacaaagagataaaccagaaaagggccagacagtggtaagagctgtgcagagaaaagagggtgactggggctactgtggactaggtggtcagatcagggaaagactcaagggcagggcatccaagacttcaatgaggagatggagtcagtcatgcccagatctgagcgaagagcattccaggagagggagcagctcctggaaaggccccgaggtgtgaacagagctggtgtgttccaggaacagcaggaaagcccgtgtggctgggtggagggaagggcgttggggtggagatagacagcggggcaggtaagcacagactgtggcaaggggtctggcattcatgtgaagtgcaattgggagtctgaaggtttttaagcagggagatgaaatgctctgatttaagttttttttgtttgtttttttttgagacggagtctcgctctgtcgcccaggctggagtgcagtggcacgatctcggctcactgcaacctccgcctcctggggtcatgccattctcctgcctcagcctcccgagtagctgggactactacaggcgcccgccaccacgcccagctaatttttggtatttttagtagagtcagggtttcaccgtgttagccaggatggtctcgatctcctgacctcgtgatccacccgccttgtcctcccaaaatgctgggattacaggcgtgagccaccacgcccggcctgatctaagtttttaaaagatgcctctgtcagccctgtggagaatggacccagggtggggctggaggcaaggctacaaatggttaggaggtagtagtagtcaggtgagacgtgatggtgacttgggcaggacgaggtgagaaatatgcagaaagagagaaatagactgagtggggacatcatttgaaggtgaaagattaaactggaggtgtggcagacagaataatggcccccagacatgtccacatcctcatctctgaaacctgtggacatgttgttttacatggcaaaaggaactttgcagatgtaattaaggatcttgagataggagaattatcctggattatttgggtgggcccactgggtccttagaagagggaagttagaaggtcagagtccggccaggcgaggtggctcacacctgtaatcccagcactttgggaggccgaggcaggcggatcatgaggtcaggagatcgagaccatcctggctaacacagtgaaaccctgtctctactaaaaatacaaaaaattagccgggcacagtggcggacgcctgtagtcccagctactcgggaggctgaggcaggagaatggtgtgaacctgggaggcggagcttgcagtgagccaagattgcgccactgcactccagcctggatgacagagcaagactccgtctcaaaaaaaggtcagagtccaaggagatgttaggacagaagtagggagaatgaatagaggacactaaacctctggctttaaagaaggaggaaggcagccaggcacgatggctcacacctataatcccagaactttgggaggctgaggcaggaggattgcttgtgcccaggagtttgagaccaggctatacggtccttgagaggagacctgttaactgagttatggtgcacgcatagtgagaccttgtctctatacaaatttttaaaattagctaggctttgtggtggacgcctgtagtccaagctacaggggaggctgaggcaagaggatcgcttgagcccgggaggtcgaggctgtagtgagccatgatcacaccactgcactccagcttgggagacagagcaagaccctatcaaaaaaaaaaaaaaaaaaaaagatggcactatgcagtgccggcagcctctagaagctggaaaaggcacaaacacaggtcctccccaagagtccccggaaggaacgcgaaaccactgacacttgaacttcgcccagtgagacccatttctgactctgacctccagaacgctaagagaagacatctgtattgtctgaagctggcaaatgagcgataatttgttacagcagccacaggaaatgagcacacaggatgaggaaaggagagggttgaagataaaccctcgatttgagatagcacaatggagcggagagtggagccattttaccatttactgaggtgaggaggaataaaaccaagagctctgtttgggccaagtgaaatgtgagacagcattcaatatccaagtacagaaattaagtccagatcaaagctggaggactgagcgggaaggacctgggaagagaaaccacgaccatgtctgctaccaaaaccaagattaggaagggtttctggaaagaggggtatttgagtgcattgaaagctgctggagcgccgggcacggtggctcacgcctgtaatcccagcactttgggaggccaaggggaagggggtggatcacctgaggtcaggagttcgagaccagcctggccaacatggtgaaaccccatctctactaaaagtacaaaaattagccaggtatggtggtgggtgcctgtaatcccagctactcaggaggctgaggcaggagaatcgcttgaaccctggaggtggaggttgcagtgagccaagatcgtgccattgtactccagcctggacaacaagagcgaaaactccatctcaggaaggaaaaaaaaaaaaaagaaagaaagaaagcagctggaacatcaagtgtaagatcacagactagccattagacctggcagcacacgggccacatcagagggcagcctcgacgtgaggcatctcaggggactgcggggtacaagcctaactcactggactgagggtttgctagggaagggtttgcagggggctgggccagtccttagacagcgatgggggttcagggagcctttagcagggaagtctagggtgcctgtgcccgtgcctgcagaagggaagggtcaggagagaagtgaaggctgtggcagcccggtcctgagagggtgagaacggaagggattctgagcacaggtgaaggagccgctggcctctgaagggagtgagggctccaagcagtgacagagggcgccagcagtgacagaggggaaagctggtcgagttagtggcatgaaacaagggagtttcctaattgcttttatttcctcagtaaagtatgaggcaaggtcatgagctaggcatgagagggtggctttcaaaggaagggagggaggagcacatggaacagacactttggagcatgggaatccgacctactgaagagcggcggtgctcctcccggtctttggtcaccatttgcaagtagtcaacagggttgacgggtactccccagggacgctgctgcgcaggtgcaggcgtggagaggcagagagccgggtgtaacagggcagggacactgtcaagcagcggggttagaagagaagggcacacacctctcctagaaaacatggataaggccgggcacggtggctcacgcctgtaatcccagcactttgggaggccgaagcaggcggatcacctaaggtcagaagttcgagaccaacatggtgaaaccccatctctgctaaaaaaaaaaaaaaatacaaaaaattagctggatgtggtggcacacacctgtaatcccagctactggggaggctgaggcaggagaatcgcttgaaaccgggaggcagaggttgcagtgagctgagatcacaccactgcactccagcctgggtgacagagcgagactccgatgcaaaaaaaaaaaatatgaatgagttgaccccatgtaagccataccaggtcacccctcccctctaaaccctccagtggttccactctccccccaagtgaaggccaaaatccttgtaacttaccacctagccactacctccatctatcccctcatacttatgttctagctgcagtgcttgggccataggaggggctccataaatatttctggaatcaaccaatcaatatatctccccttcacagatggagcccaaccaagcaggctggcctcaggagactcagctcccctggggtgcctgggacacagtctggccatgactgtgggccagaattcggaccttcccattcccactgcagggctcctgctggttcctcccgactcccataactctcctggtttaaactgtggcccagttcagagggcctggctagttggaactcttgactgaaaagcaaagatggcaaaaggcaaagatgaaggggcccagaagaagttggcagaaacaatattctgggaaaatcttggtagtcagagaccaggcttcatgccaagcctccccccacatctacacacacagcgcagaggctagaagaacaggatgggagagtaaagtgtgggaagagaagacaatccttccgctacactggcagaagagatgagtacgctggtcacacacacacacacacacacacacaattcctagagaagcctgatacaagaaaaggtaacctgaaagtcactagcgtagagctggtttggcctgtccccggagcccagcagggcaggaagtgactctaccaggcagggggatgttatcaggccggcccagagggcttggaaatggcctctcaggaagccagctccacacaggcaagttcaacacactcgcagagagccaaaagaaagagctgtggccgggcgttgtggctcacgcctgtaatcccagcactttggaaggccgaagcaggcagatcacgaggtcaggagatcgagaccatcctggctaacacggtgaaaccccgtctctactaaaaatacaaaaaattagccgggcgtggtgggggcgcctgtagtcccagctactcgggaggctgaggcaggagaatggcgtgaacccgggaggcggagcttgcagtgagccaagatcaccactgcactccagcctgggtgacacagcgagactccgtctcaaaaaaaaaaaaagaaaagaaaagaaaagaaagagctgaagcctcgaggctgcaggtctgtgggtggacaagtggcactgagtcctggcctggtggtgtggagaggcccccaggacgctgagaggagtgtccagagcaaatgagatctgggccgggcctgagggacttctccaagtgtggcaggagtttcccaggtgtgattccaggcggaaaggaggctcagcacggttgtgagtgcggtggagcagaggctaggaagggatgccacaggctgcaagccagctgcaaagggtctcagagaccacctccccaggcctcagggcctgagactcagtggcgagtcacctcccttggcctggtaggcagcatttactgcgggtcccagggcttggcacctggtcgactggacactcgctggggctagctcacttcagagaaaacactgcttcctgttaggcttcgggcctgcaagggccaggggggtagttcctcaagggaaccaggcctcacagcaaaagggctgagcccatctgcatttgcggagagatgaggaccacagaggggcggtggaggggacctgaacccctctctggggaaggctgctcagcaagtgtccaccatgcaggtccacaaaagccacagggagggaaggtcatgggcattccgtcagccccgccagcaagccaggactcacccggagccccaggcaggcagggctacacagccaccctggagatgacaccaacagtcttcggcgtgggaccaggtctcgggtggacgcccacagccactcccagtcctgagcacgtgcccaggtctgctaagagttacaggtgcatctcagacatcagtccagggcctcgggccagtggctggcacacagtaggtgttcagtaagagctcgatgagtaatgaatctaagtaaactcctcaagggcagaggccaaggtgtcttgttctgtcacccagggtagtgtgcagtggcgcgatctcggctcactgcaacctctacctcccgggttcaggcaattctcctgttctcctgcctcagcctcccgcgtagctgcgattacaggcgtgtaccacaatgcccggctaatttttttgtacttttagtagagacagagtttcaccatgttggccgggctggtctcgaaatcctcacctcaggggatctacccaccgtggcctcccaaactgctgggattgcaggcatgagccaccgcgcccggcctaaacctcacctctatctgcaaggttggaacaggggtaaggagggattcaagggtacccagagctggcttcgcttttccctcgggcattatttggggtttaagtgaggctgcaataaccagctcccaacgacttgtatacagagataaagcctgaagccgaatagagaccactagtgagactctcatcaaagagatatggggaattagccgccctgcagggggtccgtgccctgcctcagctcatcagagtcactcctgtgagccctgcggcgggcacagctcaatgcccaggggcacttggcctccttgatcccccggggaaggtggggctgtggcctttgcctctggaagggactgcccttcctcctggttcctcccatgcaggataagcagctgacatgcaaagatttgatcagatgagaaagaaaaaacttaagagtttcttctctgttcctggaagtacttgacacgaacacaaaaaaaagtcaacaattccgtttcattgaataattaattgagcaccaactgtatgccagacactgttactggtggttgggatacagcaatgaacaaaaccagcaaaaagcctcgccctcccggggctgagagtctagtggtcacattcctgtctgcatccccgctacacatacagcacccccacattctgtgctgggctcgccaaagcactgaatgaacggctggaggaggaggactgtggagtctggcagccgtgggctgaagcccgtgttctgcactgcctcgttctgtgacccagccaacaccgcgctgcttcagctttgggcctgagtcacaatcagtacaaccagaaccccacctccccgctgcagggcttgctacatccactatcactgctgctgttatcagcccacctgccccctgcaccctttgcaaagaaaccgagcatctgaacctttccatcctacttccacacacaagactcctgactcagtcaggctgctttcaaataatgctggtgccggaaactgcactgtctcatttactccacaaaataaccttgcagataaaggtgaggcttaggccaggcacagtgactcaaacctgtaatcccagcactttgggaggccaaagtgggcagatcacttgagcccaggagttcgagaccagcctgggtaacatggtgaaacctcatctctacaaaaaatacaaaaatcagctgggcatagtggtgcttgcctgtaatcccagctactcgggaggctgcggtgggaggattgcttgagcctgcgaggttgaggctgcactgagccgtgatcacaccactgcactccagcctgagcgacagagtgacaccctatctcaaaaacaaaaagagtgaggctcagagaagttaagtcactcactcacttgaggccagacaagcaggaagtgacagaaccgagatctgaacccaggtctaacagggcaaagcccactgctttctcctgcccggggttcctttcccctttgctaaaatacctctatctacctgaaagactaccgttccacttgcccaggactgagggagcttctgggactcaggactttggatgctacaaccagaaaagtctcaggccaaccaggacgagttggtcaccctcacgccaccaccctgcccaagatcctcctcctggtgccctgccaggccctgcttacccactcactgccactgagtctgacctctccaggctcccagctgcaccctctgtgcttgtaagcaatgctgtcattgctgtcctcaggctacagggtcacattctgtctcccactcggacaaccacgtctaaagtctggtcctagaactccgggcaccataatcacttggggccctgggatcctgcttcctgagtccctaaaccactaagacctcctgaagcagaagctcaggcccagcctgcccatctgagttgctaactagcccccaggggaccctgctgcccagaggttgagcgacaatcctgaactgtaagtttccctgcctggtgacctgctcactctatttcttctgatgcccctctgatacctggtgctgtgcccacacatagtaggtgcacattaaatgctaaccattgtggttcagagcaaaggctcccacacttgcctactcaaactaactgaggctgtttacaaatgtagatttccagcttctaccttgggccgagagaatcaccaccctcagccaagatgtctggtaatctataaactacacttagtttagtatttggctcaaagcatgctgcatacctgcaacactgggagcttaagaatgcagaaccccagctccaccctagacctactatatcagtatctctgggagtggggctttgcaatctggattctaacaagctgtctagaagtgattctttgatccaatcagtttagaaaaacattagtgtaatagaagaacagtgaaactagttggaagtgggctagaatccagttcaattaacggctctagcctcagtctactcaagccctgaatgagaattacccctgacatcattcgcttgttgtgatgattaactgagatctgtgtaaaagttcatagccagaatctggcacacaagagagacgcaagaggctgggcacagtggctcacgcctgtaatcccagcactttgggaggccgagggaagaagatcacttgagcccaggagttcgagaccagagtgggcaacatagggaaacccgtctctacagaaaaaatgaagagagagagagagaaagacagagagagacccaagaaatgcagttcattcttcttccctgctagcactattttaacactcatcaagtcaggacagctacagtttcagatgatcatgtgatgtgtacaaggtggcttggagggcaaatgcagaagattctgactccaggcctggtggcctctaaaaggaccagaccagatctgctctacatggttctggtgctgccaccactagccacacttgatgagcagggacagacaaatcccatgggtggaagggctgcagccactccattagctttcctgtggctgtggccgtctttcatattttatatggcacccatttgacctatctctgggtcagacatccgctcatccttgtcttggtggctgatgggaatgcttttgaggtctcagaaaacctcatccctcttcctgggcttcccaggtgggagacactggctttcacgcatgtcaaaggcctgcaacccgccaccatctaccaagcatgaggtcattcagaggggcaggaatccacccacgtgtggccaacgtgaataagaaccaaaggccattcctgcgtgcccagggcacagctggccgggcagctggggtgcagggatgctctgggtaagtaagaggtgtaccagttagaacgccttcagcagccagtaacgaccaaacgcctgactcagtgtggcttcaacaagaaggaatttattctctcacataacaggaagtccagagaagggctgctccaggcccaattgccatcagcagcctggtgatataatcgagtgagattcttcttgtctctctgcaccgccaccctccttgggtctgccttactcctgggtcaggtgccctcatggccataagatggccacagctccaggcctcaaagatatgaacgatttccaggggaaaaagagagactacttcttcccttttaagcatggatgtcacccttaagcaaaaggaaatctttcccagaagcccctccactgagcaaatgttccctgacgtctcattggtcagaactaattcacatgcttgcacttcagccaatcacaagcaagggagtgtatctactggggccagggcccctacagtgaagcacacagcaccactgctgacagctgaacaaaactgggcccaatcaaggaggaaaatgggtgggagtccgagctggaagacagcggtggagaatgctggattgacaaccagggaacctctggctggccctgactcacaagaccccaccaaccccaagggcaaacacttgtccttgcaggacgccatttctcagggccagagtcatcacgtaatattgatgtaacttggccctcgcttccattttggaaaaccctcggcctgacttccttacttacacctgttccaactgctcatgaaagccgagccaattcaacacagcatgtgctgtgagcccaactccatgtcatggggccagaaaggtagaattggccctctagaagctgaccatttggtaagaagacaaggcacatgccaaaatcggtggagtaggggagggaaacagccctgagctgggagatgggagtggataacacccaccaccaccagcaacagaaaacagctggtagctagtgaaggctcactctatgcaggcactaagaagcacttttaggtattttggttttttcttcatttgatccttacaacctccctataagtttggcactattattacaggttcataataccttacctacagtttctgaaatccaggactctctaaaaaccaaaagttgttttttgttgttaatcatttatgggatggcagaaacctcaactgaacccatgtgaggctatttatagtctatttctcccttttgcagtgactgctcatatgctttgatgcagaaatactgacccattttattacaaaatgccgccccagaccccattgggaatgtcacataatgcccagtaaacataacatgtttcaaaaaattctgcattctgaaatacatctggccccaagggcttccgaaaaagggttttggatgttgtgtcaccaaagggggctttgcaagttgaaggttaccccccataggaagcaggtgagccatgctttgaaatcaagcaacccaactccaagccagggctcttacccactgtgcttgcttctgccacttgctggttggtggctttaaggaagacatctccctctctggcactgttttgtcatctataagaggttggactacatcaatgggtttcaagcttctttgttttaaaagtgtattagcccttccttcaaaggaaaccttaaggaaaagtgtaactgctccagcgagtgaggcctgctcacccaaccaccagagccctaaagcatgttcccagaggggttccttgacagcacagtttgaaaactgctacacagcataatctgtaaggtcttctctggttctaacattgtatgattgtcttctgtaaggcaaacagccttttctgtgatgaaaggacagctgggagaaacttgaaccagaccttgacagatgggtaggcttttgatctgcagagaggattccagagtcaaatagcgtgagcaaaggtgcacagacaataagcaaggtgtgtgggagggtccaggaggccaaagtagccgagggaagtcgggggaatgaaggcagtgcagcaggtgacataaggacatgctggaaaggttggccagaccaagcagatggatgaggctgaggacgagctgcacagccccagccccactgtgcacagccacaagaaatccaaatccttctgccctgactaccatggccacgagccccaatcccagctcagtgccatcaatcagtcactgtcaaataaatgagtcttctgaatccaaaaatcaggacatatggtctgccacaaaggtgtggtcttctgatgacaagaggacagagtgtttgaaagcaggaagactggcccagaaaggccataatagtgggtcaccagagatctcactggtgtccttccccacattctgggaggagttgggctcccaggagtctgtgatgccccaggtatgtccaaagaagccacctctaaacaacaggggctgcctcaccccacagcagtgactctcagttaaacctcagtcctgtttccagagaagaccctcaggccagccagggaggaccatagtccaccccgactcctcttcttcacaggagggtgtgcatgaccaggtgtcgtctaggagcccaggaccctgcaccctccaccaaggggaagccacatcactgtggatgcccgtgcttaaaacaacacagatctccacatcctcttcttcatggcctgaaaacatttgcttaccaaactatgccccagaaatactctttgtttcaggcaccatttccctacctacccgtcaccacgaggtaattaaaatgtctcaaaatcttataggatccgacaggcaatgatctcctaagggagaagctaccatttggggcctaatctttctaagtgaactcagtcgccgagcttgcctaagaagattaacaggctggggaaggcgggaagccacactgcctcagaaaagggagcagccgtccgtcaggacagtcgcagacctccaatgtgcctgtttgtcattgcaataggtgggagtcttgaccgggcactagctcaactgtgtcatttcttggtcccccactctcttttttccctgccaggctgacagctgggacctggcctaccttgcccagggtcacaaggggtcagctgcagggaaccaaccccattatgaccatgtgccctggctgacaggtaccatcccactgaatcctcacacgtgccctgagagtgggcattctgagctggctgagcagggaggaaaggcaggctccgagaggctaagaacctggctggagatcacctagccactacaggtaaggtccaaattttagacccggtgccaggtcactgcactttcacacacagtggtgacctcatcattgggaggctggagggtgacattctgtagagagaggacagctgggcctgtcctcccagagaccaggaccgacctgtgagcccacatgaagctgatgtgcagctctgtctttatccctgagcgctcaggctgctgcctcagctccaagccagggcacctcaggcttctctgagtcccccaaacccctggacaccttgctgagatgtggattctaaccctgcacgtctgaagccggcccaagaatccgcatttctcacaggttcccggtggtgcccctgccactcatccccaggccacacttcagcccacgagggcctaggcttccgggggactgtctcccacccccacccttaacttaggtgaccattctctcagtgggactcacccgggtctggtgcacagctaggttccaccacatttgggttttttgagatggtgcaatgaaaatggtgactacggtagggtacgaggaagaagacagacctctgggttcacttttcaacttggcatttgtccttttcttccttatccacctcttggcaaaacatctaaaccaattcatctcaaaggagccaggctggggcagtacactctgaaagtgtccactatttagagtccttaacggggaggggctgccacgcttccttcccgtaaggagctaatgctgctgggtggggaagcccactacaagtgggagctttgggaaggagggattcctctgctcagaactctcccatagccctgtctcactcacaggaaagccaaagccttaccctcggcctatcaggccccgccactttctacccatgaagttccctccctagaacatgcttctccacctccttaggtctcatctcagatgttgccttcttggggacacctttcagggccaccctatttaaactagtagttcctgcaacccccactcccagcccactccaaagcacctattcaccttcccctttttctctttgatagcactgaccaccatctgacaccctgtaaactttacctaatgattatattgattatctgtctccctgcccctttcctactgggatgtgagtttcataagggctgagatttttgccatttttgtctgttttgtttaccagtgtatttccagtgcctaaaacagtggctagcacagagcaggtactcaatctttgtggaaggaaggaaggaatgagtggctggccctgagagacattagctactttaaccctcataacaacccctgcaaggtaagtcatttaaatcccgttctaaaatgagaaaactgaggctcagagtggttaagtgatttggccaatgtcacaaagtcaagaagtggccaaggtcacaagaatcagtcccccatctggctggctccaaacactgtattctttttttttttttttcgcctgtggttgttttcatggtaactgtcttagtgtgacaaacgtgacattcacttgctttccttattctaagcagaagatgctttaacttcaggattttgcaaaatctgcccagaacttgtgctcatgcacccgagaatctatgggggagccggtgcccccaaaagccaggaagaagtccctctaccagcccgagagtgggaaggcctcaccagtcaaacggagggaaggcccctcttgcaaacaccaaaggagagccacaatcattctagtttagtttcatctttttcttggcttcatcgttttattttcctgagcactcactctgtctgatcttttcaagtccgggtaactttttgccatcaatggctaccactcaccatgtgagtctctaggacaaaaatctatgtcccatgagtttccccaaactgaacttgcacacagacccatggaccacagtgcccccgcaaaccccgatccccaagccccactcatgactgcatcttaggacattgggagcagcccctgggaagagagctaagcctttcgggggccatgaaggtgaataggaagggcccaggccaccaaaaacccatctaccctctcattccagggaccatcatagcttgagtcccccttcatctgcctgtcattctcaatcacattaactcatctgttttgtttcaatcacttctcactatctgaagctgtgctgtttatttatttccatatttgcttatcacctgcctcctgagagcagggtgagggcataagggcaggggcttggtcagtgctgttcaccactgttctgtgactggcacaggtgggcacgcaaatattgggtgaatgaataagcaaagacagcaggaaacaagtggattcagaagaaaaaagaccaggaggctcacaaataaacccatttaatcctaaaatcaacctgcacagaaggtgtcattatgcctacaccgctgggaagccacaaagtagacccaggactgtgcaactccgagaggaaaagagaaaatgctgcaggtaagcggagaagcaggtgagcccgacacggagggcaaaggcaagctgcctctggggcccagggcactgaacaccatctcctcaaaggctgacataactgagaagggtccacattttccaccaagtggagcccgtgtagggtcggtgctatctccatgcccctgacacaccatggcacctgcgttcacccagaaggtacctgcccacagcatgcatccatcattgagagtgcgcaaaaccaagttctaatttccaggcactaataccataggacacaaacataaaccaccctccaggaggacacctgacatccctctcctttctgggtagtctgaagtgagaaggttgaaaatagtgcagatgtcctttcttagagcagccccgccatccattcattcactctttcattcatttgttcagccaacatgtgctcactgggcctggggaagcccaggatgaaatgagacaaaccctctgccctctggccacggtgtgctggtgcctgcgctttaggcgggtactaaaagacaagcaaatattaaagatactcgcttccaaaacaaataaggccacgtggagctgtgcactggaatgggattctggatgcaattttatttgattgggtacaagaaccaatccagttaaaggggtcatgaaccaactccaggcaccaggctcctactcagaggctgcctcagacccccttctggcccaggcaccaacccctcacccacccaactccatctcccgacattcttcaaccacattcccatctcgctccacaatattctccctccaggtccccctgactctatttctcctctattcccaaccctgacctctctaggtcggcagccttgatgctacttctccgaacgccaggacgcacatcccagcctgctttctaccaccaccccacacacctcgagtctgcgcttccacccagaaccccttaaacaccatatgtttacaaaccagattccccaggggtctatgtacaacaccccattctcaagaccccataaacacatcctgattccctgagcacaccatacacacactgtggacttcacccatgtcctgagggaccccctcaccccatcacctccaacttcttggaagccccaggccggcccctgacctcctgtggtcccagtggagcagcggactcgctgagacccccggacaccccagactccgcagaagcccgccctgcacgcttgaaccccaggcgccgggacagcccctggcgcccccccgggcccccacaccgcgtgactccggggcacccgggctcccccaggccccggtcccgcgcacatcccctgggccgcagctccctcgcggcccggccgcgcccctgcccgcgccccgcgcccggccgcgcctcgggggcccgttcccgcggaggccgcggcgccccccgcagcccaggccggcgcgcccggagcgtaccgttggcgatgagcttggccgacagctgcttgacgagctcagggatccgctcccactggcactcggagcggcagcgctcgatctccgtctccagccgcgagcctgccttcttggtcgccatcgcggcctggccgggcccggccgcccgccccgcaggccccaccgccgccgccgcggcgccccctcgccgcctcccgccgccgccgcgggctcgggctccggctcccggctccgcggcgtaac

SEQ ID NO: 1187 - DNA, 157509 bp, Homo sapiens
atagcaaccagtgtggccagcctcttccccagcttatcctcctcccaatactcccgctctgtttttatgaggctgggaaaatagaacgaggaagtggtgacgcactgggctctcacgaatacaactagaagctgcaacgactgtgtggctctatcgattcgggagaggtccagaccggaaatggtcgtttccatggtaaccctgagcaggttgcctgggagatgacctctttcgggtctctttgaatctccgctgtagcgtcacctggaaggcagatctaacagagaacctggactgtctcctatcatgattcccgggaaatatcgctctgtttctggccgggctgcgaacaacgtaagttgggccttctactttctctttcttcccactggtactctttctgactggcgtctttgtcctaggagatgggctgtattattaggaccggcaccgctgggtctactcaagctattgtctgaccagggtttgaggttcgtgggctggaccaaggcacaatttaatattgtatgatgggtactcaaagtcttgtccaggatctgggctccccagaaggtggagctggtctgctgtgaaaggcttgggtttatttaaattcctttggccagtcaattcctttttcttttcttttccttttaactgtgaagagaatttatcattagggactcccacctccttcacctgtctcattgagatgtttatttagacctgaatggcaaatgtcgaaagcctgaggtactaactagagggttaaattgctgccgacattttggaaaataaatcagtgaaaccttttaattcttagatgtgattttattgttttcagcaaatcctcagaacaagatcatttaccagaaacagaaatagagcattgtgttctatttttttgttgtatttctgtttgtaccttttttttttttggaaatatgtgtttgtgtattaagagcaaattttatggtttaatttttacatttcaggtgaactgcgggcttcatctggttattcaaacatcatcgcttcctgaaaaaaacaaagtaagatttaagaaggttggcatttaaattgaagattgttttaaattctacacaaatagcagcatgacttaaagtgtagatagattctaaactgaaaaatttaagtagatttgctttgatttccagtttaaagctagttcttactttctgcctacataaagctaaaatagccctctttaaaaaacttaatgtgattttattgattacaaaagggtaagggtttttttgttttttttttttgacatttacacttttttttttcttgagacagggtctagctgtatcacccaggctggggcgctggggtgcagtggcacaattttggctcactgcaacctctgcctcccaggctcaagcgatcctcccacctcagcctcctgaatagctgggaccacaggtgcatgccaccacgcccggctaatatttttgtattttttgtagagacaggtttcaccatgttgcccaggctgttctcgagctcctgagctgaagcaatccgcttgctttggcctcccaaagtgctgggattacaggcaacagccaccgcacccagtgatatttacacatttctgaaatcaggagccttcttaaaattgatggcatgtcatagtttaattggggaggttttttttctttcttaatagagggtaaaataatggtatgtcttactactaatgacaccttagataaaatggtaattgggagggcatatccacacatcccatttaaaatcagggaagaaaaaaataggttagcagtggacacatgttagacttaacgttatttagaagttacgatatgaatatgagatttttttccccaagattatttccccataatgtctctagcatttctagaatttctggcttttgatttaatttttgagattttgagataaacatgtttttctttcctttctgtctcacctcagcatttatacttacctactttctacacactatgtctcaagacacaacatgatttttcctcctttgaccaagttggaaacctctaaccatcacaattcaggtgtgtcctaaaaagttattaaataggcgtcactggaagaactctaaagtgaagggcagagttcacacataacagcatgaagaagggtaagaaaaggcatgaggaaggtaaatggaaggacatcgttagtcaaggaggcagctgttgattacattatatatgaatatgaaaatggtaaacactcagaaaatagacaatttgatcatctcaaataaacagcagttagattaattgaaaatattatttattataattgagcataatggattctctccagagctttcctaattgatttctctggacaaatccttttccaccattataatgtttctagagctgtgtgcctcatctaaatattttttccaaaccattcactttctcttgtgtggacatctattctgagaaaatacctttaggtcatataattcctaaggatataatgcaaatgccaacataatgtttatagtatggatacattagaagtatcttaattaattcaagatacatatttggggttttttgtggctaatcataagaagttgttctggttttgtttttctcagtcctcccaccagataattattttagatcagttttagatcaagtgaaaacctttcttagaaggcttaaatatacaattttattatattataataggacatttaaaaggattataatgatcaaaacagtgattttttcaacagcattttatttatattgtgtgtttttttttgaagcaaatgattcttttaatcattgtatttgtggtgagagcgtggagggattggaagtgtctcagcttggaatatcttgtatctgacctcataaaattgatcctgattttgtgggtggtaaaatacaatgatagaggtgcagccatcacctctatctagttccagaattttttcatcattccaaatggaatccctgtacccattaagcagttacttcccattccctgcttcccttaaatgcctggaagccacaaatatgctttccatctctatggatttgccaatgtggtattttgtgtcagttttctttcacttggcatgatgttttcaaggttcatccacattgtaccatgtgtatcagttattatatgtttttttaatttatcttcactgcttggtgttaaatttgtctccaaatatttttttctttaataatgtttttcaggttgaattcaagctaaataaagacacatcgtcattccccggtagacttttacaacatgaccttgaaagaaactactcaagtaggcaaggtattgtcagtgaatagagatcagatgtggttcatcatctttgaataatattaagtgtttaataatgttgaattactagatccaaataaacttgaatttaaaatgaaattgttcattgggaccaaattggtttggtatttttttaaatcattggttatatatatgtagcatagtagattatttccaatacagaaaaaagctgttattattttactttgagggtgggctatacactagagaatggaaaaagaatgtttcaaatactgtattagaacagtatttggaagtcgctaattagagtaagagtatgggaacacaaatattaaggaaatcaggaaagaatgtaaagtcaggagtagagaagaaacaatctttccctgttactgtcacatataattatagattttatattaaaggctttaaactctagtgtctatcacttgggatcttgggatcttgttaaaaatgcacattcttagtgctccccctccatcttccccattctgattttgtaggtcttgagcgggatttggaaatgtgcattttaataatgtcacaggtgattctgaggtatatggtttgtgggtcatcctttgacaaatactgcctcacatgatctggttatatttctgaaatatatttttcaaatcaaggaaaacgttccttcacatttgaatcttggtttgttgctgacagccattagctttctgtaatgtgctcatgttaaacacttctgaatccacatatacaaaactgcctctacctcttaggagtttatatgagagggctgatcagtataggcctttctaggttgttcatgttattactgtgggaacatatggcaatttaaaatattggttaattttctctctctttttatttctggacctacttcttggacccatctaatctgacatatcttttctctttcctacattctacactcttgtcttggccaattgctggacatgacgtcagcctaactgcagttccacagtgtggaaaacatctgtctttgccttatttgattcagttcaatacttatttataaagcaagtattgtgtgccgatcactgttttaggtacagaattatagatgtgaagcctcaactagggtttttatgcttgcattgtcaatttccttgacatttttggtaacaatatcttaaaagttttcccgaaaccatgaatcaaaattaagtactttcactaaggttttcttgagttagagtaggcagttagtaaacagatttgaggacggctggccaggcaaacttatttaagtggtaaagtattactagatattcgctaatgaggaaatagtatggatgtattgaattttgtgaacctgagagatgaataaagttttatacataagtaatgacccattcagtatgaattaactctttaggaaaaaaaacctaattggtttttcatttaaaaaatttattcaaaattggtttctgtgacaggatactaatttgaaatgtcttaaatgtgtacctggttactttcaatgtgctccctccatagttccaggcagtttcatgcaaagaaggccacacaacttattttcttgacttttgtactcaaattttacttccaagggtataaaattttggaaaaattgtaagtagcacctcatcaggaaaagtttagggatgtctgtctaataaactgtatcttgatacccaatcattataattaatttcagccatttcttatttttcaaaattaatcaaacatatcatagcctgtccacaaaaattaaccagtggtactctcagtcaaaagtaaagacacttgatattttctttaagctagtgagtttaaaacttgatatgtgatttctttaggcttcttagaatattgttaagagttaacccctgtctttgagattttataagtgccatatattgcaggaactactatataataaaatttcagttaacctgaccttattgattaaatcccttaattaggaattttaaaatgtgtgtgtagaagggaagaggcaatactttgctcttaagataatgataaatcactgaaaatctggagttaagattttggttaccaaaacaatctcaaagacatggccgagtggacacacatatatggcaatatgtactatgccgtccatccatccacctgtctgtccatccacccatctgttcatttatctatccatgcatccatctcttcatctatatagtcatacttccaaccagccatccagccatctctgtatctagcatacagtgcagtgaacattcttaccaaatttagaccattatacttcttaacactttgagatgctatttgtattgagattttaacagaagtaacacacgcaaaatagattttcaattaaatcttagtaaactggaaaaacaattaatttgtctattgattgcctactgaatttagattttaccaagaatataaagaatgtaaaatgaggtccatcacccaaggagcttgtagatttatttgggaagacaagggctacatatctggtaagttaaatagtaatataagaaataaataataacaggccggttgctatggctcatgcctgtaaccccagcactttgggaggccaaggtgggtggattgcttgagcccaggagttcaagaccccatcttgaacatgggtaatatgatgaaaccccatctgtaaaaaaaatacaaaaattagctgggtgtggtggcacatgcctgtagtcccaggtattcgagaggctgaggtaggaggatcacttgagcctgggagtttgaggctgcagtgagcggtaatcatgccacactaaattccagcctgggtgacagagcaagaccctgtctcaaaaagaaagaaagaaaaaggaaataaacagtaacaaactgttatgatgaaaattttgccacatagtaatgtagtttttttgtgggtatttatatacccacatatatatgtggatatttgtatacccacatatatatgtggatattttaactgcggatctctctggttcccagttatttagaaggtcttgttgtatggtagatttaaggccttttaccctaatcattcttatgtctttctatttattgtaagcagtatatcacatcgatagtaagttcattatgctgatagtgattatgacttctgtgtattaaaagagctagaaagtttaaggataaaattcctttattcactgagtgtaaatttaatctttggttattgcctctgtatctcaagtcttgtaaagtttaaatttgcctcttaaaaattgaggattgccttgaagccttaacaaaatcattcagaaaacctaactaatgctaacaagagaaactgaggttgtctgctgcttggagtttttcaatcttttgtctttagttgaccaattaatctttaactagttaattcttagactgcagtcagtctttagactggtttttgttttgtttttgtttttttaaccatcttgacttgatttccaaatcaatttactgacttgtggttgcttttaggtatcctgctagcatgtggtcatgccagaaaatcagtttattggtgaatatgatgtcaattctgaatgcttatactctagaacatcattattatcttgatattttgtaatattcagaaaagtgggatgtgagcactgattattttgttcaagaaactaggggtgagatacttcagtttatgccttgcagacctgaggtagctagcaaatgccattgccttatagctttttaatatgatttatatagaacttgattttaagttgtcattatattgtctggtgacctcccaaagagtaggttagctttccagatttggttttcatctttttgttagtttcaacagcagaattctgtggtaacatcaggttctgttttactattatacttagtgctcccttcaggcatttcaacatcagttgctgctttcagaagattttcttttcatagaggaaaatatggtagatttcctctggcattcaaactgtcacgtttgacccattactcaaattcttacctcatttctggaacttctcattgtttcttcttgaccatttacattcttctagttctttagaaaatatcttaatattcacctcccctcaaacccctctgtaaccaccttcattaagtaaaaaataaccagacacacttatgtgcaaacttacaaataggtattctttttattctgcatttatgtatgttgttctatttatgaatttcatatgtgtatttattaatttcagtctgctagattgaaagctacataatggcaaggacaccatctaacaaacagcctataaaccttagaggggtgtcatatactttgtggaccctaactacggtatgctagatttactgacatccactttggtatcttggcaatattctctactaatagtggctgaacttacaaagaaagagatgatgcgaggtttacatctgctatccaaaactactttttgtgtatttcctatgcatctcatccacaacaaatgtgacagaactatatgggctggaaatgaaaactgccacgaggtccttatcagcatttggagattcttccattaagacaccttcaaaatccagaatccagcagggctgtcatagtgctggcccaaatatatctggtaatgaggaactatcattttagttatagacagttagaatttaagacaaggagtcaggattacaaagggatgaagatagcactggactagttctgtactttcaaccaatctgtaaggcaagggaaaaattatttggcatacatggaacacatagtttaggtttaagaaggaaagaaacaaattcagcttagtaattaatttcaaatatggagagctatggaaactatactttctagataagatatttatggtgctaaaattctccaaatataagatgactttagtttcagacttcgaaggtttttcttaattaagtaatttgtatatcatttttaataggtgatcatattaatttggtgagctcatcattgtcatcatttcctattcttcaacgttcttctgaagagaaaattctttactcagacaggttgagcctagaaaggtgaggacaatttcttttcttttcttttttttgactaggtaatacatagacgtggtacaagacttgaaagatgcaagtctccctccttcctcctgttccccagttattcaattctcctatttagatataatttttttaaccagttttttgcttctccttcctgaggtatggtgaggaattttatatctatataacataaaagagcttgactatacttcacaagagtactacagcaattctaaaatatgacattgatgaaaaatggattgtagtatagaaaaaaaccacagtataatcctcacatgagcttcccaggccctatccagtctagtttcctgttacttcactggcttcatctcttcctacactctccttcactcactgctccaatcatacctgccaccttgctgttccttgaatacaccaagagtgattatacctcaggaatttggtgcttactatcccctctgcctggaatgctgttccttctcatatctctaggcttattgccttcaggtctttgctcaaatgtcatcatttcagggatgatttttctctggccatcctctccaaaattgcaaccccttccacactgaagtctctagcccccttctctgctttcattatttttcttcttagcatttattaccctataacataataactatttacttattatgtttagtgtctgtctcctactagaatatatgttccataagcacagaaacttttgtccagttctgtattattggtatttagaacagaacctggtacaaaacacactcttgataaaattttttttaatggaagaatatatttagaactcgatccccatctttacatctagaaactatccacagtagcatggtgggtgaaggatcccaatctctatctaccccagtggtataaccagcagagacaacatctctgttttgcatacctttagcttagcagtgcacacctgacaacaaattataatgaactatctgtgtttatagttgggaaaaactgctggaggttctaacatgttcttttgtaggaaaagtaacactgaagggcagtatctctcatgacatctttgcggtataagtggtttatgagaatgctgtctaatatttataactttcatggtattattttaatgttttgagggatttttttggtaacttttctcttgatctttgaaagactggccaagaatagtacctcagcccttcagtttcatgttacttgacattaacaggagccagtatttgtaagactgtgacataacaagttaggcacttcctttgtagcttgggatgactcaggcaattgtgaagatgggtccttaacagcatgggcctctggggtggagaagcaaactttgatcaggcagagacttgcttatcaagaaagtcaggattgagagaactgactccgcttcaaaagttggttgtaaaatgacagaatcacaaagatatcataaagttaggcatcatttgacaagaaccaggatgtgcagtcaagaaaggttggctagcagcaaggaactaactcaggtatcatttctgagagccagtgggtagtgccagtgatttccaaaggcagatctgccatgctgtgcagcttcttagctaggagcctgaggggtcaagggcagaagccaaccctgagaagtagtacttggaagagctaggctctggctgttttgggagttaggttaggcctggagtaccaggaaggcagcctatcagcaccaagaaggaaacacagaagcaaaggcatagtctgttagatgtatcagtaatggggtaggatgtagcaactcaggagttttgtaggcctagaaactccccttgagggcagtgggtctctagttattatgtatgtttgcttgcttgttttgttggagtgacaggggtttgtggggttaagcagtatacaagtgagccttggcactgggacttaaccactgtgtttagaatcagagaaagtgactttatttcaatctacggtagtttaggtaagagggaggatggaggttatttattttcctgtcttagtgatgaccgattcaagaattggatgaaatagaagttggggggtatcaataagtttaactaagagaaaaagaaaaagactgaagcaggaaaagtgagatgatttaaattttttgcaaagctgatgcacaaagatacaaattttaaggtagaatacttataatttattaatttataatttatatactaaatttattgatttatcacagttctgataaaatagttggataaaatattgtgataaaataattgaatatatgaagtgaattttaaatattctgtgaaaaaataattgaatatatgaaatgaattataaaattaaccacacattaaaataattaaactattgcccaaaatttccttttcttttcctctatcttaaacaggtttcttcagaatctatatttttaaacatcatagatttgttagccattaacattcagttatttttttttctgcgaatcattcttttttctctttatcaggaagattctgatcactgtcatagtttcacttatgctagtaacactctgatatattttctttaaagctttcattaacttgatttctactgaaagagaatatttctaataaacttccctattagagttgttcacactcagatagagctgtattttccttgagctgtattttaacctctcagagtagaatcacgcaggacctcatgtctgcccctattattttactactagaattcttaaagggccctgaacttatttacttcacgtgtagtatgttacaacattttgcataatagaggcttactgttttaaatatagctcaaagcatatatttttaaggtttcatcctaccctgtagcactctaaatgttctgcaaagttcaaagtgttgagcatgtaaacatatacttaaaatcttagtttctaaggaaatgttaagtaaggaccactttgccattaatggatctcaggttgaatttttttttttaatcaaagtgaactctagatgactgaatttcttgctcttttgaagatgtcatctggctcaagagtctatgattctctgagatttttatatgtttttaactctgatgacttagttgcctgggtaatcgttacatcggtggattgatgccaagggcatttgtctggttatgtgacaagattccttcagccatttaaacctctatcacaaaaggaaattatgttgaatgttttctcatgttaagtcaatttcatgtgaaataacttatattcgagttttttaaatacaatgagaccttagacataattttaataataaaccctgtcaaagtctattggctttttttgtgtgaatgatttacaattaaatataggtcgcttagttcatgggggttggaagtggtccaacttatttttttctcctcacagaatgggagcacaaagatactactaataatatttgtaagaagaggtaagtggctgaatcataacctaattaactttttaacattttttctagacaaaagctgaccgtatgtcctatcatcaatggggaagaccaccttcgtttgttgaactttcaacacaattttataactcggatacaaaatatttctaatctacagaagttaatatcgttggatttatatgataaccagattgaagaaattagtgggctttcgactctgagatgtcttcgtgtccttctgttggggaaaaacaggtattctttgtagagcagtttttgtagcctaatgttatgtgtaggattaatgtggagatgacaacttagaattgaataatacttaagaaatgaataggctaaaattttttaaaaattatttgaattagttgaatggattaagatccagtcataatttgtttcatgagattcagtatgacaatttgtcacaccagataacgtttattatgtattttacttccattgctttccagtgttgtatcttatagggaagtaaatagcagactttggccttgattttgttttcttagaacttactttagacatgtgtattcactttaggcttatgtgtttcacttgtgactcttcccagtgtttgactgagggtagacactcgatactttgtgattatctcacaaattgattctttttcagacagtagtttcagtttgtatctaacattacatcctatatgaactttcccagttccttttatacaactctattccgtagtgcaactatacagttcttgactcatttctttgagattcattcactacttttcattctattttactgaatagcttttgcaatgcctacaaagaagggctttatagtaaaatccaaaaatgatttttatattatcaaatgaagactttagatatatattataaccaggctaggttctcctcctccatctttccctgcctcccaccctggcatgggtcttggattactcgttgcaggaaaaaaaagtattatctcttccttacccatctcaaggttcatggccgacactctataacgaagacagattaacaagagaaaagcattaacaatttatttaatacaacttttacatgacacaagagcccttataaatgaatatcctccaaaacagggaaaactgtgtatttttaggctgaggcttgataacaagtggacagtatgattggacaaaaggaggtatgatctaatggtaataaactgggggaacttagcaaggcctatttgttcagattcttcttggtgtctctgtgtcttcattcccttttttggggtatattatgtattttacttccattgcttccttccatgagcgtcataagaccctcattccagaggaatcctgccctatatccaaaaagggaagggatagatcagatacttctatctatctggaaaatagatcagagaattctttttatggcctcggggagaaaggtgagagaagctcagacagtgagcttaggaaaagtatcttaaatttaaggtagggtaggtagatcagagaattctttttatggccttaggggagaaaggtgggagaaggtcagagagtgagctccctccatttttttttctttttttttttttttttgagatggagtctcgcactgtcaccaggctggagtgcagtggcgccatctcagctcactgcaacctctgcctcccgggttcaagtgattgtcctgcctcagcctcccgagtagctgggactataggcacgtgccaccatgcccagctaatttttgtatatttagtagagatggggtttcaccatgttggccaggatggtctcgatttcttgaccttgtgatccgcctgccttggcctcccaaagtgctgggattacaggcgtgagccaccgcgcccagccacccagagatttctttactagtttctgatcctcagagttactgatttatttgccttgcttgcagttattctttaatatcattatcattattccctgcttttagtcctgagttaatatttttagtgatatttaaaatcactttctctcgtatttaagcactgctcctggttcctaccattttaagtcatctttccatctattctattttcctatttgtacttttcagcttctctggcttcttagaatttactcattaagttgttgtttttgtttttgttaacttgtgccttgaaggtaccagtctatctgagcttctgactttatttaaggtctttttgttctttcaactctaagagacttaatgcctttctactatgtcattatttagtgaagtaaaagcaatctaatgctgtgtctttttcctctttctactcctccatcttttttatttgttatttgtttggttttaatcttattttatttttcacataaaggaatagctgtggaacagttctagaactattagtgttcttgaatcaaaaagaaaatgagtcagaagaaaactttccatattctcccctattgcatgtttttcaagtgtcagtgaaatgcaagtctgagccctaaaacaaatgccaagtggcctccagccagctgactttgtcacagcaaggggcctgtgagctgtgaagatggaaatctgtcctgggttagtactttgtgaacattaagcaaacctggctgaggatgctggtaaagagggaagtacatctgctaccctgtctcttcatgcatttgtgttaaatgacttgttgcttcctgttggtcaagttcagaaagctttctccttcccacattacaaagctctgcattgccttttggtccaaggcagtggaaccatatatggaaatccagggcaatcatgcctctgggttcaggcaactccaacaaagatttctactctaaagctaagaaagaaccttgctcaggttctgtatgtgaggtttccgttgatactaaagaactcccgaccccacattgctgtcaaagttcttattctctaattgttctgccttcagtatctcctgcttatcctctccaggtcctctgccaccctcgtcattacaggctaatgcatagaacttctctgcattttcttctgatcacccaggattatagatcaaaactcttagaacctgggattctctgtttccttccttttgactccttgaagtttcccacttaaggatttgtttctgacacctgaaaagctaagccttcatataggtcctgtagtgaggtctttatcctggcatcagtaacataatgtggcctgcggagacaggctgtgatatatccctagaggcctcaggtgatgggtgagcctcatctttttctagtttcagtttctattcaatggaagaacttcttttttaaataaatctttcaggtcacattggtgttaacgtaaaaatggtcaaatttgggggcactggctaggattctgcaaattcctcacatcaatacctaatctgaccagtaggggccttctaggtcaactgatgccttcatttacctctgaattctttagaattgggtaagtttttaggtcatttcaggtgttggggggtggaaagagaatttatgccaaaggcaactcatgagaacaagagagcaagatgtttggttggtcttgggtttaactgattgaacgacttggctgtttttcttcctgttcacctgggcgatccgaatctgatgtgagagtcataaagcagctatgtgtcaaagctaacgaataccagaagtcatgttatagcccaatgggttcttcttgcctgctgcacagaaaagccaatacactgagacagcaggtgttgcaactgagtaagagtttaataatcacaaggcagtcaagtgaggaggatggaggaggagatatttctcaaatctgcctccctaagaagttggagactaggattgtcaagggttgtttggcaggcaggaggctagggaatatgggttctgcttattggttggattggggatggaatcacagggaggttgaaactgtcttcttgcactgagtcagtgcctgagtagaaatcaccagtctgggtggtgtcagttggtctaccagaatgtgaaaatatatctgaaaaatatctcaaacactagtcttaggtttcactaacaatgttatttataggggaaattggagaagtcacaaaccttattaccattggctctgtgattcctgagcagtaagcaattacaaaaaggtaggttagaaaacaatgactgattatcatttaattatgcctccgtattagcagaattcaggcccctaacataattctaaccttatcatctttcattagttttatgaagatgtttttggttcctgaacaaagatgaggttagtttcaggaagggactgttatcatccttggtttaaagttaaactgtaaactaaatttttctcatagttagcttggcctatgtgcaggaatgagcaaagacagttagcttgtatgattagaagcaagatggagtcagttatgttagatttctcaattttgcaaaggtggttgcagtcacaacagatagggagtgaatatgtgaggccctggtggaattctgagggaatacatactgcacatgatggtttctctgattgaagggccttaaaggtgctcaggatttctcataaagacagaaacagactacattgattcttcaaatcggagaactttggggtgatacaatctccattatccctgatgtataattttcaaggtgttaaaaatatgattctcagacaaatagtaatcacaggccagcattttaattaattcaataatataggaaccagcaggatgacaaagctggttcaaaggagagtaagaggaactcataaatagtcagtgtttttacaagcactctgggtgattctgataaatccagaaatttgagaaccactgttttagggaatgtgaacttggaagtataaaataatggaataaaaggcttctctaatagctattagaaagcatggctctgtcctaagctgtatgattacagtactataattttctgcaactgttgtaggtatctcaggagcaaagcaggcaaaggaaaaattgtgttgaaagttgtacctgggctgggcgcggtggctcatgcctggaatcccagcactttgggagggtgaggcaggcggatcaccacgtcaagagatcaagaccatcctgcccaacatggtgaaaccccgtctctaccaaaactacaacaattagcagggtgtagtggctcgcacctgtggtcccagctactcgagaggctgaggcaggagaatcacttgaacctgagaggcggaggttgcagtgagctgagattgcgccactgcactccagcctggtgacagggcgagactccatctcaaacacacacacacacacacacacacacacacacacacacaaaacaaacaaaaaaagaaagttgtagctgttttcccatctggttgggctattaatttagctatttgagagatttaaattctagataggatagtattaaatgcctggcactaggtgaaggctagtgaaagagtccagtgagtccggaagaatgctgatgatttggatgaagtgaggtaggaatagggtacagattctgtcagggtgatgatgtgagaggagactgatgaggaggtggtggtcataaggcagtgtggtatgtgcgtgtgtgtgataagggagtgaagaagatctacagctacatagcgatgatacatggtgggcatatgagaaatatttttataaattaaattggattgaattggcttgtggtagtaaaattcttgatttggcaatgatataactgagataaagtggagacagaaattaatgaagtttaagtctgcattatgtttacatggtaatgatcagtatgtatgtatatacatacacactacatatatatatcacatatatacacactatatatagataacatgtatattattcaatggatgatccaagttctgaaaacagagaggtggaagtggttctttgaggcagtaaacaaggacaacgaaaatagatggtgataaatatatggtgataaagatgggttgtatgaacttaatttgttgttctttttttgccattgctcccatctggcatatcaaaaatttcaaataaatataagcattttacaaactgagcaggtcccagtagaaagcatttaggtggtatgcagtttgtctctgtcataaaggatcctattatgaatacccttgtgcgtacaacttattcatttagttagtatgttcgttcattcattaaactaatatttattgggtacctacttggcaccaggcactgttatgagtgctggggatagagtagagaacatgtcagaatgtccttttaaagctcacattttgatttggcaagagagattttttaaaaatataaacacaaaataatacaattttaggctacgatcaattctgtgaagtcaaagcagaaaaaggaaagagtaatggggacaggaagggaaaggtattttaaatatggtcatctggaagcaactttgaagagttgtttgatctgagacctgaataatgtgaagttttgagggaagaacattaggggagtaggaacagcaagaataaataccctaaggtggaaatgtacttgccaggttagagacacagcaagaatgcctctgtggctggagcagagtgagtgagcgagcctgtggtaggagataaggctggctgaaaggtcagcagccaggttagtgccttgtaggcagaagtaaggagtttagattatattctaatgtgaagaactgccttgaataagtgccttgacttaaggttcttagacataggattgctcttttctaatgatgtgacatttaaactctctttctcttgagtggtattgcattttttttaaattataataaatcagagggaaatatattattgttgaatatatatataactatatatgtagatagagtaaattaaaatgagttacacctttatgccttagcatactttgatttacagatagatgtgatacatccgtatttctattctacttattctggttttcagaatcaagaaaatctcaaatctggagaatctaaaaagcttagatgtcttggatcttcatggaaatcaggtattgtaaagccctttcatttctttcttttttgaaaaaaagtccaggaaaatggtataaaagttttaagaatcatactcgcattgaatttttcaagagtttctttattgattcactgaaatttctaaggtatcaagcttatttatagaagatttggtaactcctcagcagtacatgacagatacagcttataaaacatttcaaattcttatagttatgacaattttgttttttattaacttatttttaaagtacacattttgcaaccccaatccaagacctagaatattactgactttcttctacttaggtatttgtttttttattccatctccttatttctgcatcacaggtaaccactattttaggtttcatgcttttcattcctttttgggtttttcagttggttttatcacatataggtgtgtcttaataatatatcctttagtagtattgtctcttaatttaaaaaaggtatactatatgttgtcatctagtgtttactttttgaatacagcattatattactgagatttaactatttcaagtagctatagttttatttatagttgtatgttccatggtaagactatacaaaaactttttgctccagtttcttattgatagacatttggattgtttcctgtttttattgttgttgttgtctgtttgttttatcttgttttttgctattatgaatagtacttctaagaactttcttgtacaagtctcctgttcttcatattccatatgtactctagagtatataggagtgaaactgatgagtcataggctatttaaatgtttaactttaaaagataatgccaaattgctttccagagggattgtaccagtttgtactcgtaccactaatacataatcatgttgcttcctattcttttcaacattttgatttgtcagacttcttaatttttttctgattgaattggtataaagtggtatcactttgtggttttgatttctattttcctgattactatataatctgggctcccaattatgttcaatttgtctattcctgtatctgtctgaatttctatatttattttatttatttatttatttatttatttttgagacggagtcttgctctgtcgcccaggctggagtgcagtggtgcaatcttggctcactgcaagctccgcctcccgggttcacgccattctcctgcctcagcctcctgagtagctgggactacaggtgcccgccaccatacccggctaatttttttgtatttttagtagagacagggtttcaccatgttagccaggatggtctcgatctcctgacctcgtgatccacctgcctcggcctcccaaagtgctgggattacaggcatgagccaccgtgcccagctctatatctatttttttatgttccctctctttattcttctctgtcagatcatattggctgtttttcagtcctttgctcatccatttaaatatttgtctttgaaatgtaatatttataaatagttacatgagctacatacttatgcagaatgtaaagtctcttctgcagtgataagcctacatcctgggatgatcggggaatccctgcctgttgatgaacaagatctttcacagctgcttacagttggtcaggtgaaaacctcagtgtggtctctctaggctttctaacagctgttagttccagtagttttggtgaaaagctaatgtaattaataaaaaccttgatagatttaataggccacatctattaggttcgaatctagttcagcctgatgtgtttgtctgtgtgtgcatgtagtaagtgggaggagtgttggtggcctgggaattgtctggctctgcaggttagttactgtctgtccaacagaggggaagttatccagttagatggtgctagaaggggaagaagaattaaagagtattgacagtaaaagaatatcatatgcaaaggcactgagatggaaaacaacacagtaagtatttaccaccagagaacagagcatgtgtggaaggatgctgagagaagagactagaaaggtaggcaacggccagattgtggagggctttgtatgccaggcaaattaattggtgttttatcctgtattttaaaaactgtttataactataaatgaaacattttatgatagcagtatttttcttgtttattttaaagtgtatacatgagaaataataaacatatgattttcaaattctaatatatctttaagagtttgtgagtactacccaagatcttcaagagcacctgataaatgaataccatatcatttgatctgtaccttatgtataggcattatttaccaatcattatgttgatgaaaaatgtctgttccttgttagctgacctgtgttatatattttataatttcagcatatgtttgtgatattgtgtgtgttaaaattaaacatttgtagtgcacaaattacttctcaaggttcttccagttatagaaccttgagaagtaatttgtgcagtacaaatgttctataactggaagaagaaagttttaaatgaaaatctgagtcttgtttcataatatatgaatccaaatagcaaaaattcacagtatttcaaagcaaagatacagtcttagttaccttaggtttctaaaaagccaggaaggaactattctagatgaaacaactaatgtccaattctaaaaatttagcatcttatagtaaagaagctaaaagacattaagtgaatgttttttgtcttttgaatttacttctattggtaataaaaatatgcttggtgcacattgtgaaataaaacataattggtttatggatgtgaaatcattctgagtaatgatgatggtgttcaggaaatggattgggaagtagagatggaaggaggggaaatggagacaaaacagttgggagaaactaattacaataatcttggcgagaagtgatggtggcatgaactaaagtagtagcaataaggatatgataagggggcagattggataaatatttaaaaagtagaaacatcaagacttagcaattaattatatatgagtagtgaatacagaggaatctaggaggttgagtaggaatttctaacctagagcttgtgttggttaaccataattttttctctcagtgaatttttgctttaacatagacacagatgtgcttcaagaagaatctgttctttcagtgatctcttttcctccagggagagcctgctatttctgtggctgcttacctgaaagcaaacacttgccttttctgtattggtaggtaggaaggttatctttatccaggcagagcaatctaggttactctcatacacaaaggttaagactggagtatccagctttcctagatgtattaagaagccttgcagactatattgggacactctctgatctgtatgacccataaatgggctttccaacattcccatcatcttttttcttgctgtgaagtatatcaatcaatcaagacctatgctgtcactttatacaaccctttgcctgaagcttctattatctgctttatgcttgtgactttgtccatggctgtaacgagtaattgactttattccatagcagatgttgtacatgattctggcctgttgggttgcaaaccaagaagccagataatattcttagtgatttttaaaatatgggtctatatacaagaattaaccatgtttcttttcagacttttctaactagaaggtaactaaatgcaggcattctaattgtaagccccaccaggaccatgtggaagggtagttttctaaaagaaatgtccagaactattagcagaagggagaaaacacaccgtgcagatcatacaattgtcccccataactctatatatttatatatttcttgagctcaggaaagttttctatatttaaacactgcttcttttccatttatgtttgttatatctgtattgtttgtcttccatctctccatcttatcttttattcttcctctctgtttttccttagcattttgggaggatttctaagcttgcgctgacattactgattactttttctacagtatctattttcctttttactggcttcttgcattttaaattctatcacctgtttagttttaaaatattttactccatgtcttattacacagttttatcatctgttaatactcataatcttgtttctttttcaacttttatataattttatctttacattagttaaatcaaaaatcttaaaacacattttaaacgtggtcataggttacttttatatattattgaatttataataaacatgtttcttttctggaaactggatggaacctagatggtgtttcttgaatataagagtgtccaaataacaatgtgaaatatagattagacatctgagaaaagttcttttagctaacatctgctttgaagtgttagtaagaaatttcaaatatactgtgatggcaatacaaatgagcaaattaatctctagtgattgtgaaattcattttaatgttcatcaggtttatgaagtcctccatgaggacttctattttgtgtcatgcagaaactcatcccattgtgctacacttgctctattataatagtggggcttaacatcactttgagctctcatcacttcacagtgttagtttttacttaccctctccttagtgtgcagctcaaacttctctgctgcagttcagtgctgattatttattattattattattatttttgaggtggagtttcgctctgtcgcccaggctggagtgcagtggcgtgatcttggctcactgcaacctctgcctcctgggttcaagtgattctcttgccttagcctcctgaatagctgggattacaggcccatgccaccacacctggctagtttttgtatttttagtagagacagggtttcaccatgttggtcaggctggtctcaaactcctgacctcaagtgatccacctacctcagcctcccaaagtactgggattacaggtgtgagctaccgcgcctggcctcagtgctgattattaacggcagcagcaggccatctggagtggctgctgccatcaggccagctgcagcagggaggcgtggctggggctgtgggctccatggagccaggtggacctggggacaagtgggagccctgccccttccgagttggggcgggagctccccgggtgctgctgcagccactcaagtcacggctgcagacctgggcatccctgtgctgttggggccaggaagcaggcaggagccccgccctcctgggtacagctgcagcctcccaaactgcagctgtggacccaggcatctctgcactcttggggacgcagaaagtaccccccaaccctcactctcccgacaggttctgaagtgtttgtttctgctgtctggcttctccctgctgttggtgcctgctccaatctcagagcaaagttgtggttgagcctgggtgctgtggcagcctggccaagtgtgcacatgcttggggcagtgcttacacaccagtcccttgccacctcagctccctctgaacttttggtgccaacaagcatagaagggaatctgaggggggctgagggcagctaggtgctggcctgcaggtgccccttcatacttatagcctgggcaccatgaacagcagcaggaagcagacagttgcctgagcagaagggggcaggtccctggtgactccctaccttcaggccagactgccactcccaccgactggagtgggaacttgtggtaccttttctgggcctgcctgtggccgcccatgggccaatcagcactcacttcctctaccctgaagcccataaaagccctggactcagccagtgctgagcagacattgggataaccagctgtagagaggaccaaagtactctagggccctctctctgttgacagctgtagagacattgggatgaccatctgcagagaggagcaactcactctagggcttcctctctgctgagagctgcagagttgatgggatgaccagttgcaaagaggggctgccctttctgctgatagctgaacacttgtcaagatgactttcctagtacagaggagctaccctctctgctaggagctgaacactcatcagaacaccctggctgtggaaaggagctgctccctgtgggtttcctctgagctgttctatcacttaagaagctcctctttgtcttgctcaccctccacttgtctgcatacctcattcttcctggtcgcaggacaagaacctgggacccacagaatttgggaccccagaatggcaaggctaaaagagctataacacaaacagggctgagacatgccccttgctcgccatgttgcaggcaaagagaaggaaactgtggcccttcaggtcacctagacttgagagctccccaagccagggctgtgactccctctttgggaccctgcggttcctcgcatatccaagcttccgagtgccactgtgttctcagtgccagctgtggaagctgcttgcagtgttcctggtccagccatagcctcgcagagagctggtgcctgtgccagcacctggagctgcctgccctgctgtagcagccagcatgtctgactgtgcacagtggccagaccccatgctcactcacactcccttctcagttccacacctgacttgcccttagcaggcgtgggacccaggccagtagcatgagctgagtgcagcctgccagggtgggtaggcaaaatgagcccagcgggccagagcaaaacttgggcaaaggtaccactggccacagaggtttctggtcagaaaaatgacaccccaaagatcctgtaacattatatgtacatgcatattccatgattcaagtcctcttgttttaaacaatgttcaccattttgtaccctcactaaacatcttccatccttattaatggaacagctttccattaattaaaaaaaaattaacctcatcttctactgggaatcctagttccttgactctttccattcagactcgactgctctcaagatcttgcagtttaaatagaattaataagggtaacttgatgtcattcctttcccttgccttttctgtcagagggcagacttgctttgttaaaacatgatgagcttatgccttgggatcacagtatgtttctatttggcaggtagtatgtagccttcacagaacctgggacagactgggcacgtaaagttgcccaatggactcattgactatttgatgacgtttacgtcaagtgtttactatggtcaaattgtaaaatatgatcttttagctaatgttcacaagttacgtgacttcatgttatctacagcataggaaattgaaaatagatttttaaatgtctacatataaacttgccactaaatctagtgacttcgaatattttatttttagggtttttagaacatgtatatttcaggtttttgcctgctaatcacccttctcctattttctttaacagattaccaaaattgaaaatattaatcatttgtgtgagttgagagttttaaatcttgccaggaactttttaagtcatgttgataatcttaatgggctggattcactaactgaacttaacttgcgacacaatcaaatcactttcgtggtgagtattaaaatggagttgatatgtactttgtggctttctttcaaggaattgaaacaaatgttgtaatatggctttctgcaaagtaagaatctacggttatttaggttttttctgaatttaaattgtggatgtaattattaagctctgtaatatgttggtttgggaggtattgaggtattttccattttaaagaataaatataatgttagaaacacaacagaagtgttatcactaaatgaatcatttggtgtaaatgagtagtaaaccctcttctgttttgtcatgggtatagaattaataagaaagagggttatttgtgactgaaagttgagaaattattgtaccaagagggaaaaggcacagagaggagagattgagagttgtgaagatacacatactgtatgctttgcagtttttaaagaggagcttggtatggtgggaaaagcattgcacagggcatcagaggcctagttatggtcttagcttcatctctcattagctgtgtgaccttgggtaaatcacaactctcttggcctcagtttagctttttctaaaatgaggacattggaccagtttgactctagggtgttttttggtttattgactctgaaaaaagacatgaagatggtagagaactggcatgtgagcaggaggaaaaagagttcgattgtgggggcaaaactacacaaaaggggattctggaactctgagatgaactttgtcaaatttatgattttgctgaaggtcagcaactaaatagaagcttgatgctgagatattttgtattcgtacatatgtgaagagcattagaaatataactgttctgctttgtgatatgatacagctaatgaggaacattatttgctcttttaagaagtttcctttgtttaaatgctatagaaaaactgctttaagttctctctggtatcatttatgcactttgaaagacacaatataactcttagctgtttcaataccttgagttcccttgtaaagaactaagtgtactataaatggtacacttgaaaaggctgggggacagaggataccttatttataggtctcatcgtacagattggttttattttgaaggtttcccagaaaatatgagtcaggtaatactcatctcttctagaaggttagaataattttagcatgctatccaagacacagatttattccagaacttctaaattctgtcaagcccttcccagattagatacaatactggaactggactgtttatttagaagacattcagattgggttaacctgttatgttgctaaatctccaagaactgctcagtcaggacttagtttgtccttaggaccttgggtctggtaagattccaaaaagctttgttagagtagggaacaggaatctattggccctagcatattcctgcctatattttggctttcatttggaaagtgcataatgcatatttaggaaattgcttactgaatttcccgttgagtattatgtttaatcattactgttatagtttaggcagcagtaaacaacttatggaagaggaaattgtattaatttctaaaagttaagaagacagtagtaagtatcatgcatattaattacagtcaattgtgaaatttgctatatatcaaatttactatatccatatattgtgaaatatatggacaaataaacttcatccaactcatttctttttcaaagcatctcttttttaaaagattcaagggactttaaaatctgagaatacttctcttccatcatttttttctccagtatcagttaccacacttattcttcttgcttttttttctttcatggttttgattttcctcagtagctggtaatctttaaatgaaggaccatgttaaggagtatctgggtatcctgtgcagttgaatagatctttttaaccataagatctcactctagaataatcactagatttgtgtaagttcttgaatcccacacatttgtgaacttccctttagggtaagtgaaagggaaagtcactcagtgactgccaaaataagactttactttcaggggtagaaagactttgttttcatttgtgccaggtgaaactgccatttcttttttccctctgattcttatgtagaggtggttaataatctctatagataaaacacccacactttccacccttttttgacaaatactctattttgtttggagaacagttccttaggctctagctgaggatttctttagccagatgctctgtacatgtttatgttcatgacagaagtgggagtgggtgggtttgttggtattccaaaaatagctgttgagtagacagatctttgattatacactacttgattcagcacagttcaccgtagtccatgcctgctcattgtatgcactgacccagcatggagtaagatggcattcagtcagaaagaattgctggctttgagtgcagcatctctcttgcagttctgagctgcagttctctctgctcagggttatctcagtaagatcccatcagcttttcagctgcttgaacttcatcagaagtgttggtcagatgatgataactcttttgttagggttttcatgaatgtactcatttgtgtgtatttttattgcttcacccattgaatcttggaaagaaggtgaaacaaatgcaacctacttaccgtcttgaacagacaccttctctgatgtttttgatgtagaaaagttattgcttgtttatttaccaatctttgtttttgaaattttataaatttcaaaccaagtatttttagtttgtatggcatctttctctttaaaaattatgaagtgtcttatatccaaaagacaggcaataacaaatgctggcaggaatgtggagaaaagggaacccttgtacattgttggtgggaatgtaaattagtacaaccactgtggaaaacagtttggaggttcctaaaaaaaactaaaaattgagctaccatatgatccagcagtcctactgttgggtatatttccaaaagaaaggaagtcaggacatggaagagatatctgcatccctatgtttgttgcagcactgtttacaatagctaagatttgggaacaacctaagtgtccattaacagatgaatggataaagaaaatgtggtacatatacacagtggagtagtattcagccataaaaaaggatgagatccagtcatttgcaacaacatgaatgaactggagatcacattaaccgaaataagccaggaatggaaaaacacatatcgcatgttctcacttatttgtgggatctaaaaatcaaatcaattgaactcatagacatagagagtaggaggatggttatcagaggctgagaagggtagtggggggttgaggggaggtggagatggttaatgggtacaaaaaaatagaaagaatgaatgaaacctaccatttgatagcacaatagggtgactatagtcaataataaattaattgtgtattttaaaataatgtaagtggattgtttgtaattcaaaagataaatgcttgaggggatggatacgccgttgtccatgatgtgcttattacacattgcatgcctgtatcaaaacagctcatgtaccccataaatacctatacctactaggtacccacaaaaatttaaaattaataaaaaattttaaagcaaaaaattaataaaactcaaaaaaacctgaaacatttcagatatccccaaaataataggaactaatattaccaacatttgtatatatcttttattttatctgttgctgtctcaagttttgtgttggatatttcatatattagttttcagtcttttaaattttctcataaaagcatttaagcctataaatttccctctaaaaatcacttcagcttcttcccataagtcttgaaatttagtatttttcttattatttagttctaaacattttgtaagttccatgttttactgtgatttcttttttgatccatgtgttatttagaagtacaccttaacattttgaaatgtatggattttttattctatggccattcttttctagtttaattgcattgtgaccagtaaatgtagattatgtgtaattggtactttaacgtttgctgaggtttttatttacttatttattgcctggtatgtggtcagtatctatagttgatgcttactatcaatgtatttgtctagtatttgtcagtattttgaagctatgtttctagaagcatacaagtttaaaattaatatatcttcttggtaattgttccttttattgttatgtattaactctctttattactaactccttcattaagcaagtattttatgagcatgggctatatgccaggcattgttctaggtagttgggatataacaggacactaataatacttattaccttaatgtttatttaatgttaataccaggcttttctggttatttttctttggtatatcttttttatttcctaacctttttagaaaaatttttaatttgatataatttcagaaaatgttgtaataatagtataaagaattcccagtacaaaatgcacccggattctctaaatgataacattttgctacatctgctttatcttctctcttgcttactttctccctttttccttctccatatatcagttaatatatactttttttcaaccatttaagagtaagttgctggcataatgcctctttattgccacatacttcggtatgtatttcctaaaaacaaggaattgtcttataacaacagtaccactatcaaactcaggaaattaacattgatatgatgccatttatctaatctatagatcttatttggattttgccatttgtcccaataatgttctttatagcaaaagaaaatacaagatcatgcattgcattcagttgttatatctccttagtcttctttaatctagaagagtctttttttgtatttcatgacattgacatttgtgaagagtatggcaggaatgtcagagaaaagatgctgagtttttttcagtgtatatgaagtatgtattctttaacttccaacctttctcttaaaaagaatgcatagccccccttttaaacatataatctgagaatctgtcttattaccagagactttagtctattgtactaattgtaattactgatatgtttagattttttacttagatgttatttcatgcttcctatttgttatattttccctatgtttttattttcttctgtcttattttgggttgatagtgttttctctgttctttcttattcactttaatgcttactcttagcattttaaaatatacacttgacttaaatcacagagttaatacacatctctacactcttatcagataaggaccttagaatcatttaatacagtaacctttccattttacatgtttttgttgcctagtattttctttttattcttttacccccaaaattagacattttaattgctattgtttccagtcagtgcttatttggatttgcccacatgcttgtttgggttcaccactccttctgcatctctgtctatccttcttcccaaaatatatcatttagaaaaagtttccttgagataactctgaagtctctcagtttttgtttatcaaaaaatgagtttattttgcttttattcatgattgatggtttgacttgactgacagttatttttttcccagacgtttgaatatcatattccattgcctttgagcttctgttattgtcattaaaatgtctactatcatttgtgtgtgtctagggtatcttcttttccttcctctggttgcctttaagattgtaagatttctttttgaagtccttcagatttactatgatatgtttaggtgtggaactatcttattttattaatttgaaacagacattttccatattccaactctgaaatctaggtatgtcttacaatctatagcatgcttaaatcaatgttatacaggctacagcaatttcattgcctaaatatatgtggacttggttatgctgtttgtactattgtcatttcagttgttggtactgtatgttttgagtttaatcactgttcaaaatgcattttaaaatattacaccatgatttggcattgaaatgaaacattctattcaaaaagttatggaaatagggcagcaaagacattaagtttaatattagtgagacaaattatttttcattggaagaatggccgcaattctaccttctcttgctaattaacaatcaaatactttaaaaggaagatagccatgtattactgaagctgtattacatttgttactgagatagattcagagagattttgcctatcatgtgtcaagcaatgcaactgaaggcagaagaaattgaggaaaccccttggaatagatgaaagaaatttcaaaataacaagaagctgtgtgaacaattcatattggtgctttctttgtcttatagtatcaaaacatacagaatgggtatcagtatttggaagaaaatcccatatacaataatggaacacacttttaggatatactgcatcatcaatgttcttaatggcatagaagacaatattgtgtgaaaagcatggacattattagttgaaaagtgattgagaagtttaaatctaaatatgaagacttttccttcatactttattgagggataatttaggtacaataaaatacacaatcaactgtacagttcaatagcttctatttaatctgagtaatttcatgtgactgatatttctatcacctcagaaagtttccttgtgcctctttctagttagtaccctcccctgccccacaggtattctgacttctatccctgtggattaattttgcctgtttttgaaaagtacatatataaagattatgtactcttttgtatattcaacataatgtcttgatattcatccattttgttgtgcatatcagtagtttaaaaaattattgagctgtattccattgttgaaatatcatacaatttgcttattcatttttctgttcacaggcacattggttatttccaatttttggctcttacaaataaagctgctgcggatattcttgcagtttttaaaaattatttatttatttagagatagggtctcattatgttgcccaggctcgttttgaactcctgggctcaactgatcctcctgcctcagtctcccaaagttctggaattacaggcatgagccaccaaacatggccatagttttaagtttacatatatattttggtggacaaatgctctcatttctcttaggtaaatatgtaggagtgttattactgagccatagggtaggtggatgtctaaatttattagaaactaccagtttttttgttttttattttttatttttattatactttaagttttagggtacatgtgcacaacgtgtaggttagttacatatgtatacatgtgccatgttggtgtgctgcacccattaacttgtcatttaatattaggtatatctcctaatgatatccctaccccttccccccaccccacaacaggccccagtgtgtgatgttccccttcctgtgtccatgtgttctcattgctcaattcccacctatgagtgagaacatgcggtgtttggttttttgtccttgagatagtttgcagagaatgatggtttaaatttttgcaatctactcatctgacaaagggctaatatccagaatctacgaagaactcaaacaaatttacaaggaaaaaacaaacaaccccaccaaaaattgggcaaaggatatgaacagacacttctcaaaagaagacatttatgcaaccaacagacacatgaaaaaatgcttatcatcactggccatcagagaaatgcaaatcaaaaccacaatgagataccatctcacaccagttagaatggcgatcattaaatagtcaggaaacaacaggtgctggagaggatgtggagaaactaccagttttatgaagtgattataccattatactcccagcagcaatagagagttctcattgctcaaaatccttgccaaagtttgtcagtctttataattttagcaattctatgattctcattgtgcttttaatttgcattttctttattactaatgatgctgaacatcttttcaagcatcttttcatcttttatgaagtatcagttcaaatctgttacctgtttgaaaaaattaggttatctttttatcattctagatgcaggtcctttgtttgatatatatatattgagtgtattttctccatgtaaaaaggcttgcctttttactctcttaacagtgtttttgatatgtagaaacttctaattttagtgaagctcagtttagcaatttgtttttgttagttgttattatcttttgtgttctgtctgagaaatcttttcctgtcccaatatcatgactatgttcacctacattttcctccagaaggtttatagttttacctttctatttagatatgtgattcatttttattttcatttatttgtttatttatttgagacagagtttcactctgttgcccaggttggagtgcagtggctcgaacatagcacactgcagccttgacctcctgggctgaagcaatcctcccacctcagccttccatgtagctgggactacaggcacatgccaccacacctggctaatttttttattttttgtagagatggggtcttgccatgttgcctaggctggtctcaaacacctgggctcaagtgatcctcccatcttggcctcctacagtgtcagagtttacaggcatgagccaccatgcccagccagtcatccatttttaattaagtttatgtatgctgtgaggtaggggatcatagttcatttttcccacatagggatatctattttcttcattatcttttatttaaaaaacttgctttccccactgaattaaactgttgtctttgttgaaatcgagtactaatcaaatggatcttttttctggaccctctattctgttccatctattcgtctacgtaatatataccagatccagtcacatctttaggctccacttttagttctagctcttttgccctttctaccgcatctatatagtaagtagagatattctggaagttcaacaaatttattttgtgtaacttactttttatgtatgcataaaaacgatattcagtaaaaaaatctggttaagtctaaaagagctctttcagtaataaacacaaattttaagtgatatattattctactataagttaattttaagtttattttccccaagtgctgaataaaatagttgtaagataatgttagatttaataaaatgtggtaattttattagcatacctaatatttgtgtttcctaaatctgcagattcataactttcatttatttatttatttatttatttaattttcttttatttatttatttatttttgaaacagagtttcactcttgttgcctatgctggagtgcaattgcagtcttggctcactgcaagctccacctcccgggttcaagtaattctcctgcctcagcctcccgagtagctgggattacagatgtgcactaccatgcctggctaattttgtatttttagtagaaatggggtttcaccacattggtcaggctggtctcgaactcctgatctcaaatgatccacccgccttggcctcccaaagtattgggattacaggcatgagcccccgtgcctggcacatatctttcatttattatgggaacattctgagtctttatattttcaaatattgcacttccattttatctctttctacttcttaaacacctgctagatatagtatggaccttttcattctattctttgtttctataattttcatcattcttatttctctctgcttcatttcttcattcttatcacttatctggttctacctttgaattcactaactttatcctcaatttatctaatttgattttcagtccatccattgagtttttaaaaatgaccgtagttttttctttgtagaagttctacatgaatttttttcataaatgcccagatgtctttatttctaatgcaggtataccttagagatactgtgggttcagttccagagcaccacaataaagcaaatgtaggaataaatgtaggaatgagttacatgaagtttttagtttcccagtacatataaaagttatgtttacactatactgtagtctattaaatgtgctatagcattatgtctaaaaaaactatgtacataccttaattcaaaaatactttagtaataaaaaatgctaatgatcatctgatctttcagcaagttgtaatctttttgctggtggagggagggtcttgccgtgatgttaatggctgctgacagatcaaggtgatggttgctgaaggttgggatggctgtggcgtaaaactcagacaaaaatgaaatttgcctcattgacccttcttttcatgaaagatttctctgtagcatgagatactgtttgatagcattttacttacagtaagacttctttcagaattgaaatccgtcctctcaaaccctgctggtgctttatcaactaagttaatgtgatattctaagttgtttgttgtcatttcagcaatgttcatagcatcttttcaccaggagcagtttccatcttaagaaactattttctttcctcatccgtaagaagtgactcctcatctattcaagtttggtcatgagattgcagccattcagtcacatctttaggctccacttttagttctagttcttttgccctttctaccacatctgcagttccttccttcactgaagtcttgaacccctcaaagtcatccatgaggtttgggatcaacttcctccaaactcctgttaatgttgatattttgacctcctcccatgaatcatgaatgttcttaatagcatctaggatggtcaattctttctagaaagttttcagtctactttgcccagatccagtagaggaatcactatttaaggcagctaaagccttatgaaatgtatatcttaaataataatccttgaaagttgatattactccttgctccatggactgcagaatggatgttgtgttagcaggcatgaaaacaacattaatctccttctacatctccatctgggctcttgggtgaccaagtgcattgttaataagcagtaatattttgaaaggaaaattttttcctgagcagatctcaatggtgggcttaaaatattcagtaaaccatgctgcagacagatatactgtcatcagcatacaactttgttgttctgtttatagagcacaggcacagtagatttagcacaattcttaagggccataggattttcacaatggcagaggagcattggcttcatcttaatgtcaacaactttgttagctcctaacgagagagtcagcatgtgttttgaagctttgaagttagttattgacttctcctctccatctataaaagtcctagatggtatcttcttccaatagaaggctgtttctctatattgaaaatctgttgtttagggtagctaccttcatcagttatcttagctggattatctaggtaacttgctgcagctttgacatcagcacttgctgctacttcaccttgcacttttatgttctggagatggcttctgtccttaaacctcatgaaccaacctctgctagcttctagcttttcttctgcagcttccttatctctctcagccttcatagaattgttgagagttaaggccttgttctggattaggctttggcttaagagaatactgtggctggtttgatctttccagaccattcaaactttcttcctattgtttttatttattaattgtgtgttccactggagtagcacttttgattttctccaagaacttttcctttgcattcataacttggctagctggtgaaagaggcctggttttcagcctatctcagctttcaacatgactttctcactaagcttaaccatttctagcttttgattttaagtgagagacttgtaactcattttttcacttgagcacttagagaccattgtaggggttattaattggcctagttttaatattgttgtgcctcgaggcaaaggtaggaccaagaagagggagagagatgggggaagtgccagtgagtggagcagtcagaacacacatttgttgattaagtttgcaaccttctatgggcacagtttgtgatgccccaaaacaattgcaatagtaatatcacagatcactgatcacggataatcataacaaatataataataataaaatttgaaatattgtgagaactacaaaaatgtgacctagagacgaagtgagcacatgctgttggaaaaatggcactgacttggttgatacaggattgccacaaaccttcaatttgtaaaatttaaaaaaaagcacaatatctgcaaagcataattaaacgaggcatgcatgtaccttattttttcttgtttttaatttttttcattgctcttataaatttaaagataaatattccatagtctttatcaagttactatattttcttaattttttggcatttcttcatctgttgcctgaaagttctactgactgttactcatggtaattttttctttatagtttaatagtttggaatagtcaggatgttgcaaagcctgagttgaattcgtgtccttctagacagttttgccaggagtgttagggtcatgaatgccaggtaccattttttatgaggggtctttttagattatgtttgtgatgtaagtttgaactgtaaattccagtgagggaaagcctatggttatgaaattgaggctttttattgatttcctcaaagctgttaaatctagctctcctagattataaagactggacatttccctaattagtcagcatatcagtgccttcttactggtctggttttaagttccctttcagtttttgctctggggtattaaaacagtgtgtagaagaaaatcagactggtgaattgactgatatctattgctgtgtaatgggtagtaaacaagtacaaaaaccagataaacccattaatgcctttggataactgccaaataatggacttttttcattggcatttatatatatgattagagttttaatatgatggcttgcagctattagtcctcatataataagtgtctgtgtcacaaagtgataggtgaagcaagtagttattttggaattaatttaataagtcttttttttaaaaaggaatacttcattgttttttgtttccaagcttgtttgatgctttgtgaatgaatctgtttacagctctcaaagttagaataattacccctatatatttttactctaacttgttttgtatgaaagcctacatagtaaaaatgagagtagctatgattttattatagacatctttgccctacttgttgcatgtcagaatccttggtgcatgtcaaaatctgttcacctttcttcttccttattcctctagaggaagctgctctaaaaatagctccagtgatagatattccccacgtgatcagattgctgaatcatttagttcttttcttttcttttttctttctctgtctttttttttttttttttttttgagatggagtcttgctctgttgtccaggctagagtacagaggcgcaatctcggctaactgcaacctccgcctccctcgttcaaacaattctcccgtctcagcctcccaagtagctgggactataggcacacgcctccgtgcctggctaatttttgtatttttagtagagatggggtttcaccacactggtcaggctggtctcgaactcctgatctcaaatgatgcacccacctcacctcccaaattgctgggattacaggcacaagccaccacacctggccatttagttcttttatgcagtttagggatatggacaacagtgcctgagcagagtaggacaagcatttttctcagaaaacaaatcagtatttttttggaaaataaagaattataatcctctcaaataatcttgtggtaaataattttttctattttttaaaagattatattttccaaatacataaaatagttttgaattttacttcaaaaaatgttttgaatattattttcagtattatgttttattaaaaataataaatttaagataatgaggaaattaataacgagctataaatattcccctacatgtaaacattttatttcatttttttccctctcatcttaggtatgttaacattctggcttctttgttatagtttctctgatgctgaaatagttacctccagaaaggatatgttaggggtatttaatgcttgacagtaaaataaatactttttcttaaatagatgagaatttacctttcttacattatccctaacccccatttccactttccctgtcattccgaaataatttttaggtaagcagattgttgagtgctggctcctgcagagtaccgccagaatgactagttgataaagcaaaggagaaattactactggcaagtaaaagcacactgccttgacatagccttggctgtatcttcgaaggcagagacaggagatttagtttgaaatttcttggggttctggtttagggtgggtctttcaatgcaggggcttaatgaaaatggatacatttatgatagaatagattaggatggttgacaaagcacggtgaggttttcaaagtgagtcttggaccatgatgttaaacttttgttttccctgagattaatagctgtctcaatttagggcttgtttaactatcattaatgtccaaactctccaacaaaaccctaaaatccctttctgtataggcaaagacttcaggtgatctgtgtttcatttttacctcttggagatacccttctagagcctcctgtcccctgtctaatgaagtctgcttgcatttagccctgctatacagatttcatccttggatttctctttgcctctcctagatgatgaattgtactccctgaatcttatatatatcccatcttttgtttactctcttatattagaggagccatcccctagtagtttttaacaggtctttcttctgtaaataatgcatgcatagataattgatacggtaaatacggtgttttctttttgtctattataatgctagaattttgttacaaaagtatatcacagaattgctaaaaaattggagaaaagttaacattttcttacagaaatgaaatttggaacaacgaaaaatgattgtgtataattatttgctttttaaagttctggaaagggtatctatgtaagtgattatgaggatatatagaattgaattctgcattttagtgtttcaacttgtgaatatttttatatttttgataactctactaggcaatgacatttaatgatttttaaaatttgataaagacgtaaaattttgtctcataaacagagattaaataattataattttgtcaaataaacttaaaaaactttttctcacaaattatatcctgatggaatttgagttttctatttttattgaaaaaagttatgtcttagaaggtgtttataatctctgaagatggcatgctggagctcaaagggacagatgtattttttaaatgagatgccttgattcaaaggatttaaaatgtatttttaaaggctgctacctctcagtttctccaggttgagtgccaataacaatgattgtgcccagaaatatctcaggtagattccaggaagaatctgggagaagagatttccccaggaatacagagagggttttcagtctggctatgacttcatgtttctagagaccagataggcagcaggctgccatttcctttggaaactagggccctggagtgaaatgagccctaccactagtctatcactcctcctccatttatgggaatatcagagagaagtagctgaaagagatgattttaaaagtttgccaacatatgaagtatatcacctactgagggaaatttggctgccctcctgtttccacagacttactccttggccatgaaaagctctaaaaatcattatctcacatctgtggaataggcttcatgggagtgggcctgagaatggtaatgtcaaatgaatggtatacatagccagtgtattgatcatgggctattgtattgattttacactgtttagggtctaaagggttgagagaagtttggagaatagtacatagggtaggtagaaaaacaaggcagcttcatttttcctttgctccctgaaaaaccattaaaaagtggttctgtcctaattctatcacttttatattttctttgaataacaaactttaaaaaaataaatacagcattttgggaaaagctaggtttgtcaataattttaatgcacttgcctaaactcttactcgggtcttagaaatggtagttttcagatggagggaagaaaaggagggaggaagaaagacgatgatttatggaaacagtaaaacaagttttgatttaggattaaatattggtcacaataacatataaaatatacttatttttgtattattcaaattaatgtaactgagaattactgcaaatgatactgcccttaaaaacgaaaaacattttatatgagacatggcagtatgtaacactttgaggatcagagcactggaagtcaggatactggaatctttccctgtctcagcctctagggactgactgtatgtactcctgggccaccttcccaccacacccttattctccccctgtagtaacctcgattggtcacttttctaggtgaataataaagttgtagacttggtaattaccaagcgtctgtaagattctgttactccattatatataaatcttttcagaaggtttatgtcttttcatgaaatgaattaggtagcttttactttattttttgttgtttttttttaaataatttggtcctaagcaattcaatatttgttaaggttaactgtatttaaacagcagtggtatgtttttggggtggtgtgcataaatataatagggtagatttcctattttaagaacctctgatatgagcttagatgagaaattgcccttacagtacccttcagtgacacttaccatgatttgcttttagttttatgggggaatcattagtgtattggttcatttgtaactgatggtttatttccaaggttttgagaccagtgagttaaatagctttaaaattctcactattgtttagaaagctaattgtataaatttaaatgttaaagcttttgaatggcttctttttaacagtgatttttaacaaatgtttgatcatactgtatttgtgctacagttgaagtgctgaagtagcattttggcatctttcccaaaagcatgcttaaagaggctagcggcagcgtctctccctgtctcctcagtgctttttaccttgcgagtggtgcagcttgttctgcggatgtactgaaaccctcccatttaatctgcagtggaggagagtggagctcactgtccagtagaaatcagtgatgtagcaatgttgcagtaaatagaaatgattatatatttcaatagcttagcaagaagacatttataatatttttttctttcatctgattaagttttgctgtctattttcttccagagagatgtggataatttgccctgcctccaacatctctttctcagctttaacaatatatctaggtaagtggaaactcccaagttgtcattcattataacttgattgtgtgagttctagtgctttagattaagattgtaaataccttggagaattttactagcatggaagattttaaattagaaaatgataagacaaagttctttgtggaaaagcaaagctcttgtgtgtattcttgcctgtaatgctaacatgatgaaattaatatagcatgtgcttttgatttaattatgctttagagttgctcttttgtaaaacatgagtacatagaaatttcaatgtatattttgctgtcctttgtttgacattcacggcactggtcagttgaattagaatttctttcataaattgtcagctacaatttgtatagctactaagcaattttaatacagcaggctatatttgtcactgagccacttgctaattaggccaaattgccttctaacttagtatctctgcttagaattaatgctgctaagagacagtggattagaatatagaaatgtataaatttagttttctaactatttgaagcatattatcctttatattgtgatgatgtctcatttagaattggagctgagacgtacagtaagacttttcaatgcaaaagggcccctactttttccctaattctttccttctcctccttcccaggagccacttagtttgaactgggctttttaatgccctcagttctttagtttcacttcaaagctgttctttgaatctgcttttataagagggtaaaaaatatatataaaaagatttagagcatatctttttctgaactccaggtctatgcttctgtattaaaaactagtttaatttttgtgtgttgtctgttggcatgttttttgcatgtctgccatcagacttgttttaacccaatcatcctgtactatgtctctaaaagacagaaattatctgaagacagtgagctttgcaaatagacattattttgaagaaaatactctttctcttttttctcttctgtgggaaaaaatattaaagtttttttgatagacttttcatattcctcttagtatattttgaatgcaacattccaggtgccattattctatcttgttggggaggcagaatttcttttcaatggcaatggaagggtcactcattttttttaggggaatttcctcctaaaaatcattaacaactctttagagaagatagtgtctcgtttttacaatatgcaaaatattctctgtttaagatacaaacttttagattcccccaacctgtggtggaactcattacttcttttgcttcttgtttatggggagtaatttaaagagatatataaatttggttatataggggttatgatgttcccaggtccccaggatatctgaatttctaaactcctaaattcctagctctgtaggaagttggttttggttgcctatatctgggaagttttcttcccaacctggaaaggagttctgctcacccagcaaaacaaagttaagattaatgagattaatatttacaactttctttaaaaagtgtgatttctcaagaaaataaagatagaagtcagctgacaattttgaggcttttaaaaattctctctgtgattgctttctttgtgtttttatatggctttcacagtataccttcctctagtgtttccagcggatctgcttttgaggcacagtatgtttcctgctctgtttttgttgatgcttgtggtccaggaggtggtatagtgaatatattgggtctgaggagggaaaaatcagagagaacaactttgaaaacatttctgtgaactttactcaagatacagatatctcagatagctgggctgtcagataacctgtagtgatagctacagtatatattcagggcacaattgttcttctatatcctggcataatagagttgccaggttttacagtgccagctttctgggacctatcttccatggactctaattcagtagttttaggtagggctcaggaatttgtacctttattttaaaaatgcagctgacttaaaaataccagtggtctgtgttattcaaacttcaggtcaaaacccatatagggatcctaagatcaatttagtgatttaaaaccagacaaattaaaatggaatggaaaatatcagagtttgtcacacattttaaaagcatacactgttgcataaaaattttccagttttaattatatatggatatgtctatgcatatgtgtgtatgttattttactatagacaacatggaaactgggttacaatgtaaatatgtttcttactatgggttagatgaaaaaatttgaaaaattctgtgagatatagcttcttatatttccactattattgcagtgttagagtttattgtactttcattttatattgtcccttctgttagactgtaaacttgacaaaggcagaggaatatgtctgtactgcttactacagcctcttcagcatctagcatgtatgtgttcttagtacaggtatcactagttgtattgaaaagatttataaggagaacttaattcctcaaacagaaatatttttctgtgtgatctaagaactctttttggtgtgtccatttttatgttattactaggtcatttagtctgtgtttaatgtgtggacctgtgaggtttaaagccataagcaaatcaaagttctcttggcagttgttttgggcttccaggttaatttgctgatttgtcagtaaggatcttgcccataatttctagagaaactaaaacttttatttatgcagtggggtatatcagggttagggtggtgggtgtggtgtgtcccagggtacagacaatgaggtacgttgtctgtaagacatttaaaaacaataaaactgacaaaaataatgttgctttttattgtcactttgcattggaatttctaacctacgtcactgttaaaatagtcttctctgccggaatgacctctcatacctcttttcttactttagtaagacaatgttatttggactcagctttttctttatgatatcactgaaaattttaaactaggtttttttttttttttttttttaggaaggaatgctgttttaagttctctaatgacctttgttagtacatatgttagtacatatagtatggttaaaggtcactgaagcacacgctttggggtgtgacttttccttcatcactattctctaagacaagataatcctccgggctgttttcaaaattttactgaaaatggtttataattttacctttatcaggaaatcattctccttgcatttttctcaagttatatttcagcttgataagtcaccctatatcaattatatttctagaaaagaatctatttctatttaggaaaccttaaactgccctgcagttgtctaatttagtactagttggtattttaaggaggaaattatttcactgaccttcagaatatatggatttttttttttttttttttttttgagacggagtctcgctctgtcgcccaggctggagcgcagtagcgcaatctcagctcactgcaagctccgcctcctgggttcatggcattctcctgcctcagcctcctgagtagttgggactacaggcgcccgccaccatgcccggctaatttttttgtgtgtgtttttagcagagacggtgtttcactgtgttagcctgacctcgtgatcctcccgccttggcctcccaaagtgctgggattacaggcgtgagccactgcgccggcctatatggatattttttatgagctcaggttgttagatagtattcctgtagttgagatacaaggttttattcttgtgccttccaggattgcaagtgtcacttacattattttggcttgaaggaaaatcatttcccttagttctagtatgcagcatactgttagaatgcctttacttttcctttgttagcagataaccaatgatatgcaaatcttcttactgagttaaacagaggaaatcaactattgacagatcttttctgaccatctgctaagttttaaatttgagaaatgagtacatgcttgtcaaggaaatttcattatcagtacccatttatctactgaactcctcttgaggggtttaccaaatggttgacacgtgattcgccttcagacaaacatttaattgcatttttctaaatgtgatgggcataatgtaaggaggacccataaaaacaagatttaaaaataggggcatttgttttcatccatgctgctttattccttctttgtgagtaaacccctctgagtatagtaaggtggcatatagtgccttagtaggtctgactgtaaagcctagctccagcttttgaattcttttagtcagaaaataggtgaaaatagatattcacaactaatgatagatatgttctaccgcttcagaaaaatagactttgaggtaagatcaatttgtttgatcatcctcagggctgatgtaattattgggtctaaatttattttatttgaaacacagcacttatactaaaataatttttctatggtttttcattgtatatcttatttcaatactactttattaaagtgctgtttttccttttagagatcaaaagcaaaaattattctaaaatgttatagaatgatagtttctgaggacgattttccacaagccttgcaatttactgaagagtcagagttcatggggcaggggtagtagagagtaaaaaaaaaaaaaagaaaagaaaaaaagaaaagggggccaatgtacaacgtaatggggaaactggggaccctctgttacatttgttgtattccttttgcattacctttgaagcagcaaaaagcaaaaaaatctaatggatagcagtcactttttaaattattattacatagcttcttttattatcctccttatatcagcatctataaccatttaaagcattaatgctgtaagtacaaaaatacatacagatactctcatggattttatttataacattataaagtggagagtgctaccgtgtatgctttccaacttcattttataaaatgttgttgaaattaatctttgcaaaattgtaatcgttttctattaaaagattgcctttctttaatggacattatgagtcagttggagggttttttacctgtaccttctcaaccaacttataaatatatatatgattgcaaactcacaggaaattttccagatattcttctataattgtaagcctccatttttattactgtaaaggttatgtgtgtgtgtgtgtgtgtgtgtgtgtgtgtgtgtgtgtgtaagcgagagagagagtttttctaaaaagaaggcttctggaactaaaattaaactaaggcctgggagcaggctgcttgcataccttgtgtcagtctgagttcacacatacatatttgagaggctgatagctattcatagcagtgagttagcagttttgaaaacactgatgtaccaaaggtccctttggattttattcacgtgaaggttctaaaagttgcaggaaaaattttggtgcataagggccttaaaattaattactcatgattacatactgggtggtgttcagaaacaaacaagtatgataaattgagaccaacatacgttttatgatttcctttgtattttgttttacaaaggcatgaaaattcaaagaatattcagaaacaaagtataagtatattaaattcaaaatccacttagaaacaaacttaagatatataactagtttcccctagtgcatttcttgtacttatattatagaaatacttccaaaagggatttgaggtagtatcaatgaagagagtcaaactctgtaaaatatttgaagagatttattctaagccaaatgtgagtgaccatggaccgtgacacagccctcaggacgtcccaagaacatgtgcacaaggtggtcagggtgcagcttggttttatacattttagggaggcacgagacatcaatcaaatacatttaagaaatacattggtttggtccagaaaggcgggacaactcgaagtggggggagaaaaacagagatcttgcttcagctgtttcctaactcatttatgaaaaggtaagatagccctctgtcagaagcaaaaatatctacgtgattgtatagattttaaaaatctatataaatagctgttttaaagttcttatctactaattccaacatttgtgtcatctttagtactgttacagtgactttttttctcgttaatatatgtttcaatttttattgcttcttcctcatctggcaattgttttgattgtattctgggcattgtggatgttctgttgagagatttaaggattattgagttttgttttgatagctactagagaatcaggttgatcctgttgaggtttatttttagtttagttttttttttaaggaagatctaaagtgatacttattatagaactagagtagtatatttttatatctgttaccagcggcaaatctatatgggtctgcagcaacctcaattcttgcctcctcagaagaaagaatttgactgaggggcataaggcaaaaggagagaccaaggcaagttttagagcaggagtgaaagtttattaaaaagctttagggcaggaatgaaagggagtaaattacacttggaagagggccaagtgggcaacttgagagatcaagtgcccagtttggcctttgatttagagttttatacgttggcatacttcccaggtcttgcatcccttctcccctgattcttcccttgcagtgggctgtccatatgtgcaatggcctgctggcatttgggagaggccgcatgcacagtgtgtttactggagttgcacacatgctcacttgaggcattcttcccttaccagtcaactgttcctagaaggtcatataccagttaaactctgacattttgcctcttaatgcacatgcttgagcccacttgcccaactccagtgtgaagccactaattatcagtagatcttattgggaaactactgagtatcagtttcaggtttttttctatctattgggagactgcctttccctggtgcctgctgcaaccaattcttattttagagaaacagtgtaacaactgcctgaccatcacctgagggtcgcctgacattcctggttgctggggagccctctccagccccactggagcctggctagctacttactgtaacacatccatattttttttgttacgacagtaaacataagatttgtgtatctgaggcagactgattatttacctgcagaatatcttgtattagtttcccatgctccatttttttcccatggtgctgtgataaatgcagatgtcacctgcatgtatgaggaggggcctctagtacatgagagaaaccccaaattcttagtcttgaagcttatatagaagctgcttacataactgcaccttctcccctccaggacggaaagagagaacacagagagaaactgagaccttgtcttcctaatgtaaacaaatcctctctgaagagaaaagtcaaaggtgttttggccaataatcttttggaatataaacaaatggctccacatttttgataccctttgaaatgtaaacacatagttcttagagataaatttccatattgctctttttttttctttgagacccagtctcactgctctgtcgcccaggctgtagtgcactggcgcgatctccgttcaccgcaacctccgcctccagggttcaagcaattctcctgcctcagcctcccgagtagctgggactacaggtgtgtgccaccatgcccaacttatttttttacttttagtagagtcagggttttaccatgttggccatgctggtctcaaactcctgacctcagatgatctgcctgccttggcctcccaacgtgctgtgattacaggcgtgagccactgcgcccggcctaaatgtccatattgctcttatcatttctatctattcagtcaccctttaatcaaagtgccaattttctttgctcagaaggccattaccatgcagaaacatgaaaatattcacattgtttcttgacacagagtcgcctcacacctaaggcatggctgttcttggacttcagatatataatctgggtattcattgaggtctcttcactctatttggttggaattgcaatgtctcccagttccatgtgacccatagatactcttcatctcacagcccctcaatagttatattttgctaggctttgtggaattataccctgtgtacccacatcctaatatttagccaaatactcaagagacccctatgcagacttctggagttccttctctacaaggttccctcctctccattcctcttcacccaaattccagtagcctcaacagacccaaattctgacttctatttcatctacccagtgagacctctgttctgtctctagctccacttccctatgctatgatctgtaagtaccctcaggcagaaagccgagatgaacgtggcttttatatgtctgtcttctcccaaggatcacagccctgagctagtcaacatctgcttcatatattttgtccagtttcatagttgtttacattgggaaggtgagtctgatgctgtcatggcaaaaactgcaagctctatctaccagattttcaaattgtcatgattgtatatcatctctgccatttacctgtctggtacttaaagaatatggaattccccttaaatcaacaatacattctttctgtatttaacaacctgtgtgtgtgtgtgtgtgtgtgtgtgtgtgtgtgtgtgtgtgtgtgtatctgtctgtctgtccaggttattagacgggttgaatttgtttcctttttatttgtttttagtattaaagatgtttttttttttgtaggactgaaactcagcttgctcaggaaggaaaataattgcctgaccattaagggcattgggcttggttaaaagaggagggtattttcttctttaaaaaattttgcttccatgcaagtaaggaagttgggattctccataaggaggatacttctggaagtgaaacagttaggcttgtttatcctggatgcacaggaaggtatcacagtgacttaattatacaccccaaaatatcttaaaaagtagtttagaactgtcaactagtctctgggcattgtttggttttgttttaaacattttttaaatcaacaaataaaagttgtatatatttgtggtatacaagataatgttttgatatatatatatacacacattatagaatgactaaaaccaattaacatatatgttacctcacatacttatcttttttgtaataacatttaatgtcttatttaaagattttattaaagaacatttaaagtcttagcagttttcaagtatacaatacattgttattaaatataatcaccatgttgaactaattcctcctgtctaactgaaattttgtatcctttgaccaacatctccccaatcaccctacatgaccatagcctctgataactaccattctactctcagcttctatgagttcaacttttttagatttctcatatgagtgagatcatgttgtatttgtttttctgtgcctggcttatttcacttagcataatatcctccaggtttgtccatgttgtcaaaaattacaggatttacttctgtttgaggctaaattgtattccactgtgcatatatataccacattttctttatccattcattatttaaagatgcttaggttgattccatatcttggttattgtgaataatgctgcaatgaacatgggagtacagatacgttttcaacatactaattttatttccttcagaatatacctggaaatgggattgctggttcatatggtagctctaattttaatttttttaggaacctccatactcttttttataatgattgtactaatttatattgacagcaacaatgtacagggttttcttctctccacattctcacccacacttatctgttgtcttttttataaaatacccatcctaacaggtgtgagatgatatctcattgtggttttaatttaatgaatttccttgatgatttttttcatctacattttggccatttgtaatcctcttttgggaaatgtctattgtagtcccttttttttcataaaacttcctttttatggcttaaaaagaaatagacaatgtcaattatagacccccaggttagagaccatagtttttagtttaggaatatcctgggaagcactgagtaaatgtgaaataagattaataatatttttctgctagtttcttcagacttgtttttggggcttgctttttggcatttcatgggtattggcttgttattcttcaaaatgacctacttcagggattatgagtgatgccagtttttcatagctgggtgggtttaggatctaagattatcttagggatatcctgaggatgtgttatttttacctcaatagtgatagctagtagctgatcctcctccttcctgtcctttacaatttcattaaaataccttctccatctctttcatctaaagaattcaagtttttttccaagttggttgttgaagaacattgattatgtatctttatgtttaaaacaccaaaaaaggcattgtggagagtaacagaagttaaacatatgacttttgttttccatgagtgtataacctaatgacagagaacatacaaagacgtgagtgacagaaacatgaaaaaaaaaccttgcagcttttggaaaagccaacagcttgagaatcacagtctgtcacttagcagttctagtataaagagcgcttcatctctgattgctctggcaaaaggttctgaagagccttaatgttcaaaattgtgtccttgaaccagcagtattagcatcactgggaagcttattggaagcccaggatctcaagccctaccctagacattctgggtgagaactgtcattttaaaaaggtctcctggtgatttaaatgcacattacagtctgggaagcactgctgcagaggattctgattgtgttcatttaggtcaggtgcccacttggaatgaatcgccgcagccagggacatacaggacatactgaatgctcaatcctgggacatatggtccttatcccctaggacaatgggtgtgggatcagtttgtggaatgggtttactacaggaaaggggtgttttattaccaagggaagggaagttgggaaagaagataataacaatagttgtccaataaacttatttcctctttcatgcctttgctcacattaatgttagaactagctaactcctttactttgggtcatttcatcccatttcctgtgtgtgtgtatgtgtgtgcacacgtgtgtgttcgtgtgtgttctactttcaatctcccccacccctcattgccatctgtctgcctgacctagatatcagaggttcttccttattccacagcatggttctcctgtccctctcagagagttcatatctttcaaatatatataaacacgttatggataagcacacacatacctctgcctaagtctaactttacttcattgcactcctgatagagcatgtgtgcttcacctactgcttttcattctaccactaaggcattaacccttggagtcacgccttttaaagctgtgaatatctgttaaaatgtacttgtattaatattacagggggtcatacttttagccctcaggaattctgattccattagcaaagttttttttttttttttgcatacagggaacaaaagagggatgtaatcctttactattattatttattttgatgttcatattttctctgatttctcaagaagggtcctgtggtcttttgatgtgtcctcattctttaagtacttccttcctttctggcccaacaagatgttccaggctcatcttatacttttgcagtcctagctctggaatcagccatttctccaaggagttctaatgacttttagtggagaatgctgtttagaaactaagatttgagtgcaaggtgtgcttatcctttttgagttatcattgtttctgggccatctcagtggatagaattaggaaatatgcatgtgtatatgtatgtgtgtatgtgtgtatttagataacttaaattggtatcatatacatgattctttgcaggccagttggtctctgtttcaagtacttaactttccctttgtaacacaaaagcagccataaataatatgtaaatgaatgggcagagctgtgtttcaataaaacttatttatggaccctgaaatttgtatttcatatcattttcacatatgacatattcttcttttgacattttttctaaccattttaaaacatagaggccattattaacttgtgggccatacaaaaacaggtgatagagcatatttggcctgtgggctgtagtttgccaagtcctggtctttccgaaacactttcagtttacatacaacacacatacctatatagtcatacactgagtaacaacattttggtcaacgatggaccacatttacaatggtggttacctagactataaaggagctgaaaagctcctgttgtctagtgatatcatagccattataacatcataccgcaacttattacatatatatttttgctgatgctgatgtaaacaaacctactgagctgccagtcatatcaaagcgtagcacatacagttatctatggcacacaatacttgttaattataataagtgaccctgtttttggtttatgatgtactatatagttttccctccatatctttatgggattccttctaggaacccactcgacccctcccgtggataccaaaatccaccaatgctccccaatataaaatggcataatatttgtgtataacctatgcacatgcttctgtatactttaaatcatctctagatttcttacaatacctatcacaatacctacacatcacttcatttgtgtgaatacagtgtagtacttggcacacagtaaattcaagttttactttttggaactttgtgaaattttatattttatattttgtttttatttatttttaaaattttaagttcggggctacatatgcgggtttgttacatgggtaaattgtgggtcgctgaggcttggtatatgaatgatcccattaccaaggtagtgagcacagtaccagataggcggacttccaagatatgccttcccctcaccctcccccatcaagtggtccccagtgtctttgttcccttctttgtattcatgtgtattcatcgtctggctcccacttataagtgagaacatgcaatatttggttttctgttcttatgttagtttgcttaggataatgtcctccatctgtatccatgttgctgcaaaagatatttcattattttttatgtctgtgtagtattctatggtgtatatgtaccacattttctttattcagtccatcgatgatggacatcttggttgattccgtgtctgctgttgtaaatagtgctgtgattaacatgtgtctttttggtagaatgatttattttcatttggatatatacccaatagtggtattgctgggtcaaatggtaattctgttttaagttctttgaggaatctccacactgctttccacaatggatgaactaatttacactcccaccagcagtgtataagtgttcccttttctccaatgtataagtattctcccttttcaccagcgtatcattgtggttttgatttgcatttatctaatgattagtgatgatatgagcattttttcatatatttgttggccacatgtatgtcttcttttaagaaatgtctgttcatgttctttgaccattttataatggggttatttgttttttgcttactgattcaagttttttataaattctggatattagacctttgtcagatgcatagtttgcaaatattttctcccattctgtaggttgtctgtttactctgttggtagtttcttttgctgtgcagaagctgtttagtttaattaggtcctacttgtcaattttttgttttgttgcattgtttttgaagacttagtcataaattctttgccaaggccaacgtccagaatggtatttacttggttttctcctagggtttttattggtttaggtcttagatttaagtctttaatccatgttgagttaatttttgtatatggtgagaggaaggggtctggtttcaatcttctgcatgtggctagcaagttatctcaacaccatttattgaataggaaatactttccccattgtttgttattgctgactttgtcaatgatcaggtagttgtaggtgtgtggctttatttctgggttctctatcctgttccattggtccatgtttctgttttcataccagtaccatgctgtttcagttactgtagctttgtaatatagtttgaggttaggtaatgttatgcctctggattcattctttttattaggattgctgtggctattctagctctcttttggttcctccatatagatttttataattttttttctaattctgtgaaaaatgacattggtagtatgataggaatggcactgaatctgtaaattgctttgggtagtatggtcattttatcaatgttgattcttcttatccttgagcatggaatgtgtttccatttgtttatgttgcctctgatttctttcagcaatgcattgtattgctcattgtagacatctttcccctccttagtaagctgtatccttaggtattttattctttttctggctactataaatgggattgtgttcttgattttgctgagcctagacattattggtgtatagaaatgctactgattttcttacattgattttgtatcctgaaactttactaaggttgtttatcagttctagaagccttatgatggagtctgtgggttttcctaggtatagaattatattgtccatgcagatagacagtttagctttctgtctccctaatttagatgccttttatttctttttcttgcctgatagctctggttaggacttctagtactatgttgaataggagcagtgaaaatgggcatccttgtctttttccagttctcaaggggaatgcttccagcttttgcccattcagtaagatgacattgtctataggtttatgttatatgggtcttattattttgaagtgttttcctttgatgcctaatttgttgatggtttttaacatgaagggatgatgaatttttttgaaggccttttctgtgtctattcagatggtcatatggtttttattatgaattcagtttatgtggtgaatcacatttattgatttgtgtatgttgaaccaactttgcatcccaggaataaagtctacttgatcatgatgaatgagctttttgatgtgcttctgaatttgcttgtattttgttgaggatttttacatctgtgttcatcagggacgttggcatgaagcttttttttttttttctgtgtctctgctgggctttggtatcagaatgatgctggctttgtagtctgaattagagagtagtccctccttctcaattttttgaaataaatttagtaggattggcactagctcttctttgtatatctggtagaattcaactgtgaatccatctggtctagggctttttttggttggtagactttttattattgatttaatttctgaactcattattggactgttcaatattgattgctatttttattgtgctgttgtccaagtgtgtggttgattttattttgatttttgaatttgctgagacttgccttataactgagcatgtagtcagtcagagtatgtgccatgtgcagatgagaagaatgtatactttcttgttgatggttggagtgttctgtagatgtctattaggtccagttagtcaagtgtcaagtttaagtccggaatatctttgctggtttactgccttgatgatctgtctaatgctattagtgggggttgaagtcctgagtattattgtttggttgtctgaatctcttcacagatcgctaagaacttttttttaaaatctgggtgctccactgttgggttgggtgtgtatatatttaaaataattaagtgttcttgttggattgagccctttatcattatgtaatgccctttctttgtcctttttgatcattgttggtttaaagcctgttttatctgatgtatgaatagctacccgttttttgtttcctattagcctgatagatctttctccatttctttactttgagcctatatatgttgttacttgtgagatgtgtctcttgaagaccatagtcagttggtttgtgcttctttatctaactgggcacactatcccttttaagtgggggcatttagtccatttaaattcagggtcggtattggactgtgaggatttgatcctgtcatcatgctattagctggctattatgtagacttgatcatatagttgctttataatatcaatgaagtatgtgcttaagtatgtctttatggtggcaggtatcattcattaatttccatgtttagcacttcctttagaagctcttgtaaggcaggtctaggggtaatgaatactcttagctttgcttgtttgaaaaggatttcatttctcctttgctgatgaggtttagtttggaatgatatggaattcttggttggaatttcttttcttcaaggatattgaaaacagaccccaaatctcttctggcttataaggtttctactaaaaggtccattgttaacctgatagggttccctttgtaagtttttctctagatgcttttaagattttttcttttgcattgaccttggagaatctgatgactgtgctttggggatgatcatcttgcatagtatctcacaggtgttctctgagtttcttgaatttgtatatcaccctctcaagcaagattgggaaaattttcatggactatatcctcaaatacgttttccaggttgcttgttgtttctcctctttctggaatgcaaatgagttacaggtttggtctctatgtaatcccctatttctcagctattctgttatttttttaaattattttttctttatttttgtcttcctttgttgcttcaaaggagtgaccttcaagctgtgaggtttttatttttcatttttatttatttatttattgagacagagtcttgctctgtctcctagactgtagtgcagtggcgtgatcttggctcactgcaacctccacctcctgggttcaagcgattctccagcctcagtctcccgagtacttgactctacaagcatgtgccaccatgcccagctaatttttgtatttttaatagagatggggttttgccatgttggacaggctggtctcaaactcctgacctcagatgatccacctgccttggcttcccaaagtgctgggattacaggtgtgagccaccatgcctggccaagctgccagattcttttctcaacttggtctattctgcttttaatgcatccaattgtattttgaaattcctggaatttttcatttccagaagttcagtttggtctttttttaaatggttatgtcatctttcaactgttgggttgttttactgttttgcctgggttgggtttcaacctcttcttgtgtctcagtgtgcttccttatcatcccgattctgaattctctgcctggcatttcagccatttcattctggttaggatccactactggggagctagtgtgatcatctggaggtaagaagacatgctggtttttagagttgccagagttcttgtgctgggtctttcttctgtgacagctgatgattctttattatttgaagttattgtcctttgggtgaggctttttgtttttatgatctttattgcccttagggttttttgactgtggtgtaagctggatatagttgaatcacttcatttctggatgcttttagggggcaagactcagctccatactgctgggatgcatgctctaaccctgtgggactgggactgggtcagcagctttgtcctctggtctctcactgttgagctttggctgggatagagaggctggggtgttcccagaccattgacagggcatgggtgtaggtgctccagcaggggcagcaggggcactgtgggcaggatatgctccagtgggcagggctgtgggcgaaaggcactctggcaggggcactgagggtgggaggtgctctggtagggggcaccgtgggcttgggaggtgtgctccagcagaagtggtggaggcgttgtggccgggaggcactccagcttggggtgctgtgggtagggtcgcttctgcagggggaaaccatgggtgggtgggttgctctggctggaaatgccgcaggcaggaggcctggaatttacttttttttaaatctgaggttgattgaattcatagatgtagaacacatggatatggagggccaactggaccatatttttactgttattttagagtgtattcttacttatcaaaaaaaagttaactgtaaaacagcctcaggcaggtccttcaagaagtattcccaaagaaggcattgttatcttaggagatgacagctccatggatgttaaagcccctgaagacttttccctgggacagttgtggtctgtggttacaagtaataagggaagaattttctaccctttctagtcttagccccaagctttgagataggcaatatttcaggggctgtcagtaagaaagtttataactaatccagttttgagggtcttgctcttagggtcccagatttatcaacaggtgtctactagttagactctccaacttgagtggctcctaggattgtcttctatctctcagccttgaagatcatgtaaaccaaatctcaatttcattaggtttagcaaaatgccatcacagcataaaggtcagtttctacattctatttacctctcttggttcctacgtttatttattgatttagttttctatgtagtcctcatttgttttttttagcagatcatgaatgcatttgagaccagtagttttagttcatcattctctcagaatacaaacacctgtattatgtgtacttttctttaactgtgcattactctttaatatttgatcatatattatacatctttctagttattttatgtttgtcagttgtgtatatttcagtccttgtgagcacgcttgatgatttattctattgttccatttcacttcagccctctaggcaaatagtaactattcagaaaaatcctcactgatcaatataaaataagtggcttttcattaagattatttcagagatcatggtaccttgctggtataaaagagtaaaagccctttttctaaagtacttagcttacttaggggaggaaaatttctaattggagaaatttgactgatatttaggaattgttagttaaatatctatgctgtgtgatacatgcatatatgggaattttatttctttctctgtattttattaagtaagcataaaatggactaaaatattttcttttcctttcgggatatgaattttggtcagtagggacagactgtttctctataggttctttagcagataggaagcagatgtggcaatgtgaggagactactaggggaagaacaaatgtatgagtaatctggaaaaagattaaagtcaattataagttaaatgtcagcctttggaccaaagctttttcattcttggtactctaaagagatgagagcaattgagtgttcttaaaccctctgccaaaaaaaaaaaaaaaaggtggggtggcgagagagagagactgtttttaaaagccagtatttcactatacttactgttttatttccaggtgtttttttttaaacagtctgcttttgattttgtttggttaggtaaaatataacccatcattagcctgtatttgtacttaagagtattgttttatttggttagagaatgtctttaaaatcatatggtctttgtcagtgaacttctaggaatgtctggcatggttattggtcaaatgcctggcagatggaaatgaaattttgtgaggaatcttctggatcaaatacagatttatttttactttaataaaactattcaaagcataaagacttcagtctgagtgtcaacagtagtagctgatgtgggagcagttgcccggatagtacttgctgaggactgcagtgatgttcccattcctgatgccacttttttgttgtgcttgaattacagacatagaccatatgggcatctacaggtcttttagatctctgaagttctttataatgtatactgggcatactgttttcttctatacataaaaaagtgctttgtatttaattaaatgaagatactgtttagttttgtgtgtgacaccacccattcttagaccaattccattggcaattattagatcaatttaattccccaaaggaatacttgagagacagggctgagaacagttacaatcattttagtttaaaattctacttagcaatgagaaacaaatgatagactctacaatctggcttgtaaataaatagtaaatagcaataaaattagaatctatctataataaaattaagttttccagcttgtctatgcttttgtacatattattttcacttttaagtgcatctgcctaattagtaatatatagggtcataatgctacttaaatatcatgttatcctttaaataataattccaataaaagtgtaagaaaattcactcattcactttttttttaatcaaggataagccttttggaattattccagttcatcacatttttttcattcattcaccgaaactttattgcacacttactaaagattggtcttaagttaggtgttggggcagtggtcacagtatctttccagtcttcaagaaacttacagtttaattctattgagttaggttgagtattggaaaaaaaaatgctcttcaacatctactggctctgttacctctgctcttcacattagttaataccttaaggtggaaattagtgagcccatcctatggtagttggaggaaaacttagtgaaaacccttttgaaatgtatcttaatggccattggccaccaacataacagtgttccaggaaaaggagacttgatagatgaaaagataatctgtcaaatatatattttttatagtttaaaatttctctgtaaattaatttttaaagatataatttacatataataaaatgcacacattttaagtgtagagttcaatgaattttgacagagtatgtacccttgtaaccataactctagttgttcacctgagagagaaacttggagttattctggattcctttccttatcacatccaaatgattactaatttctgtccatgctacactctaaacttccatagaacatctcccctctttactctcctgactactaccttggtttttgacatgttaagccctgtttttcacctctgttaccgcaatctgctttataactagcttttgattcttatctcttttctttttcgtatacccttcatgacgttattaatttgtgatttttctaaaatactattctgatcatattaactgccttgcttaaaatcccttcatgactctttacagttcccattcttaattattgttttgatggtggcatcatttatcaagtagaaaatacacatagaaaagcagatttgtggagggaaagtgatgagttagttcactttaacaaagtggaagaaataaaacattgccttcagaagcatttttatttgattcaagctttatgtacacaactatgggggaaggagagaaaagccatcacaaataccagaaactgttctgagatttttatactgatgaagaaaatgaattttggcaatgctgggtaggaaaaattatgtttgttcaagcttgtttatactttaagtgatgattaagtttaaatttataaactcacatcttcaccttcatatactagtttgttaaaaaatgccttccaatatttatctaaacatgtctcaaacactatgagttgcgtataaattgtgaggtttaccttttagattggtaaagacaagctctgaggtaaaataattaatagcagggtatctttttaccttgagtgtgaggaaaacatagaagaaatatttaaatatgacaataaaagcagtgaactttattcttgctgtagaacttgcctcaaccttgttagtacctacattattttctataccatgaatattctatatcatctagcttttcttgacacagtgagaagagatatttaatttagtgcctgaataaataaagtatttatagtactataaagtactggtaatttagtgcctgaataaataaagtatttataaagtatttgtgtactgaatgagaatgactctaatataaatgagttttaccaaggtgccctgtggtattatttagaaaagtgattatttctttaaaaaataaaaatcccggctggatgcggtggctcacgcctgtaatcccagcactctgggaggccgaggcgggcggatcacctgaggtcaggagttcaagaccagcctggccatggtgaaaccctgtctctactaaaaatacaaagaattagccgggtgtggtggtgcatgcctgtaatcccagctactcgggaggccgaggcaggaaaatcgcttgaaccagggaggcggaggttgcagtgagccgagattgtgccattgcgctccagtctgggcaactagagcaaaactccatgaaagaaagaaaggaaggaaggagggagggagggagggaggaaaggagggaaggaaggaaggaaggaaggaaggaaggaaggaaggaaggaaggaaggaaggaaggaaggaagggagggaaattccagtcaaaatcccataggttatttatagatatcaacaattggattctaaagtttatatgaaaaggccagaaagaaagaaaatcccaatcaaaatcccataggttatttatagatatcaacaattgaattctaaagtttatatgaaaaggccagacctggaatagtgacacaatactgaagaaaaagttagaggagtcacactaaccttttgcaagactgttttgtatggttaaaataaacagatgatcaaagtatgttttcacaaatcacacagtttattgccatacaaagagcttatcatttttattcataatgctcaaagaatggaagaataacaggaagaaacatcatagggaatatactcaatagataaagtacattatccacatattggatgagttccaatttagtttagagtccagtttttaaagtctagttgctaaattaggatggaagcttgcctctgtggatgtaaagtctaatcaaagtttggagagtacttttctataagtggtttcaggagggatggtttgatcaccacagtgtacatccataacaatgtgcaatgtccctcaacactaacaagcagtgccagtgttactgggctttggaggatagttcaaaggctgacagagagcaaccctgctagtctgatattttggtctttggagaagtgtctgacatagagtagccctgacaaagcctaagttatcaatctgtcaaaatcttgggtttatatgtgtttttaaagtccagtcgttgagcccaataactcatgtatgtggtctgatgaggagtgatataacaatcttacagggagaggaattaaacttcatgttcttatcagagcaaaacgtgtatcattcatgtagtaaataaactaagtgtttaaatcatttcaaagctatataataaagattccttataaaactacagtaatcatgacagtgtggtattggtgaaagagtagacacatgtatcaatggaaccaaataaaaggcccagaaatagacccatacaaatatattcaggtgatctttgataaaggagcaaaagcaattcaatagagaaaggatagtcttttcagcaaatggtaatggaacaattggatgtccatatgaaaaaaaggaatatagacatgggccttacaccttttactaaattaactcaaaatggatcatagacttaaatgtaaaacacaaaaccattaaacttctaaagaaaacttaggagaaaatccagacaaccttggatttggcaattagtttttagatacaggaccaaaagtaggatctatgaaagagaaaattgttaagttgggcatcattaaaattagaaacatctgttctgtgaaagacactgttaagagaaggaaaagacaagccacagactgagataaatatttgcaaaatatatatctaataaaagacttgtatccaaattttaaaaaaatcttagaattccacagtaagagaagaaagaatccaatttaaaataggcaaaagagctgaaaacacaaagaagatacatggatggcaagtatgcatatgaaaagatgctcagcatcttttgtcattagggaattgcatattaaaacagtgagataccactatgtacctcttggagtcactgaaattccagaacacagataccaaatgctggtgaggatggtgagctgttaagattgcaagatgatacagccactttggaagatagttcggcagtttcttacaaagctaaaataaacatagtcttactgtaatatacagcagttatactcttaggtatttatccatttgaattgaaaacttatgcccacacaaaaagttgcaggtgaatatttacagcagctttattcataatcaacaaaaactggaagcagccaagatgtcctcagaaggtgaatggataaagaagctatggtatatccatacaatggaatattgctcagtgataaaaagaaatgagctatgaagccacagaaagacatggatgaaacaaatgcatattgctaagtgaaagaagtcaatctgaaaaggctacatattacatgattccaattatatgacattctagaaatggcagaactatagtgacagtagaaagatttgtggttgccagtgatttgggaggaggagagaagatcaaatggctaaagtacagcagatttttctagtgtcatgaaacggttctctaagatactttaatggtggatacatgacattaagcctgtagaaatttacacaattaaaaagtaagccttaatatatgcaaatgttaaaaaatcacttaggagtttagaggatctcagaaaggaatgcagaccgacaagagaatctaactgtattaaaaatgtatgaaacaacctccctaagggggtgggggaaaaggcactgatctaagaaacttcggaaatgagcctgtaagactaaatggaaaagcaattatacctaatcattgtactttagttgataaagttgtttctcattgggggtacacattaaacattctgatacctctatacatacatattggaattgaataattaagtaaatggagagttgatggtttgaagccaaacttcttgttgaagtagaaatgttcagataagcaagggaaggaggctagaatgattcatttggtgatggattagagttggagacatcagtataaactcatctttagcttaatatagacacagatggcacagatggacagatggttacttagagaaatatttatagatatatgcatatacacaggtttctgtacacacatatattttcttgctgtgtcagctgagagggactaaaggaaatgaccccacagtagcaagaagtacacttagcccccagatctttgtttctaatactagtctccaataaaaggaactatggctcctcagaaatggccgattctaggaccaggaccggaattagtctagaaaatacatgagtatagaaaatcttatagtgccagaaagtaagaaagtgctcagaaaaagaaaaaaaaaatccacatcgatgggaaccaaagggacatagaagccaattgaaagagcttccaatggccaaagctggaacaatttgaacaacaaaatagtaaaattgtattggataataacccaaagcatagaataaatatccatgagttcagactctgtgtcctcaaggaggaggagcttaacttcccactccctgagtgtgggctgtacatggtgacttccttacaaatagttgagtatgaaaaggagaggatgcaatggtaactttacattggagaaacctgaagaacataacctcagcctcagccttgaacatgttgatcagggtcaacatcaacagtaataagtcatattaataatatataccacctgggcatagtggtcatgcctgttaattccagcactttgggggggcaaggtgggaggatcgcttaaacaggagttcgagaccagcttgggcaacatagtgagacgctttttattttgtagacaaaataaaaagtaaaacattagccaggcatgatggtacatacctgtagttccaactacttgggttgctcaggtgggaggattgctcgagcccaagagtttgaggttaggattagctatgattgcaccactgaaacccagcctggatgacagagtgagacctggtctcaaaaaaaaaaaaaaaaaaaaaagtaggtatcttaacccccatctaatcatgagaaaaatatcagacaaatcctaatagggggtcatcctacaaaataactgatgagtattcctcgaaactgtcaactcatcaaaaacaaggcaagtctgagaaattgtcacagccaagaggagcctcaggagatatgacaactaaatgtaatatggtatcctccatgggatcctggaacagaaaaaggacattaggtaaaaactaagggaaacctggataaaatacaggctttagctactaagaatatgtttactttggttgattaattgtaacaaatgtactatactaacacaagatgttagcaataggggaaactgggtatggggtataggggaactctgtactatcttctcaatttttctgtaaatctaaaactgtgctaaaaataaagtctattaaaaatgaaagtattatcttaaggcctcagaataatccagtggtttctgtctctcctgcagttttgacagtgtttcctgccttgctgactcttcttccctctcggacatcacctttgatggcaatcccatagctcaagagtcatggtacaaacacactgtccttcagaatatgatgcagctgcgccagctagatatgaagagaatcacggtgagaacccttccaaagtgttcaccatgttgttgtccttagtgtggattaggaaattgggatgcatattctttgcttgaaatgcttcttaattttagtgaactatgggttatcatgattgtatacttcataattgcaattatgtagtttttactgcctgatcccatcccaagtttaattgagcaagacttttaaaattcctagccttctgtttaaattaatcatcgtgtttatttttcattcttgcttaatatccaaataataatttattttgaaatgaatgagtgagaatttctttaagttatgtagcatagtggttaagagcatggacactggagccagattgcctgcgtctgaattctggcttgactgctttctaacgatagtcctttggcaatgtatttaatctttgtatacctcattttcctcaaagtaaaatggggatcagaattaagtcataggtttgtcgcgaagatgaaataaagtactacaccttagaaaataaggtactacactttagactgcgaggctcctaggaggcatttgtatgtagttgttattgttgatgttatatctcccaaagtagctacctctttttattcatcgtatctccatgttaagatattttctacacttagatgttttaatatggtttctgatctaaggaaatgctgtgcataatatccccctctttttaggtgtacaatgtgtattagcatattataggatccaagaagttctgtaattaaataaacttgtttaactttgtttctttgaccaggtttatttgttatgagaaaacacattttaataatctcagtttgatagtctctgacctagaaaaatatcctaagcctctacctattttctctcttctggactgctgattttcatgtgaattctgttgatcacctaggtttatgcagttgccaactgacctatttctttgtatattagcatcacaatgtgtgcagttttcatttatgcgttggcaatactgtggacctctaaggtggctagctaatagctaaaagtgtggatgaattgatggataccagaggtcttctagggttctgcctctctctctattccatggtggagctatggttctttgtcctcttagttaattcagctctatagtgtcaacactgtttcatatttttgtggtgactctttacccttatctccatgtctttcttagttaagcatctatgctacttcttaaattgctctttctaatgaggttgagatgagtgggataagatttagagctaactcgtttatataaattagtacttaattatatggtatgttcctcatagtgaatttatttgtcagtcttgtctacccaaacaatatatagtctttaaaggcagaaaccattcttctttcttgcctggcacctacagattactagcatctaattctcacaccacattgaacttttaccagttatatcaatattgttctttacagcaaaaagatgcagtttaaaattatacattgcattatagctgaattttgttgtcatgtctctaaagtcatcatttttctggaactatttctcagtctttctttgattttcatgactgatatttatgaaaattacaggttagtttttttgtagaatgaccctcaattcagattttttgatgtttcctcatgattaatttttacttataggtttttggcattaatatcatagcagtgattttgtattcttctcattgcatcttagaccagcatgtcttacaacatgttcttcatatttatctctttattgaggatgcttactttaggatgatttctgccaagcttttctttgtgaagattctctttttccctttgtaatcccattcctcataaaaatgtaaatttattcattcattcatatctatatggacttatggtatttagtctcgtcttttatttataactttttagtaactttagtgtggaagctgtaccttttttaaggactttttataacaaatgtcaacaaacagcctgtgagctggctacctgtttttgtaaataaagttgtattggaacacagtgatgcccattcatttatgtattatctatgtttgctttgatgctgcaatggcagagtcaagtagttgctatggatactatgtggcctacaagcccaaaatatttattatctggctgaaaaagtttgctgatgccagtaactattttttctctttaagaaacaatatcttaattgaatttttgtgtaaattaccatataaacattctcactgtggtggattacacaaatatttaatgaacttctgtgcactggggcagtggttcctaaactgcgtgcagaggatgctgcagtgaactcatagggagtgatttttaacttccaggggaaacacagtgagatttgacatctctgagactgtgggcaaattagtagctcaaatagtttaccatttcaacatgacctcacactatatttgtttcaatcacttcctatctttgaaaagctgaattttcagtagttgttgtaataaaaataaataccttgccaaaatcagtatcgaacaggaaatggggatggcagtgtccaatgtgattctctgtttgagaaattgtataacgtcctcctggttctacacattccattgataagtagttgtggttatttaaaaatgatataaaatattttttctttctatttacatatattattttttaattgctactaaagtgctagaccatgaatacttattaaattgtttggaccaaactacttagtaaacagagttgtcacatatttcttttggcctagaggcactgtgaaaaaatccctgagactattaggtatcttgaactcacgagtttctgtactaggatatatattagacagtagagatgaaaagatcaaaatcacagttcatgccctaaagttacttgcagttgtctgcagaggcaaccatgcagctggattacagtgcaaaatgacaatctagagagataagattactagatggatcaatagagatatatgtttgtgtcaacacacttacacccagggcaaaatgatatcaaagagcaaagcaatcccaagtctacctgaaaaacagaaaagttccaaaggagaaaataattgactcaagactttaagggtggtaaagaagaaggaggatgtatttgtggaaaataaaggcatgcaaaatgcagaaggaagctgagagaatatagcagctgacaggagttcaacatggctaagcattgagtgtacatggctgagggacatagaaggagacaactatgtctgacaggcaaggacaggcaaggactagggcattttatatcataataaggagtttagatttttgtcttggacataataggagaaacccttgaagagtttaaggtagttaaattggatttgcctattaagaagactgtctttctgggttcagccttgaagatagatcggagaggatgcgatgggtgatgagatgagaagcaaggagattaatcagagtaagagtctgggaatctgatccagaggaatggcaagagataatatgatgccatctatcactggcctcaactcctattttgctttatctttcttcagaagaaggggttttagtttgtaaagattagcataaagattaataagataaaagtgaagcttaggataggtaaataaataagttggaactcaggcccacatctagagcaagggttggcaaattttatctataaaggacctgatagtaaatattttaggctttggggcctgcatattgtctgttgaaactactcagtttgcccattgtagtatgaaaaaaggcatggacaatacatatatgaataagcatgattctgttccaggagaatgttatttagaaaaacaggtggctgactttggcctgtggcctagagtttggcagtccttaatctagagcactgaataaatcgctgaaccactgagagttttgtctaggtagggttatagaataatggagcagctgaaaggtaagatgaagtaactttttttttttttgcaatattgctttatttatttatttgtttatttttgattatactttaagttctgggatacatgtgcagaatgtgcaggtttgttacataggtatacaggtgccatggtggtttgctgcacctatcaacccgtaatctgcattagatatttctcctaatgctatccctctccttgcctccacaccccaacaggccctggtatgtgatgttcccctccctgtgcccatgtgttctcattgttaaactcccattatgaatgagaacatgcagtgcttggttttctgtccttgcaatagtttgctcagaatgatggtttccagcttcatccatgtccgtacaaaggacatgaactcattcttttttatggctgcatagtattccatggtgtatacgtgccacattttctttatccagcctaagattgatgggcattttggttccaagtctttgctattgtgaatagtgctgcaataaacatacgtatgcatgtgtctttatagtagaataacttataatcctttgggtatatacccagtaatgggattgctgggtcaaatggtatttctagttctagatccttgaggaattgctgcactgtcttccacaatggttgaactaacttacactcccaccaacagtgtaaaagcattcctatttgtccacattctctccggcatctgttgtttcctgacttttgaatgatcaccattctaaatggcatgatttgcgtttctctaatgtggtttgctttgcatttctctaatgaccagtgatgatgagctttttttcatgtttgatggctacataaatgtcttcttttgagaagtgtctgttcatatccttcccccactttctgatggggttgtttgtttctttcttgtaaatttgtttacgttccttgtagattctggatattagtcctttgtcggatggatagattgcaaaaattttcttccgttctgtaggttacctgttgactctgatgatagtttcttttgctgtgcagaagctcttttgtttgattaggtcccatttgtcaattttggcttttgttaccgttgcttttggtgttttagtcatgaagtcttcgcccatgcctatgtcctgaatggtattgcctaggttttcttctagggttttcatggttttaggtcttaagtttaagtctttaatctattttgaattaatttttgtgtaaggtgtaaggaaggggtccagtttcagctttctgcatatggctagccagttttcccagcaccattcattaaatagggaatcctttacccattgcttgtttttgtcaggtttgtcaaagatcagatggttgtagatgtgtggcattatttctgagggctctgttctgttccattggtctatatatctgttttggtaccagtaccttgttgttttggttactgtagccttgtagtatagtttgaagtcaggtagcatgatgcctccagctttgttcattttcttaggattgtcttggctatatgggctcttttttggttctaaatgaatttaaagtagttttttctaattctgtgaagaaagtcaatggtagcttgatgggattagcattaaatatataaattactttgggcagtatggccattttcactatattgattcttcctatccacgagcatagaatgtttttccatttgtttatgtcctctcttatttccttgagcagtggtttttagttctccttgaagaggtccttcacatcccttgtaagttgtatgcctagacgttttcttctgtttgtagcaattgtgaatgggagtttgctcatgatttggctctctgtctattattggtgtataggaatgcttgtgatttttggatattgattttgtatcctgagactttgctgaagttgcttatcagcttaaggagttttggggctgagatgatggggttttctaaatatacaatcatatcatctgcaaacagagataatctgactcctgtcttcctatctgaataccctttatttctttctcttgcctgattgccctggccggaacttccaatactatgttgaataggagtggtgagagagggcatccttgtcttgtgccagttttcaaagggaatgcgtccagcttttgcacattcagtatgatattggctatgggtttgtcataaatagctcttattattttgagatatgttccatcaatacctagtttgttgagtgtttttagcatgaagcggtattgaatttttatcgaaggccttttctgcatctattgagataatcatatggtttttgtcattggttctgtttatgtgatggattacatttattgatttgagtatgttgaaccagccttgcatcccagggatgaagctgggttgatcgtggtggataagctttttaatgtgctgctggattcggtttgcccctattttactgaggattttcgcattgatgttcatcagggatactggcctgaaattttctttttttgttgttgttgtgtctctgccaggatttagtatcaggatgatgctggcctcataaaatgagttagggaggagtccctctttttctattgtttggagtagtttcagaagggatgctacctgctcctctttgtacctctggtagaattcagctgtgaatccatctggtcctgggctttttttggttggtaggctattaattactgcctcaattacagaacttgttattggtctattcagggattcaacttcttcatggtttagtcttgggagggtatatgtgtccaggaatttatctgtttcttctagattttctagtttatttgcatagaggtgtttatagtattctctgatggtagtttgtatttctgtggcatcagtggtgatctcccctttatcattttttattgtgtatatttgattcttctctcccttcttctttattaatctggctagcagtctacctattttgttgatcttttcaaaaaatcagctcctggattcattgattttttgaagggtcattcgttctctatccccttcagttctgctctgatcttagttatttcttgtcttctactaccttttgaatttgtttgctcttgcttctctaattctttcaattgtgatgttagggtgtcaattttagatctttcccactttcttctgtggccatttagtactataaatttccctctaaacactgctttagcacccagagattctggtacattgtgtcttttttctcattggtttcaaagaacttctttatttctcccttaaattcattatttacccagtagtcattcaggagcaggttgttcagtttccatgtagttttgtggttttgagtgtgtttcttaatcctgagttctaacgtgattgcactgtggtccgagagactgtttgttgtgatttccattcttttgcatgttttacttccaattatgcggttgattttagaataagtacgatgtggtgctgagaagactgtatattctgttgatttggggtggagagttctgtagatgtctattaggtccacatgctccagagctgagttcaagtcctgaatatccttgttaattttctgtcttgttaatctgtctaatattgacagtggggtgttaaaatctcccattattattgtgtgggagtctaagtctccttgtgggtctctaagaagttgttttatgaatctgagtgctcctatattgggtgcatatgtatttaggatggttagttcttcttattgcattagatccctttattattatgcaatgcccttctttgtcttttttgatctttgttggtttaaagtctgttttgtcagagactaggattgtaaccactcctttttttttttttttttttttgctttccatttccttggtaaatcttcctctatcactttattttgagtctatgtgtgtctttgcatgtgagatgggtctgctgaatacagcacaccaatgggtcttgactctttatccaatttgccagtctgtttcttttaactggggcatttagcccatttacatttaaggttaatattgttatgtgtgaaattgatcctgtaattatgatgctagctggtgttttttgcccattagttgatgcagtttcttcatagtgtcgatggtctttacactttggtttgtttttgtagtggctggtactgttttttcctttccatatttagtgcttccttcaggagctcttgtaaggcaggcctggtggtgacaaaatacctcagcatttgcttgtctgtaaagtattttatttctccttcacttatgaagcttagtttggctggatatgaaattctgggttgaaaattcttttctttaagaatgttgaatattggcccccactctcttctggcttgtagggtttctgcagagagatccaatgttagtctgatgggctcccctttgtagataacgcaacctttctctctggctgtgcttaacattttttccttcatttcaaccttggtgtatctgatgattatgtgtcttgaggttgattttcttgaggagtatctttgtggtgttctccgtatttcctgaatttgaatgttggcctgtcttgctaggttggggaagttctcctggataatatcctgaagtgtgttttccaacttgcttccattctccccgtcactttcaggtacagcaatcaaatgtaggtttggtcttttcacatagtcccatatttcttggctgctttgttcattccttttcattcttttttctctaatcttgtcttcacgcttcatttcattaagttgatcttcagtctctgatatcctttcctctgcttgatcgatttagctattgatacttgtgtacgcttcacgaaattcttgtgctgtgtttttcagctccatcaggtcatttatgttcttctctaaactggttattcttgttagcagttcctgtaaccttttttcagggttcttagcttcattccattgggttagaacatgctcctttagcctggaggagtttgttactacccaccttctgaagcctacttctgtcaattcgtcaaactcattctccatccagttttgttcccttgctggtgaggagttgtgatcctttggagaagtggcattctggtttttggaattttcaacctttttgtgctggtttttcctcatcttcgtggatttatccacctttggtctttgctgttggtgacctttggatggagtttttgcgtagttatcctttttgttgatgttgatgctattgctttctgttttttcccttctaacagtcaggcccctcttctgcaggtctgctggagtttgctgggggtccactccacaccctgtttgcctgggtgtcaccagcagatgctgcagaacagcaaaacattgctgcctgctctttcctctggaagcttcatcccagaggggcacccgccagatgccagttggagctctcctgtatgaagtgtctgtcaacacctgctgggaggtatctccccatcagaaggcaggggggtcagggacccacttgaggaggcagtctgtcccttagcagagctcgagcactctgctgggagatccgctgctctcttcagagctggcaggcaggaacatttatgtctgctgaagctgtgcccacaaccgccacttcccccaggtgctctgtcccagggagatgggagttttatctataagctctgagtggggctgctgcctttctttcagagttgctgagcttagagaagaggaatctagagaggcagtcagtctggctacagtgactttgtggcactgtggtttttttaatgtcaaaagtacagaatataaattccacaaattgtgacagtcaacttgatgttgattctgaaataaatttaaattgcattattaaaagatggtttgtggcccagtgcggtggcttactcctgtaatcccagtactttgggaggttgaggtgggcggatcacaaggtcaggagattgagaccatcctagccaacatggtgaaaccccatctgtactaaaaatacaaaaattagctgggcatggtggtgcgtgcctgtaatcccagctactcgggaggctgaggctggagaatcacttgaaccagggagttggaggttgcggtgagccgagatcgcgccactgcactccagcctggcaacagaaggggactctgtctcaaaaaaataaaataataaaataaaataaaaagatggtttgtgagtacttaggaattggtcactaggaggcagcattagctcactaaaaaacaattcatgccagaaaagaattagtttcctgacctagaaattacaaatagaccttgttagaggagtgctatagacagtgttttggtatttaagcaaagcatttggcaaagtcttttatggcatcattttgagtaaattgtatgacatggttatgtagatttttgattcaagtatacttacagaacatgaagtaatggattaatgccagcctttagagaaatctgtactggcatgccatgaggcttttttcctccagtccattctattcacatttttattaatgtctaggagaaaatatttgttattctggtaaagtatgtgaatgacagaaactagagaaattagagttcttggtatattggttgatcaaatgagaatccaaaagtatctccatagtctagaacagggtttggcaaactacagcctatgggctagatccatctggcagcctgctttttgtacagctctcaagctaataatggcttttatgttttcaaagcattgtaaaaaaaaaaaaaaagaacaacaaagaaggatatgagatagagatcacatacagctcacaaagcctaaaatatttaccatactatctgaccctctacagaaaaagtttgtttatgcctagtctagaaaagtaagcagaatttaacaacataaaaaatagatgaattgaacatcctggactttattccataacaacaatcaagcaaaacaattcttagcacaaattcagtattatacaagattagacttagcagcgtgtgttaaagtgacttggaattgctaaattcaagttcaattaattatgagatgtgattattaaaagttaatatggcttaaaacaatattcatttatagaaaaagagaattcagacaatggagacagtcccatcccatttttttctacagtggtcagattacacctgaactattactagttttagagggcagacaataaactagagcatttccaaagaatctgacatgattagttgacaaaggagaagacataaggaagatatcccagtgatcttcacctgttttcacaactattcaaaaaaagagagaacagacacatgttgaggggctagaacaaggacccttatatagaaaattctgggaggcagaattttcctttttatttctaaggcagcattttgtgaatgcaggcagtattctcacaattctgaaacagggttgggcgtggtggctcatgcctgtaatcctagcactttgggaggccaaggtgggcagatcacttgagtcaggagtttgagaccagctggccaacatgacaaaaccctgtctctacaaaaaatacaaaaaatttagccgagtgtggaggcacacgcctgtagtaccagagacttgggggactgaggcaggaggatcgcttgaacccaggaggtcaaagctgcagtgagccaagatctcgccactgcactcaagcctgggggacagaatgagatcctgtctcaaaacaaaacaacaacacaattcagaaacaaacaatgtctaaagttttcacctcaagctcacatttaattggcttagtgtgaacttgtttacaatttgctctccaaaaaaaaaaaggagctcatctcatgtgtacgttttctgttttggtagacattactaatgttcaccaatatgctctggttctcctcctttttgacatgtgggaagatgtttggccaatgaaatgtgagcagaaataatgtatatcatttccaggcagaagcatttaaaagcatgattctcatgcttccttcccatgtggtagtcactgcggaagcctatataaagttgaggatgccatcagatcatagcactcaggaatacttagccactacattgaagacaggtgcagtgttctttgcgtgatcaagaaataaacttttttaaagtcataagccagtgaaagttttgaagttgttacagcagcataacctatcctgttctgactatttccctccccagtatttaacagctaatatccctggaccagaagtcaggtgacatggcttctaatcttcactctaacactaggtgtgaccctgcaaaaaaatcagttttgtttgctaaaagtgattgtttgagtaaaaattattgaccacctctttgagggaaaaaaccctgtgattttaaagtctgttttaatattttatatgttcaaagaaaataatgtttataactaaagtatatggttaaaacacaccttgccatttgatttttaaaatttcataaaatgctgcctatattaggactactattatttattttggatcagtctttttcttgtgtgatatgtgcattgttttaggccttaatatctgctaacaaagtataatctaggttatcaaacacctattaaatcactgcatggcttaattgacttgaaattatttctatattgggtcttcatggccaaaatgaagtgaggaaaaagtagttttttgtcccagatcccagattccccccccaacttatttatttttttatttttattttttgctatgtaaaggatatggcttttgtcccagaaattggactattatcaagaagataccagaattttagtttttctttcttaccaacagatttataacttatcttcacaattagaggttttttttctaagtttagttactctgtaattatttgggctgaaatatagctctcagatacataaattccttaaaatattcaatatttgaattgatttggtgtaaatccagttttccaaggtttagctttccttttaagccctactgcctttaatagaagctcaaattcttttcaaaaatctgatgaaatcatctcgtaagtatgtgtagtacgtgatccatacagtttccagtactgtttgaaattggctctttgaaaaaacaatctgtttctagttcacattttatagatgagtcaacaattgaacatcaatgtattttgctcttttaaacactttattctgaaatagattgtactctgtaggtaccaagtcagtatttactgaataaaagaatttaacagaattattaaaccagatattttgtgaagctaggattcaaagttctgcatttttaatttagtttatttctcctcattacctctatttagtttttaaaagttaagaataattattttccagctgggcattggtggctcacgcctgtaattgtagcactttgggaggctgaagtgggcagatcacatgaggctaggcgtttgagaccagcctggccaacatggtaaaaccctgtctctactaaaaatacaaaaattagcctggcatggtggcacatgcctgtaatcccagcttcttgggaggctaagacatgagaattgcttgaacccaggaggcggaggttgcagtgagctgacattgcaccatggcactccaagcctgggcaacaagcaagacacaagactgtcttaaaaaaataataattattattattttccatattgtaaaagacactttaaattcactaaaattacattacatttccatttccatttcctttaaaacaactaaatcatatggcagatcacttctgagttctaaactcttctttatctatctaaaatcagtaaaattaatttaaatacatctttattataaaaaaaatatgaattttgtttctagcaggccatggcttctggtcctgatcctggccttgtcactagctatgtgacctcatacaagttactaatgtcttggagcatttgttaccttatttctaaaattagagttgtctagtatatgctttcttagttttctttttaaactctgtgttggtttctgtttgtgcatttttaaatataattatttaatctaggttttttctttgttttcaggagcatgtataatggcccatcctctagaacacattttcatagtctctttgaccttctttaattctaatataacatatatatactggtcagcataggctagattgtgctgcagtaacagcttctctaacttcagtgaattaaaacaacaaagtttatttcaggcttctaatacctgtctgcctatgatgtgtgatttgggatctttgctctatgttgtcctcattctagtactcaggctttcaaagtacccacctgtggagttttgcaggtgctgtagcaaggtgagagagagaatagttgtatcatacattgtctttgaaagttttcaaccagaagtaaatacatgtcacttttgtccatatgacattggccaaagcaagtcacatggccacatctaacctcaagggggctagaagtgctatctcacaatgtgtcttggatatgcaaagacacaagaatatttggtgaacagcttttatgaataaccatcaggttttaaatcaaatgttgaaatctggtaggagtataaattagaactgcatttatggagggcagtttgcagacatatcaaaaggatagaaatatgtctaccatttgatacagcagtttcggttttaataaattactgaacagacatggttcatacattcatagagcttattttatggcgtgggaggcaagagggatagcaccagaaaaaattaaaatgaaacaggttaagtgctatgatagagaagtatgtagggtgatactaaaacatatagaaaacattctcatcctctattttccagttgactgattctctcttcagctgtgtataatctgctattaaatctccctttgttgaattttaaatttcaattcttataattttttgtttctaaaagagttattcttcaaatctgctaagttacttgttatggtttcctgtctctgaagatgttttcaagcttgtcttttatgaataaattgttttctcaaattatcgtattattttgagtatctacaaatcttttggtaatgaaaattaaaagttacgtggttataatttattaaaatctgacagtcttcgggggaaaaattgtccagattgtgtatatagattataacctttaaaaaaattgctcatagtgaatattataaactgatacacagaaattgtaagatttgagttaggtgtttgggattatgactgatttttaagcatttttctaaactgtttgtaaggttattttgtcatttctactttttccagctttgttgaggtatgattgatgaaactatataaaattaaggtgtacagtgtggtgatttgatgtgtatgataaaatgattaccacaatcaagttagttaatatttctatcacttcacctgattatctttttttttttgtagttagaacatataagatctattctcttagcaaatgccaagattacaatacaagattattaactacggtcatcatgctatatttcatagcttttagaatttaaaaaatgagactgggcaacacaatttaaaaacaaaccaaaagtaattatattaatggggagtaatttattaatataattggagttttaaaagatatttaccctggttttttcatcaaaaagttctgattttctatcacagatccagtcaacattgttagatgtatcacttttatccttcttaccttgatgatagaaagtttaaacctatgtggaaccatgatgcacagcgtacaaaaggaaaatgatgcaaacatacttctccttttcttctcattcttttttctttcttgtatgagctaggttcacgtcacctccagagttgggaatagagttaggaatgcacagatttttagcattaagaggaaagaagaaaataaagagaaacatactaaatttttctttgagagtatattttctgctagtaaatactatgcctctcaagaagaaaactgtgcttaataggaccaatgatatttagcattaaaaaatggttaaactcttcataatacttttcggaaaatgtcttttaggaagaagaaaggcgtatggcatctgttttagccaaaaaagaggaagagaagaagcgggaaagtcataaacaatctttgcttaaggtattttctctgatgtctacatggatgtgtgtgcacacgtagacacacataccccaaagccagctagctagtctactggaaaagtggtttctaaactttgtaagttttttgttcctatcaacagaatgtacgtacccctaaaacttttacaagttattacctataaataaacctgtacttaagaaataaaatatgatatacattataaaataaatgcaaaggctagttttaaaaggaagagatgataaataaatataattgaagttataacacttttatttcataccagtgcatcatcttgtgtatcccatggcctattcacttccttttggaacgtactgtaattgactgtcatctttactgatatattttaatgagctctgctacgttttttttttttaatgatagctttttaaatttaaaaagtttatgatatagaagtgataaagattttgtggaacttaggaatgaaaatttgttttaaactggttttaaatgatttagcagatattaatttccttaaataaaatattctcttttaaatattttatattaacattgcaaagtataagtaaaggcagctttaagtttatagttcataatatgcatcatgctgtgttctaaaattaaggacatcaccctgattatcattactcattcatgttctatatagatgcttttctttttaaaattaaagtggcactcagaattcaaaaaaatgactagccaggcaaggtggtatgtacctgaagtcttaactacttgggaggctaaggtagaggattgcttgagcccaggaattaagtccagcttggaaaatacagtgagacaaaacaaaatgtcactaaataggactctttagttacgaggtttacttagtatttttatttttagtaagaggaaaagcatggggaatcaggagacccaggttctagccctagctcagatttggaatcatgatacaacagaccctcagcatttgctgaggattgctcgtgcaactctacatattgatcattaagaaaatgggatggacattctcagcaaactaacacaggaacagaaaaccaaacactgcatgttcttactcatgagtgggagttgaacaatgagaacacatggacacagggaggggaacatcacacaccggggcctgttggagggtgggggggctaggggacggatagcattaggagaaatacctaatgtagatgacgggttgatgggtgcagcaaaccaccatggcacatgtatacctatgtaacaaacctgcacgttctgcatatgtatcctagaacttaaagtataatttaaaaaaaaaaagaatgctaaaaaataaaaaaaagaaaatggaatggattggttacaggaagagtgtatagatactgtcttctgccttgttgcttttctattttttttattttccttgtaaccttagaagtgaaggaaagtgaaacttatggcatatactggtatggtcttgcctggactatgaaaagtagactcaaatggcagaaactggaatttggcaccttctaaaatatttgtcactttagcacagacttggccatttattggcacctagctattagaaacataattgtcgctgatatcccaaatgcttctgtgatctttacactttactttgggtacccccttatgccttgcagaatctctagcattctctaacctttcttttgcttcttcttttttttttttttttttttcctccacagatgcatagagcccttatgtgtcctcctggccagccattaatccccacctgacattaagacaggctatactcctgtcttaaaatatgtcttcccttttccgggccccagtaaaattaatcattctcttagtcaacctggtaatgatctgattttaataacccaaattaaagaagcttaacttttgcactaatataggaaaacgtttgcattttcaaagattatcttattataaatttaacatactcagtggtctaaagatattttatgccctttttctaagcactgctttatctatgtcattctgagtatttctttcgcctacccctgccagccagaaatccaaaagcatgaagccaactgagaaccatcagccattaactcactgccctggcctctttcaaagtggccttgatactgagtaaaaaaaacagagttgcttagattacaaattgggttggcatagtcatcagcaagtaacttaaatagaattccttaaggtaagaagcatttttattatagaatggggaaaaaatgtttttacaataggaattgcagatttctacttgctttatataaggagcacatacatagaatgtcagaaagtctccaaagtatatacatattaaatataacccactgaattgtacacaaaattttgaaacaccaaacaacagaaaaaaagaaagccaggcccaaaacattttttttagagatggggtcttgctgtgttgcccaggctggaatgcagttcacaggtgtgactgtagcacactacagctttcaactcctgggttcaagcagtcctcctgcattagcctcccaagtagttgagatttcaagtgtgcaccactgcactcccccagaaaacatgtttaaaacagaaatagaacttttaaaactttagttttaattaagcaagccatatcactttttattcctatctaatgccatgcatacatgctaaaatcttagataaccaaaaattatgcaaacatatgcaaagaggtacaactaaaaagaattattctacatgtactgaaggagtggacagagaatcttcctactagccttctgtggcttcagggccagcaggtgaagaggggtcagtatcacactcagctgatttttcaatgcaggattgtagtcttagtaaagaggaaaaggaaagtgtctgttttcagcattctgatctaattgacaagctgtaattaaatattatcttttgataatggaaactttaccagaatagggatttttttttctattaatatatataaattgaatagaaacgtttcaatttagcacaatttctttcagtagtctagatctgctttttcacaagagggtttctatgagatgactgagctccaatgctggaagtcagtggttctcaaagtgaggttcatgaactagcaatattagaatacttaggagaattcaaattctcaaaccctatgcccaaaactctaaatcagcaatctgttataagctccaggtgatttgaggtaccctgaaatttgagaaccactaccttaagacatccgttgcttataatgaattaatttctttcctactcatctggaatggtactagttatctagagacatttcaacctagtacaatttcttttaatagtctagagaataatttttaaatttcagacagtataatttattctgagaaacttggaacattgatcaactccttcccttccccccctccaagattatttcaccttaccagtcttaattattgagtagaaaaactaaaatatcattagttttttcttactgtgttagaggcatataaatttctgtttaaaacttcagataacattaagtatgtaaaaatttatgtgaaattaaaacttcagattttgaatttttaatctctagttggttgtatatttatttttaataaaattaagttcctaaagagcaataattgtttgcatttttttcctttagagttagataattattgagatttttggatgcagagagtaaatacaggcctcttgaatcttgttttagaatgtattgggtatctacttaaaaggaacaggctccttttaaaagtattataagaaggcacaaacaatatgccccttagatgtcacttctgctacaaaaattgcattatataacttttgtcacaattaactttttcataggagaagaaaaggttaacaattaacaacgtagctcgacagtgggacttgcaacaacaacgagtagccaatattgctacaaatgaagatagaaaagattctgactctcctcaggacccctgtcagattgatggaagcaccctctctgcattcccagaggaaacagggtatgcaatggtattttttcaagatacaagcatctttgataattgaatttggagtgggaattagaaaccattttacatataattattttaaaagggttttcttaagaaaacttgctgaaattagaaattaagatggaaaagttgaaaatataaatcttactataacattctccaaattaaaacatgcttcatagggcatttcatattttttatagggaaaagtctagatttcttaatatagtctatgatgtcttttgcccacttcatctcttttatctcatgccatcaaccatgttcttctgctattgcagcatcactgtctgtctttcagttcagttacttcctacttcagaacatttcttttttattattattactattattattatactttaagttttagggtacatgtgcacaatgtgcaggttagttacatatgtatacatgtgccatgctggtgtgctgcaccaattaactcgtcatttagcattaggtatatctcctaaagctatccctcccccctccccccaccccacaacagtccccagagtgtgatgttccccttcctgtgtccatgtgttctcattgttcagttcccacctatgagtgagaatacgcggtgtttggttttctgttcttgcgatagtttactgagaatgatgatttccaatttcatccatgtccctacaaaggacatgaactcatcattttttatggctgcatagtattccatggtgtatatgtgccacattttcttaatccagtctatcattgttggacatttgggttggttccaagtctttgctattgtgaatagtgccgcaataaacatacgtgtgcatgtgtctttatagcagcatgatttatagtcctttgggtgtatacccagtaatgggatggctgggtcaaatggtatttctagttctagatccctgaggaatcgccacactgacttccacaatggttgaactagtttaccgtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatgatgagcattttttcatgtgtttttttggctgcataaatgtcctcttcagaagtgtctgttcatgtccttcgcccactttttgatggggttgtttgtttttttcttgtaaatgtgtttgagttcattgtcgattctggatattagccctttgtcacatgagtaggttgggaaaattttctcccattttgtaagttgcctgttcactctgatggtagtttcttttgctgtgcagaagctcttgagttcaattagatcccatttgtcaattttggcttttgttgccattgcttttggtgttttagacataaagtccttgcccatgcctatgtcctgaatggtaatgcctaggttttcttctagggtttttatggttttaggtctaacatttaagtctttaatccatcttgaattaatttttgtataaggtgtaaggaagggatccagtttcagctttctacatatggctagccagttttcccagcaccatttattaaatagggaatcctttccccattgcttgtttttctcaggtttgtcaaagatcagatagttgtagatatgcggcgttatttctgagggctctgttctgttccattgatctatatctctgttttggtaccagtatcatgctgttttggttattgtagccttccttgtagtatagtttgaagtcaggtagcgtgatgcctccagctttgttcttttggcttaggattgacttggcgatgtgggctcttttttggttccatatgaactttaaagtagttttttccaattctgtgaagaaagtcattggtagcttgatggggatggcattgaatctataaattaccttgagcagtatggccattttcatgatattgattcttcctacccatgagcatggaatgttcttctatttgtttgtatcctcttttatttcattgagcagtggtttgtagttctccttgaagaggtccttcacatcccttgtaagttggattcctaggtattttattctctttgaagcaattgtgaatgggagttcactcatgatttggctctctgtttgtctgttattggtgtataagaatgcttgtgatttttgcacattgattttgtatcctgagacattgctgaagttgcttatcagcttaaggagattttgggctgagacattggggttttctagatatacaatcatgtcatctacaaacagggacaatttgacttcctcttttcctaattgaataccctttatttccttctcctgcctaattgccctggccagaacttccaacactgtgttgaataggagtggtgagagagggcatccctgtcttgtgccagttttcaaagggaatgcttccagtttttgcccattcagtctgatattggctgtgggattgtcatagatagctcttattattttgagatacgtctcatcaatacctaatttattgagagtttttagcatgaagggctgttgaattttgtcaaaggccttttctgcatctattgagataatcatgtggtttttgtctttggttctgtttatatgctggattacatttattgatttgcgtatattgagccatccttgcatcccagggatgaagcccacttgatcatggtggataagctttttgatgtgctgctggattcggtttgccagtattttattgaggatttttgcatcaatgttcatcaaggatattggtctaaaattctcttttttggttgtgtctctacccggctttggtatcaggatgatgctgacctcataaaatgagttagggaggattccctctttttctattgattggaatagtttcagaaggaatggtaccatttcttccttgtacctctggtagaattcggctgtgaatccatctggtcctggactctttttggttggtaagctattgattattgccacaatttcagctcctgttattggtctattcagagagtcaacttcttcctggtttaatcttgggagggtgtatgtgtcgaggaatttatccatttcttctagattttctagtttatttgcatagaggtgtttgtagtattctctgatggcaatttgtatttctgtgggatcggtggtgatatcccctttatcattttttattgcgtctatttgattcttctctcttttcttctttattagtcttgctagcggtctatcaattttgttgatcctttcaaaaaaccagctcctggattcattaattttttgaagggttttttgtgtctctatttccttcagttctgctctgattttagttatttcttgccttctactagcttttgaatgtgttttctcttgcttttctagttcttttaattgtgatgttagggtgtcaattttggatctttcctgctttctcttgtgggcatttagtgctataagtttccctctacacactgctttgaatgtgtcccagcgattctggtatgttgtgtctttgttctcgttggtttcaaagaacatctttatttctgccttcattttgttatgtacctagtagtcaatcaggagcaggttgttcagtttccatgtagttgagcggttttgagtgagtttcttcatcctgagttctagtttgattgcactgtggtctgagagatagtttgttataatttctgatcttttacatttgctgaggagagctttacttccaactatgtggtcaattttggaataggtgtggtgtggtgctgaaaaaaatgtatattctgttgatttggggtggagagttctgtagatgtctattaggtctgcttggtgcagagctgagttcaattcctgggtatccttgttaactttctgtctcattgatctgtctaatgttgacagtggggtgttaaagtctcccattattattgtgtgggagtctaagtctctttgtaggtcactcaggacttgctttatgaatctgggtgctcctgtattgggtgcatatatatttaggatagttagctcttcttgttgaattgatccctttaccattatgtaatggccttctttgtctcttttgatctttgttggtttaaagtctgttttatcagagactaggattgcaacccctgcctttttttgttttctatttgcttggtagatcttcctccatctttttattttgagcctatgtgtgtctctgcatgtgagatgggtttcctgaatacagcacactgatgggtcttgactctttatccagtttgccagtctgtgtcttttaattggagcatttagtccatttacatttaaagttaatattgttatgtgtgaatttgatcctgtcattatgatgttagctggttattttgctcattagttgatgcagtttcttcctagtctcgatggcctttacaatttggcatgattttgcagtggctggtaccggttgttcctttccatgtttagtgcttccttcaggagctcttttagggcaggcctggtggtgacaaaatctctcagcatttgcttgtctgtaaagtattttatttctccttcacttatgaagcttagtttggctgtatatgaaattctgggttgaaaattcttttctttaagaatgttgaatattgacccccactctcttctggcttgtagagtttctgctgagagatctgctgttagtctgatgggcttccctttgtgggtaacctgacctttctctctggctgtgcttaacattttttccttcatttcaactttggtgaatctaacaattatgtgtcttggagttgctcttctcgaggagtatctttgtggcattctctgtatttcctgaatctgaatgttggcctgccttgctggattgggaaagttctcctggataatatcctgcagagtgttttccaacttggttccattctccccatcactttcaggtacaccaatcagacgtagatttggtcttttcatatagtcccatagttcttggaggctttgttcgtttctattcttttttttctaaacttcccttcttgcttcatttcattcatttcatcttccatcactgatatcctttcttccagttgatcgcatcggctcctgaggcttctgcattcttcacgtagttctcgagccttggctttcagctccatcagctcctttcagcacttctctgtattggttattctagttatacattcgtctaaatttttttcagttttcaacttctttgcctttggtttgaatttcctcctgtagctcggagtagtttgatcatctgaagccttcttctttcaactcgtcaaagtcattctccgtccagctttgttccattgctggtgaggagctgtgttactttggaggaggagaggcgctctgctttttagagtttccagtttttctgctctgttttttccccatctttgtggttttgtctacttttggtctttgatgatggtgatgtacagatgggtttttggtgtggatgtcctttctgtttgttagttttccttctaacagacaggaccctcagctgcaggtttgttggagtttgctagaggcccactccagaccctgtttgcctgggtaccagcagcggtggcggcagaacagcggatttttgtgaaccgcgaatgctgctgtctgatcgttcctcttgaagttttgtctcagaggagtacccggctgtgtgaggtgtcattctgcccctactggggggtgcctcccagttaggctgctcgggggtcaggggtcagggacccacttgaggaggcagtctgcccgttctcagatctccagctgcgtgctgggagaaccactgctgtcttcaaagctgtcagatagggacatttaagtctgcggaggttactgctgtctttttgtttgtctgtgccctgcccccagaggtggagcctacagaggcaggcaggcctccttgagctgtggtgggctccactcagttggagcttcctggctgctgtgtttacctaagcaagcctgggcaatggcaggctcccctcccccagcctcgctgctgccttgcagtttgatctcagactgctgtgctagcaatcagtgagactccgtgggcataggaccctccgagccaggtgcgggatataatctcctggtgcgccgttttttaagcccatcggaaaagcacagtattggggtgggagtgacccaattttccaggtgccatctgtcaccgctttctttgactaggaaagggaactccctgaccccttgcacttcccaagtgaggcaatgcctcaccctgcttcggctcatgcatggtgcgctgcacccactgtcctgcgcccactgtctggcactccctagtgagatgaacccagtacctcagatggaaatgcagaaatcacccgtcttctgcgtcactcacgctgggagctgtagaccggagctgttcctattcggccatcttggctccagccagaacctttcttatagggatagtgtttttctgccctaacaccaatcacttccctgcactatttctctgatcccgccctagctaacttcagcaaacccacagaggtctgaagtttaaacttcacatgttccaaaaaagccttccctaactccaagttggtaggtagttgtttcatgtgtgtcttccccattagaatgtaagcttcatgaggaaaggaatcctgcttgattgacttgactcctgctgtgtcctcagcagccagcacaaaaccttcctctttaactactggtagtaagcaattgggcatataatctgaaagttactccagctgtgatctatactatctgtctattccagtggctcacaacctcttttcttctatgatacatttatcacatgataatatatccctaggtttatgagcaatgctgaatgcattatctagactccacatgtttctcttcctcttagaaaagcatattggaatcaagtaaattcagagggacataaagcatttatatctttatagtgcatgtataatttaaatatatatttgtacagctgtccctcagtatccacaggggattggttccctgcaaatacccaaatctgcagatactcaattcccttatataaaatgggatagtatttgcatataacctatattcttcctgccatatacttgaaatcatctctggattacttaaatagtatttaatacagtgcctacacatcactccatttgcatggatttggtatagtactcagcatgtggcaagttcaagttttgcttttggaactttgtggaatttttttcggatatttttgatccatttggtttaatctatggatgcagaacccactgatactgagggctgactatatttacataattttaaaataaagcctaaaaatcaaagatagaatacattttagttttgtttaatttgatgaagcatatgtgtcttattaccttaactaaactctgaaacaccttttaaaactaaatataatatagcttttacttcaggtttttagctggaattctttaagcctttcatatgcaaaaaatatatagtaaaggaagtaatttgagtgacatgagaataatgttttggaaattgtctgtagttagagtctaacatatatttaggcaaatatgctttttaaattttagttatagaattaacttatatcagtgtatttccttcagctcacttgggatccacatgtagaccttgtcagctctttcagctacaaaaataaatcaagaataaaaattcaatcactgatacccttgcttccagttgattgaattggctgctgaagcttgtgcattcatcacatagttcccgtgccatggttttcagctccatcaggtcatttaaggacttctctacactggttattctagttagctatttgtctaatcttttctcaaggtttttagcttgtttgcaatgggttcgaacttcctccattagctcggagaagtttgatcgtctgaagccttcttctctcaactcgtcagtcattctccgtccagctttgttccgttgctggcgaggagctgcgttcctttggagggggagaggcgctctgatttttagaattttcagcttttctgctctgttttttccccatctttgtggttttatccaactttggtctttgatgatggtgacgtacagatggggttttggtgtggatgtcctttccgtttgttagttttccttctaacagtcaggaccctcagctgtaggtctgttggagtttgctggaggtccactccagaccttgtttgcccaggtatcagcagcagaggctgcagaacagcaaatattgctgaacagcaaatgtccactccagaccttgtttgcctgggtatcagcagcagaggctgcagaacagcgaatattgctcaacagaaaatgttgctgtctgattgttcctctggaggtttcgtctcagaggggtacctggctgtgtgaggtgtcagtctgcccctactcgggggtgcctcccagttaggctactcgggggtcagggacccacttaaggaggcagtctgtctgttctcagatctcaaactccatactgggagaacctctactcttcaaagctgtcagacagggacatttaagtctgcagaggtttctgccgcattttgttcagctatgccctgcctgcagaggtggagtctacagaggcaggcaggcctccttgagctgcggtgggttccacccagctcgagcttgctggctgctttgtttacctactcaagcctcagcaatggtgggtgcccctccgcaagcctcgctgccaccttgcagttagatctcagactgccatgctagcaatgagcgaggctctgtggacgtaggaaccctcctagccatgtgcgggatataatctcctggtgtgccatttgttaagaccgttggaaaagtgctgtattagggtgggagtgacctgattttccaggtgccgtctgtcacagcttcccttggctaggaaagggaattccctgaccctttgcccttcccaggtgaggtgatgcctcaccctgctttggctcacgcttggtgggctgcactcactgtcctgcacccactgtccaacaagccccagtaagatgaacccagtacctcagttggaaatgcagaaatcacctgtcttctgcactcacgctgggagctgtagactggagctgttcctattcgaccatcttggaactgcctggcctagtgtcaagaataaaaattctaatgaagtgacaatttatgtaactaatataccactcttatatagccctagagctatatttaatattatttaaatggcaaaatataattttacttggttagaactataatactttataatgttaaaactttatagcattgggctttagatttatgaaataatacaggtcagttctatttctaatttcttttttaaaaattatttttcagtttcaagtttatccaagtaatatggaatttaatattctaaaattataataaggttttagaagttagtccttcaatccgtcaaatttttttctttcttcttttggagatggagtctcgctgtgtctcccaggctggagggcagtggtgcgatgttggctcacggcaacctttgcctcccaggttcaagtgatgctcctgcctcagcctcttgagtagctgggattttccaggtgcccaccaccacacctggctaatttttgtatttttaaaagaggcagggtttcaccatgttggccaggctggtctcgaactcctgatctcaagtgatcctcctgcctcggcttcccaaactgctaggattacaggcttgagccaccgcacatggcctcaaacttatttttatacacaatgttagataagggtctaacttgattttatttcaattgactagtcaatttgctaataaccttttaaaaattaaacttcttttttcatgagaatgccatctttatctcatgttaagattttgtaaatatgtgcacatatttctggactatccatttcacttatctgttttaatgccaacaccagactcttttgattatagtaattttgtagtaagttttcacaacttgtaggggaaataggtttccactgttcttttcaagtttcaattgtcacacacctattcttccatatgagctttatttatttatttatttatttatttattgagacagggcctcactctgtctcccaggctgaagtgcggtggcatgatctcggctcactgcaacctccgcctcccaggcttgagcagtcctcccacctcagccttccaaatagcttggacaataggtgcacacctctatgtccagctaatttttgtattttttgtagagatggagttttgccatgttgcccaggctggtcttgaactcttaggctcaagtgatctgcctgccttgacctcccaaagtgctgggattacaggcatgagccactgtgcccagcctcatgtgaactttaaaatcagtttacctaaatagaaaagaaatgatgagaatcttgttcaaatcacatttaagtttacttattaatttcagaagaattaacattgttatgacagtaacgtcactttaagaaacaggtctcgtttgatatccagagggagctaactgggaaaatgttgaaagattgaaggaaaattctgaggaactaaatgaggttagagaccatgaaattatagcaactttagcctgaatggttgagtgagtttattccaagatcgcagagtagctaagtataacagaagagaagctaaatgtctgaaaaagaacaaagagacaagggatcaaaggcaaggaattaaaaaattcaagtgtgatgacaaaggaaaagatagaaatgatgggtcagatagtctaggcgagatttttaaagaattaaaaaccagaaggtttgcaacagattggaagaaaattttgtttctgggactgtaagtctaattaaagttgcaaatgaggagcatataaagtaagagcattaataatgagctggaatagtgggaatttatggtcaaagtaagtttttgaggttaaatattttagaggtagaacacatttaagtaatgaaatctaagcaatatggaagccattgttgtggttatcagagtggattgttggaaaagagtaaaagcaaaaggtcaccagaagagagatccgttgaagccattattatagatattgaagttactgatggtagaacaaggtatgctaccagaggccgtacatcctgttctcttgtgatagggctattcactgtataagttttactagttttggcagcttcagtgaatgcaggagtatcttttttattaaatgactcttttatctggcaaaactacctctgatcagtggattgcagactattaacgtgactttcatgacattttgaacttttaaagtggcatatggccaaacattttatgaccctctaaaataacttaaaatcatagcgtctttatggtctcaaaacaagcaagctgttccaagagaaagaggaagtatctgttagtgaaaattgttgtgccttatgcttactgccaagagtttcagaatttttattaggagttccacaaagtcgttagcttttaagaagggagcatagagaaagagtttgggagagatgggagaagtgatgtggggggttcaatggagaggatgtaaaaagtaatgatgaataattaggaaagggatccacaatttctggcaaaagatttactttctacaaatgtatgtttaaagtgtcatggaaacactattacattctcttagtttgattctttttttaatgaccggaaaactagcaagttgagtagccacagaagatatttatatatgaaggtagaaaaataaaattttagggataaatagtatataactggtagagattataatgcaaaatcagttacttataacttctactggttgtagatttttcttcagtttattttgtagttatctgattcctttaaaatctcctagaactgaaatttagagatatttctaaaagaactttttataccttgcattttatctaaacaaggaactcttaaccagtgcattcagtttggcttcttgaattttaagtccttattttacttgacctccttacagcatttgacgtagttgaaactcctcattcacctgattttccttttatgtatgtggctactctctcttttttttaagtggtatcttactggctccttctctaccaaatctttaaatgtatattatgcagttttttaaatttgtaagatttagatatactacttgctaaaatagatgaagattcagctccctcacctcttttcctcccaaaactatatatctatagttgctttattggtagcttttgtaatgtgtatctaaatctctgtttttttgtttcatccactataggcaataggcctcaagtctgcatttgcaagatgagtctatcctttttatttttcccactttgtacattgcaacttctatcagctacacttttgtaatttcccttgtgatttcttctttttccagtgtttgtttaagactgcagtgtttaatttgtgaatttaccagatttgttcattgtggtcagagaagacattttgtagaatttaatctttttagattgattgagacttgctttatggctgaacatatggtctatcccagagaattttccatgcgtacttgagaagaatatgtattctgttgctgggtggggttttctatatatgtctgctagttggttttatagtgtacttcaagtcctctttacttgctgatcttctgtctggttgttctatccattattgaaggtagggtattgaagtctccaactattattgtagaactgtttcttctttcaactttgtccattttgcttcatgtattttagatgttaagtgcatatacctttataattgttgtaccttccttatggattaaccaatttttcaatataaaatgttcttccttgactctcataaaaatatttgatataaaatctatttaacgtaatattagtagctactctggctctcttttggttactgtttgcatggaatatctgtttctattctttccatttcattctatttgtgtcttttaatcctgtagaaagcatatacttggagctttaaaaaaaaaatcctggctgggagtggtggttcacacctgtaatcctagcactttgggaggctgaggcgggtggataacctgaggtcaagagtttgagaccatcctggccaacatggcgaaaccccgtctctactaaaaatatgaaaattagccaagcgtggtggtgcatgcctgtaatgccagctactcaggaggctgaggcaggagaatcacttgaacccaggaggtggaggttgcagtgagccaagattgtgccattgcactccagcctgggcgacagagcatgactccatcttgaaaaaaagaaaatcctttctgctaatttctgccttttaatttgggtagtttaatctttgaagtcctgataaggaaggacacacatctaccattttgttacttgctttctatctgttgtatatccttttttggctcctcaattcttttattgctttcttcttttgtatttaactgattttcttagtgtaccgtttttgatccctttcttgttccttttaccatacattttctagctattttcttagttgttaccctggggattacaattaacattttaatttagctagttagaattaataccaacctagttgtaatagtatataagaactttgcttctgtttaactctactcccttttctgttactattttcagaaattacgtctttaaacattgtgtgcacattatagatttataattaattttatacatttttcttctaaatcatatattaaaaagaggaattaccaccttaaaaattcagtaatactggcttttattatgcacctgtgtaattacctttcttgatgttatttcttcgtatgacttcaagttaccaactagtgttctttaatttccagagaatttcctttagcatttcctgtaggtcaggtatactagtaataaattccctcagcttttgtttatcagggaatgtcttaatttatctcttatttgtgaagtccagttttgccatatataattttgggttgacaggttttttttttctttcagcactttaaatatatcatccactactttgtggtctccatgatttctgatgagaaatcagctgtttttcttagtgaggatcccttgtccattatgagtaacttctctctcactactttcaagattgtctctttatttttgtctttcagtagtttgattataatgtgtcttggtgtggatctatgagtttatcctagtcagagttcattgagcctcttggatatgttgttttatgtcttttatcaaatttgggaagtttctggccattgttttttcaaatattctttctgcttttttttttctctcatgtctgtgcttccgaaactcccattatgtttatattggtatgctggatagtgtcccacagttttcctggttctgttcatttatctttattctttatttaacctcactcctcagactacataatttaattgacctatctaagtttactgattctttcttctgcctgctaaaatctgctgttgaaaccctctagagagcttttcagttattgtacttttcaactccagaatttctatttgattcctttttaatttccatttctttattgatattctttatttggtgagacatcattctcctggttttccttagttatttcagcatatttaaaatagttgacttaaaagtttttgtctagtaagtccaatgcctgggcttcctcagggacagtttctgttcatttctgtttttcctgtgagtgggttagtctttcttgtttctttgtatgcatcatattttttgttgaaactggacatttatgtgacaactctggagatcagatcattcttcccccctagggtttgttgttgctgcttgttttgattgttgtcttctatttttttaatgactttcctaattatttctgtgaagactgtattatttagcatgtgtacccactgaaatctctgttcttttagcttagtggtcagttagtgattttcagagattttcttaaatgcctggagaaaaaaggaaaaaataaacctctcccagactctatcgattggttctgttttgaggcactctttcactgcttatctaggcagtttaccactctgccttaaccttcattcctgcttgtgtggaacctgaagatcagccaggggttagggttagggttaaggttagtgtcttctcaggtcttttccaaacatgtgtctgaccctggacatatatgtggccttttagattccctggactcacaggagcttctcaaaactctattctcccagacatctctttccctagcctcttccttctcagcctttttggtctgtctgttgcttgctgcagctactatcctttgtccaatgtggtggcagctaatacatttttgcctttaactactttcaacaaatgccacttagaagccacctcagccctagggaagctccagggcaagtgatacaaaggcaagcccttgagctaatccttcagagagccaccaaacatgtcaaaacacacaactacaactttttgagaatatggtctgcattgcttcctctgttgccagcaatctgcaccaggaatgtgggctgttcaacttcaaggccaccaccaagctggggagtggggaatggtaacagggtaagttaagatgcttcagaactctcttattgaaattcagcagtttttcttttcttcattaagtgtttccctggttttgtaatttattagattccagatttctgaaaaagttgattttgtttttggggtttttttgttcctagcatatttgttgcttttgtggagggatggagtgtttcggagttccctactctagcatttttgctctctctttgggattccaatttggctttattctatgagttatacttttaaatttcaagattaatgtcatttatatctgttctataatcataaaactttgtcagttggtaggatttaaaacttgaaaactggtaaacagtatttaagtctctataatataacaattttttactttacagtaaagaattaagctatgtttgtctccttttccgcttcctaagccactccaagaatagtcatagcatcaaattcaaatggacccctcttcattataccttaaaagttgtccaaacccatgccacattttagtttgccccatatttgagccatgcctttcatatatagtttgtttttttctggagtttctgattgcctttttaaaaaattgaacaaagaaatttactgctgtttctacatttctgacttctagaatctactctttttgaagcctgtctccgtgatctaatttagactcatcatttgcttttgggccattctttatagtttattattttatatcatattattagtagcctttgatttttttcttgtattatgtgtctttctcatatcttcaagtatttctgtcctctcaacctctcgatggtagagttcttcggattttggtcctgggctctgtttacactctctgctttcctcctaggcagtctcgtacatgcctttgactttaaatactatttatatactgaagacacaaaaatatatacctgttcctttatggtttacccacttagattgtgtttaggaaaacaagtcctttaccacattgagattttaaaaacattctcccattttgtcttcctaaagttttaacatttggccttttttatttaaatttttattatacctgtaattgatttttatatttgaggttaagttctgatttgggtggggaggggttttccttccataggaataatcagttaccctagtgctatttattgagtgttctttcctttctcattgaactgcaatgccactctgtgagacttttgttggcagtgagagaagtaggtgggagagaccttttgcagatcttcaattaatgcccctgtgttcagtctcacttctcattcccatcctccatcatacttactgttagttgctttccagagttccactgagcaatttggctgccatctttttcttatttccagtgcatatttgagaacacagcccttttttatccttcttcatcacttaacactttttctttctagcttccagaaattttctgaaatctcctgctgccaatagtcttcccctactgcacttgttgttgttgtgggtttatgtctttttcattactttactattcttcaatggggtcttggagggagagcttttaaacacatgtgcttagtctatctgctatttttttttttgtgagacggagtctcacgctctgtcccccaggctggagtgcagtggcacaatctcggctcactgcaacctctgcctcccaggttcacaccattctcctgcctcagcctcctgagtagctgggactacaggtgcccgccaccacgcccggttaattttttgtatttttagtagagacagggtttcaccttgttagccaggatggtctcaatctcctgaccttgtgatccgcccacctcggcctcccaaagtgctgggattacaggcgtgagccaccgtgcccggctgtctatctgctatttttatctgaaagtacaaagtgaagaattttaaacattagaggttatatttctacattttctgtaagtcttcaaaaagataattaaattttatcatttgggaccctgaatgatacaatttaactatttctgaacataaaaagctagtcagagggccgcaaagtttcttacctagtgtttcgatttgttttttaatactgcatagggttttccatttttaataatcatttatatttatagtctttagtatttcataatgccaaaaaagtggatatttcttgggttacaatgtctataacctttggcttatggggggggcgtgtaactaaatgcctggaaacaagtctctatgaaaaaattatagacacaaaaagggaagaaattctctaaaactttgctatatcccactaatgatttcactattcactgtacttgggacagctctacagtaaaatgacatattgcaggtttcttttctctggcagaaattggaaagtacttggtgtaatgttttttttttgcttacattggatgcatgcagtgaagctgggttatttttggtcatttcctgtctatgaacactgtggtattttagccaacactactataataaaatataatgcatacaatgaattttcacacctatgaatgttgtaatagaaattcataaaataaattattataggaatcagcaccacttattcattgggaaaagaatcttccgaaatattttaagtctttctgttcaggcctgttacgaaaagcctaaaggttaaaaaaacaataataatcctcctaaataatgtctcttttcatctagacatttaagagtatgttctacatttagctgggctttcagagtcattattgcattgagctagtcaccctgtcttttcttagggtcctttattgaaaaggcataggatattttctggccttttttttttttttttttttttttttgagacagagtttttgaggctggagcgcaatggtgcaatctcagcccaccgcaacctctgcctcccaggttcaagcaattctcctgcctcagcctcccgagtagctgggattacaggcatgcaccaccatgcccagctaattttgtatttttagtagagatggggtttcatcatattgaccaggctgatctctaactcctgaccttgtgatccacccacctcggcctcccagagtgctgggattacaggcatgagccactgtgcccagcctcctgacttattcttatgtaaagatcaagttgaattgatgaaactttggacttaaattaaccactaaaaatcttgaagagaattcatatttgatttcattctgcctgctgttatataattaatatttcagttggagaatataattggaaatgtattggactttatgggaaaacacattttaaacagatcctccagagaagaataccagctttcttagagtacagatttagactagacagaggtaggaaactgggtcagatgaccagttacccactctagaaatctgactcacacttaattccaccctttccttcattctccagtcaaccactaagtcttacttttatttattcttgaatgtctgataaatctgtgttctcttttattaataataatcatgaaaatgtactgagctaagtatgaggcatagtttagaatatttttttctaatcttcacaacaactctgaaaatatatgtattatgataatcatttacatacaagcaaactgaaactcaaagaattgaataacttgccccagaagtcatcagttaccaatggcagatctggaatttgaactaaagtctatctcactttcttgccattgccattttgactacaccatacccttttttgttatgccagcatatggtctagttgacacttttgcaatggtctcttactcatcccctacattcagcctctccctactatgtcctccacaaagttgattgacttatctgtctgaagtggggctttgagagcagagagcatatcttattcatctttgtatccctaacaccagtacctagatccatgcatgatactttggaggtgcttaaaaacttgcattgaatataatctcatcactttttaaatttaaaaacctttttctgcttctgaaccatgcaggataaaatctgacttttcaggctcatctccagctcctactcccctccatgtttcaatgttcctgccctgtattttagtgttccagccatagaaatattgttcaacccagcaatcccattattgagtgtatacccaaaggaatataaatttctctagtataaagacacatgcacatgtatgttcattgcagcactattcacaatagcaaagatgtggaatcaatctaaatgcccatcagtgatatactggataaagaaaatgtgggaggccgaggcaggcagatcacttgaggtcaggagttcgagaccagcctggccaacatggtgaaaccccgtctctactaaatatacaaaaattagctgggcaaggtggcatgtgcctgtaatcccagctactcgggaggctgagacacaagaatctcttgaatccgggaggcggaggttgcagtgggctgagattgtgccactgcactccagcctgggtgacagagtgaaactgtgttaaaaaaaaaaaaaaaagaaagaaagagagaaaatgtggtacatatacaccaaggaatactatgcagccataaaaaagaatgagatcatgttattttcagggacatggatggagctggaggccattatcattagcaaactaacacagaacagaaaatcaaataccgcatgctcttatttataagcaggagctaaatgatgagaacacagggacacactgaagggaaagacacaccagggcctattggatggtaaaaggtgggaggaggaggaaaaaataactaacgggtactaggcttaatatctgggtgatgaagtaatctgtaaaataaacccccatgacacagtttgcctgtgttacaaacctgtacatgtacctctgaacttaaaataagagttaaaaaaagaaattattcttacataaatatattatacataatcaggttttattttccatacaaaataatgtctgtgtcaggtttgcgcatgtgcccctgaacttaaagtagtcattcctgcgcccttcttcattctgttttcccaacttctgctcctgataaaaatctgctatttatctctcaaggatcagttcaaatccaaccttcctttttaaaattgacttttcccctctggaagaattagtcattcctttctctgtgttcccttagcatatggtttaaatattcgttatatcacaataagcacattatattatatttaatatatatattcatcttcctctccgccccacccatccagattgagagctctttgagggcaaatatatcttgatttattatatccccaatgcttaacacaatatctgacacataataaattctccacaaaaacctatttgtttaatgagatattgaggtcattttagtttagaaattatatcccatgtgtttattaggttgattgcagaggaggattagagcagttatatttctgaaactatgacccagtaaaagtgagcaataattttgctatatccagaaacctttgtatgatctcagtgttgattgttcttatcaatacagatgatttagtggcatgtgccagaattcttagcacagtgttttgtagatagtgggctttgaggacatgtttggtgaatgaaagaaagaaagaattaattagttaattaattaatatgtgtgtatgtataactaaaaagatgtacccatatctgctaaggatacaaggaaaactagaagaacaatccccaaaatataaacattgtttggcaagctaagtcactttttaatggagctcagaacacactttcccagaggagcaaatttgtaaacattgaccagagtttaaggctaaactcaaaagcttccttcagaaaataactgaaatgggttaggtgttatatggcctgtttactaggtgctagtgaaaaggatgagcctgtctgcagcccaggagacttgccgtttgtttttaccaaatgggcatgtgatagctatataaattggaaattacttctgctttgttttgtaaccatgtcactgttttactgaatgtagccttgtttattatgtcacttatttcctgaagagtttacttgacaagccctttacacaaaataaataatccctttctgatgacagactttttattgtggagcttatattcttaaacttttaattatgtggaaaaagaaaagcaagacacttttaaatatatgatgtggagcaacatcatttcccaaagggtttgttgatgtttttgatacataactctgattccccatcatttttacattaaacttttttgctggttactgtggccatcaggcgtccctatgtgggtaaaccttcttgctaaacctgattctgtgtctatatcactgattctgcccctttactgaaactatagcttatggttcaaacatccttcttaagatataatacatactcattaaaaacttcatcattgtcccacttcattaattcatccaagaaatatgtattgagcagagcataggctaggagctgtactagatgttggatctactatagtaatcgtgacaaaattcaagccctcaaggatcactgtgtttagtaagagagatatagataaggcaacaagtaattgcagtacaatgtggcaagtattgtaatagcagtatgcactcttttcatcttctttgttttagtggcagtgaagctgtcctttgttctgttccagtattgattatataagcaacctcaatgagatataatctaactcaatgtatcacacaaagcacaatgtatggaactaattgttaagttagtttttcctattatcagccttcacctttctaagattattatctaagaccattcatgtactactactcattggatatttgatttttgtcacataataatcattgtcttaagtgctagtctggtagaaatcaagcctttttgtattttcttggttgcatattcacttaaagtagactgatgtcattattcatcttgttattgaataaacaaatgtgtagaaggttaactggtacctctgaaataagtatgataaacaacagggcagcgctttcttagttttatcccttaacatcattgtaaatgtttgaagatatttaataattcattcagtatacattgttaaaagctgattactagattttgggtccccaaagatgaaaaaatatataatctttagcctcactcactatctggaataacaggcaaaattgtaagcataaaattgtaatatagttatgagaagtgtgttccaggagtataccaaagaccatgggagcacaaataagagcgagacactaattttagtaggggcaaataaatactggatgaaaggagaaatcccagaaggaaaatgcagaaacaaaaaccatgctttgtttaagttttgaggttgggtaaaacaaatagttatgtctctattcacaaagcagataatatgagttggattaagatatttcatttattctctagctatgatttagatagccttatataaaaaatgtggcttctaccttggaaataataattaccaaattcagtgcagtatgagaagcatgtatatatatatatatatatatatatatatatagtgtgtatatataatataaataatgattccttttcactgtttcttatttcaaagtgaggaggaaatctacactgattttactgattataactgtagtatacactttaaaaatttcaaaaaccattgaagtatccaaaagtagaaagttagagttaccccctaatacaacctctgagaaataaactatttttagcagttattacttggttcataaacatatttttatatgtatggttcttactatagaaatactaatttgtaaactgtacttttttctagtcagaaaagtttatagattgggaaaacctatctgtgttgacatggaaagataaccataatgtagtaaacggcttgttttaaaactaaagggaatattagttatctttcatggatagaaataatttgggtttagaggtgatcttttttgttcataacatgcctcttaaattaaaatatatgattagaataatacaaaactgctagatagtctattgaaaattagtctttaatgctctaggtttaattactgaaatgaaaaaagaatataaaattgtgaagagcttttctgacaggtcattatactgttaggtattctgcatgatatctttcatttaaaattatactttgggttttccaggcctctagactcaggactcaacaatgctttacaaggtttatctgtcatagacacataccttgttgaagtggacggggatacactttccctatatggctcaggagcactggaatctctggataggaattggagtgttcaaacagcaggaatgatcacaacagtctccttcactttcatagaatttgatgaaatcgtccaagtgcttcctaaactgaagattaagtttcctaattctctggtaaatatttccttttagtagtatatttgaatattcttagtcaatgacttgtgtgttcaggccaaagacctgttttaacttgtatttatgtagtttctatctggcaggaagatttaagttttgtgttgattttcttgagctaggatttaaattagtattcataaatggccttgaagttttatgttaacatttgaaattctatctcaaaaaaaatgatcctttgtggagtagaaaaagactgatataattttattcaagttatatatttctactttataagtgattcaccttaccacatagccttatgtattcacctatggtacctggtaatggtgaaatgtatatttactgtataatttttacagttgtcccctaacaatgttgaaaataattttaatagctcattaaaattactttgagaaattagccttcctcaattatggtgtcattgtattatttagtatgcatttgtagaaactgtgatttctgtaatgagttctctcttgagtttctattattgttgtgtttttctctgtcagccaagagacttccctcacctgcctttttggtgggtttttgtttttattttcacttcattctccctaaaaaagatagttagaggtgaagacagtatgtttagaaaagagcatctagattcacagacagaatgcttgcgttaacattgcagttttagtgatttgatttttctatagccagtataactatcctacgtagtgtttggcaagatacaagtaataataactaactagttcttctcaggaaaattgtgggggcctgtatttataaagttctgaaattttcatttccagtctttttaaaaaaatttatttaatgtcaatgtaaagcatataaaatcaataattcctgaaagaatctgcattatttgatatttatgtatctttaaagaatgttggtttataagtgagactgtcatttgtagaaggagtcacccagaattcaatattggatggattccatcaatggtgcattggatgaattaaagttatgtaagtttagtacattcagttgatttaatgtaattgaaaacatatttgctaagcctaaagtttacatatttacctggggaatgattagtgaagctttaatgttaatatttcaatatggttaaaatcaatgttctgatctgtatttgtgttttatcattgcagcaccttaaattcaaggaaacaaatcttgtaatgctgcagcaatttaacgcactagcccaactccgtcgtattgaccagttgacaattgatcctcaaggaaatccagttgtcaattttacactctggaaatactatgtactgtttaggctaagccatttcagtatgcagaaaataaatggaacagaggtaagctaaaaactagatgaactatagaataaaaatattccttcttagtgaaaatagttactttaaatgtttaggaatttaagtaaccatgatagaacatttgagatataatggttttttttaaattgacatttaaaatgtcaaaaggctaagaatctattttaaaacttccaaagaactaaataaattgtaaaaataaaatagtaaccaggttatagtaaatggcaaatacttatactgttgtttgtaagcattcagtgaaataaaatggtggggtgacagttaaaaataaaaataaaaaataactcttttataagtaatgtgatctttgtatttctcaaagtactttgcagactgcctgctatgcaagaggggataaggaagtaaaacctaaatgtcaactaataagggtattgtggtagagaaagggaagaataaaatggaaaaaaaaggggaggaagaagatgacttacaaaaagaagagatgaaaaggagaaataagccaggaagaaagataaaataagagaaagtgaaaataagagaaaaagaaaataaaataagtataagtaaatgtctggaaagctttgttaatagctggtagcaaccactgtgccatgactacattgggtaactcaggtctggagctgaatagctggaaaattattagtgaaaagttatttttagattgattctgctaagcttgtcacaaggtaatcccccagctactcaaaagccatgttcttttaaaatattaatttggaaggaaagagagaagctatgcttccacctctactaaatttaaacactcctccagaggaaaaaaaaaacatctttaatatgttgttagtcttattacaatatctcttgaaattcagaagacctctttattgtaagattaactgtaatcaactttctggcacagtaactgtgtttccctgcagctgatacagtacaggtagatacttaactccaaaaattcagcatactatgaggagactgtacatctctggatcaatgtacaagcagctatatgaaatttgcatcaaccatggtatttctgtaacctcagaatcagccatctgctgaagatgttgggtaaatctgaatcttcagatgacttttaatttctccagctagttctcaagagggttggctcagtcttgtgtactcatgtatactatttggtacttcccccgaggtgaggttgtgagtccctggaaggacctaataattagtcctaaaggttttcaaagttagcccagactggaaatagaatggttatttttactgtgggtgactgagtctcccttaattgaggtaacacaccgttacctcagttaaccctaaatggtgtatttacccagatatggattattactagaataatacccattattatcaaactttgaatcaggaaggaatagtgtagttatataaagtggagaagaattagaaagaattagaaagaaccaatataatttattctgatttaaatttctgaaaatctcaatgccagggatatttgacactttattaaaatacctaaaatatattcctgtttgttaggtccttgaccttagatagtaatgttacactgcatttttacttctctgtgtataaaaaagaatgatattgcttgaggtagaattaaattgaattaatagcatcaagaaaacatggagtagtggcctgcattggccactaggtgactatattggaccaaacactacttagttattagctaaggaagaatttgaagtctccttaactgtgaagatccagggaagggaagagagttagcctgcactgattcataggtatgtttgtgaattattggtttgttttaaagaaaatgcctgtgaagagtattacagatagtgtcaggaacaaattttcaaaagatccaaaatttaattataccagggtttctaaaccttggctctgttgacattttgagccagataattctttgttgtgggggctgtcctctgcattgtgacatgtttaacagcaaccctggtctctacccactagatgcccgtaatgtccagaaataactaaacatgtctccagacattgccagttgttctgtagggggcaaaatggctcttggctgggatcattgaattatatatagacaaaaaaacagtatttaaaatgtaagcaaccctattttatattaaagaaaatatccccagatagtaatacaggtactgctttcagcttttagtactttcttggttaatgtaagaatgggtcctcatagggtatacttgtgacaagttattctttttggggagaaagactgatagaatgaacaggagcatccttgctaattcagtgaaagttccatctctcaggaagggacaaaattatccctataggagcaaggtatgaccaacaccttggcttacctttgacacattattaaaatgaatctatcccattgatacttgggaattttttcctctaaatcattctaatccaagaagctataggatttctgaaaaaaaaaaatactaaaaattgaaggtacctcaagtgtaattctcaggaaagacagcttctaaatcagagctgactcatcacctccaatcagcttccatcatcatgaaccacaattatacgtcttcattttaactcaagaaagaaaaatatcaatgaaaactcttctttccacagcacaggagaatgtgcttttgtgggcttaaaagataatatttaatttggatctctctttgggattatatcagttttattcagctaagagttggtgtcatttttttacccctttctattgtgtctcttcaggtgacacagaatgatatgataatggctgaaaggctctttggaatcctagcacatgtagcatcttctgagttaccccagtatcgtctgatttccattctgggtgatgccaggtaacctttaatttttgtagttttttatagaattactgttacactagaaaaagaaataaattccacatacctcctaactatgctaattatgtgttccataaacatgtatcctagactggcctattgaaagtgttggggatcttaagataaataagatgaagtccttattctcgtatggcttatagtctaataagttaaagatatacacatacaattaaaacgtaatgtttcaggtgctataagggagggctgtaggagggactaaccatattttggaataacactggggaaggcttcacaaaggagaaaacattttatctagttctttgggaatgagtaggagttttcaggtagaggatatggggaaaagatatctgcaaaagcacaagtaattgtaaatagctcagtataattggaacatgggatgattatgaataaatgataggaaatgaagctagaaagactgattgtggtctgactttgaagagctttccaatccatgccaagcaaaaatgaaaacttgtgttttgtaatgaagcacaagcaatcatataattggatttacattgtagaaaggctgccatttgagcaggcagagcttgaagtaatgaagaccaatcaaatggttactctgtaggccaggagagattatgagggcctgagccagggcagcaagatggagaagaggaaacctgacagaacacactaactgacgaggtggagcatggatgaagaaatagtcaaggatggttgaccagtcatgattcagttacagatcatacaagtcactctggttagagtaagcaaggaattagatatctacaaaatatttgaaagcgttgaggaagcagtttctagactgagcctccagagatatctcccagaattataccatagaacaagcccacaaaggaaactgcctccttgctatggtcatggagcactttgctacagtcaaggacaacaggagactgttgtcccagctgtgagcaccaggatcataccgctttagctgcgctgaggatcaggaagttccctactctgctccccagaatctggctccagaaccatgttaccctactataatttacactaacaaagtgagtcttttgcatgctactcctacttccccacttagcccagttctgaattcaaatcttacccaagtgtatcggattgatggaatataaatcccatctaaaacccacaaaaccattctgaaaaaaaaggaggcattgaattcaagaaacaatgatgtagaaagaaatcggtaaaaattatagttgtctgaataagtattaatgtataatgttaaaaagattaaataacctacaaggaaaaatccaagaaaatcctaagagaatgtaagttaaagtttactttctttccctgtttaggtgagataataggtactaattaacaataaaaattgatggaaaaatacacgtttgtgtgtattaaaatattaagggttttcatagaaaaagattagatggataatttctaaactactaaaaggaaaaaagtgatcaacgaaaagcaggaaggaaaaaaaagcatttgggttatcaccataaatattaataaagtcttctattaatagatgctctcagattgaattaaaaacatgtttttcagagatacccctaaaaaacccctaaaggcttaaaagaaagggatgggaaatatataatgaactaaatgccaacaacaaacagatacaggaatattagtggttaataatgatagacttgatgacactaaaaactacaatccaccagaaaatagttatgaaacagtgtaactaagactacagcttttaaacatatcaacaaatacaggcatatattgacaaatttttcagttattataatagtcattaatatgcttctttcataaatcagatcaaatcaactaacataagaaagactatagaggatttgcataacatagttaacacattttatcaaataaatatacttaaaatcttgtgttgacaaccttattcccaattcagaaaaaaacatatattttattcaaacatctatggaatgtttgtaaaagttgaacatctattaaactgaaagtaaatcttcaagtatctcaaaaagcatactcatacagatcacattttctaatcataatattataaaattagaaaataatgggtcaggatagccaaaaacttatctagttggaattgggatgggtagtggggtagacagtggacacaagcttccagaaaacaaaatacaaatgcctttaaactttaagaagaggatgtttggtcaaagttatagacaaccaaattttaaaataatgagataactttgtgggaaaagactagaagtttgatgatatgcagcggcagtcctcaacctttttggcaccagggactggtttcgtgacagacaattttgccatggacggttggggctaggggatggttttggaatgaaactgttccaccacaggcattagattctcataaggagtgggcaaccaagatccctggcatgtgcagttcacaatagggtttgcgttcctatgagaatctaacgccactgctgatctgacaggaggcggagctcagcggtaatgcttgcccgcagttcaccacctgctatgtggcccggttcctaacagccatggacaggcctgaatagcacagttatttcaccatgctatatatcggggtctccaagccccaggctgtggactagggctcgggaacccctgatatacagcatagcaaaatagagttcttacatacttttggtggtaatgaaagttactgtaatacttgttcatagtaacttagcaatatctaataaattgtaaatgcacatacctttacacttagcaatttcacttaaaggaatttgttctacagataattttctttacatgagcacaaatatctatgtgcaaggattttccttgcagccagtgtttatattagcaaaaatatgaaaactcactaaatgtccatcaatagagcgagacgaattacttgcagctctaaaaataattggatgttcttatatgaaacggttaaggtgtttcagaaaataaaaatataaggtacagaacaattgtatagtatgctgcaatttgtgagaaatggggcatatgtgtcaaagatactcttgtgcaatttaaaaatatttgattttttcaatatgcttgcctctaagtgttgaactggagggagacactaggattccaaagtacatagatactttttactctatgtttctatgaacctcttgaattatcttcttgctttttgttctatcttgtttttttattttttatcctttttaaaaaagcatttaaaaatactttaatgcttctgaattaaagaggaaataaagctaaaataataaatcatatataaatgaatttgataataagaatactatatgtcaaaacctctgggatgtgaccaaagctgtgctgacaggaaattatacatctttaatgtacttattagaaaacaagaaagattagaaagtaatgaatgaagcttttacttcaggaacctagagaaataccaaagtaaggcaaaattttaaaaaatggaaaaaagaagttcataaagataatagcagcttctaaagaaataagaatttgaaagagaatagttgaccaataaaagcaaacactgacgctccagaaaatccaagaattcaactattacacttttggaattaattggaatatataacaatgaggccagatactagattaacatatcaaaataattaatatttcttcataccaataataagctgttgaaaatagtattagaaaaagtaccccatttatagaggcaaagaaactatgaaatatcagaaaatacaccttataaaaagtaactctgacatacacaataaaattgggaacaggcctggcatggtggctcacgcctgtagtcccagcactttgggaggctgaggcaggtggatcacttgagcccaggagtttgagaccagcctgggcaacatggcaagactccatctctacaaaaaatacaaagactaaccaggcatgtggctcgcacctgtggtcccagctacttgttgggcttgaggcaggagggagaatcacttgagcctgggaggctgaggctgcagtgagccatgatctacaccactgtactctgatctgggtgacagagcaagaccctgtctctaaataaataaataaataaaaatacaattaggaacaaaaaggaagcttaaaaatgaatatttacaatgttaacaaattccaagacttaatattgtaaagatgccaatttatcctaattaaattacaaatttacttaattcccaatcacaaatcccaatatgatttctcaggaccctaaaacaagatacattttatatcttagaaaggcatttatcatctcatgttaatgaaaatgttctactatactttctcatacttcctgaaggtttgtaacatgtagctcacaaacatttttacagttttatatgatgaaatacatcataaagtgaaaatacataagcagacaggagaatatatttgcagcatgtttaacagaatttttaagaaatcctacaaatttagtaagaaaaaagacagttgagataatagaaaaaaaaaggcaaagcatataaagagaaaactcacaagaagaaatatgaatagccagaaaatgtaagcccaactcacttctcatcagagaaatacaacttaaattaaaataatgcgatgtcatttttgccaatgagattgacttaaaaatttaaaaaccaataatatcaatgacttattagtattcaggacaatgtacactgtacatgttggtagaagtgtaacatgacttttggtggaaggtagtttcacaatgtctatcaaaatttaaagcatacatatatttgaacccagtagttttagtactaggaatatattctaatgaaatacacatatgcacaagttatttatgtagtaagctgccatgctttattgtttgtagttacttaactttggaaagtaaccaaatgccaaataattggtaaaactaagtatatcatagtacttccacatttatagatgtagaatctatatgatactgtttatattacagtagataatatgactgtaaaaggaggaggaggagggggagaaagattgaggtaaatctcctgttctaacatgaaatgatccagagacagttcattgaatgaaatatggcataaaactatttatattatgacccaatgttatttaaaaacaacataataaatatgtagacattaaaaatatggaaacacagaaagggaactgacaggatgaacacctgggaggatatagatatgaggagtaaggtagagtagttgaagagtgcttttcaggttttattctatgtctgtacggtttgaaaagagtagtttttgagttttaatctgtataagattaggaatatattgaacttctatttctgacaatgatgagtttggttgtttttaccatttcttgagttaaaaacaatacaaaatgctagacaaaataaaaaccttcattaaagttttggggagctggtaaggtataacataattactaggccaggatctatgggaaaatgagaacattgagaattaaggtagacacaaagctcttagaaccgaacttacttttcctgctcttacacaccattcaacacagatatgtgagggggttttccctacacactagccaggcaattcagcagcagacaccagctgggtgccctctaattcaatttaattctgacactgcctacctggagatagtgtcagatcctacaggttgaaagatcattcccacaagacggctcctccccaccaaacccagcctccctacatcacatgccagttgcaagcactagttgtgacctgtgcttctgactgaccagctaagaattgagattctgacaacccccttcttggggggttctattaatttgcttagagtggctcacagaacacaaggaaacactttaattacatttacccgtttattataaaagatattacaaaggatacagatgaacagccagatagaaaaaatgcaaagggcaaggtatgtgggaaggggcacagagcttccatgccctctccaggcataccacccttcaggaacctccacatgttcatctatccagaagttctctgaatcttgtccttttgggtttttgtggagacatcattatgtaggcatgataaatgaaatcattggctattggtaatcaagtcagttttcagctcctctcccctccccagaggttggggatggggctggaggtcccacccctctaattatgccttggtctttccagtgaccagcccccatcctgaagctatctggctcacacaccccagttaccagccatctcattagcataaaaaacattctcgttactcttgcaattccaagggttttaggaactttttgccaggaaatgggaatggagagaatacagggatggacaaagaccaaatgtatattttatcatatcacagagactgtttgatccagaggcatttcaaggaaacataaatttttgttctgctagtctagaacagtagaaatgatggaaatcaaagcccagggctccatctaaaatggtaaatgtgaattgacgtcttcctaagggttaaaatgaaaccccagtggctataccatcaggtcagaaataaacctacctcttctccccactcaggaatttccaaggaaggttgccttgatatgagcagaaaagaggaaagttgtccctaagcaaatgtaaacaaaaagcagtcctcatatagatgtgcagcctgaattcataacacataactagtttaaaataatataaagatttaaatatcactgtctctaaatatctggaaaaagcaaatatacctcctctctggaagaagttactttcatcttgtctcaaagaatcctcatggctaatttttaagggcaattaccagcatacaatgaaaaaataaataaccagtcacacaagaaaataagacatcatgtaaaagaactggaaggaaaaaatagattacagaaacagacccatgaatactttaaatattggtattatcatgcatagactataaaacgactgtgcctgctatatctcatgatatacaagataagcatgaaaatatctgaagagaataagaaattgcaaaaagtgatccagaagacctgaaaggaaaccaaaagaaattatataaatgaaatatgtaatacacaaagttaaaatttaatgaggaggcttaacagctgactagacacagttgaaaagagatccataaactgagaaacagactagaagagattttctggaatgtagtacaaaaagaaaagaagatagagtatatgagaaagtggctaagaaatttggaggataaagtgagttgggaggtttaacatctgactgaagtttctaaaagacacaatggagagcatagggtagagtcagtattaaaacagataatggcaaaaattgttcagaactgatgaaatacacaaactacatattaaataagcccagctaatcgcaaaaaggataaatgaaatctacacctagtcacatcacagtgaaactacagaactctaaatataaggtgaaaaaatttaaaaacaaccaggaaaagagaagttaccttcaaaagagtggagatcaacaaattgatttcataacagcagcggtggaagccagaagataggataatgaatgatatgttcaatgtactgaaggaaattaccaacctagaattctatgcacagcaaatatgtcttttaagaatgaaggtgaaataaagacatttgaaacaaaataataaaaacaaaatctaagagaattcccattagtattcttacactaaaagaaattataaagcttataattaaggcaggacagtgaccccagttagaaggtctgagatgcaagaaaagctaaagaacaaggaaagtactaactatgttggataaggctaaatgaacattgaccatataaattaggagtatccaatcttttggtttccttgggccacattggaagaagaattgccttgggctacacgtaaaatacactaacactaatgatagctgatgagctagaaaaaaatcacaaaaaaaaaatctcatgttttaagaaagtttacaaatttatgttgggccacgttcaaagccatcctggatcccatgtagtggcccgtcagccacaggttggacaagtttgatatagatcaacagtaacaacattttgtggggtttaaaaatataaaattaaaatacactgcaacagaagcatatgtagtcggaaggagtaaatggagatattgtattctaggacctcgtattatctgggatggagataaatatagtgactaactttagatattagtgggttaatgttgttcatgttgtaatttctatggtaaccaaataataagcaaatatatagcttccaaattagtaaggtaaggcaaagagaaaacgaaaaatagaacatgtggattaaacagaaagaaatgaaaatggtagatttaaacataaatagtggtatatcagcatgtatgttcctgtcactttgccagtactgtgtgacaaacaccccaaatcttagtggcttaaaacaggaagcatatatttttttctttgagactataggtcagctaggtggatcttatgccttcagctggggtcctcatgtgtcagtagtcacctgtggattggataggcggctctgctgatcaaaccttggctctctcacttgtttgagggttggctggctgtaacctggtctaggaaggccttagctgggacaacctgtctctgctccacatggtctctcatactccagaaatctgcctgggcttgttctcatggcagaggcagggttcaaagaaaaagcagaaacatgcaaggcctcttgagtcctatgctaagaactgacataccatcatttcacccacaaacttttggtcaaatcagataacagagcaacacttaaggggcctgagagtaggccttacgtaattgtaaaatcacattttaaaggacgtggatgcaaggaagccataatacaaccatcaatgtaatgaatccacctcaatgataaaatgcaaatatattaattgttctgattaaaatgcaaagattagccaggcctggtggctcatgcctataatcccagcactttgggaggctgagacaggcagatcacctgaggtcaggagttcaagaccagcctgttcaacattgtgaaaccctgtctctactaaaaatacaaaaattagctgggtgtggtggaacgtgcctgtaatcccagctactcaggaggctgaggcatgagaatcacttgaacccaggaggcagaggttgcagtgagttgagattgtgcaactgcaccccagcctgggtgacagagcgagaccctgtctccaaaaaaaaccaaaaaaataaaatgcaaagattgtcagactgaataaaaaaatgaagttcaactatatgttgtttacaagagatacatctgacatatgtttacataaatattgaaagtaaaaaagtgagaaaagataaacaacataaatacttaccgaaataaaaatggagtagctattgaggactcaatagacttgaaagttgaaagtaatactagaaataaaaaggatcatttcaaaatgataataggttcagttcactagaaaaatataggacatttaaatttgtatgcacttattagcataaccttaaaaatgtataaccccaaaattgacagaactacaaatccacaattacaattagtggaaagttttaacacatctctgagtaattaatagaaaaaggatataaaatgcttgaataatgtgataaatttgacctaattaccacttagagaacattgcccccagcaactgcacattcttgtcaagcatacatggaacatttataaaaattgaccaaatactgttcataaagcaaatgtcaagagattgcaaagaattgaaatcacatggagcatgttttctattcaaaatgtggtcaatctttaacctgattacaaaatgataaccaggaaattcccatatatttgaattaagaaacacatttctaaataacccacaggttaaagataatttcataatagaaatctgaaactaccttgaactgaaatataataaaaatacccatttcaaaacttgtgggatcaagttaaagtggtgctaaatggaaacagccttgcaatgggtatagtgggaaagaataaaagctgaaagtgaatgcgctaaaacacttatctcaccaagatagcaaaagagcagcaaaataatccagaagaaagttaaagaaaagaaatgatgttcaaagagtattaatgtaaagctgattatgtgaaaagactaataaaagtgataacaaatgtgtacagacattgcttctgtaattttaaaaaaatcagtaaagataataaatggaaataggggccaagatggccaactagtagtagctgtggttggagactcccactgagaagaacaaaaatggtgagtgaatcctgcaccagcaactgaggtatccaggccctcttattgagactgacttgggcagttggcacaacccatggagagagaggaaaaacagggtggtgcgatggcccacctgagagccacacagggcaaggggagctcccacccccagccaagggaggcattgagtgattgtgctaccctgcctgggaaaccacaatttttccatggatctgtgcaacccacagatcaggagatcccccttatgagcccatgccaccagggccttggatctcaagcacagagctgtgcagattctcagtgaccactcggctggagactgcctaagactactgagttcctcgggggagaggcagtcaccatcactgaggctgcctgctgcctaagacaactgaactccttgagggagggacagaggccatcactgcagctgcctgctgcctaagacgactgagcttcccaggggaggggcagatgccatcactgcatctgactgctgcctaagaccactgagctcccagagacaggaatggcagccatcactgcagtaacccatccctgcttactaggtagggcctccctgcaggaatttcagcaactccagccaggggtttagggacagacctctgatctccctgggactgagcccctgaggggcagccacagtctccacagatcagccgatttagtctttctcctgctggctctgaggtatctgggtagtccagacaagtgggattcctcccagtgcagtgcaccccttccactaagggacagccagagtgcttcattaagcgggtgctggatcccatgcctcctgactgggtgagactcccctcaacaagggttgccagacaccttatactggagcattcccactggcatcagattggtgcccttctaggacagagaccccggaggaaggagcaggcagtcatctttactgttttgcagcctccactgatgacacctccaagtgcaggagggacccagttgaatagtgtctggagtggaccccccacaaaccacagtagccctacagaagaggggctgactgttgaaggaaagcaacaacaacaacaacagcataaacaaaaaagtccccataagaaccccatccaaaggtcagcagcctcaaagatcgaagataaattaactcacgaagatgagaaagaatcaatgaaaaaaaaaaacattgaaaactcaaaaagctagaatgcctctcctcctccaaatgatcacaacacctctccagcaaggacacagaactgggtgaaggctgatttggatgaattgacaaaatagtgcaaagaagccaagaaccatgctaaaagattacaggagctgttaaccagaataaccagtttagagaggaacatagcgacctgatggaactgaaaaacacaagaacttcacaatgcaaccacaagtatcaataactgaatataccaagcagagtaaagaatttcagagcttgaagactgtcttgctgaaataagaaggcagacaagattagaggaaaaagaatgaaaaggaatgaacaaaatctctgagaactatgggattatgtaaaaagacaaaacctacagctgactggggaacctgaaagagacagggagaatggaaccaagctggaaaacatacttcaagatatcatccaggagaacttcccgtacctaacaagacaggctaacattcatattcaggaaatccagagaaccccagtaagatactccatgagaagatcaaccccaagacacacaattatcagattctccaagattgaaatgaaggaaaaaatgttaagggcagccagagagaaaagccagtcacctacaaagggaagcctatcaggctaacagtggacctctcagcagaaagcctacaagccagaagagattggaggaaaagccattaccagccactgcaaaaacacactgaagtacaaagaccaatgacactatgaagcaactacatcaacaagtctgcaaaataaccagctagcatcatgatgacaggatcaaattcacacaaaacaatattaaccttaaatgggctaaatgccccaattaaaagacacagaatggcaagctggataaaaagtcaagacccatcggtgtgctgtattcaagagacccatctcatgtgcaaagacacacaaaataaaataaaatgaaataataaaataaaacaaagggatggaggaaaatttaccaagcaaatagaaagaaaaaaaaaaacaggggttgcaatcctagtttctgacaaaacggactttaaaccaacacagatcaaaaaagacagagaagggcattacataatagtaaatggatcaaggagagctaactatcctaagtatatatgcacccaatacaggagcacccagattcatgaaacaacttcttagagacctacaaagagacttagactcccacacaataatagtgagagactttaacaccccactgtcaacattagatcattgagacagaaaattaacaaggattttcagaacttgaactcagctctggatcaagtggaccttatagatatctacaggtatttctcctaatgttattccctcccttagccccccaccccctgacaggccctgttgtgtgatgttcccctccctgtgtccatgtgttcttatttttcaactcccacctatgagtgagaacatgcagtgtttggttttctgctcctctgttggtttgctgagaataatgacttccagcttcatccatgtccctgcaaaggacatgaactcattcttttttatggctgcgtagtattccatggtgtatatgtgccacatttttttattcagtctatcactgatgggcatttgggttggttccaagtctttgctattataaatagtgctgcaataaacatacatgtgcatgtgtcttcgtagtagaatgatttataatcttttgggtatatacccagtaataggattgctgggtcaaatggtatttctggttctagatccttgaggaatcaccacacagtcttccacgatggttgaactaatttacactcccaccaacagtgtaaaagaacttcaccccagcctgggtgacagagcaagaccctatttctccacagcttcgccagcatctgttgtttgttgactttttaataatcgccattctaactgacatattatctcattgtggttttgatttgcatttctctaataaccagtgatgatgagctttttttcatgtgtttgttggccacataaatgtcttcttttgagaagtgtcttttcatatccttcacccactttttgatggggttgtttgtttttttcttgtaaatttgctttaagttccttgtagattctggatattagacctttgtcagatgggtcgcttgcaaaaattttctcccattctgtaggttgcctgttcactctgatgatagtttcttttgctgtgcagaagctctatagtttgattatatcccatttgtcaattttggcttttgttgccattgcttttcatgttttagtcatgaagtctttgcccatgactatgtcctgaatggtattgcctaggttttcttctaggggttttgtggttttaggttttacatttaagtctttaatccatcttgagatactttttgtaaaaggtgtaaggaaggggtccagtttcagttttctgcatatggctagccagttttcccagcaccatttattaaatagggaatcctttccccattgcttgtttttgtcagatttgttgaagatcagatggttgtagatgtgtggtgtaatttctgaggtctctgttctgttccattggtctatatgtctgttttggtaccagtaccatgttgttttggttactgtagccttgtagcctagtttgaagtcaggtagcgtgatgcctccagctttgttctttttgcttaggattgccttgcctatatgggctcttttttggttccatatgaaatttaaagtacttttatctaattctacaaggaaactcactggtagcttgatgggaatagcattgaatctataaattactttgggcagtatggccattttcatgatattgattccttctatccatgagcatggaatatttttccatttgtttgtgtcctctcttatttcctatttgattatttgtagttctccttgaagaggtccttcacatcccttgtaagttgtattcctaggtattttattctctttgtagcaattgtgaatggtagttcactcatgatttggctctgtgcttgtctgttgttggtgtataggaatgcctgtgatttttgcacattgattttgtatcctgagactttgctgaaaagttgcttatcagcttaaggagtttttgggctgagacaatggggttttctaaatatacagtcatgtcgtctgcaaacagaaacaatttgatttcctctcttcctatttgaatacactttatttctttctcttgcctgattgtcctggccagaacttccaatactatgttgaatagcagtggtgagagagggcatccttgtctcgttacagttatcaaagggaatgcttccagcttttgcccattcagtataatactggctatgggtttgtcataaatagctcttattattttgagatatgttccatcaataaccaatttattgagagtttttggcatgaagcgatgtttaattttatcgaaggccttttctgcatctgttgagataatcatatggtttttgtcattggttttgtttatgtgatggattacgtttattgatttgtgtatgttgaaccagccttgtatcccagggataaagccaacttgatcatgctggataagcttcttgatgtcctgctggattcagttggccagtattatattgaggatttttgtatcaatgttcatcattgatattggcctgaaattttctttttttgttgtgtctctgccaggtttcagtatcaggatgatgctggcttcataaaatgagttagggaggagtccttctttttctgttgtttggaatagtttcagaaggaatgctaccggctcctctttgtacctctggtagaattcagctgtgaatccatctggatctgggcttttttggttggcacactattaattactgcctcaatttcagaagttgttattggtgtattcagagattcgacttcttcctggtttagtcttgggagggtgtatgtgtccaggaatttatcagtttcttctaagttttctagtttattggcatagagatgtttatagtattctctgatggtagtttgtatttctgtgggatcagtggtgaactcccctttatcattttttattgtgtctatttgattcctctctcttttcttctttattagtctggctagcagtccgtctactttgttaatcttttcaaaaaaccagctcctggattcactgatttttttgaagggtttttcatgtctctatctccttcatttctgctctgatatttgttatttcttgtcttctgctagttttagaatttctttgctcttgtttctctagttcttttaattgtaacgttagggtgtcgattttatatctttccagctttctgttttggggcatttagtgctataaatttccctcttaacactgctttagctgtgtcccagagattctggtatgtgtctatttgttctcattggttttaaagaacttctttattgctgccttaatttcattatttaccgagtagtcattcaggagcagattgttcaatttccatgtagttgtgtactattttcccagtagtcattcaggagcagagtgttcaatttccatgtagtcccatgcagattgttcaatttccatgtagtttggagtgagtttcttaatcctgagttctaatttgattgcactgtggtgtgagagactgttatggtttctcttcttttgcatttgctgaggagtgttttgcttccagttatgtggtcaattttagaattcatgctatgtggtgctgagaagaatgtatattctgttgatttggggtggagagttctgtggatgtctattaggttcgcttggtccagagctgagttcaaatcctgaatatccttgttaattttgtgtcttgttgatctgtctaatattgacagtgggctgttaaagtctcccactgttactgtgtgggagtctaagtccctttgtaggtctctaagaagttgttttatgaatctgggtgctcccgtattagacgcatatatatttaggatagttagctcttcttgttgcattgatccctttaccattatgtaatgcccttctctgtcttttttgacctgtgttgatttaaagtctgttttatcacagactaagattgcaacccttgctttttttgctttccatttgcttggtaaatatttctccatccctttattttgagcctatgtgtgtctctgcatgtgagatgggtctcctgaatacagcacaccgatgggtcttaaccctttatctgatttgctagtctgattattttaattggggcatttagcccatttacatttaaggttaatattattatgtgtgaatttgattctctcatcatgatactagctggttattttgtacattagttgatgcagtttctacatagtatctttggtctttatattttggtatgtttttgcagtggctggtaccaatttttcctttccatatttagtgctttctttaggagctcttgtaaggcaggcctggtggtgacaaaatcccttagcatttgcttgtctgtaattttatttctccttcacttatgaagcttagtttggctggatatgaaattctgggttgaaaattcttttctttaagaatgttgaatataggccaccactctcttctggctttcagggtttctgcagagagatccactgttagtctgacgggcttccctttgtgggtaacctgagctttctctctggctgcccttaacattttttcctttgtttcaaccttggagaatctggggattatgtgtcttggggttgctcttcttgaggagtatcttagtggtgttctctgtatttcctgaatttgaatgttggcctgtcttgctaggttggggaagttctcctggataatattctgaagtgtgttttccaacttggttccattcactccttcactttcaggtacaccaatcaatcgtaggtttggtcttttcatatagtcacatatttcttggaggctttgttcattccttttcattcttttttctctaatcttgtcttcatgccttatttcagtaagttgatcttcaatctctgatatcctttcttctgcttgaaagattcagctattgatacttatatatgcttcatgaagttctcgtgctgtgtttttcagctccatcaggtcatttatgttcctttctaaactggttattctagttagcaattcctgtaaccttttatcaagaacattgggttagaccatgctcctttagctcaaaagagtttgttattacccatcttctgaagcctacttctgtcaaattgtcaatctcattctctgtccagatttgtgccattgctggggaggagttgcaatcatttggagaaggggcattctggttttgggaattttcagcatttttgagctggtttttcctcatctttgtggatttatctacctttgatctttgaggctaatgacctttggatggggtttttgtgtggggatcctttatgttgatgttgctttctgtttgttagtttttcttctaacagtcaggccccttttttgcaggtctgctgcagtttgctggaggtccactccagtccctgttcacctgggtatcaccagtggaggctgcagaacagcaaagattgctgcctgctccttcctctggaagcttcgtcccagaggggcattggcctgatgccagccagcactcttctgtatgaggtgtctgttggcccctgttgggaggtttctcccattcaggaggcacgggggtcagggatccacttgaggaggcagtctgtcccttagcagagctcgtgcactgtgctgggagaatccctcttgtcaggatcagctgctgtcttcagagctggcaggcaggaacgattaaatccactgaagctgtgcccatagccaccccttccccaggtgctctgtcccaggaagatggggattttgtctgtaagcccctgaatggggctgttacctttccttcagagatgccctgcccagtaaggaggaatctagagaagcagtctggccagagtcactttgccatgcccagcccagacctcccagcctccttagcactgtcaggggaaaactgcctactaaaacctcagtaatggtggacacccctccccccaccaagctcgatcatcccgggtcaacttcagcctactgtgctggcagtgagaatttcaagccggtggttcttagcttgctggactctgtgggagtgggacccactgagtgagaccacttggcttcctggcttcagaccgctttccaggggagtgaacggttctgtctcactggggttccaggcgccactggggtatgaaaaaatactcctaaagctagttcaatgtcttcccaaacagctgcccagttttgtgcttgaaactcaggaccctggtgatgtaggcacatgagggaatctcctgatcagcagattgcaaattaatgggaaaagtgtagtaacccagcggggtagcacagtccctcacggcttcccttggcttggggagggagatccctggctccttgcacttcccaggtgaagtgatgccccaccctgcttctgctcaccctctgtgggttggacccattgcctaaccagtcccaatgagatgaactgggtacctcagttggaaatgcagaaatcacccgccttctgtgttggtctcgctgggagctgcagactggagctgttcctattctgccctcttggttccttctattctgtactatttcttccaaaactattccaaacaattgaaaaggagggacttctccctatctcattttatgaggccattatcatcctgataccaaaacctggcagaggtacaacaaaatagaaaacttcaggccaatatccctgatgatcattaatacaaaaatcttcaatcaaatactggcaaaccaaatcaagcatcacatcaaaaagcttattcaacaccatcactttggcctcatccctgggatgcaaggttggttcaacataggcaaatcaataaacgtaattcatcacataaacagaactaaagaccaaaaccacatgattatctcaatagacgcagaaaaggccattaataaaatttgacatcccttcatgttaaaaactttcaataaaccaggtattgatggaatgtacctcaaaataataggagtcatttatgataaacccatagtcaatatcatactgaatggtcaaaagctggaagtattctccttgaaaaccagcagaagataaggatgccctctctcactactcctattcaacatagtattggaagttctggccagggcaatcaggcaagagaaagaaataaagcgtattcaaaaaggaagagaagaagtcaaactgtctctatttgcagatgacatggtcctatatctagaaaaccccattgtctcagcccaaaagctgcttaagctgataagcaacttttcagcagtctcaggatacaaaatcaatgtgcaaaaattgcaagcattcctacacaccaatattagacgagcagagacccaaatcatgaatggactcccattcacaattgctacaaagagaataaaatgcctgggaatacagctaacaagggaagtgaaggacctcttcaaggagaactgcttgttctattttcaagaagaactacaaatcactgctgaaggaaatcatagaggacacaaacaaatagaaaaacattccatgctcatggataagaagaatcaatatcatgaaaatggccatactgcccaaagcaatttacagattcaatgctacttccattaaactaccattgacattcttcacagaattagaaaaaaactactttaaaatttatatggaaccaaaaaagagcccatacagccaagacaatcctaagcaaaagaacaaagctggaggcatcaagctacctgacttcaaactatactacaaggctacagtaaccaaaacagcatggtactggtaccaaaacagacacatacaccagtggaacagaatagaaatctcagaaataagaccacacatctacaaccatctgatcttcaacaaacttgacaaaaaccagcaatggggaagggattccctatttaataaatagtactgggaaaactggctagccatatgcagaaaattgaaactggaccccttccttacaccttacacaaaaattctcaagatagattaaagacttaaatgtaaaacccaaaactataaaaagcctagaagaaaatctaggcaataccattcaggcataggcacaagcaaagatttcatgacgaaaacatcaaaagtaattgccacaaaagcaaaaattgacaaaggggatctaaacaaactaaagagcttctgcacagcaaaagaaactatcatcagagcaaacaaggcaacctacagaatgggagaaaatttttgcaagctacccatctgacaaaggcctaatatccagaatctacaaggaacttaaacaaatttacaagaaaaaaacaaaccccatcaaaaagtgggcaaaggacatgagcagacacttctcaaaagaagagatttatgtggccaacaaacatatgaaaaaaaggtcgacatcactgattattagagaaatgcaaatcaaacctcaatgaaatactatctcatgccattcagaatgacgattattaaaaaatctagaaacaacagatgctggagaggatgtggagaaataggaatgcttttacactgttagtgggaatgtaatttagttcaaccattgtggaagacagtgtggtgactcttcaaagacctggaaccagaaatacgatttgacccagcaattccattagtgggtatatacccaaaggaatataaatcattctattataacatgtacatgtatgtttattgcaggactattcacaataacaaagacatggaatcaacccaaatgcccatcagtgatagactggataaagaaattgtggtatggatatgccatggaatatgccatggaatactatgcaatcataaaaagaaatgaggtcatgtcccttgcaaggacatggatgatcgagatggaagccattagcctcagcggactaacacaggaacagacaaccaaacaccacatgttctcacttataagtgggagctgaacaatgagaacatatggtcacagggaggggaacaatacacgctggggcctaccagagggcaggaggagggagagcatcaggataaatagctaatgcatgtgggacttaatacctagtgatgggttgataggtgcagcaaaccaccatgataaatgtttcactgtgtaacaaagctgcacatcctgcacaggtatcctggaacttaaaataaatagaagaaaagatctatatgttactcatttttttctttacaaaggtgagaaaattatactatgtaactatcctataagaggaaccaattaagtaaattgtgatatatatcacaattgatttttattcaggtattaaaattataatttttaatgatacagaaaatacttatatagcattaagtgaaaacagtatacaaagttgtatgtttagtataatcttaattttttacaaaaatttatagaagaagtttgcaacgaaatatgtcaaatgtgaacattattattgttttttttaaagatttatttttttttatactttaagttctggggtacatgtgcagaatgtgcagttttgttacataggtatacacgtgccatggtggtttgctccacccatcaacctgtcacctacattaggtatttctcctaatggtatccctgccctagccctccaccccctgacaggccctggtgtgtgatgttcccctccctatgtccatgtgttctcattgttcaactcccacttgtgagtgataatgtgcggtgtttggttttctgttcttgtgatagtttgctgagaatgatggtttccagcttcattcatgtccctgcaaaggacatgaattcatcctttttatggctgcatagtattccatggtatatatatattccacattttctttatccagtctatcactgatgggcatttgggttgattccatgtctttgttattgtgaatagccctgcaataaacatacatgtatatgttataatagaatgacttatattcttttgggtatatacccactaatggaattgctgggtcaaatcgtatttctggttccaggccttcaaagaatcatcacactgtcttccacaatggttgaactaatttacactcccaccaacagtgtaaaagaactcctattcctccacatcctctccagcatctgttgtttcctgactttttaatgatcgccatcctaactggtgtgagatggtatctcattgtggttttgatttgcatttctctaatgaccagtgatgatgagcattttttcatatgtctgttggctgcataaatgtcttcttttaagaagtgtttgttatatcctttgcccactttttgatggggttgtttgtttttttcttgtaaatttgtttaagttctttgtagattctagataagccctttgtcagatggatagatagcaaaaatgttctcccattctgtaggtcaccttttcaaatatgaacattattaatttatgaaaacttatgggtggtttttatccatttctttatacttttcaaatttgcacttcctaaaaatctctaaaattattgtgttatacttttagatcagagaaaaataaatgtttaaaaaagttatattcctcttctgccctcaatcttcagtacacagttcacagtaaggtagtagtatcattttgagacaccctaagtggtggaaaccaaaaatccaccttcatggaggacgaatcatggctgatggctctgtaagtgatactatgagcactatgtatgttcctcttcacaatcaaatgaggcttcttgtttcaatatttaacccctactagaatcttgccatgatatgctcacaattggaggtttttggtttttgggttattttggttttgcctaaacttaagccaagatccaattccattttctagctatcagtaatattgccaagctgcataatggaattattaaccatttgtgtgatttataagtggtaattagcatgttttatgggacatgaagactttgaaagtttgacctactatatctttttgggttgttttgtgctctgtgattaatttttgtgttgatttttattaaaggagagttttttcattttagaaatgtttgagacgtattttcattgatgattagtagttatggaaaaaataattggggctgaatagcttaattagtagaaagtttggggtaccagactgaactcaaataaatcataaactcaaactcattaaaatatatattcaaaaaagtatatgttctcctctaaagtcaacaaaaaatagacatgttttagtaagtctgataagtaactctctaaatctctttactgtctttctacaggaaaaagcaatttcggtatctactagaatccaaaggaaaaaaacctggtattatcaacgaagaaaataatgacagcaaaagacttgtaggagaaaacacaaatcgtgctacattaaattatactacaagagacttttataatgaaaagctagaggtaaaactactgttaatctttgcgatctaatgccaggatatatcccacatggcttggaatttgggggttgtacattttacccttagttaagataacttttttgttctggaatatttgtcaaccttatattacaaagccagggacagtaggtacccaggcaattagggagaaatagagccctgagatgcagaagaacccagggtttcagtatcgttatttcagcagaaaaaaaaaatgctcaaaagaaatctgtaccataaatctgtagcaaaaatctagtccaaagcaggaccaagggtcccgatctatgtaagaaataggttataggcttgctgtaggtacttagccacatcatgccagaccatcagagaacacagcaggacctccgtttttgttctccttactgggaccattgatgttttaattcatacctttcattctacaccattttttttatgattacttaatcatataatttcaacttgttctattcctaatatagctacttagccaggaaaatggtaactaaacctttatgttttatgtggtcagaggttcagagtgttttgtataggggaatacaatgttgtggtgctgcaggaactacaaagaagaaaactatgtagtatttaccttgatggagctcataggaaagctgaagaaacaacttatctacataacaatacaacgttgtgacccttcaagagattttgagggaacaaaggggcaaaagaacaagaaagagaaaacacatttactgagcatctatgactcatgtgcaaggtgctgtatgaggtgatacatctatatccagatataagtatatctatagatcccctcacacaggttatacgattgatatataatagatatctttcaatatctacatatgtatctctagatatatagatataacatttagaagtgtgtgtgtggcagggcgaagtgtgtatactgtagatgtgaaatggctagtcaagtggttttcaaatgtttttaacagttttggacctctttattcaaaccaccgtattatagctgaaaacccagtgtatcagaagaaagcaaaacagcagagctgctgttgttatagaggaaaagtaggaaattcagagtttcatttgattgggtcttcttttccttttcctttcctttccttccccacccccaatcctgaagtgtctctttggaacccatagggctgtaggcattacagcttgaaaattacttgaaaactcaatgcaagactatttttaatagtatcctacaagatgttctactttaagttcttctagtgtgaaaggtcaatgtttcatgacattgttgtctatcacagaacaactctaaacgtgaagaaattcttactgatattaagcttaaatctgcctcttaataaccttcacttagtgatcctagtaccaccttacatagtaaaaagaacaagtctgttccttatgaaaatgcttcaaatacttgaagtcaactacctttttcatctcagcactctctacattcatactttcattcattcaaaaatcatgtattgaacacctgtcatacacaacacactgtgtaatatactagggctataaaaagacactgtccttgccctcatggatctcacattctaatggaggagatagacatatatacggataagtatcaatcagtttatcaagagcatagagagataactaacccagatcaaagtagggttttagaaaaaatgatggccgatatgagtcttaaaagataaaatatagctatattaaaaaggggaaagaggcagttctggcaaatagcacagtgcaaataaggcatagaagtataaaacatgtaaggagagggccaggaactataagcaggtcattgttgtggaagttcagagattgaggtagacagtattaaaagatgagaccagaaagatagtaagagaacaatgtgaaagagattgaacataatcctttggccaataggggtttcctagtgttgccaaaagaagaaaatgaaagccaaggtggcaggattatgtctcctcttcctgaatacagctggttctatgagtgaaaaaattaatatgtatatagttgtgtttggtttctatggacgattggtttcaggacctcctgcagataccaaaatgcacagatgctcaagtccctgataaaaaatgatgtagtaacgtagtatttgcatgtagcctatgcacatcctcccatatactttaaatcatttctagattacttataatactacaatgcaaatgccatgtaaatagttgttatactgtattgtttagggaataatgacaagaaaagtctgtacagatgtgttttaaaaaaatgttttcaatctgcagttggttgaattcacagatgcagaatccacggatatggagggccaactgtatttagtaaatctaaacatgccaatttacattaaagaaatttagtaaaatatcgaaaagctgcattcaaaccaaggatttcacagtaaaatctaccaactttttaagaaacagagaattctaatgattttaaaattgtttgagagtattgaaaaagaaggaaaactcttccatgttttcaatacagacagcataacattgattccaaaaatgccagtattgcataggaaaagaaaagccaaaccatacatttaaaaatattggtgcaaaccccttttaaaaatattgtcagccagaatacagcagaacattaaatgaataacaaacattatagccaagtgtagtttatcctagaaaggcagggaagattcaatattagtgaattaatagatctaatgtgaaaaatcatgattatttctatagacattgaaaataaatttcacacaattcaatacctattcttaattttgtaactcaataaataggataaatggaaattgcatagtgttatgcttgatggggaaactctggaaacattagcattagtagtaggcagaattctaactaaggtggcctctgtgatccccacaccccagtatccataccttatataatcccctcccatgggtgtaggtaaaacctgtgtcttgcctttaaccagtggaatatggcaagggtaaaggggttttgcagacatgattaatatccctcatcagttgactttgagttaatgaagagagagatcatcctgagaaagtctaacttaatctggcaagtcctttaaaagaggattcaagcggccgggcgcggtggctcacacctgtaatcccagcactttgggaggccaaggcaggcggatcatgaggttaggagatcgagaccatcctggctaacacggtgaaaccccgtctctattaaaaatgcaaaaaaattagccgggcgtggtggtgggtgcctgtagacccagctacttgggaggctgaggcaggagaatggcgtgaacctgggaggtggagcttgcagtgagccgagattgcgccactgtactccagcctgggcaacaaagcaagactccgtctcaaaaaaaaaaaaaaaaaaaaggattcaagctttccctgaaagatttttctgttggtcttaaagaaataagtcaccatgttttgagaggcccacatggcagggaactgcaagaagcttttaggacctgagaacagccccagaccaacagccaacaagaaaacagggacttcattcccacagctgcaaggaactgaattctgccaacaaccacttaggcttagaagaggactctgagcttcagaaataaacacaacctaggcaacaccttcatttcagctttatgaagtcctgagcagaacacccagctaagccgtgcctgggttcctgatacatggaaactgagctaatagatgcacgttgttttaagctgccaagtttgaggtaatttgttagacaggactagaacaccagtgcatcactgaagtaagtaacaagacaaggatgcctaatatcactattatatttttctcaatacagataatgcaatgaaacaagagaaggaaatcaatggtcatttgaaaagaaggaagtaaacttatatttgcagataatattattgaatacctggaaatcccaagaatattaatttagaaatcataaaaagctataagaaaattcagtaatatagcagaagtcaacagcttccatattacagataacaagcagaaagaagatataaggaaaaacctaactcacagtagcaacacagaaagataatgtatcttgtaataacctaataataaatatgcaggatctataaataaacttttcaaacattagtgaagcatacaaaagatttatacaaatggaaaaacatgccatgttttagataagaagaatttcaagcaaactttgtcaattttctttaacttaaaaatttcatataatcccaatgaaaataccaaaaacttttttgttgaggctttttgacaagttgatactatagtacatgtggaaaaataaacataattagctacaaaaactccaaaaaagaacaatgagaagaaggctagcactattagatattaaggcatattataaatacctatcaattaaaacagggtggttgtaaagagatagtctaatgggataaatgatactgaggaaatgggatattcaatcagaaaagcatattgaaccccttctttgcaccatgcaacaaaaaattaactccagaccaaataaaaacccaagtattaaaagcaaaagtttcaagtttttattttaataagaagagaaaatctttatgatcttgattgggttggctatgattttttaacaccatagatgcacaaactataaaggaaaatgttttggtaaattggacagtcattcaaggtgattgtgttttttgtttttgtttttttctatgttgcccagtctgtccctgagctcctgggctcaagaaatcctcctaccttgtccttccaagtagctgaaactacaggcatgcagatttttaaaaacagatagcttcagtgcagtcatgtaagcagagtcttgattaaagtgatatgagcaataattaagctataagaaagtaaagacagggaatgttgactcctgctttgagaaattttaaagaggaaagaaggaatctgaagccccaaaatatttggaaagaaacactaatctaacaatcaggagatgtggatttgagcccctgattctacttctgagtacttgaaagaccttgctgaagtcccttaatcactctctcgactcacagcccagcattccttcacttataccatgctccttacatcttgaaaaatacttaaatcactgcagcacaaagtgctcagtctctcttccatacatcctgagttgttgagaaaattaattgaggtaagttcttcacaaatcaggttaagcagaccctttcattatacatgtcataactctgttgcttggtagttgtccatctattctcctgactcatctaaaaaagatttaagatggacatagaatcagagtgctgaaagggactttaaagaatctaatgctattcttagatgaggaaaactggaaactcagatgagttactgagggtcacgttgaattattgactgagccgcctctagaatggagtcctaattctgaccttggacacgttcacagtatatcatggtgctctctcaagttttcttgaccaccctagtgcaaagggctctctcttttctgaacactgtttgtaatttgctgtctgaacgttttactcagcatgtatctactgttttatgtttttagttgactttttatatgtgcatgccatctcccaactagactgtaagttcttcaaggactagattagagagttttctctatggaagtattaatagaagatgcttaatcctgagcagatctctcaatctctatagaccttgtttcccacttataaaatggagatatggattaaatcctaatacaagtaccattatagttaaaattgctctataacaaaccccactgttgaccttctttttcccaaaccatcttcataacaacaaaattctagtttaatgaaataatgtaaacaatattgtatatagtttatctcatcagaattgaacttgtaaaatacttgctttatgaatcccacagggatattgtgagacaaaaagagatgagtatatgaaagcatttgggaatggaaaaagcattactcaaggagcaacaactccttgacaggtcagggcaagagaggtgtctctaacgtgctttcaatgggatcatcctggacaggcagagtgagtcatcctggcagacacctgatgacttatagggcatattgtaaggagatgcagaatagttggcttggaggagaggagaaatcatgaagtagaaatgctttcaaacacagttactaaattaaggattattatagcagatacaattctatatcaacatgtccctagagaaacagtggaagtaactatagcagaaaattttaaagcactgtaaattatactgtgccagttatgaagaatttattttcaattgtataatacataaatgatttaacaaaatatatcatttaattgttttaatttttgttatccctaaattattataaaaaatcttccaatcttaataatagaattttgtctttttaaattcaaaatcctattttaagcaatttggaaatctgtaaaagaagcattcactaaatatgctctatgctttctacttgtaaatgcattgcttgtaaaatattgctcattttagttgctgatctctagtgactcacacttgtccttctttgtaggagttcctatgtagtccagatttactgagtgcgaaaagggagcagctacattctgttctcatcaacaagctaacttagtataggtggctaatgttcagactatagtatttcagagtgagggaagatcttcagagaagaggccagctggaaccatttgttgcttatcacacatcaaaaatctgtacatacttttaagactggtcaatctatgacctattgttttagtacatgactatatcaaatcagcattttgacctgtgaatggtgattgattgcttagagatgccttatatgtcataagaaaattcttaaaatatgcctctgttaaggaaagttagtgcaggttggacttattgttaacttacattaattaatcaggaatttaaaacatattttattttaaacatcataagcatttgggccaggtgtggtggctcatgcctgtaatcccagctctttgggaggctgaggtgggtggattgcttgagttcaagagtttgagaccagcctaggcaacatggcaaagccacatctttacaaaaaataaaattagctgggtgtggtggtgcacgcctgtggtcacaactgctggagaaggtaaggtgggagggtcgtttgagcctgggaggcagaggttgcagtgagcggagatcatgccactgcactctagcctgggcagcagagtgagaccctgtctccaaaaaataaattaatttaaaaaatcataagcattgggaaacagaagaaaatattaaaaaggaggaaaacatactaatgttctcagaactcagaaacaatctttttttttttttttttttttttgagacggagtctccctctgtcacccaggctggagtgcagtggtgtgatcttggctcactgcaagctccgcctcccaggttcatgccatttcctgcctcagcctctcgagtagctgggactacaggcgcccaccaccacacctggctaattttttttgtgtttttttagtagagacggggcttcaccatgttaaccaggatggtctcgatctccagacctcatgatctgcccacctcagcctcccagagtgctgggattgtaggcgtgagccaagaattcagaaacaatcttaatgagacttcaatatattttcttcaatagtttttatgcattcttttctaactttttaataaaaatttcaaacatacagcaaagttgaaagaattttacaataaacatccatacgtccaaaacctacactcaactattagcatcgtaccatacagtgtacttactttatcacatatctatgtgtctatccatccatcagtctaccttcgtattttttaaattcatctcacagtcattgcagacattagtatgcttctgcctaaataattcagcgtgcatttcattaattgagattcagtattctacagagtatttttctttgtaaatttttccatttagaggtaaaacttatatactgaaatgtaaatcttaggtgtacaattgctgagttttgacaattcatacattcatataacccaaaccctatcaaaaaaaattttatttttttcacataacattatgatttaagcattttttcttattatgaatctttattttattttatttttaaatatttcaccttttagatatggggtacagtgcagatttgttacatgagagtattatgtgatgctggggtttggagtatggatcctgtcactctagtaatgagcacagtaccagacaggtagttgtttagcccacacccctaccaccctctatgttgttcccatatttatgttgttcccatcttccatgtgtgcacagtgcttagctcccacttataagtgagaatatgcagcatttggttttctgtttctgcattaatttgcttaagattatggcctccagttccatctatgttgctgcaaaggacaggatttcactctttgttatggctatgtagttactattccatggtgtatatatactatattttctttatccaatctaccattgatgggcacctgggttggttctatgtctttgctactgtgaatagtgtagcaatgaacatatgagcgcatgtgtctttttggtagaatgatttattttctttggagtatatacccaggaatgggattgttgggccaaatggtagctctgttttaagttatttaagaaattgccagactgctttccacagtggctggactaatttaattatattcccaccagcagtgtatgagagttcctttttctccacagcctcgccagcatctgttgttttttcactttttagtaatagccattctaactggtgtgagatggtatctcactgtggttttgatttgcatttctctgatgattagtgatgctgagcactatttcatatccttgttggccacttgtatgtcttcctttgagaagtatctgttcatgtcctttgcccattttttactggggttatttggtttttgcttggtgatttaagttccctataaattctggatattaagcctttgtcagatacatagtttgcaaatatcttctccaattctgtaggttgtctgtttgctctgttgatagtttcttttgctgtgcaaaagctctttagtttaattaagtcccatttgtctatttttgtttttgttgcaattgcttttggggacttagccaaaaattctttgccaaggccaatatcaagaagagtcttccagaatttttatagtttgaggtcttacctttaaattattaatcccttttgagttaatgtttgtatatggtgaaagataagaaaggtccagcttcaatcttctgcatatggctagccagttatctcagcaccgtttatagaatagggagtcctttccccattgcttgtttttgtcagccctgttgaagatcagatggttttcggtgtgcagctttatttctgagttttctattctgttccattggtcgatgtatctgttttttaccagtaccaaactgttttggttactgtggctttatagtatagtttgaagtcagatagcataatgcctctggctttgttctttttgcttaggattgctttggctattcgggctcttttttggttccatatgaattttagaattttttttctaattctgtgaagagtgacattgggaatttgatatgaatagcattgaactgtaaattactttgggcaatatggccatttttatgatattgattcttccaatccatcagcagggaatgtttttccatttatttgtgtcatctctgatttctttcagcagtattttgtagttctccttgtagaggtctttcaccttcttagctgtattcctacgtatttcattttctttgtggctattgtaagtgggattgtgttcttgatttcactgtcagcctggatgttgttggtgtatagaaacgctactgaattgtgtacattgattttatatcctgaagttttactaaaattgtttcaatttgagagccttttggcagagtctttaggattttctaggtatagaaatcatattgtcagcaaagagagatagtttgacttcttttcctatttagatgctttttaatttctttctcttgcctgaccgttctggctaggacttcctagaaatcttcgtaggtataattttaatgacactatctgtgatttttaggatttcatttgtttgtttgtttgttttgttttgttttttgagacagagtcttgctctgtcgcccaggctggagtgcagtggcacgacctcagctcactgcaacctccacctcctgggttcaagcaattctcctgcctcagcctcccgtgtagctgggactacaggcatgtgccacaaccctggctaatttttatatttttagtagagatggggtttcaccatgctggccaggctagtctcgaactcctgaccgcaagtgatccacccaccttggcctcccaaagtgctgggattacaggtgtgagccactgcaccgggccaaattttttttttttttttttttttttagaaacaaggtctcactctgttactcaggctggagtgcaatggcatgatcatagcttaaactgtagccttgaactcctgggctcaaacgattctcccacctcagcctcccaagtacctggaactacaggcatgtgctattacacctggctaaattttttattcttgtttttctgtagagatggggtctcgctatgttgcccaggctggtcttgagttcttggccttaagcgatcctcctgccttggcctcccaaagtgctgggattacagatgtgagctaccatgcctggcttatgatattttaaatttagctcatttaatttatcttgaaattattttggtgttttgacttgagttggagatttaaatggatcctttttctagtagttaaatgtattgtctcattgacatttattactttccttcttcattgatgtgcattacttcccttgtaattctgattatctgatgtgttacattgattcttccatgtatattatacattccatgattatgccttgatactattcagaagtatcaatagccaaaataaatgttaaattcttgattaaacaaaatcactttgttttagtctctgtgatgaaattggggcacaatattcaaatatcctcagctccaaaattcctctgttgtgtttaggaccaggtttttcattttcacactgccagacccagaagttgagtgggagacctgtttctttagaaggcaacgtcctgggtcccaggtttctatatgtttactcttcctaattgtacacttccccccaactttctccaaatggtcaaggctgcgtaagtcagtgtagtgtaccattttatgctttcccataatagagggtaaattcagagtatacatacttaaagtattacatagatattaactaatatcataccaattgaaattgtcactatctgtatcctgatacatttaccacaggaatctgtgagtctgcattcagctgacttgtgtgagctaaatgacctgaactgagataggagaaatagtagttatgattcaacaattccagtaaagaaacacattttctagcagagctgtccaacagaggtaggagtagactgagaagtactgagacccttgttgttatctttactcaagcagaactctgtcagcagtgactaggaaagaattcctgctctgaggagtagatgggggaggaatagggggtcagaataaattatttcaattttctgtggttcagctaattgttgctttgacttttggattagttatgatttaatacaaaactttctcttttttttaacaggaaataaaggaaaagaagaaattctgtaaaacatatatagaagaccttgtgaaggaagccacagaaatcaacatgaaaaatgaggctttgcagaagctttggccacagatgttcattgagcttgttagggatgcagtcatagaaattcgcaataaaaattcctatatgaagctctgcctacagcagataacagaccaaaaataaaaatggcctttagttacagttgattttggcagttttattttttgaaggttgaaaatatgcaggttatacatgttaaaacaacaacaacactatcctataaactagaaagactagtataaaagcattattgcccactgttctcatagctaaaagttaagaaggaaggaaggaaagcaggagaaaggaaggattaattgcctgtatgtgaggaccaaacaacctttgggaactaaacagttttcagagatggcgtggcactgcatccttggttcttgctttgattggtgccctgctatagcccaaagcacgtagtatttgctgatgattcagcatgagctgcatctacctacttttagctgataattttcagttatttccctttttattttatgtcatgatttcaaagccaaaaatatgttctttttatgagtgaagaataaacttactaacaaattagtcaaaataaagtatgtttgcctccttaa

SEQ ID NO: 1188 - DNA, 157418 bp, Homo sapiens
aagtggtgacgcactgggctctcacgaatacaactagaagctgcaacgactgtgtggctctatcgattcgggagaggtccagaccggaaatggtcgtttccatggtaaccctgagcaggttgcctgggagatgacctctttcgggtctctttgaatctccgctgtagcgtcacctggaaggcagatctaacagagaacctggactgtctcctatcatgattcccgggaaatatcgctctgtttctggccgggctgcgaacaacgtaagttgggccttctactttctctttcttcccactggtactctttctgactggcgtctttgtcctaggagatgggctgtattattaggaccggcaccgctgggtctactcaagctattgtctgaccagggtttgaggttcgtgggctggaccaaggcacaatttaatattgtatgatgggtactcaaagtcttgtccaggatctgggctccccagaaggtggagctggtctgctgtgaaaggcttgggtttatttaaattcctttggccagtcaattcctttttcttttcttttccttttaactgtgaagagaatttatcattagggactcccacctccttcacctgtctcattgagatgtttatttagacctgaatggcaaatgtcgaaagcctgaggtactaactagagggttaaattgctgccgacattttggaaaataaatcagtgaaaccttttaattcttagatgtgattttattgttttcagcaaatcctcagaacaagatcatttaccagaaacagaaatagagcattgtgttctatttttttgttgtatttctgtttgtaccttttttttttttggaaatatgtgtttgtgtattaagagcaaattttatggtttaatttttacatttcaggtgaactgcgggcttcatctggttattcaaacatcatcgcttcctgaaaaaaacaaagtaagatttaagaaggttggcatttaaattgaagattgttttaaattctacacaaatagcagcatgacttaaagtgtagatagattctaaactgaaaaatttaagtagatttgctttgatttccagtttaaagctagttcttactttctgcctacataaagctaaaatagccctctttaaaaaacttaatgtgattttattgattacaaaagggtaagggtttttttgttttttttttttgacatttacacttttttttttcttgagacagggtctagctgtatcacccaggctggggcgctggggtgcagtggcacaattttggctcactgcaacctctgcctcccaggctcaagcgatcctcccacctcagcctcctgaatagctgggaccacaggtgcatgccaccacgcccggctaatatttttgtattttttgtagagacaggtttcaccatgttgcccaggctgttctcgagctcctgagctgaagcaatccgcttgctttggcctcccaaagtgctgggattacaggcaacagccaccgcacccagtgatatttacacatttctgaaatcaggagccttcttaaaattgatggcatgtcatagtttaattggggaggttttttttctttcttaatagagggtaaaataatggtatgtcttactactaatgacaccttagataaaatggtaattgggagggcatatccacacatcccatttaaaatcagggaagaaaaaaataggttagcagtggacacatgttagacttaacgttatttagaagttacgatatgaatatgagatttttttccccaagattatttccccataatgtctctagcatttctagaatttctggcttttgatttaatttttgagattttgagataaacatgtttttctttcctttctgtctcacctcagcatttatacttacctactttctacacactatgtctcaagacacaacatgatttttcctcctttgaccaagttggaaacctctaaccatcacaattcaggtgtgtcctaaaaagttattaaataggcgtcactggaagaactctaaagtgaagggcagagttcacacataacagcatgaagaagggtaagaaaaggcatgaggaaggtaaatggaaggacatcgttagtcaaggaggcagctgttgattacattatatatgaatatgaaaatggtaaacactcagaaaatagacaatttgatcatctcaaataaacagcagttagattaattgaaaatattatttattataattgagcataatggattctctccagagctttcctaattgatttctctggacaaatccttttccaccattataatgtttctagagctgtgtgcctcatctaaatattttttccaaaccattcactttctcttgtgtggacatctattctgagaaaatacctttaggtcatataattcctaaggatataatgcaaatgccaacataatgtttatagtatggatacattagaagtatcttaattaattcaagatacatatttggggttttttgtggctaatcataagaagttgttctggttttgtttttctcagtcctcccaccagataattattttagatcagttttagatcaagtgaaaacctttcttagaaggcttaaatatacaattttattatattataataggacatttaaaaggattataatgatcaaaacagtgattttttcaacagcattttatttatattgtgtgtttttttttgaagcaaatgattcttttaatcattgtatttgtggtgagagcgtggagggattggaagtgtctcagcttggaatatcttgtatctgacctcataaaattgatcctgattttgtgggtggtaaaatacaatgatagaggtgcagccatcacctctatctagttccagaattttttcatcattccaaatggaatccctgtacccattaagcagttacttcccattccctgcttcccttaaatgcctggaagccacaaatatgctttccatctctatggatttgccaatgtggtattttgtgtcagttttctttcacttggcatgatgttttcaaggttcatccacattgtaccatgtgtatcagttattatatgtttttttaatttatcttcactgcttggtgttaaatttgtctccaaatatttttttctttaataatgtttttcaggttgaattcaagctaaataaagacacatcgtcattccccggtagacttttacaacatgaccttgaaagaaactactcaagtaggcaaggtattgtcagtgaatagagatcagatgtggttcatcatctttgaataatattaagtgtttaataatgttgaattactagatccaaataaacttgaatttaaaatgaaattgttcattgggaccaaattggtttggtatttttttaaatcattggttatatatatgtagcatagtagattatttccaatacagaaaaaagctgttattattttactttgagggtgggctatacactagagaatggaaaaagaatgtttcaaatactgtattagaacagtatttggaagtcgctaattagagtaagagtatgggaacacaaatattaaggaaatcaggaaagaatgtaaagtcaggagtagagaagaaacaatctttccctgttactgtcacatataattatagattttatattaaaggctttaaactctagtgtctatcacttgggatcttgggatcttgttaaaaatgcacattcttagtgctccccctccatcttccccattctgattttgtaggtcttgagcgggatttggaaatgtgcattttaataatgtcacaggtgattctgaggtatatggtttgtgggtcatcctttgacaaatactgcctcacatgatctggttatatttctgaaatatatttttcaaatcaaggaaaacgttccttcacatttgaatcttggtttgttgctgacagccattagctttctgtaatgtgctcatgttaaacacttctgaatccacatatacaaaactgcctctacctcttaggagtttatatgagagggctgatcagtataggcctttctaggttgttcatgttattactgtgggaacatatggcaatttaaaatattggttaattttctctctctttttatttctggacctacttcttggacccatctaatctgacatatcttttctctttcctacattctacactcttgtcttggccaattgctggacatgacgtcagcctaactgcagttccacagtgtggaaaacatctgtctttgccttatttgattcagttcaatacttatttataaagcaagtattgtgtgccgatcactgttttaggtacagaattatagatgtgaagcctcaactagggtttttatgcttgcattgtcaatttccttgacatttttggtaacaatatcttaaaagttttcccgaaaccatgaatcaaaattaagtactttcactaaggttttcttgagttagagtaggcagttagtaaacagatttgaggacggctggccaggcaaacttatttaagtggtaaagtattactagatattcgctaatgaggaaatagtatggatgtattgaattttgtgaacctgagagatgaataaagttttatacataagtaatgacccattcagtatgaattaactctttaggaaaaaaaacctaattggtttttcatttaaaaaatttattcaaaattggtttctgtgacaggatactaatttgaaatgtcttaaatgtgtacctggttactttcaatgtgctccctccatagttccaggcagtttcatgcaaagaaggccacacaacttattttcttgacttttgtactcaaattttacttccaagggtataaaattttggaaaaattgtaagtagcacctcatcaggaaaagtttagggatgtctgtctaataaactgtatcttgatacccaatcattataattaatttcagccatttcttatttttcaaaattaatcaaacatatcatagcctgtccacaaaaattaaccagtggtactctcagtcaaaagtaaagacacttgatattttctttaagctagtgagtttaaaacttgatatgtgatttctttaggcttcttagaatattgttaagagttaacccctgtctttgagattttataagtgccatatattgcaggaactactatataataaaatttcagttaacctgaccttattgattaaatcccttaattaggaattttaaaatgtgtgtgtagaagggaagaggcaatactttgctcttaagataatgataaatcactgaaaatctggagttaagattttggttaccaaaacaatctcaaagacatggccgagtggacacacatatatggcaatatgtactatgccgtccatccatccacctgtctgtccatccacccatctgttcatttatctatccatgcatccatctcttcatctatatagtcatacttccaaccagccatccagccatctctgtatctagcatacagtgcagtgaacattcttaccaaatttagaccattatacttcttaacactttgagatgctatttgtattgagattttaacagaagtaacacacgcaaaatagattttcaattaaatcttagtaaactggaaaaacaattaatttgtctattgattgcctactgaatttagattttaccaagaatataaagaatgtaaaatgaggtccatcacccaaggagcttgtagatttatttgggaagacaagggctacatatctggtaagttaaatagtaatataagaaataaataataacaggccggttgctatggctcatgcctgtaaccccagcactttgggaggccaaggtgggtggattgcttgagcccaggagttcaagaccccatcttgaacatgggtaatatgatgaaaccccatctgtaaaaaaaatacaaaaattagctgggtgtggtggcacatgcctgtagtcccaggtattcgagaggctgaggtaggaggatcacttgagcctgggagtttgaggctgcagtgagcggtaatcatgccacactaaattccagcctgggtgacagagcaagaccctgtctcaaaaagaaagaaagaaaaaggaaataaacagtaacaaactgttatgatgaaaattttgccacatagtaatgtagtttttttgtgggtatttatatacccacatatatatgtggatatttgtatacccacatatatatgtggatattttaactgcggatctctctggttcccagttatttagaaggtcttgttgtatggtagatttaaggccttttaccctaatcattcttatgtctttctatttattgtaagcagtatatcacatcgatagtaagttcattatgctgatagtgattatgacttctgtgtattaaaagagctagaaagtttaaggataaaattcctttattcactgagtgtaaatttaatctttggttattgcctctgtatctcaagtcttgtaaagtttaaatttgcctcttaaaaattgaggattgccttgaagccttaacaaaatcattcagaaaacctaactaatgctaacaagagaaactgaggttgtctgctgcttggagtttttcaatcttttgtctttagttgaccaattaatctttaactagttaattcttagactgcagtcagtctttagactggtttttgttttgtttttgtttttttaaccatcttgacttgatttccaaatcaatttactgacttgtggttgcttttaggtatcctgctagcatgtggtcatgccagaaaatcagtttattggtgaatatgatgtcaattctgaatgcttatactctagaacatcattattatcttgatattttgtaatattcagaaaagtgggatgtgagcactgattattttgttcaagaaactaggggtgagatacttcagtttatgccttgcagacctgaggtagctagcaaatgccattgccttatagctttttaatatgatttatatagaacttgattttaagttgtcattatattgtctggtgacctcccaaagagtaggttagctttccagatttggttttcatctttttgttagtttcaacagcagaattctgtggtaacatcaggttctgttttactattatacttagtgctcccttcaggcatttcaacatcagttgctgctttcagaagattttcttttcatagaggaaaatatggtagatttcctctggcattcaaactgtcacgtttgacccattactcaaattcttacctcatttctggaacttctcattgtttcttcttgaccatttacattcttctagttctttagaaaatatcttaatattcacctcccctcaaacccctctgtaaccaccttcattaagtaaaaaataaccagacacacttatgtgcaaacttacaaataggtattctttttattctgcatttatgtatgttgttctatttatgaatttcatatgtgtatttattaatttcagtctgctagattgaaagctacataatggcaaggacaccatctaacaaacagcctataaaccttagaggggtgtcatatactttgtggaccctaactacggtatgctagatttactgacatccactttggtatcttggcaatattctctactaatagtggctgaacttacaaagaaagagatgatgcgaggtttacatctgctatccaaaactactttttgtgtatttcctatgcatctcatccacaacaaatgtgacagaactatatgggctggaaatgaaaactgccacgaggtccttatcagcatttggagattcttccattaagacaccttcaaaatccagaatccagcagggctgtcatagtgctggcccaaatatatctggtaatgaggaactatcattttagttatagacagttagaatttaagacaaggagtcaggattacaaagggatgaagatagcactggactagttctgtactttcaaccaatctgtaaggcaagggaaaaattatttggcatacatggaacacatagtttaggtttaagaaggaaagaaacaaattcagcttagtaattaatttcaaatatggagagctatggaaactatactttctagataagatatttatggtgctaaaattctccaaatataagatgactttagtttcagacttcgaaggtttttcttaattaagtaatttgtatatcatttttaataggtgatcatattaatttggtgagctcatcattgtcatcatttcctattcttcaacgttcttctgaagagaaaattctttactcagacaggttgagcctagaaaggtgaggacaatttcttttcttttcttttttttgactaggtaatacatagacgtggtacaagacttgaaagatgcaagtctccctccttcctcctgttccccagttattcaattctcctatttagatataatttttttaaccagttttttgcttctccttcctgaggtatggtgaggaattttatatctatataacataaaagagcttgactatacttcacaagagtactacagcaattctaaaatatgacattgatgaaaaatggattgtagtatagaaaaaaaccacagtataatcctcacatgagcttcccaggccctatccagtctagtttcctgttacttcactggcttcatctcttcctacactctccttcactcactgctccaatcatacctgccaccttgctgttccttgaatacaccaagagtgattatacctcaggaatttggtgcttactatcccctctgcctggaatgctgttccttctcatatctctaggcttattgccttcaggtctttgctcaaatgtcatcatttcagggatgatttttctctggccatcctctccaaaattgcaaccccttccacactgaagtctctagcccccttctctgctttcattatttttcttcttagcatttattaccctataacataataactatttacttattatgtttagtgtctgtctcctactagaatatatgttccataagcacagaaacttttgtccagttctgtattattggtatttagaacagaacctggtacaaaacacactcttgataaaattttttttaatggaagaatatatttagaactcgatccccatctttacatctagaaactatccacagtagcatggtgggtgaaggatcccaatctctatctaccccagtggtataaccagcagagacaacatctctgttttgcatacctttagcttagcagtgcacacctgacaacaaattataatgaactatctgtgtttatagttgggaaaaactgctggaggttctaacatgttcttttgtaggaaaagtaacactgaagggcagtatctctcatgacatctttgcggtataagtggtttatgagaatgctgtctaatatttataactttcatggtattattttaatgttttgagggatttttttggtaacttttctcttgatctttgaaagactggccaagaatagtacctcagcccttcagtttcatgttacttgacattaacaggagccagtatttgtaagactgtgacataacaagttaggcacttcctttgtagcttgggatgactcaggcaattgtgaagatgggtccttaacagcatgggcctctggggtggagaagcaaactttgatcaggcagagacttgcttatcaagaaagtcaggattgagagaactgactccgcttcaaaagttggttgtaaaatgacagaatcacaaagatatcataaagttaggcatcatttgacaagaaccaggatgtgcagtcaagaaaggttggctagcagcaaggaactaactcaggtatcatttctgagagccagtgggtagtgccagtgatttccaaaggcagatctgccatgctgtgcagcttcttagctaggagcctgaggggtcaagggcagaagccaaccctgagaagtagtacttggaagagctaggctctggctgttttgggagttaggttaggcctggagtaccaggaaggcagcctatcagcaccaagaaggaaacacagaagcaaaggcatagtctgttagatgtatcagtaatggggtaggatgtagcaactcaggagttttgtaggcctagaaactccccttgagggcagtgggtctctagttattatgtatgtttgcttgcttgttttgttggagtgacaggggtttgtggggttaagcagtatacaagtgagccttggcactgggacttaaccactgtgtttagaatcagagaaagtgactttatttcaatctacggtagtttaggtaagagggaggatggaggttatttattttcctgtcttagtgatgaccgattcaagaattggatgaaatagaagttggggggtatcaataagtttaactaagagaaaaagaaaaagactgaagcaggaaaagtgagatgatttaaattttttgcaaagctgatgcacaaagatacaaattttaaggtagaatacttataatttattaatttataatttatatactaaatttattgatttatcacagttctgataaaatagttggataaaatattgtgataaaataattgaatatatgaagtgaattttaaatattctgtgaaaaaataattgaatatatgaaatgaattataaaattaaccacacattaaaataattaaactattgcccaaaatttccttttcttttcctctatcttaaacaggtttcttcagaatctatatttttaaacatcatagatttgttagccattaacattcagttatttttttttctgcgaatcattcttttttctctttatcaggaagattctgatcactgtcatagtttcacttatgctagtaacactctgatatattttctttaaagctttcattaacttgatttctactgaaagagaatatttctaataaacttccctattagagttgttcacactcagatagagctgtattttccttgagctgtattttaacctctcagagtagaatcacgcaggacctcatgtctgcccctattattttactactagaattcttaaagggccctgaacttatttacttcacgtgtagtatgttacaacattttgcataatagaggcttactgttttaaatatagctcaaagcatatatttttaaggtttcatcctaccctgtagcactctaaatgttctgcaaagttcaaagtgttgagcatgtaaacatatacttaaaatcttagtttctaaggaaatgttaagtaaggaccactttgccattaatggatctcaggttgaatttttttttttaatcaaagtgaactctagatgactgaatttcttgctcttttgaagatgtcatctggctcaagagtctatgattctctgagatttttatatgtttttaactctgatgacttagttgcctgggtaatcgttacatcggtggattgatgccaagggcatttgtctggttatgtgacaagattccttcagccatttaaacctctatcacaaaaggaaattatgttgaatgttttctcatgttaagtcaatttcatgtgaaataacttatattcgagttttttaaatacaatgagaccttagacataattttaataataaaccctgtcaaagtctattggctttttttgtgtgaatgatttacaattaaatataggtcgcttagttcatgggggttggaagtggtccaacttatttttttctcctcacagaatgggagcacaaagatactactaataatatttgtaagaagaggtaagtggctgaatcataacctaattaactttttaacattttttctagacaaaagctgaccgtatgtcctatcatcaatggggaagaccaccttcgtttgttgaactttcaacacaattttataactcggatacaaaatatttctaatctacagaagttaatatcgttggatttatatgataaccagattgaagaaattagtgggctttcgactctgagatgtcttcgtgtccttctgttggggaaaaacaggtattctttgtagagcagtttttgtagcctaatgttatgtgtaggattaatgtggagatgacaacttagaattgaataatacttaagaaatgaataggctaaaattttttaaaaattatttgaattagttgaatggattaagatccagtcataatttgtttcatgagattcagtatgacaatttgtcacaccagataacgtttattatgtattttacttccattgctttccagtgttgtatcttatagggaagtaaatagcagactttggccttgattttgttttcttagaacttactttagacatgtgtattcactttaggcttatgtgtttcacttgtgactcttcccagtgtttgactgagggtagacactcgatactttgtgattatctcacaaattgattctttttcagacagtagtttcagtttgtatctaacattacatcctatatgaactttcccagttccttttatacaactctattccgtagtgcaactatacagttcttgactcatttctttgagattcattcactacttttcattctattttactgaatagcttttgcaatgcctacaaagaagggctttatagtaaaatccaaaaatgatttttatattatcaaatgaagactttagatatatattataaccaggctaggttctcctcctccatctttccctgcctcccaccctggcatgggtcttggattactcgttgcaggaaaaaaaagtattatctcttccttacccatctcaaggttcatggccgacactctataacgaagacagattaacaagagaaaagcattaacaatttatttaatacaacttttacatgacacaagagcccttataaatgaatatcctccaaaacagggaaaactgtgtatttttaggctgaggcttgataacaagtggacagtatgattggacaaaaggaggtatgatctaatggtaataaactgggggaacttagcaaggcctatttgttcagattcttcttggtgtctctgtgtcttcattcccttttttggggtatattatgtattttacttccattgcttccttccatgagcgtcataagaccctcattccagaggaatcctgccctatatccaaaaagggaagggatagatcagatacttctatctatctggaaaatagatcagagaattctttttatggcctcggggagaaaggtgagagaagctcagacagtgagcttaggaaaagtatcttaaatttaaggtagggtaggtagatcagagaattctttttatggccttaggggagaaaggtgggagaaggtcagagagtgagctccctccatttttttttctttttttttttttttttgagatggagtctcgcactgtcaccaggctggagtgcagtggcgccatctcagctcactgcaacctctgcctcccgggttcaagtgattgtcctgcctcagcctcccgagtagctgggactataggcacgtgccaccatgcccagctaatttttgtatatttagtagagatggggtttcaccatgttggccaggatggtctcgatttcttgaccttgtgatccgcctgccttggcctcccaaagtgctgggattacaggcgtgagccaccgcgcccagccacccagagatttctttactagtttctgatcctcagagttactgatttatttgccttgcttgcagttattctttaatatcattatcattattccctgcttttagtcctgagttaatatttttagtgatatttaaaatcactttctctcgtatttaagcactgctcctggttcctaccattttaagtcatctttccatctattctattttcctatttgtacttttcagcttctctggcttcttagaatttactcattaagttgttgtttttgtttttgttaacttgtgccttgaaggtaccagtctatctgagcttctgactttatttaaggtctttttgttctttcaactctaagagacttaatgcctttctactatgtcattatttagtgaagtaaaagcaatctaatgctgtgtctttttcctctttctactcctccatcttttttatttgttatttgtttggttttaatcttattttatttttcacataaaggaatagctgtggaacagttctagaactattagtgttcttgaatcaaaaagaaaatgagtcagaagaaaactttccatattctcccctattgcatgtttttcaagtgtcagtgaaatgcaagtctgagccctaaaacaaatgccaagtggcctccagccagctgactttgtcacagcaaggggcctgtgagctgtgaagatggaaatctgtcctgggttagtactttgtgaacattaagcaaacctggctgaggatgctggtaaagagggaagtacatctgctaccctgtctcttcatgcatttgtgttaaatgacttgttgcttcctgttggtcaagttcagaaagctttctccttcccacattacaaagctctgcattgccttttggtccaaggcagtggaaccatatatggaaatccagggcaatcatgcctctgggttcaggcaactccaacaaagatttctactctaaagctaagaaagaaccttgctcaggttctgtatgtgaggtttccgttgatactaaagaactcccgaccccacattgctgtcaaagttcttattctctaattgttctgccttcagtatctcctgcttatcctctccaggtcctctgccaccctcgtcattacaggctaatgcatagaacttctctgcattttcttctgatcacccaggattatagatcaaaactcttagaacctgggattctctgtttccttccttttgactccttgaagtttcccacttaaggatttgtttctgacacctgaaaagctaagccttcatataggtcctgtagtgaggtctttatcctggcatcagtaacataatgtggcctgcggagacaggctgtgatatatccctagaggcctcaggtgatgggtgagcctcatctttttctagtttcagtttctattcaatggaagaacttcttttttaaataaatctttcaggtcacattggtgttaacgtaaaaatggtcaaatttgggggcactggctaggattctgcaaattcctcacatcaatacctaatctgaccagtaggggccttctaggtcaactgatgccttcatttacctctgaattctttagaattgggtaagtttttaggtcatttcaggtgttggggggtggaaagagaatttatgccaaaggcaactcatgagaacaagagagcaagatgtttggttggtcttgggtttaactgattgaacgacttggctgtttttcttcctgttcacctgggcgatccgaatctgatgtgagagtcataaagcagctatgtgtcaaagctaacgaataccagaagtcatgttatagcccaatgggttcttcttgcctgctgcacagaaaagccaatacactgagacagcaggtgttgcaactgagtaagagtttaataatcacaaggcagtcaagtgaggaggatggaggaggagatatttctcaaatctgcctccctaagaagttggagactaggattgtcaagggttgtttggcaggcaggaggctagggaatatgggttctgcttattggttggattggggatggaatcacagggaggttgaaactgtcttcttgcactgagtcagtgcctgagtagaaatcaccagtctgggtggtgtcagttggtctaccagaatgtgaaaatatatctgaaaaatatctcaaacactagtcttaggtttcactaacaatgttatttataggggaaattggagaagtcacaaaccttattaccattggctctgtgattcctgagcagtaagcaattacaaaaaggtaggttagaaaacaatgactgattatcatttaattatgcctccgtattagcagaattcaggcccctaacataattctaaccttatcatctttcattagttttatgaagatgtttttggttcctgaacaaagatgaggttagtttcaggaagggactgttatcatccttggtttaaagttaaactgtaaactaaatttttctcatagttagcttggcctatgtgcaggaatgagcaaagacagttagcttgtatgattagaagcaagatggagtcagttatgttagatttctcaattttgcaaaggtggttgcagtcacaacagatagggagtgaatatgtgaggccctggtggaattctgagggaatacatactgcacatgatggtttctctgattgaagggccttaaaggtgctcaggatttctcataaagacagaaacagactacattgattcttcaaatcggagaactttggggtgatacaatctccattatccctgatgtataattttcaaggtgttaaaaatatgattctcagacaaatagtaatcacaggccagcattttaattaattcaataatataggaaccagcaggatgacaaagctggttcaaaggagagtaagaggaactcataaatagtcagtgtttttacaagcactctgggtgattctgataaatccagaaatttgagaaccactgttttagggaatgtgaacttggaagtataaaataatggaataaaaggcttctctaatagctattagaaagcatggctctgtcctaagctgtatgattacagtactataattttctgcaactgttgtaggtatctcaggagcaaagcaggcaaaggaaaaattgtgttgaaagttgtacctgggctgggcgcggtggctcatgcctggaatcccagcactttgggagggtgaggcaggcggatcaccacgtcaagagatcaagaccatcctgcccaacatggtgaaaccccgtctctaccaaaactacaacaattagcagggtgtagtggctcgcacctgtggtcccagctactcgagaggctgaggcaggagaatcacttgaacctgagaggcggaggttgcagtgagctgagattgcgccactgcactccagcctggtgacagggcgagactccatctcaaacacacacacacacacacacacacacacacacacacacaaaacaaacaaaaaaagaaagttgtagctgttttcccatctggttgggctattaatttagctatttgagagatttaaattctagataggatagtattaaatgcctggcactaggtgaaggctagtgaaagagtccagtgagtccggaagaatgctgatgatttggatgaagtgaggtaggaatagggtacagattctgtcagggtgatgatgtgagaggagactgatgaggaggtggtggtcataaggcagtgtggtatgtgcgtgtgtgtgataagggagtgaagaagatctacagctacatagcgatgatacatggtgggcatatgagaaatatttttataaattaaattggattgaattggcttgtggtagtaaaattcttgatttggcaatgatataactgagataaagtggagacagaaattaatgaagtttaagtctgcattatgtttacatggtaatgatcagtatgtatgtatatacatacacactacatatatatatcacatatatacacactatatatagataacatgtatattattcaatggatgatccaagttctgaaaacagagaggtggaagtggttctttgaggcagtaaacaaggacaacgaaaatagatggtgataaatatatggtgataaagatgggttgtatgaacttaatttgttgttctttttttgccattgctcccatctggcatatcaaaaatttcaaataaatataagcattttacaaactgagcaggtcccagtagaaagcatttaggtggtatgcagtttgtctctgtcataaaggatcctattatgaatacccttgtgcgtacaacttattcatttagttagtatgttcgttcattcattaaactaatatttattgggtacctacttggcaccaggcactgttatgagtgctggggatagagtagagaacatgtcagaatgtccttttaaagctcacattttgatttggcaagagagattttttaaaaatataaacacaaaataatacaattttaggctacgatcaattctgtgaagtcaaagcagaaaaaggaaagagtaatggggacaggaagggaaaggtattttaaatatggtcatctggaagcaactttgaagagttgtttgatctgagacctgaataatgtgaagttttgagggaagaacattaggggagtaggaacagcaagaataaataccctaaggtggaaatgtacttgccaggttagagacacagcaagaatgcctctgtggctggagcagagtgagtgagcgagcctgtggtaggagataaggctggctgaaaggtcagcagccaggttagtgccttgtaggcagaagtaaggagtttagattatattctaatgtgaagaactgccttgaataagtgccttgacttaaggttcttagacataggattgctcttttctaatgatgtgacatttaaactctctttctcttgagtggtattgcattttttttaaattataataaatcagagggaaatatattattgttgaatatatatataactatatatgtagatagagtaaattaaaatgagttacacctttatgccttagcatactttgatttacagatagatgtgatacatccgtatttctattctacttattctggttttcagaatcaagaaaatctcaaatctggagaatctaaaaagcttagatgtcttggatcttcatggaaatcaggtattgtaaagccctttcatttctttcttttttgaaaaaaagtccaggaaaatggtataaaagttttaagaatcatactcgcattgaatttttcaagagtttctttattgattcactgaaatttctaaggtatcaagcttatttatagaagatttggtaactcctcagcagtacatgacagatacagcttataaaacatttcaaattcttatagttatgacaattttgttttttattaacttatttttaaagtacacattttgcaaccccaatccaagacctagaatattactgactttcttctacttaggtatttgtttttttattccatctccttatttctgcatcacaggtaaccactattttaggtttcatgcttttcattcctttttgggtttttcagttggttttatcacatataggtgtgtcttaataatatatcctttagtagtattgtctcttaatttaaaaaaggtatactatatgttgtcatctagtgtttactttttgaatacagcattatattactgagatttaactatttcaagtagctatagttttatttatagttgtatgttccatggtaagactatacaaaaactttttgctccagtttcttattgatagacatttggattgtttcctgtttttattgttgttgttgtctgtttgttttatcttgttttttgctattatgaatagtacttctaagaactttcttgtacaagtctcctgttcttcatattccatatgtactctagagtatataggagtgaaactgatgagtcataggctatttaaatgtttaactttaaaagataatgccaaattgctttccagagggattgtaccagtttgtactcgtaccactaatacataatcatgttgcttcctattcttttcaacattttgatttgtcagacttcttaatttttttctgattgaattggtataaagtggtatcactttgtggttttgatttctattttcctgattactatataatctgggctcccaattatgttcaatttgtctattcctgtatctgtctgaatttctatatttattttatttatttatttatttatttatttttgagacggagtcttgctctgtcgcccaggctggagtgcagtggtgcaatcttggctcactgcaagctccgcctcccgggttcacgccattctcctgcctcagcctcctgagtagctgggactacaggtgcccgccaccatacccggctaatttttttgtatttttagtagagacagggtttcaccatgttagccaggatggtctcgatctcctgacctcgtgatccacctgcctcggcctcccaaagtgctgggattacaggcatgagccaccgtgcccagctctatatctatttttttatgttccctctctttattcttctctgtcagatcatattggctgtttttcagtcctttgctcatccatttaaatatttgtctttgaaatgtaatatttataaatagttacatgagctacatacttatgcagaatgtaaagtctcttctgcagtgataagcctacatcctgggatgatcggggaatccctgcctgttgatgaacaagatctttcacagctgcttacagttggtcaggtgaaaacctcagtgtggtctctctaggctttctaacagctgttagttccagtagttttggtgaaaagctaatgtaattaataaaaaccttgatagatttaataggccacatctattaggttcgaatctagttcagcctgatgtgtttgtctgtgtgtgcatgtagtaagtgggaggagtgttggtggcctgggaattgtctggctctgcaggttagttactgtctgtccaacagaggggaagttatccagttagatggtgctagaaggggaagaagaattaaagagtattgacagtaaaagaatatcatatgcaaaggcactgagatggaaaacaacacagtaagtatttaccaccagagaacagagcatgtgtggaaggatgctgagagaagagactagaaaggtaggcaacggccagattgtggagggctttgtatgccaggcaaattaattggtgttttatcctgtattttaaaaactgtttataactataaatgaaacattttatgatagcagtatttttcttgtttattttaaagtgtatacatgagaaataataaacatatgattttcaaattctaatatatctttaagagtttgtgagtactacccaagatcttcaagagcacctgataaatgaataccatatcatttgatctgtaccttatgtataggcattatttaccaatcattatgttgatgaaaaatgtctgttccttgttagctgacctgtgttatatattttataatttcagcatatgtttgtgatattgtgtgtgttaaaattaaacatttgtagtgcacaaattacttctcaaggttcttccagttatagaaccttgagaagtaatttgtgcagtacaaatgttctataactggaagaagaaagttttaaatgaaaatctgagtcttgtttcataatatatgaatccaaatagcaaaaattcacagtatttcaaagcaaagatacagtcttagttaccttaggtttctaaaaagccaggaaggaactattctagatgaaacaactaatgtccaattctaaaaatttagcatcttatagtaaagaagctaaaagacattaagtgaatgttttttgtcttttgaatttacttctattggtaataaaaatatgcttggtgcacattgtgaaataaaacataattggtttatggatgtgaaatcattctgagtaatgatgatggtgttcaggaaatggattgggaagtagagatggaaggaggggaaatggagacaaaacagttgggagaaactaattacaataatcttggcgagaagtgatggtggcatgaactaaagtagtagcaataaggatatgataagggggcagattggataaatatttaaaaagtagaaacatcaagacttagcaattaattatatatgagtagtgaatacagaggaatctaggaggttgagtaggaatttctaacctagagcttgtgttggttaaccataattttttctctcagtgaatttttgctttaacatagacacagatgtgcttcaagaagaatctgttctttcagtgatctcttttcctccagggagagcctgctatttctgtggctgcttacctgaaagcaaacacttgccttttctgtattggtaggtaggaaggttatctttatccaggcagagcaatctaggttactctcatacacaaaggttaagactggagtatccagctttcctagatgtattaagaagccttgcagactatattgggacactctctgatctgtatgacccataaatgggctttccaacattcccatcatcttttttcttgctgtgaagtatatcaatcaatcaagacctatgctgtcactttatacaaccctttgcctgaagcttctattatctgctttatgcttgtgactttgtccatggctgtaacgagtaattgactttattccatagcagatgttgtacatgattctggcctgttgggttgcaaaccaagaagccagataatattcttagtgatttttaaaatatgggtctatatacaagaattaaccatgtttcttttcagacttttctaactagaaggtaactaaatgcaggcattctaattgtaagccccaccaggaccatgtggaagggtagttttctaaaagaaatgtccagaactattagcagaagggagaaaacacaccgtgcagatcatacaattgtcccccataactctatatatttatatatttcttgagctcaggaaagttttctatatttaaacactgcttcttttccatttatgtttgttatatctgtattgtttgtcttccatctctccatcttatcttttattcttcctctctgtttttccttagcattttgggaggatttctaagcttgcgctgacattactgattactttttctacagtatctattttcctttttactggcttcttgcattttaaattctatcacctgtttagttttaaaatattttactccatgtcttattacacagttttatcatctgttaatactcataatcttgtttctttttcaacttttatataattttatctttacattagttaaatcaaaaatcttaaaacacattttaaacgtggtcataggttacttttatatattattgaatttataataaacatgtttcttttctggaaactggatggaacctagatggtgtttcttgaatataagagtgtccaaataacaatgtgaaatatagattagacatctgagaaaagttcttttagctaacatctgctttgaagtgttagtaagaaatttcaaatatactgtgatggcaatacaaatgagcaaattaatctctagtgattgtgaaattcattttaatgttcatcaggtttatgaagtcctccatgaggacttctattttgtgtcatgcagaaactcatcccattgtgctacacttgctctattataatagtggggcttaacatcactttgagctctcatcacttcacagtgttagtttttacttaccctctccttagtgtgcagctcaaacttctctgctgcagttcagtgctgattatttattattattattattatttttgaggtggagtttcgctctgtcgcccaggctggagtgcagtggcgtgatcttggctcactgcaacctctgcctcctgggttcaagtgattctcttgccttagcctcctgaatagctgggattacaggcccatgccaccacacctggctagtttttgtatttttagtagagacagggtttcaccatgttggtcaggctggtctcaaactcctgacctcaagtgatccacctacctcagcctcccaaagtactgggattacaggtgtgagctaccgcgcctggcctcagtgctgattattaacggcagcagcaggccatctggagtggctgctgccatcaggccagctgcagcagggaggcgtggctggggctgtgggctccatggagccaggtggacctggggacaagtgggagccctgccccttccgagttggggcgggagctccccgggtgctgctgcagccactcaagtcacggctgcagacctgggcatccctgtgctgttggggccaggaagcaggcaggagccccgccctcctgggtacagctgcagcctcccaaactgcagctgtggacccaggcatctctgcactcttggggacgcagaaagtaccccccaaccctcactctcccgacaggttctgaagtgtttgtttctgctgtctggcttctccctgctgttggtgcctgctccaatctcagagcaaagttgtggttgagcctgggtgctgtggcagcctggccaagtgtgcacatgcttggggcagtgcttacacaccagtcccttgccacctcagctccctctgaacttttggtgccaacaagcatagaagggaatctgaggggggctgagggcagctaggtgctggcctgcaggtgccccttcatacttatagcctgggcaccatgaacagcagcaggaagcagacagttgcctgagcagaagggggcaggtccctggtgactccctaccttcaggccagactgccactcccaccgactggagtgggaacttgtggtaccttttctgggcctgcctgtggccgcccatgggccaatcagcactcacttcctctaccctgaagcccataaaagccctggactcagccagtgctgagcagacattgggataaccagctgtagagaggaccaaagtactctagggccctctctctgttgacagctgtagagacattgggatgaccatctgcagagaggagcaactcactctagggcttcctctctgctgagagctgcagagttgatgggatgaccagttgcaaagaggggctgccctttctgctgatagctgaacacttgtcaagatgactttcctagtacagaggagctaccctctctgctaggagctgaacactcatcagaacaccctggctgtggaaaggagctgctccctgtgggtttcctctgagctgttctatcacttaagaagctcctctttgtcttgctcaccctccacttgtctgcatacctcattcttcctggtcgcaggacaagaacctgggacccacagaatttgggaccccagaatggcaaggctaaaagagctataacacaaacagggctgagacatgccccttgctcgccatgttgcaggcaaagagaaggaaactgtggcccttcaggtcacctagacttgagagctccccaagccagggctgtgactccctctttgggaccctgcggttcctcgcatatccaagcttccgagtgccactgtgttctcagtgccagctgtggaagctgcttgcagtgttcctggtccagccatagcctcgcagagagctggtgcctgtgccagcacctggagctgcctgccctgctgtagcagccagcatgtctgactgtgcacagtggccagaccccatgctcactcacactcccttctcagttccacacctgacttgcccttagcaggcgtgggacccaggccagtagcatgagctgagtgcagcctgccagggtgggtaggcaaaatgagcccagcgggccagagcaaaacttgggcaaaggtaccactggccacagaggtttctggtcagaaaaatgacaccccaaagatcctgtaacattatatgtacatgcatattccatgattcaagtcctcttgttttaaacaatgttcaccattttgtaccctcactaaacatcttccatccttattaatggaacagctttccattaattaaaaaaaaattaacctcatcttctactgggaatcctagttccttgactctttccattcagactcgactgctctcaagatcttgcagtttaaatagaattaataagggtaacttgatgtcattcctttcccttgccttttctgtcagagggcagacttgctttgttaaaacatgatgagcttatgccttgggatcacagtatgtttctatttggcaggtagtatgtagccttcacagaacctgggacagactgggcacgtaaagttgcccaatggactcattgactatttgatgacgtttacgtcaagtgtttactatggtcaaattgtaaaatatgatcttttagctaatgttcacaagttacgtgacttcatgttatctacagcataggaaattgaaaatagatttttaaatgtctacatataaacttgccactaaatctagtgacttcgaatattttatttttagggtttttagaacatgtatatttcaggtttttgcctgctaatcacccttctcctattttctttaacagattaccaaaattgaaaatattaatcatttgtgtgagttgagagttttaaatcttgccaggaactttttaagtcatgttgataatcttaatgggctggattcactaactgaacttaacttgcgacacaatcaaatcactttcgtggtgagtattaaaatggagttgatatgtactttgtggctttctttcaaggaattgaaacaaatgttgtaatatggctttctgcaaagtaagaatctacggttatttaggttttttctgaatttaaattgtggatgtaattattaagctctgtaatatgttggtttgggaggtattgaggtattttccattttaaagaataaatataatgttagaaacacaacagaagtgttatcactaaatgaatcatttggtgtaaatgagtagtaaaccctcttctgttttgtcatgggtatagaattaataagaaagagggttatttgtgactgaaagttgagaaattattgtaccaagagggaaaaggcacagagaggagagattgagagttgtgaagatacacatactgtatgctttgcagtttttaaagaggagcttggtatggtgggaaaagcattgcacagggcatcagaggcctagttatggtcttagcttcatctctcattagctgtgtgaccttgggtaaatcacaactctcttggcctcagtttagctttttctaaaatgaggacattggaccagtttgactctagggtgttttttggtttattgactctgaaaaaagacatgaagatggtagagaactggcatgtgagcaggaggaaaaagagttcgattgtgggggcaaaactacacaaaaggggattctggaactctgagatgaactttgtcaaatttatgattttgctgaaggtcagcaactaaatagaagcttgatgctgagatattttgtattcgtacatatgtgaagagcattagaaatataactgttctgctttgtgatatgatacagctaatgaggaacattatttgctcttttaagaagtttcctttgtttaaatgctatagaaaaactgctttaagttctctctggtatcatttatgcactttgaaagacacaatataactcttagctgtttcaataccttgagttcccttgtaaagaactaagtgtactataaatggtacacttgaaaaggctgggggacagaggataccttatttataggtctcatcgtacagattggttttattttgaaggtttcccagaaaatatgagtcaggtaatactcatctcttctagaaggttagaataattttagcatgctatccaagacacagatttattccagaacttctaaattctgtcaagcccttcccagattagatacaatactggaactggactgtttatttagaagacattcagattgggttaacctgttatgttgctaaatctccaagaactgctcagtcaggacttagtttgtccttaggaccttgggtctggtaagattccaaaaagctttgttagagtagggaacaggaatctattggccctagcatattcctgcctatattttggctttcatttggaaagtgcataatgcatatttaggaaattgcttactgaatttcccgttgagtattatgtttaatcattactgttatagtttaggcagcagtaaacaacttatggaagaggaaattgtattaatttctaaaagttaagaagacagtagtaagtatcatgcatattaattacagtcaattgtgaaatttgctatatatcaaatttactatatccatatattgtgaaatatatggacaaataaacttcatccaactcatttctttttcaaagcatctcttttttaaaagattcaagggactttaaaatctgagaatacttctcttccatcatttttttctccagtatcagttaccacacttattcttcttgcttttttttctttcatggttttgattttcctcagtagctggtaatctttaaatgaaggaccatgttaaggagtatctgggtatcctgtgcagttgaatagatctttttaaccataagatctcactctagaataatcactagatttgtgtaagttcttgaatcccacacatttgtgaacttccctttagggtaagtgaaagggaaagtcactcagtgactgccaaaataagactttactttcaggggtagaaagactttgttttcatttgtgccaggtgaaactgccatttcttttttccctctgattcttatgtagaggtggttaataatctctatagataaaacacccacactttccacccttttttgacaaatactctattttgtttggagaacagttccttaggctctagctgaggatttctttagccagatgctctgtacatgtttatgttcatgacagaagtgggagtgggtgggtttgttggtattccaaaaatagctgttgagtagacagatctttgattatacactacttgattcagcacagttcaccgtagtccatgcctgctcattgtatgcactgacccagcatggagtaagatggcattcagtcagaaagaattgctggctttgagtgcagcatctctcttgcagttctgagctgcagttctctctgctcagggttatctcagtaagatcccatcagcttttcagctgcttgaacttcatcagaagtgttggtcagatgatgataactcttttgttagggttttcatgaatgtactcatttgtgtgtatttttattgcttcacccattgaatcttggaaagaaggtgaaacaaatgcaacctacttaccgtcttgaacagacaccttctctgatgtttttgatgtagaaaagttattgcttgtttatttaccaatctttgtttttgaaattttataaatttcaaaccaagtatttttagtttgtatggcatctttctctttaaaaattatgaagtgtcttatatccaaaagacaggcaataacaaatgctggcaggaatgtggagaaaagggaacccttgtacattgttggtgggaatgtaaattagtacaaccactgtggaaaacagtttggaggttcctaaaaaaaactaaaaattgagctaccatatgatccagcagtcctactgttgggtatatttccaaaagaaaggaagtcaggacatggaagagatatctgcatccctatgtttgttgcagcactgtttacaatagctaagatttgggaacaacctaagtgtccattaacagatgaatggataaagaaaatgtggtacatatacacagtggagtagtattcagccataaaaaaggatgagatccagtcatttgcaacaacatgaatgaactggagatcacattaaccgaaataagccaggaatggaaaaacacatatcgcatgttctcacttatttgtgggatctaaaaatcaaatcaattgaactcatagacatagagagtaggaggatggttatcagaggctgagaagggtagtggggggttgaggggaggtggagatggttaatgggtacaaaaaaatagaaagaatgaatgaaacctaccatttgatagcacaatagggtgactatagtcaataataaattaattgtgtattttaaaataatgtaagtggattgtttgtaattcaaaagataaatgcttgaggggatggatacgccgttgtccatgatgtgcttattacacattgcatgcctgtatcaaaacagctcatgtaccccataaatacctatacctactaggtacccacaaaaatttaaaattaataaaaaattttaaagcaaaaaattaataaaactcaaaaaaacctgaaacatttcagatatccccaaaataataggaactaatattaccaacatttgtatatatcttttattttatctgttgctgtctcaagttttgtgttggatatttcatatattagttttcagtcttttaaattttctcataaaagcatttaagcctataaatttccctctaaaaatcacttcagcttcttcccataagtcttgaaatttagtatttttcttattatttagttctaaacattttgtaagttccatgttttactgtgatttcttttttgatccatgtgttatttagaagtacaccttaacattttgaaatgtatggattttttattctatggccattcttttctagtttaattgcattgtgaccagtaaatgtagattatgtgtaattggtactttaacgtttgctgaggtttttatttacttatttattgcctggtatgtggtcagtatctatagttgatgcttactatcaatgtatttgtctagtatttgtcagtattttgaagctatgtttctagaagcatacaagtttaaaattaatatatcttcttggtaattgttccttttattgttatgtattaactctctttattactaactccttcattaagcaagtattttatgagcatgggctatatgccaggcattgttctaggtagttgggatataacaggacactaataatacttattaccttaatgtttatttaatgttaataccaggcttttctggttatttttctttggtatatcttttttatttcctaacctttttagaaaaatttttaatttgatataatttcagaaaatgttgtaataatagtataaagaattcccagtacaaaatgcacccggattctctaaatgataacattttgctacatctgctttatcttctctcttgcttactttctccctttttccttctccatatatcagttaatatatactttttttcaaccatttaagagtaagttgctggcataatgcctctttattgccacatacttcggtatgtatttcctaaaaacaaggaattgtcttataacaacagtaccactatcaaactcaggaaattaacattgatatgatgccatttatctaatctatagatcttatttggattttgccatttgtcccaataatgttctttatagcaaaagaaaatacaagatcatgcattgcattcagttgttatatctccttagtcttctttaatctagaagagtctttttttgtatttcatgacattgacatttgtgaagagtatggcaggaatgtcagagaaaagatgctgagtttttttcagtgtatatgaagtatgtattctttaacttccaacctttctcttaaaaagaatgcatagccccccttttaaacatataatctgagaatctgtcttattaccagagactttagtctattgtactaattgtaattactgatatgtttagattttttacttagatgttatttcatgcttcctatttgttatattttccctatgtttttattttcttctgtcttattttgggttgatagtgttttctctgttctttcttattcactttaatgcttactcttagcattttaaaatatacacttgacttaaatcacagagttaatacacatctctacactcttatcagataaggaccttagaatcatttaatacagtaacctttccattttacatgtttttgttgcctagtattttctttttattcttttacccccaaaattagacattttaattgctattgtttccagtcagtgcttatttggatttgcccacatgcttgtttgggttcaccactccttctgcatctctgtctatccttcttcccaaaatatatcatttagaaaaagtttccttgagataactctgaagtctctcagtttttgtttatcaaaaaatgagtttattttgcttttattcatgattgatggtttgacttgactgacagttatttttttcccagacgtttgaatatcatattccattgcctttgagcttctgttattgtcattaaaatgtctactatcatttgtgtgtgtctagggtatcttcttttccttcctctggttgcctttaagattgtaagatttctttttgaagtccttcagatttactatgatatgtttaggtgtggaactatcttattttattaatttgaaacagacattttccatattccaactctgaaatctaggtatgtcttacaatctatagcatgcttaaatcaatgttatacaggctacagcaatttcattgcctaaatatatgtggacttggttatgctgtttgtactattgtcatttcagttgttggtactgtatgttttgagtttaatcactgttcaaaatgcattttaaaatattacaccatgatttggcattgaaatgaaacattctattcaaaaagttatggaaatagggcagcaaagacattaagtttaatattagtgagacaaattatttttcattggaagaatggccgcaattctaccttctcttgctaattaacaatcaaatactttaaaaggaagatagccatgtattactgaagctgtattacatttgttactgagatagattcagagagattttgcctatcatgtgtcaagcaatgcaactgaaggcagaagaaattgaggaaaccccttggaatagatgaaagaaatttcaaaataacaagaagctgtgtgaacaattcatattggtgctttctttgtcttatagtatcaaaacatacagaatgggtatcagtatttggaagaaaatcccatatacaataatggaacacacttttaggatatactgcatcatcaatgttcttaatggcatagaagacaatattgtgtgaaaagcatggacattattagttgaaaagtgattgagaagtttaaatctaaatatgaagacttttccttcatactttattgagggataatttaggtacaataaaatacacaatcaactgtacagttcaatagcttctatttaatctgagtaatttcatgtgactgatatttctatcacctcagaaagtttccttgtgcctctttctagttagtaccctcccctgccccacaggtattctgacttctatccctgtggattaattttgcctgtttttgaaaagtacatatataaagattatgtactcttttgtatattcaacataatgtcttgatattcatccattttgttgtgcatatcagtagtttaaaaaattattgagctgtattccattgttgaaatatcatacaatttgcttattcatttttctgttcacaggcacattggttatttccaatttttggctcttacaaataaagctgctgcggatattcttgcagtttttaaaaattatttatttatttagagatagggtctcattatgttgcccaggctcgttttgaactcctgggctcaactgatcctcctgcctcagtctcccaaagttctggaattacaggcatgagccaccaaacatggccatagttttaagtttacatatatattttggtggacaaatgctctcatttctcttaggtaaatatgtaggagtgttattactgagccatagggtaggtggatgtctaaatttattagaaactaccagtttttttgttttttattttttatttttattatactttaagttttagggtacatgtgcacaacgtgtaggttagttacatatgtatacatgtgccatgttggtgtgctgcacccattaacttgtcatttaatattaggtatatctcctaatgatatccctaccccttccccccaccccacaacaggccccagtgtgtgatgttccccttcctgtgtccatgtgttctcattgctcaattcccacctatgagtgagaacatgcggtgtttggttttttgtccttgagatagtttgcagagaatgatggtttaaatttttgcaatctactcatctgacaaagggctaatatccagaatctacgaagaactcaaacaaatttacaaggaaaaaacaaacaaccccaccaaaaattgggcaaaggatatgaacagacacttctcaaaagaagacatttatgcaaccaacagacacatgaaaaaatgcttatcatcactggccatcagagaaatgcaaatcaaaaccacaatgagataccatctcacaccagttagaatggcgatcattaaatagtcaggaaacaacaggtgctggagaggatgtggagaaactaccagttttatgaagtgattataccattatactcccagcagcaatagagagttctcattgctcaaaatccttgccaaagtttgtcagtctttataattttagcaattctatgattctcattgtgcttttaatttgcattttctttattactaatgatgctgaacatcttttcaagcatcttttcatcttttatgaagtatcagttcaaatctgttacctgtttgaaaaaattaggttatctttttatcattctagatgcaggtcctttgtttgatatatatatattgagtgtattttctccatgtaaaaaggcttgcctttttactctcttaacagtgtttttgatatgtagaaacttctaattttagtgaagctcagtttagcaatttgtttttgttagttgttattatcttttgtgttctgtctgagaaatcttttcctgtcccaatatcatgactatgttcacctacattttcctccagaaggtttatagttttacctttctatttagatatgtgattcatttttattttcatttatttgtttatttatttgagacagagtttcactctgttgcccaggttggagtgcagtggctcgaacatagcacactgcagccttgacctcctgggctgaagcaatcctcccacctcagccttccatgtagctgggactacaggcacatgccaccacacctggctaatttttttattttttgtagagatggggtcttgccatgttgcctaggctggtctcaaacacctgggctcaagtgatcctcccatcttggcctcctacagtgtcagagtttacaggcatgagccaccatgcccagccagtcatccatttttaattaagtttatgtatgctgtgaggtaggggatcatagttcatttttcccacatagggatatctattttcttcattatcttttatttaaaaaacttgctttccccactgaattaaactgttgtctttgttgaaatcgagtactaatcaaatggatcttttttctggaccctctattctgttccatctattcgtctacgtaatatataccagatccagtcacatctttaggctccacttttagttctagctcttttgccctttctaccgcatctatatagtaagtagagatattctggaagttcaacaaatttattttgtgtaacttactttttatgtatgcataaaaacgatattcagtaaaaaaatctggttaagtctaaaagagctctttcagtaataaacacaaattttaagtgatatattattctactataagttaattttaagtttattttccccaagtgctgaataaaatagttgtaagataatgttagatttaataaaatgtggtaattttattagcatacctaatatttgtgtttcctaaatctgcagattcataactttcatttatttatttatttatttatttaattttcttttatttatttatttatttttgaaacagagtttcactcttgttgcctatgctggagtgcaattgcagtcttggctcactgcaagctccacctcccgggttcaagtaattctcctgcctcagcctcccgagtagctgggattacagatgtgcactaccatgcctggctaattttgtatttttagtagaaatggggtttcaccacattggtcaggctggtctcgaactcctgatctcaaatgatccacccgccttggcctcccaaagtattgggattacaggcatgagcccccgtgcctggcacatatctttcatttattatgggaacattctgagtctttatattttcaaatattgcacttccattttatctctttctacttcttaaacacctgctagatatagtatggaccttttcattctattctttgtttctataattttcatcattcttatttctctctgcttcatttcttcattcttatcacttatctggttctacctttgaattcactaactttatcctcaatttatctaatttgattttcagtccatccattgagtttttaaaaatgaccgtagttttttctttgtagaagttctacatgaatttttttcataaatgcccagatgtctttatttctaatgcaggtataccttagagatactgtgggttcagttccagagcaccacaataaagcaaatgtaggaataaatgtaggaatgagttacatgaagtttttagtttcccagtacatataaaagttatgtttacactatactgtagtctattaaatgtgctatagcattatgtctaaaaaaactatgtacataccttaattcaaaaatactttagtaataaaaaatgctaatgatcatctgatctttcagcaagttgtaatctttttgctggtggagggagggtcttgccgtgatgttaatggctgctgacagatcaaggtgatggttgctgaaggttgggatggctgtggcgtaaaactcagacaaaaatgaaatttgcctcattgacccttcttttcatgaaagatttctctgtagcatgagatactgtttgatagcattttacttacagtaagacttctttcagaattgaaatccgtcctctcaaaccctgctggtgctttatcaactaagttaatgtgatattctaagttgtttgttgtcatttcagcaatgttcatagcatcttttcaccaggagcagtttccatcttaagaaactattttctttcctcatccgtaagaagtgactcctcatctattcaagtttggtcatgagattgcagccattcagtcacatctttaggctccacttttagttctagttcttttgccctttctaccacatctgcagttccttccttcactgaagtcttgaacccctcaaagtcatccatgaggtttgggatcaacttcctccaaactcctgttaatgttgatattttgacctcctcccatgaatcatgaatgttcttaatagcatctaggatggtcaattctttctagaaagttttcagtctactttgcccagatccagtagaggaatcactatttaaggcagctaaagccttatgaaatgtatatcttaaataataatccttgaaagttgatattactccttgctccatggactgcagaatggatgttgtgttagcaggcatgaaaacaacattaatctccttctacatctccatctgggctcttgggtgaccaagtgcattgttaataagcagtaatattttgaaaggaaaattttttcctgagcagatctcaatggtgggcttaaaatattcagtaaaccatgctgcagacagatatactgtcatcagcatacaactttgttgttctgtttatagagcacaggcacagtagatttagcacaattcttaagggccataggattttcacaatggcagaggagcattggcttcatcttaatgtcaacaactttgttagctcctaacgagagagtcagcatgtgttttgaagctttgaagttagttattgacttctcctctccatctataaaagtcctagatggtatcttcttccaatagaaggctgtttctctatattgaaaatctgttgtttagggtagctaccttcatcagttatcttagctggattatctaggtaacttgctgcagctttgacatcagcacttgctgctacttcaccttgcacttttatgttctggagatggcttctgtccttaaacctcatgaaccaacctctgctagcttctagcttttcttctgcagcttccttatctctctcagccttcatagaattgttgagagttaaggccttgttctggattaggctttggcttaagagaatactgtggctggtttgatctttccagaccattcaaactttcttcctattgtttttatttattaattgtgtgttccactggagtagcacttttgattttctccaagaacttttcctttgcattcataacttggctagctggtgaaagaggcctggttttcagcctatctcagctttcaacatgactttctcactaagcttaaccatttctagcttttgattttaagtgagagacttgtaactcattttttcacttgagcacttagagaccattgtaggggttattaattggcctagttttaatattgttgtgcctcgaggcaaaggtaggaccaagaagagggagagagatgggggaagtgccagtgagtggagcagtcagaacacacatttgttgattaagtttgcaaccttctatgggcacagtttgtgatgccccaaaacaattgcaatagtaatatcacagatcactgatcacggataatcataacaaatataataataataaaatttgaaatattgtgagaactacaaaaatgtgacctagagacgaagtgagcacatgctgttggaaaaatggcactgacttggttgatacaggattgccacaaaccttcaatttgtaaaatttaaaaaaaagcacaatatctgcaaagcataattaaacgaggcatgcatgtaccttattttttcttgtttttaatttttttcattgctcttataaatttaaagataaatattccatagtctttatcaagttactatattttcttaattttttggcatttcttcatctgttgcctgaaagttctactgactgttactcatggtaattttttctttatagtttaatagtttggaatagtcaggatgttgcaaagcctgagttgaattcgtgtccttctagacagttttgccaggagtgttagggtcatgaatgccaggtaccattttttatgaggggtctttttagattatgtttgtgatgtaagtttgaactgtaaattccagtgagggaaagcctatggttatgaaattgaggctttttattgatttcctcaaagctgttaaatctagctctcctagattataaagactggacatttccctaattagtcagcatatcagtgccttcttactggtctggttttaagttccctttcagtttttgctctggggtattaaaacagtgtgtagaagaaaatcagactggtgaattgactgatatctattgctgtgtaatgggtagtaaacaagtacaaaaaccagataaacccattaatgcctttggataactgccaaataatggacttttttcattggcatttatatatatgattagagttttaatatgatggcttgcagctattagtcctcatataataagtgtctgtgtcacaaagtgataggtgaagcaagtagttattttggaattaatttaataagtcttttttttaaaaaggaatacttcattgttttttgtttccaagcttgtttgatgctttgtgaatgaatctgtttacagctctcaaagttagaataattacccctatatatttttactctaacttgttttgtatgaaagcctacatagtaaaaatgagagtagctatgattttattatagacatctttgccctacttgttgcatgtcagaatccttggtgcatgtcaaaatctgttcacctttcttcttccttattcctctagaggaagctgctctaaaaatagctccagtgatagatattccccacgtgatcagattgctgaatcatttagttcttttcttttcttttttctttctctgtctttttttttttttttttttttgagatggagtcttgctctgttgtccaggctagagtacagaggcgcaatctcggctaactgcaacctccgcctccctcgttcaaacaattctcccgtctcagcctcccaagtagctgggactataggcacacgcctccgtgcctggctaatttttgtatttttagtagagatggggtttcaccacactggtcaggctggtctcgaactcctgatctcaaatgatgcacccacctcacctcccaaattgctgggattacaggcacaagccaccacacctggccatttagttcttttatgcagtttagggatatggacaacagtgcctgagcagagtaggacaagcatttttctcagaaaacaaatcagtatttttttggaaaataaagaattataatcctctcaaataatcttgtggtaaataattttttctattttttaaaagattatattttccaaatacataaaatagttttgaattttacttcaaaaaatgttttgaatattattttcagtattatgttttattaaaaataataaatttaagataatgaggaaattaataacgagctataaatattcccctacatgtaaacattttatttcatttttttccctctcatcttaggtatgttaacattctggcttctttgttatagtttctctgatgctgaaatagttacctccagaaaggatatgttaggggtatttaatgcttgacagtaaaataaatactttttcttaaatagatgagaatttacctttcttacattatccctaacccccatttccactttccctgtcattccgaaataatttttaggtaagcagattgttgagtgctggctcctgcagagtaccgccagaatgactagttgataaagcaaaggagaaattactactggcaagtaaaagcacactgccttgacatagccttggctgtatcttcgaaggcagagacaggagatttagtttgaaatttcttggggttctggtttagggtgggtctttcaatgcaggggcttaatgaaaatggatacatttatgatagaatagattaggatggttgacaaagcacggtgaggttttcaaagtgagtcttggaccatgatgttaaacttttgttttccctgagattaatagctgtctcaatttagggcttgtttaactatcattaatgtccaaactctccaacaaaaccctaaaatccctttctgtataggcaaagacttcaggtgatctgtgtttcatttttacctcttggagatacccttctagagcctcctgtcccctgtctaatgaagtctgcttgcatttagccctgctatacagatttcatccttggatttctctttgcctctcctagatgatgaattgtactccctgaatcttatatatatcccatcttttgtttactctcttatattagaggagccatcccctagtagtttttaacaggtctttcttctgtaaataatgcatgcatagataattgatacggtaaatacggtgttttctttttgtctattataatgctagaattttgttacaaaagtatatcacagaattgctaaaaaattggagaaaagttaacattttcttacagaaatgaaatttggaacaacgaaaaatgattgtgtataattatttgctttttaaagttctggaaagggtatctatgtaagtgattatgaggatatatagaattgaattctgcattttagtgtttcaacttgtgaatatttttatatttttgataactctactaggcaatgacatttaatgatttttaaaatttgataaagacgtaaaattttgtctcataaacagagattaaataattataattttgtcaaataaacttaaaaaactttttctcacaaattatatcctgatggaatttgagttttctatttttattgaaaaaagttatgtcttagaaggtgtttataatctctgaagatggcatgctggagctcaaagggacagatgtattttttaaatgagatgccttgattcaaaggatttaaaatgtatttttaaaggctgctacctctcagtttctccaggttgagtgccaataacaatgattgtgcccagaaatatctcaggtagattccaggaagaatctgggagaagagatttccccaggaatacagagagggttttcagtctggctatgacttcatgtttctagagaccagataggcagcaggctgccatttcctttggaaactagggccctggagtgaaatgagccctaccactagtctatcactcctcctccatttatgggaatatcagagagaagtagctgaaagagatgattttaaaagtttgccaacatatgaagtatatcacctactgagggaaatttggctgccctcctgtttccacagacttactccttggccatgaaaagctctaaaaatcattatctcacatctgtggaataggcttcatgggagtgggcctgagaatggtaatgtcaaatgaatggtatacatagccagtgtattgatcatgggctattgtattgattttacactgtttagggtctaaagggttgagagaagtttggagaatagtacatagggtaggtagaaaaacaaggcagcttcatttttcctttgctccctgaaaaaccattaaaaagtggttctgtcctaattctatcacttttatattttctttgaataacaaactttaaaaaaataaatacagcattttgggaaaagctaggtttgtcaataattttaatgcacttgcctaaactcttactcgggtcttagaaatggtagttttcagatggagggaagaaaaggagggaggaagaaagacgatgatttatggaaacagtaaaacaagttttgatttaggattaaatattggtcacaataacatataaaatatacttatttttgtattattcaaattaatgtaactgagaattactgcaaatgatactgcccttaaaaacgaaaaacattttatatgagacatggcagtatgtaacactttgaggatcagagcactggaagtcaggatactggaatctttccctgtctcagcctctagggactgactgtatgtactcctgggccaccttcccaccacacccttattctccccctgtagtaacctcgattggtcacttttctaggtgaataataaagttgtagacttggtaattaccaagcgtctgtaagattctgttactccattatatataaatcttttcagaaggtttatgtcttttcatgaaatgaattaggtagcttttactttattttttgttgtttttttttaaataatttggtcctaagcaattcaatatttgttaaggttaactgtatttaaacagcagtggtatgtttttggggtggtgtgcataaatataatagggtagatttcctattttaagaacctctgatatgagcttagatgagaaattgcccttacagtacccttcagtgacacttaccatgatttgcttttagttttatgggggaatcattagtgtattggttcatttgtaactgatggtttatttccaaggttttgagaccagtgagttaaatagctttaaaattctcactattgtttagaaagctaattgtataaatttaaatgttaaagcttttgaatggcttctttttaacagtgatttttaacaaatgtttgatcatactgtatttgtgctacagttgaagtgctgaagtagcattttggcatctttcccaaaagcatgcttaaagaggctagcggcagcgtctctccctgtctcctcagtgctttttaccttgcgagtggtgcagcttgttctgcggatgtactgaaaccctcccatttaatctgcagtggaggagagtggagctcactgtccagtagaaatcagtgatgtagcaatgttgcagtaaatagaaatgattatatatttcaatagcttagcaagaagacatttataatatttttttctttcatctgattaagttttgctgtctattttcttccagagagatgtggataatttgccctgcctccaacatctctttctcagctttaacaatatatctaggtaagtggaaactcccaagttgtcattcattataacttgattgtgtgagttctagtgctttagattaagattgtaaataccttggagaattttactagcatggaagattttaaattagaaaatgataagacaaagttctttgtggaaaagcaaagctcttgtgtgtattcttgcctgtaatgctaacatgatgaaattaatatagcatgtgcttttgatttaattatgctttagagttgctcttttgtaaaacatgagtacatagaaatttcaatgtatattttgctgtcctttgtttgacattcacggcactggtcagttgaattagaatttctttcataaattgtcagctacaatttgtatagctactaagcaattttaatacagcaggctatatttgtcactgagccacttgctaattaggccaaattgccttctaacttagtatctctgcttagaattaatgctgctaagagacagtggattagaatatagaaatgtataaatttagttttctaactatttgaagcatattatcctttatattgtgatgatgtctcatttagaattggagctgagacgtacagtaagacttttcaatgcaaaagggcccctactttttccctaattctttccttctcctccttcccaggagccacttagtttgaactgggctttttaatgccctcagttctttagtttcacttcaaagctgttctttgaatctgcttttataagagggtaaaaaatatatataaaaagatttagagcatatctttttctgaactccaggtctatgcttctgtattaaaaactagtttaatttttgtgtgttgtctgttggcatgttttttgcatgtctgccatcagacttgttttaacccaatcatcctgtactatgtctctaaaagacagaaattatctgaagacagtgagctttgcaaatagacattattttgaagaaaatactctttctcttttttctcttctgtgggaaaaaatattaaagtttttttgatagacttttcatattcctcttagtatattttgaatgcaacattccaggtgccattattctatcttgttggggaggcagaatttcttttcaatggcaatggaagggtcactcattttttttaggggaatttcctcctaaaaatcattaacaactctttagagaagatagtgtctcgtttttacaatatgcaaaatattctctgtttaagatacaaacttttagattcccccaacctgtggtggaactcattacttcttttgcttcttgtttatggggagtaatttaaagagatatataaatttggttatataggggttatgatgttcccaggtccccaggatatctgaatttctaaactcctaaattcctagctctgtaggaagttggttttggttgcctatatctgggaagttttcttcccaacctggaaaggagttctgctcacccagcaaaacaaagttaagattaatgagattaatatttacaactttctttaaaaagtgtgatttctcaagaaaataaagatagaagtcagctgacaattttgaggcttttaaaaattctctctgtgattgctttctttgtgtttttatatggctttcacagtataccttcctctagtgtttccagcggatctgcttttgaggcacagtatgtttcctgctctgtttttgttgatgcttgtggtccaggaggtggtatagtgaatatattgggtctgaggagggaaaaatcagagagaacaactttgaaaacatttctgtgaactttactcaagatacagatatctcagatagctgggctgtcagataacctgtagtgatagctacagtatatattcagggcacaattgttcttctatatcctggcataatagagttgccaggttttacagtgccagctttctgggacctatcttccatggactctaattcagtagttttaggtagggctcaggaatttgtacctttattttaaaaatgcagctgacttaaaaataccagtggtctgtgttattcaaacttcaggtcaaaacccatatagggatcctaagatcaatttagtgatttaaaaccagacaaattaaaatggaatggaaaatatcagagtttgtcacacattttaaaagcatacactgttgcataaaaattttccagttttaattatatatggatatgtctatgcatatgtgtgtatgttattttactatagacaacatggaaactgggttacaatgtaaatatgtttcttactatgggttagatgaaaaaatttgaaaaattctgtgagatatagcttcttatatttccactattattgcagtgttagagtttattgtactttcattttatattgtcccttctgttagactgtaaacttgacaaaggcagaggaatatgtctgtactgcttactacagcctcttcagcatctagcatgtatgtgttcttagtacaggtatcactagttgtattgaaaagatttataaggagaacttaattcctcaaacagaaatatttttctgtgtgatctaagaactctttttggtgtgtccatttttatgttattactaggtcatttagtctgtgtttaatgtgtggacctgtgaggtttaaagccataagcaaatcaaagttctcttggcagttgttttgggcttccaggttaatttgctgatttgtcagtaaggatcttgcccataatttctagagaaactaaaacttttatttatgcagtggggtatatcagggttagggtggtgggtgtggtgtgtcccagggtacagacaatgaggtacgttgtctgtaagacatttaaaaacaataaaactgacaaaaataatgttgctttttattgtcactttgcattggaatttctaacctacgtcactgttaaaatagtcttctctgccggaatgacctctcatacctcttttcttactttagtaagacaatgttatttggactcagctttttctttatgatatcactgaaaattttaaactaggtttttttttttttttttttttaggaaggaatgctgttttaagttctctaatgacctttgttagtacatatgttagtacatatagtatggttaaaggtcactgaagcacacgctttggggtgtgacttttccttcatcactattctctaagacaagataatcctccgggctgttttcaaaattttactgaaaatggtttataattttacctttatcaggaaatcattctccttgcatttttctcaagttatatttcagcttgataagtcaccctatatcaattatatttctagaaaagaatctatttctatttaggaaaccttaaactgccctgcagttgtctaatttagtactagttggtattttaaggaggaaattatttcactgaccttcagaatatatggatttttttttttttttttttttttgagacggagtctcgctctgtcgcccaggctggagcgcagtagcgcaatctcagctcactgcaagctccgcctcctgggttcatggcattctcctgcctcagcctcctgagtagttgggactacaggcgcccgccaccatgcccggctaatttttttgtgtgtgtttttagcagagacggtgtttcactgtgttagcctgacctcgtgatcctcccgccttggcctcccaaagtgctgggattacaggcgtgagccactgcgccggcctatatggatattttttatgagctcaggttgttagatagtattcctgtagttgagatacaaggttttattcttgtgccttccaggattgcaagtgtcacttacattattttggcttgaaggaaaatcatttcccttagttctagtatgcagcatactgttagaatgcctttacttttcctttgttagcagataaccaatgatatgcaaatcttcttactgagttaaacagaggaaatcaactattgacagatcttttctgaccatctgctaagttttaaatttgagaaatgagtacatgcttgtcaaggaaatttcattatcagtacccatttatctactgaactcctcttgaggggtttaccaaatggttgacacgtgattcgccttcagacaaacatttaattgcatttttctaaatgtgatgggcataatgtaaggaggacccataaaaacaagatttaaaaataggggcatttgttttcatccatgctgctttattccttctttgtgagtaaacccctctgagtatagtaaggtggcatatagtgccttagtaggtctgactgtaaagcctagctccagcttttgaattcttttagtcagaaaataggtgaaaatagatattcacaactaatgatagatatgttctaccgcttcagaaaaatagactttgaggtaagatcaatttgtttgatcatcctcagggctgatgtaattattgggtctaaatttattttatttgaaacacagcacttatactaaaataatttttctatggtttttcattgtatatcttatttcaatactactttattaaagtgctgtttttccttttagagatcaaaagcaaaaattattctaaaatgttatagaatgatagtttctgaggacgattttccacaagccttgcaatttactgaagagtcagagttcatggggcaggggtagtagagagtaaaaaaaaaaaaaagaaaagaaaaaaagaaaagggggccaatgtacaacgtaatggggaaactggggaccctctgttacatttgttgtattccttttgcattacctttgaagcagcaaaaagcaaaaaaatctaatggatagcagtcactttttaaattattattacatagcttcttttattatcctccttatatcagcatctataaccatttaaagcattaatgctgtaagtacaaaaatacatacagatactctcatggattttatttataacattataaagtggagagtgctaccgtgtatgctttccaacttcattttataaaatgttgttgaaattaatctttgcaaaattgtaatcgttttctattaaaagattgcctttctttaatggacattatgagtcagttggagggttttttacctgtaccttctcaaccaacttataaatatatatatgattgcaaactcacaggaaattttccagatattcttctataattgtaagcctccatttttattactgtaaaggttatgtgtgtgtgtgtgtgtgtgtgtgtgtgtgtgtgtgtgtgtaagcgagagagagagtttttctaaaaagaaggcttctggaactaaaattaaactaaggcctgggagcaggctgcttgcataccttgtgtcagtctgagttcacacatacatatttgagaggctgatagctattcatagcagtgagttagcagttttgaaaacactgatgtaccaaaggtccctttggattttattcacgtgaaggttctaaaagttgcaggaaaaattttggtgcataagggccttaaaattaattactcatgattacatactgggtggtgttcagaaacaaacaagtatgataaattgagaccaacatacgttttatgatttcctttgtattttgttttacaaaggcatgaaaattcaaagaatattcagaaacaaagtataagtatattaaattcaaaatccacttagaaacaaacttaagatatataactagtttcccctagtgcatttcttgtacttatattatagaaatacttccaaaagggatttgaggtagtatcaatgaagagagtcaaactctgtaaaatatttgaagagatttattctaagccaaatgtgagtgaccatggaccgtgacacagccctcaggacgtcccaagaacatgtgcacaaggtggtcagggtgcagcttggttttatacattttagggaggcacgagacatcaatcaaatacatttaagaaatacattggtttggtccagaaaggcgggacaactcgaagtggggggagaaaaacagagatcttgcttcagctgtttcctaactcatttatgaaaaggtaagatagccctctgtcagaagcaaaaatatctacgtgattgtatagattttaaaaatctatataaatagctgttttaaagttcttatctactaattccaacatttgtgtcatctttagtactgttacagtgactttttttctcgttaatatatgtttcaatttttattgcttcttcctcatctggcaattgttttgattgtattctgggcattgtggatgttctgttgagagatttaaggattattgagttttgttttgatagctactagagaatcaggttgatcctgttgaggtttatttttagtttagttttttttttaaggaagatctaaagtgatacttattatagaactagagtagtatatttttatatctgttaccagcggcaaatctatatgggtctgcagcaacctcaattcttgcctcctcagaagaaagaatttgactgaggggcataaggcaaaaggagagaccaaggcaagttttagagcaggagtgaaagtttattaaaaagctttagggcaggaatgaaagggagtaaattacacttggaagagggccaagtgggcaacttgagagatcaagtgcccagtttggcctttgatttagagttttatacgttggcatacttcccaggtcttgcatcccttctcccctgattcttcccttgcagtgggctgtccatatgtgcaatggcctgctggcatttgggagaggccgcatgcacagtgtgtttactggagttgcacacatgctcacttgaggcattcttcccttaccagtcaactgttcctagaaggtcatataccagttaaactctgacattttgcctcttaatgcacatgcttgagcccacttgcccaactccagtgtgaagccactaattatcagtagatcttattgggaaactactgagtatcagtttcaggtttttttctatctattgggagactgcctttccctggtgcctgctgcaaccaattcttattttagagaaacagtgtaacaactgcctgaccatcacctgagggtcgcctgacattcctggttgctggggagccctctccagccccactggagcctggctagctacttactgtaacacatccatattttttttgttacgacagtaaacataagatttgtgtatctgaggcagactgattatttacctgcagaatatcttgtattagtttcccatgctccatttttttcccatggtgctgtgataaatgcagatgtcacctgcatgtatgaggaggggcctctagtacatgagagaaaccccaaattcttagtcttgaagcttatatagaagctgcttacataactgcaccttctcccctccaggacggaaagagagaacacagagagaaactgagaccttgtcttcctaatgtaaacaaatcctctctgaagagaaaagtcaaaggtgttttggccaataatcttttggaatataaacaaatggctccacatttttgataccctttgaaatgtaaacacatagttcttagagataaatttccatattgctctttttttttctttgagacccagtctcactgctctgtcgcccaggctgtagtgcactggcgcgatctccgttcaccgcaacctccgcctccagggttcaagcaattctcctgcctcagcctcccgagtagctgggactacaggtgtgtgccaccatgcccaacttatttttttacttttagtagagtcagggttttaccatgttggccatgctggtctcaaactcctgacctcagatgatctgcctgccttggcctcccaacgtgctgtgattacaggcgtgagccactgcgcccggcctaaatgtccatattgctcttatcatttctatctattcagtcaccctttaatcaaagtgccaattttctttgctcagaaggccattaccatgcagaaacatgaaaatattcacattgtttcttgacacagagtcgcctcacacctaaggcatggctgttcttggacttcagatatataatctgggtattcattgaggtctcttcactctatttggttggaattgcaatgtctcccagttccatgtgacccatagatactcttcatctcacagcccctcaatagttatattttgctaggctttgtggaattataccctgtgtacccacatcctaatatttagccaaatactcaagagacccctatgcagacttctggagttccttctctacaaggttccctcctctccattcctcttcacccaaattccagtagcctcaacagacccaaattctgacttctatttcatctacccagtgagacctctgttctgtctctagctccacttccctatgctatgatctgtaagtaccctcaggcagaaagccgagatgaacgtggcttttatatgtctgtcttctcccaaggatcacagccctgagctagtcaacatctgcttcatatattttgtccagtttcatagttgtttacattgggaaggtgagtctgatgctgtcatggcaaaaactgcaagctctatctaccagattttcaaattgtcatgattgtatatcatctctgccatttacctgtctggtacttaaagaatatggaattccccttaaatcaacaatacattctttctgtatttaacaacctgtgtgtgtgtgtgtgtgtgtgtgtgtgtgtgtgtgtgtgtgtgtgtatctgtctgtctgtccaggttattagacgggttgaatttgtttcctttttatttgtttttagtattaaagatgtttttttttttgtaggactgaaactcagcttgctcaggaaggaaaataattgcctgaccattaagggcattgggcttggttaaaagaggagggtattttcttctttaaaaaattttgcttccatgcaagtaaggaagttgggattctccataaggaggatacttctggaagtgaaacagttaggcttgtttatcctggatgcacaggaaggtatcacagtgacttaattatacaccccaaaatatcttaaaaagtagtttagaactgtcaactagtctctgggcattgtttggttttgttttaaacattttttaaatcaacaaataaaagttgtatatatttgtggtatacaagataatgttttgatatatatatatacacacattatagaatgactaaaaccaattaacatatatgttacctcacatacttatcttttttgtaataacatttaatgtcttatttaaagattttattaaagaacatttaaagtcttagcagttttcaagtatacaatacattgttattaaatataatcaccatgttgaactaattcctcctgtctaactgaaattttgtatcctttgaccaacatctccccaatcaccctacatgaccatagcctctgataactaccattctactctcagcttctatgagttcaacttttttagatttctcatatgagtgagatcatgttgtatttgtttttctgtgcctggcttatttcacttagcataatatcctccaggtttgtccatgttgtcaaaaattacaggatttacttctgtttgaggctaaattgtattccactgtgcatatatataccacattttctttatccattcattatttaaagatgcttaggttgattccatatcttggttattgtgaataatgctgcaatgaacatgggagtacagatacgttttcaacatactaattttatttccttcagaatatacctggaaatgggattgctggttcatatggtagctctaattttaatttttttaggaacctccatactcttttttataatgattgtactaatttatattgacagcaacaatgtacagggttttcttctctccacattctcacccacacttatctgttgtcttttttataaaatacccatcctaacaggtgtgagatgatatctcattgtggttttaatttaatgaatttccttgatgatttttttcatctacattttggccatttgtaatcctcttttgggaaatgtctattgtagtcccttttttttcataaaacttcctttttatggcttaaaaagaaatagacaatgtcaattatagacccccaggttagagaccatagtttttagtttaggaatatcctgggaagcactgagtaaatgtgaaataagattaataatatttttctgctagtttcttcagacttgtttttggggcttgctttttggcatttcatgggtattggcttgttattcttcaaaatgacctacttcagggattatgagtgatgccagtttttcatagctgggtgggtttaggatctaagattatcttagggatatcctgaggatgtgttatttttacctcaatagtgatagctagtagctgatcctcctccttcctgtcctttacaatttcattaaaataccttctccatctctttcatctaaagaattcaagtttttttccaagttggttgttgaagaacattgattatgtatctttatgtttaaaacaccaaaaaaggcattgtggagagtaacagaagttaaacatatgacttttgttttccatgagtgtataacctaatgacagagaacatacaaagacgtgagtgacagaaacatgaaaaaaaaaccttgcagcttttggaaaagccaacagcttgagaatcacagtctgtcacttagcagttctagtataaagagcgcttcatctctgattgctctggcaaaaggttctgaagagccttaatgttcaaaattgtgtccttgaaccagcagtattagcatcactgggaagcttattggaagcccaggatctcaagccctaccctagacattctgggtgagaactgtcattttaaaaaggtctcctggtgatttaaatgcacattacagtctgggaagcactgctgcagaggattctgattgtgttcatttaggtcaggtgcccacttggaatgaatcgccgcagccagggacatacaggacatactgaatgctcaatcctgggacatatggtccttatcccctaggacaatgggtgtgggatcagtttgtggaatgggtttactacaggaaaggggtgttttattaccaagggaagggaagttgggaaagaagataataacaatagttgtccaataaacttatttcctctttcatgcctttgctcacattaatgttagaactagctaactcctttactttgggtcatttcatcccatttcctgtgtgtgtgtatgtgtgtgcacacgtgtgtgttcgtgtgtgttctactttcaatctcccccacccctcattgccatctgtctgcctgacctagatatcagaggttcttccttattccacagcatggttctcctgtccctctcagagagttcatatctttcaaatatatataaacacgttatggataagcacacacatacctctgcctaagtctaactttacttcattgcactcctgatagagcatgtgtgcttcacctactgcttttcattctaccactaaggcattaacccttggagtcacgccttttaaagctgtgaatatctgttaaaatgtacttgtattaatattacagggggtcatacttttagccctcaggaattctgattccattagcaaagttttttttttttttttgcatacagggaacaaaagagggatgtaatcctttactattattatttattttgatgttcatattttctctgatttctcaagaagggtcctgtggtcttttgatgtgtcctcattctttaagtacttccttcctttctggcccaacaagatgttccaggctcatcttatacttttgcagtcctagctctggaatcagccatttctccaaggagttctaatgacttttagtggagaatgctgtttagaaactaagatttgagtgcaaggtgtgcttatcctttttgagttatcattgtttctgggccatctcagtggatagaattaggaaatatgcatgtgtatatgtatgtgtgtatgtgtgtatttagataacttaaattggtatcatatacatgattctttgcaggccagttggtctctgtttcaagtacttaactttccctttgtaacacaaaagcagccataaataatatgtaaatgaatgggcagagctgtgtttcaataaaacttatttatggaccctgaaatttgtatttcatatcattttcacatatgacatattcttcttttgacattttttctaaccattttaaaacatagaggccattattaacttgtgggccatacaaaaacaggtgatagagcatatttggcctgtgggctgtagtttgccaagtcctggtctttccgaaacactttcagtttacatacaacacacatacctatatagtcatacactgagtaacaacattttggtcaacgatggaccacatttacaatggtggttacctagactataaaggagctgaaaagctcctgttgtctagtgatatcatagccattataacatcataccgcaacttattacatatatatttttgctgatgctgatgtaaacaaacctactgagctgccagtcatatcaaagcgtagcacatacagttatctatggcacacaatacttgttaattataataagtgaccctgtttttggtttatgatgtactatatagttttccctccatatctttatgggattccttctaggaacccactcgacccctcccgtggataccaaaatccaccaatgctccccaatataaaatggcataatatttgtgtataacctatgcacatgcttctgtatactttaaatcatctctagatttcttacaatacctatcacaatacctacacatcacttcatttgtgtgaatacagtgtagtacttggcacacagtaaattcaagttttactttttggaactttgtgaaattttatattttatattttgtttttatttatttttaaaattttaagttcggggctacatatgcgggtttgttacatgggtaaattgtgggtcgctgaggcttggtatatgaatgatcccattaccaaggtagtgagcacagtaccagataggcggacttccaagatatgccttcccctcaccctcccccatcaagtggtccccagtgtctttgttcccttctttgtattcatgtgtattcatcgtctggctcccacttataagtgagaacatgcaatatttggttttctgttcttatgttagtttgcttaggataatgtcctccatctgtatccatgttgctgcaaaagatatttcattattttttatgtctgtgtagtattctatggtgtatatgtaccacattttctttattcagtccatcgatgatggacatcttggttgattccgtgtctgctgttgtaaatagtgctgtgattaacatgtgtctttttggtagaatgatttattttcatttggatatatacccaatagtggtattgctgggtcaaatggtaattctgttttaagttctttgaggaatctccacactgctttccacaatggatgaactaatttacactcccaccagcagtgtataagtgttcccttttctccaatgtataagtattctcccttttcaccagcgtatcattgtggttttgatttgcatttatctaatgattagtgatgatatgagcattttttcatatatttgttggccacatgtatgtcttcttttaagaaatgtctgttcatgttctttgaccattttataatggggttatttgttttttgcttactgattcaagttttttataaattctggatattagacctttgtcagatgcatagtttgcaaatattttctcccattctgtaggttgtctgtttactctgttggtagtttcttttgctgtgcagaagctgtttagtttaattaggtcctacttgtcaattttttgttttgttgcattgtttttgaagacttagtcataaattctttgccaaggccaacgtccagaatggtatttacttggttttctcctagggtttttattggtttaggtcttagatttaagtctttaatccatgttgagttaatttttgtatatggtgagaggaaggggtctggtttcaatcttctgcatgtggctagcaagttatctcaacaccatttattgaataggaaatactttccccattgtttgttattgctgactttgtcaatgatcaggtagttgtaggtgtgtggctttatttctgggttctctatcctgttccattggtccatgtttctgttttcataccagtaccatgctgtttcagttactgtagctttgtaatatagtttgaggttaggtaatgttatgcctctggattcattctttttattaggattgctgtggctattctagctctcttttggttcctccatatagatttttataattttttttctaattctgtgaaaaatgacattggtagtatgataggaatggcactgaatctgtaaattgctttgggtagtatggtcattttatcaatgttgattcttcttatccttgagcatggaatgtgtttccatttgtttatgttgcctctgatttctttcagcaatgcattgtattgctcattgtagacatctttcccctccttagtaagctgtatccttaggtattttattctttttctggctactataaatgggattgtgttcttgattttgctgagcctagacattattggtgtatagaaatgctactgattttcttacattgattttgtatcctgaaactttactaaggttgtttatcagttctagaagccttatgatggagtctgtgggttttcctaggtatagaattatattgtccatgcagatagacagtttagctttctgtctccctaatttagatgccttttatttctttttcttgcctgatagctctggttaggacttctagtactatgttgaataggagcagtgaaaatgggcatccttgtctttttccagttctcaaggggaatgcttccagcttttgcccattcagtaagatgacattgtctataggtttatgttatatgggtcttattattttgaagtgttttcctttgatgcctaatttgttgatggtttttaacatgaagggatgatgaatttttttgaaggccttttctgtgtctattcagatggtcatatggtttttattatgaattcagtttatgtggtgaatcacatttattgatttgtgtatgttgaaccaactttgcatcccaggaataaagtctacttgatcatgatgaatgagctttttgatgtgcttctgaatttgcttgtattttgttgaggatttttacatctgtgttcatcagggacgttggcatgaagcttttttttttttttctgtgtctctgctgggctttggtatcagaatgatgctggctttgtagtctgaattagagagtagtccctccttctcaattttttgaaataaatttagtaggattggcactagctcttctttgtatatctggtagaattcaactgtgaatccatctggtctagggctttttttggttggtagactttttattattgatttaatttctgaactcattattggactgttcaatattgattgctatttttattgtgctgttgtccaagtgtgtggttgattttattttgatttttgaatttgctgagacttgccttataactgagcatgtagtcagtcagagtatgtgccatgtgcagatgagaagaatgtatactttcttgttgatggttggagtgttctgtagatgtctattaggtccagttagtcaagtgtcaagtttaagtccggaatatctttgctggtttactgccttgatgatctgtctaatgctattagtgggggttgaagtcctgagtattattgtttggttgtctgaatctcttcacagatcgctaagaacttttttttaaaatctgggtgctccactgttgggttgggtgtgtatatatttaaaataattaagtgttcttgttggattgagccctttatcattatgtaatgccctttctttgtcctttttgatcattgttggtttaaagcctgttttatctgatgtatgaatagctacccgttttttgtttcctattagcctgatagatctttctccatttctttactttgagcctatatatgttgttacttgtgagatgtgtctcttgaagaccatagtcagttggtttgtgcttctttatctaactgggcacactatcccttttaagtgggggcatttagtccatttaaattcagggtcggtattggactgtgaggatttgatcctgtcatcatgctattagctggctattatgtagacttgatcatatagttgctttataatatcaatgaagtatgtgcttaagtatgtctttatggtggcaggtatcattcattaatttccatgtttagcacttcctttagaagctcttgtaaggcaggtctaggggtaatgaatactcttagctttgcttgtttgaaaaggatttcatttctcctttgctgatgaggtttagtttggaatgatatggaattcttggttggaatttcttttcttcaaggatattgaaaacagaccccaaatctcttctggcttataaggtttctactaaaaggtccattgttaacctgatagggttccctttgtaagtttttctctagatgcttttaagattttttcttttgcattgaccttggagaatctgatgactgtgctttggggatgatcatcttgcatagtatctcacaggtgttctctgagtttcttgaatttgtatatcaccctctcaagcaagattgggaaaattttcatggactatatcctcaaatacgttttccaggttgcttgttgtttctcctctttctggaatgcaaatgagttacaggtttggtctctatgtaatcccctatttctcagctattctgttatttttttaaattattttttctttatttttgtcttcctttgttgcttcaaaggagtgaccttcaagctgtgaggtttttatttttcatttttatttatttatttattgagacagagtcttgctctgtctcctagactgtagtgcagtggcgtgatcttggctcactgcaacctccacctcctgggttcaagcgattctccagcctcagtctcccgagtacttgactctacaagcatgtgccaccatgcccagctaatttttgtatttttaatagagatggggttttgccatgttggacaggctggtctcaaactcctgacctcagatgatccacctgccttggcttcccaaagtgctgggattacaggtgtgagccaccatgcctggccaagctgccagattcttttctcaacttggtctattctgcttttaatgcatccaattgtattttgaaattcctggaatttttcatttccagaagttcagtttggtctttttttaaatggttatgtcatctttcaactgttgggttgttttactgttttgcctgggttgggtttcaacctcttcttgtgtctcagtgtgcttccttatcatcccgattctgaattctctgcctggcatttcagccatttcattctggttaggatccactactggggagctagtgtgatcatctggaggtaagaagacatgctggtttttagagttgccagagttcttgtgctgggtctttcttctgtgacagctgatgattctttattatttgaagttattgtcctttgggtgaggctttttgtttttatgatctttattgcccttagggttttttgactgtggtgtaagctggatatagttgaatcacttcatttctggatgcttttagggggcaagactcagctccatactgctgggatgcatgctctaaccctgtgggactgggactgggtcagcagctttgtcctctggtctctcactgttgagctttggctgggatagagaggctggggtgttcccagaccattgacagggcatgggtgtaggtgctccagcaggggcagcaggggcactgtgggcaggatatgctccagtgggcagggctgtgggcgaaaggcactctggcaggggcactgagggtgggaggtgctctggtagggggcaccgtgggcttgggaggtgtgctccagcagaagtggtggaggcgttgtggccgggaggcactccagcttggggtgctgtgggtagggtcgcttctgcagggggaaaccatgggtgggtgggttgctctggctggaaatgccgcaggcaggaggcctggaatttacttttttttaaatctgaggttgattgaattcatagatgtagaacacatggatatggagggccaactggaccatatttttactgttattttagagtgtattcttacttatcaaaaaaaagttaactgtaaaacagcctcaggcaggtccttcaagaagtattcccaaagaaggcattgttatcttaggagatgacagctccatggatgttaaagcccctgaagacttttccctgggacagttgtggtctgtggttacaagtaataagggaagaattttctaccctttctagtcttagccccaagctttgagataggcaatatttcaggggctgtcagtaagaaagtttataactaatccagttttgagggtcttgctcttagggtcccagatttatcaacaggtgtctactagttagactctccaacttgagtggctcctaggattgtcttctatctctcagccttgaagatcatgtaaaccaaatctcaatttcattaggtttagcaaaatgccatcacagcataaaggtcagtttctacattctatttacctctcttggttcctacgtttatttattgatttagttttctatgtagtcctcatttgttttttttagcagatcatgaatgcatttgagaccagtagttttagttcatcattctctcagaatacaaacacctgtattatgtgtacttttctttaactgtgcattactctttaatatttgatcatatattatacatctttctagttattttatgtttgtcagttgtgtatatttcagtccttgtgagcacgcttgatgatttattctattgttccatttcacttcagccctctaggcaaatagtaactattcagaaaaatcctcactgatcaatataaaataagtggcttttcattaagattatttcagagatcatggtaccttgctggtataaaagagtaaaagccctttttctaaagtacttagcttacttaggggaggaaaatttctaattggagaaatttgactgatatttaggaattgttagttaaatatctatgctgtgtgatacatgcatatatgggaattttatttctttctctgtattttattaagtaagcataaaatggactaaaatattttcttttcctttcgggatatgaattttggtcagtagggacagactgtttctctataggttctttagcagataggaagcagatgtggcaatgtgaggagactactaggggaagaacaaatgtatgagtaatctggaaaaagattaaagtcaattataagttaaatgtcagcctttggaccaaagctttttcattcttggtactctaaagagatgagagcaattgagtgttcttaaaccctctgccaaaaaaaaaaaaaaaaggtggggtggcgagagagagagactgtttttaaaagccagtatttcactatacttactgttttatttccaggtgtttttttttaaacagtctgcttttgattttgtttggttaggtaaaatataacccatcattagcctgtatttgtacttaagagtattgttttatttggttagagaatgtctttaaaatcatatggtctttgtcagtgaacttctaggaatgtctggcatggttattggtcaaatgcctggcagatggaaatgaaattttgtgaggaatcttctggatcaaatacagatttatttttactttaataaaactattcaaagcataaagacttcagtctgagtgtcaacagtagtagctgatgtgggagcagttgcccggatagtacttgctgaggactgcagtgatgttcccattcctgatgccacttttttgttgtgcttgaattacagacatagaccatatgggcatctacaggtcttttagatctctgaagttctttataatgtatactgggcatactgttttcttctatacataaaaaagtgctttgtatttaattaaatgaagatactgtttagttttgtgtgtgacaccacccattcttagaccaattccattggcaattattagatcaatttaattccccaaaggaatacttgagagacagggctgagaacagttacaatcattttagtttaaaattctacttagcaatgagaaacaaatgatagactctacaatctggcttgtaaataaatagtaaatagcaataaaattagaatctatctataataaaattaagttttccagcttgtctatgcttttgtacatattattttcacttttaagtgcatctgcctaattagtaatatatagggtcataatgctacttaaatatcatgttatcctttaaataataattccaataaaagtgtaagaaaattcactcattcactttttttttaatcaaggataagccttttggaattattccagttcatcacatttttttcattcattcaccgaaactttattgcacacttactaaagattggtcttaagttaggtgttggggcagtggtcacagtatctttccagtcttcaagaaacttacagtttaattctattgagttaggttgagtattggaaaaaaaaatgctcttcaacatctactggctctgttacctctgctcttcacattagttaataccttaaggtggaaattagtgagcccatcctatggtagttggaggaaaacttagtgaaaacccttttgaaatgtatcttaatggccattggccaccaacataacagtgttccaggaaaaggagacttgatagatgaaaagataatctgtcaaatatatattttttatagtttaaaatttctctgtaaattaatttttaaagatataatttacatataataaaatgcacacattttaagtgtagagttcaatgaattttgacagagtatgtacccttgtaaccataactctagttgttcacctgagagagaaacttggagttattctggattcctttccttatcacatccaaatgattactaatttctgtccatgctacactctaaacttccatagaacatctcccctctttactctcctgactactaccttggtttttgacatgttaagccctgtttttcacctctgttaccgcaatctgctttataactagcttttgattcttatctcttttctttttcgtatacccttcatgacgttattaatttgtgatttttctaaaatactattctgatcatattaactgccttgcttaaaatcccttcatgactctttacagttcccattcttaattattgttttgatggtggcatcatttatcaagtagaaaatacacatagaaaagcagatttgtggagggaaagtgatgagttagttcactttaacaaagtggaagaaataaaacattgccttcagaagcatttttatttgattcaagctttatgtacacaactatgggggaaggagagaaaagccatcacaaataccagaaactgttctgagatttttatactgatgaagaaaatgaattttggcaatgctgggtaggaaaaattatgtttgttcaagcttgtttatactttaagtgatgattaagtttaaatttataaactcacatcttcaccttcatatactagtttgttaaaaaatgccttccaatatttatctaaacatgtctcaaacactatgagttgcgtataaattgtgaggtttaccttttagattggtaaagacaagctctgaggtaaaataattaatagcagggtatctttttaccttgagtgtgaggaaaacatagaagaaatatttaaatatgacaataaaagcagtgaactttattcttgctgtagaacttgcctcaaccttgttagtacctacattattttctataccatgaatattctatatcatctagcttttcttgacacagtgagaagagatatttaatttagtgcctgaataaataaagtatttatagtactataaagtactggtaatttagtgcctgaataaataaagtatttataaagtatttgtgtactgaatgagaatgactctaatataaatgagttttaccaaggtgccctgtggtattatttagaaaagtgattatttctttaaaaaataaaaatcccggctggatgcggtggctcacgcctgtaatcccagcactctgggaggccgaggcgggcggatcacctgaggtcaggagttcaagaccagcctggccatggtgaaaccctgtctctactaaaaatacaaagaattagccgggtgtggtggtgcatgcctgtaatcccagctactcgggaggccgaggcaggaaaatcgcttgaaccagggaggcggaggttgcagtgagccgagattgtgccattgcgctccagtctgggcaactagagcaaaactccatgaaagaaagaaaggaaggaaggagggagggagggagggaggaaaggagggaaggaaggaaggaaggaaggaaggaaggaaggaaggaaggaaggaaggaaggaaggaaggaagggagggaaattccagtcaaaatcccataggttatttatagatatcaacaattggattctaaagtttatatgaaaaggccagaaagaaagaaaatcccaatcaaaatcccataggttatttatagatatcaacaattgaattctaaagtttatatgaaaaggccagacctggaatagtgacacaatactgaagaaaaagttagaggagtcacactaaccttttgcaagactgttttgtatggttaaaataaacagatgatcaaagtatgttttcacaaatcacacagtttattgccatacaaagagcttatcatttttattcataatgctcaaagaatggaagaataacaggaagaaacatcatagggaatatactcaatagataaagtacattatccacatattggatgagttccaatttagtttagagtccagtttttaaagtctagttgctaaattaggatggaagcttgcctctgtggatgtaaagtctaatcaaagtttggagagtacttttctataagtggtttcaggagggatggtttgatcaccacagtgtacatccataacaatgtgcaatgtccctcaacactaacaagcagtgccagtgttactgggctttggaggatagttcaaaggctgacagagagcaaccctgctagtctgatattttggtctttggagaagtgtctgacatagagtagccctgacaaagcctaagttatcaatctgtcaaaatcttgggtttatatgtgtttttaaagtccagtcgttgagcccaataactcatgtatgtggtctgatgaggagtgatataacaatcttacagggagaggaattaaacttcatgttcttatcagagcaaaacgtgtatcattcatgtagtaaataaactaagtgtttaaatcatttcaaagctatataataaagattccttataaaactacagtaatcatgacagtgtggtattggtgaaagagtagacacatgtatcaatggaaccaaataaaaggcccagaaatagacccatacaaatatattcaggtgatctttgataaaggagcaaaagcaattcaatagagaaaggatagtcttttcagcaaatggtaatggaacaattggatgtccatatgaaaaaaaggaatatagacatgggccttacaccttttactaaattaactcaaaatggatcatagacttaaatgtaaaacacaaaaccattaaacttctaaagaaaacttaggagaaaatccagacaaccttggatttggcaattagtttttagatacaggaccaaaagtaggatctatgaaagagaaaattgttaagttgggcatcattaaaattagaaacatctgttctgtgaaagacactgttaagagaaggaaaagacaagccacagactgagataaatatttgcaaaatatatatctaataaaagacttgtatccaaattttaaaaaaatcttagaattccacagtaagagaagaaagaatccaatttaaaataggcaaaagagctgaaaacacaaagaagatacatggatggcaagtatgcatatgaaaagatgctcagcatcttttgtcattagggaattgcatattaaaacagtgagataccactatgtacctcttggagtcactgaaattccagaacacagataccaaatgctggtgaggatggtgagctgttaagattgcaagatgatacagccactttggaagatagttcggcagtttcttacaaagctaaaataaacatagtcttactgtaatatacagcagttatactcttaggtatttatccatttgaattgaaaacttatgcccacacaaaaagttgcaggtgaatatttacagcagctttattcataatcaacaaaaactggaagcagccaagatgtcctcagaaggtgaatggataaagaagctatggtatatccatacaatggaatattgctcagtgataaaaagaaatgagctatgaagccacagaaagacatggatgaaacaaatgcatattgctaagtgaaagaagtcaatctgaaaaggctacatattacatgattccaattatatgacattctagaaatggcagaactatagtgacagtagaaagatttgtggttgccagtgatttgggaggaggagagaagatcaaatggctaaagtacagcagatttttctagtgtcatgaaacggttctctaagatactttaatggtggatacatgacattaagcctgtagaaatttacacaattaaaaagtaagccttaatatatgcaaatgttaaaaaatcacttaggagtttagaggatctcagaaaggaatgcagaccgacaagagaatctaactgtattaaaaatgtatgaaacaacctccctaagggggtgggggaaaaggcactgatctaagaaacttcggaaatgagcctgtaagactaaatggaaaagcaattatacctaatcattgtactttagttgataaagttgtttctcattgggggtacacattaaacattctgatacctctatacatacatattggaattgaataattaagtaaatggagagttgatggtttgaagccaaacttcttgttgaagtagaaatgttcagataagcaagggaaggaggctagaatgattcatttggtgatggattagagttggagacatcagtataaactcatctttagcttaatatagacacagatggcacagatggacagatggttacttagagaaatatttatagatatatgcatatacacaggtttctgtacacacatatattttcttgctgtgtcagctgagagggactaaaggaaatgaccccacagtagcaagaagtacacttagcccccagatctttgtttctaatactagtctccaataaaaggaactatggctcctcagaaatggccgattctaggaccaggaccggaattagtctagaaaatacatgagtatagaaaatcttatagtgccagaaagtaagaaagtgctcagaaaaagaaaaaaaaaatccacatcgatgggaaccaaagggacatagaagccaattgaaagagcttccaatggccaaagctggaacaatttgaacaacaaaatagtaaaattgtattggataataacccaaagcatagaataaatatccatgagttcagactctgtgtcctcaaggaggaggagcttaacttcccactccctgagtgtgggctgtacatggtgacttccttacaaatagttgagtatgaaaaggagaggatgcaatggtaactttacattggagaaacctgaagaacataacctcagcctcagccttgaacatgttgatcagggtcaacatcaacagtaataagtcatattaataatatataccacctgggcatagtggtcatgcctgttaattccagcactttgggggggcaaggtgggaggatcgcttaaacaggagttcgagaccagcttgggcaacatagtgagacgctttttattttgtagacaaaataaaaagtaaaacattagccaggcatgatggtacatacctgtagttccaactacttgggttgctcaggtgggaggattgctcgagcccaagagtttgaggttaggattagctatgattgcaccactgaaacccagcctggatgacagagtgagacctggtctcaaaaaaaaaaaaaaaaaaaaaagtaggtatcttaacccccatctaatcatgagaaaaatatcagacaaatcctaatagggggtcatcctacaaaataactgatgagtattcctcgaaactgtcaactcatcaaaaacaaggcaagtctgagaaattgtcacagccaagaggagcctcaggagatatgacaactaaatgtaatatggtatcctccatgggatcctggaacagaaaaaggacattaggtaaaaactaagggaaacctggataaaatacaggctttagctactaagaatatgtttactttggttgattaattgtaacaaatgtactatactaacacaagatgttagcaataggggaaactgggtatggggtataggggaactctgtactatcttctcaatttttctgtaaatctaaaactgtgctaaaaataaagtctattaaaaatgaaagtattatcttaaggcctcagaataatccagtggtttctgtctctcctgcagttttgacagtgtttcctgccttgctgactcttcttccctctcggacatcacctttgatggcaatcccatagctcaagagtcatggtacaaacacactgtccttcagaatatgatgcagctgcgccagctagatatgaagagaatcacggtgagaacccttccaaagtgttcaccatgttgttgtccttagtgtggattaggaaattgggatgcatattctttgcttgaaatgcttcttaattttagtgaactatgggttatcatgattgtatacttcataattgcaattatgtagtttttactgcctgatcccatcccaagtttaattgagcaagacttttaaaattcctagccttctgtttaaattaatcatcgtgtttatttttcattcttgcttaatatccaaataataatttattttgaaatgaatgagtgagaatttctttaagttatgtagcatagtggttaagagcatggacactggagccagattgcctgcgtctgaattctggcttgactgctttctaacgatagtcctttggcaatgtatttaatctttgtatacctcattttcctcaaagtaaaatggggatcagaattaagtcataggtttgtcgcgaagatgaaataaagtactacaccttagaaaataaggtactacactttagactgcgaggctcctaggaggcatttgtatgtagttgttattgttgatgttatatctcccaaagtagctacctctttttattcatcgtatctccatgttaagatattttctacacttagatgttttaatatggtttctgatctaaggaaatgctgtgcataatatccccctctttttaggtgtacaatgtgtattagcatattataggatccaagaagttctgtaattaaataaacttgtttaactttgtttctttgaccaggtttatttgttatgagaaaacacattttaataatctcagtttgatagtctctgacctagaaaaatatcctaagcctctacctattttctctcttctggactgctgattttcatgtgaattctgttgatcacctaggtttatgcagttgccaactgacctatttctttgtatattagcatcacaatgtgtgcagttttcatttatgcgttggcaatactgtggacctctaaggtggctagctaatagctaaaagtgtggatgaattgatggataccagaggtcttctagggttctgcctctctctctattccatggtggagctatggttctttgtcctcttagttaattcagctctatagtgtcaacactgtttcatatttttgtggtgactctttacccttatctccatgtctttcttagttaagcatctatgctacttcttaaattgctctttctaatgaggttgagatgagtgggataagatttagagctaactcgtttatataaattagtacttaattatatggtatgttcctcatagtgaatttatttgtcagtcttgtctacccaaacaatatatagtctttaaaggcagaaaccattcttctttcttgcctggcacctacagattactagcatctaattctcacaccacattgaacttttaccagttatatcaatattgttctttacagcaaaaagatgcagtttaaaattatacattgcattatagctgaattttgttgtcatgtctctaaagtcatcatttttctggaactatttctcagtctttctttgattttcatgactgatatttatgaaaattacaggttagtttttttgtagaatgaccctcaattcagattttttgatgtttcctcatgattaatttttacttataggtttttggcattaatatcatagcagtgattttgtattcttctcattgcatcttagaccagcatgtcttacaacatgttcttcatatttatctctttattgaggatgcttactttaggatgatttctgccaagcttttctttgtgaagattctctttttccctttgtaatcccattcctcataaaaatgtaaatttattcattcattcatatctatatggacttatggtatttagtctcgtcttttatttataactttttagtaactttagtgtggaagctgtaccttttttaaggactttttataacaaatgtcaacaaacagcctgtgagctggctacctgtttttgtaaataaagttgtattggaacacagtgatgcccattcatttatgtattatctatgtttgctttgatgctgcaatggcagagtcaagtagttgctatggatactatgtggcctacaagcccaaaatatttattatctggctgaaaaagtttgctgatgccagtaactattttttctctttaagaaacaatatcttaattgaatttttgtgtaaattaccatataaacattctcactgtggtggattacacaaatatttaatgaacttctgtgcactggggcagtggttcctaaactgcgtgcagaggatgctgcagtgaactcatagggagtgatttttaacttccaggggaaacacagtgagatttgacatctctgagactgtgggcaaattagtagctcaaatagtttaccatttcaacatgacctcacactatatttgtttcaatcacttcctatctttgaaaagctgaattttcagtagttgttgtaataaaaataaataccttgccaaaatcagtatcgaacaggaaatggggatggcagtgtccaatgtgattctctgtttgagaaattgtataacgtcctcctggttctacacattccattgataagtagttgtggttatttaaaaatgatataaaatattttttctttctatttacatatattattttttaattgctactaaagtgctagaccatgaatacttattaaattgtttggaccaaactacttagtaaacagagttgtcacatatttcttttggcctagaggcactgtgaaaaaatccctgagactattaggtatcttgaactcacgagtttctgtactaggatatatattagacagtagagatgaaaagatcaaaatcacagttcatgccctaaagttacttgcagttgtctgcagaggcaaccatgcagctggattacagtgcaaaatgacaatctagagagataagattactagatggatcaatagagatatatgtttgtgtcaacacacttacacccagggcaaaatgatatcaaagagcaaagcaatcccaagtctacctgaaaaacagaaaagttccaaaggagaaaataattgactcaagactttaagggtggtaaagaagaaggaggatgtatttgtggaaaataaaggcatgcaaaatgcagaaggaagctgagagaatatagcagctgacaggagttcaacatggctaagcattgagtgtacatggctgagggacatagaaggagacaactatgtctgacaggcaaggacaggcaaggactagggcattttatatcataataaggagtttagatttttgtcttggacataataggagaaacccttgaagagtttaaggtagttaaattggatttgcctattaagaagactgtctttctgggttcagccttgaagatagatcggagaggatgcgatgggtgatgagatgagaagcaaggagattaatcagagtaagagtctgggaatctgatccagaggaatggcaagagataatatgatgccatctatcactggcctcaactcctattttgctttatctttcttcagaagaaggggttttagtttgtaaagattagcataaagattaataagataaaagtgaagcttaggataggtaaataaataagttggaactcaggcccacatctagagcaagggttggcaaattttatctataaaggacctgatagtaaatattttaggctttggggcctgcatattgtctgttgaaactactcagtttgcccattgtagtatgaaaaaaggcatggacaatacatatatgaataagcatgattctgttccaggagaatgttatttagaaaaacaggtggctgactttggcctgtggcctagagtttggcagtccttaatctagagcactgaataaatcgctgaaccactgagagttttgtctaggtagggttatagaataatggagcagctgaaaggtaagatgaagtaactttttttttttttgcaatattgctttatttatttatttgtttatttttgattatactttaagttctgggatacatgtgcagaatgtgcaggtttgttacataggtatacaggtgccatggtggtttgctgcacctatcaacccgtaatctgcattagatatttctcctaatgctatccctctccttgcctccacaccccaacaggccctggtatgtgatgttcccctccctgtgcccatgtgttctcattgttaaactcccattatgaatgagaacatgcagtgcttggttttctgtccttgcaatagtttgctcagaatgatggtttccagcttcatccatgtccgtacaaaggacatgaactcattcttttttatggctgcatagtattccatggtgtatacgtgccacattttctttatccagcctaagattgatgggcattttggttccaagtctttgctattgtgaatagtgctgcaataaacatacgtatgcatgtgtctttatagtagaataacttataatcctttgggtatatacccagtaatgggattgctgggtcaaatggtatttctagttctagatccttgaggaattgctgcactgtcttccacaatggttgaactaacttacactcccaccaacagtgtaaaagcattcctatttgtccacattctctccggcatctgttgtttcctgacttttgaatgatcaccattctaaatggcatgatttgcgtttctctaatgtggtttgctttgcatttctctaatgaccagtgatgatgagctttttttcatgtttgatggctacataaatgtcttcttttgagaagtgtctgttcatatccttcccccactttctgatggggttgtttgtttctttcttgtaaatttgtttacgttccttgtagattctggatattagtcctttgtcggatggatagattgcaaaaattttcttccgttctgtaggttacctgttgactctgatgatagtttcttttgctgtgcagaagctcttttgtttgattaggtcccatttgtcaattttggcttttgttaccgttgcttttggtgttttagtcatgaagtcttcgcccatgcctatgtcctgaatggtattgcctaggttttcttctagggttttcatggttttaggtcttaagtttaagtctttaatctattttgaattaatttttgtgtaaggtgtaaggaaggggtccagtttcagctttctgcatatggctagccagttttcccagcaccattcattaaatagggaatcctttacccattgcttgtttttgtcaggtttgtcaaagatcagatggttgtagatgtgtggcattatttctgagggctctgttctgttccattggtctatatatctgttttggtaccagtaccttgttgttttggttactgtagccttgtagtatagtttgaagtcaggtagcatgatgcctccagctttgttcattttcttaggattgtcttggctatatgggctcttttttggttctaaatgaatttaaagtagttttttctaattctgtgaagaaagtcaatggtagcttgatgggattagcattaaatatataaattactttgggcagtatggccattttcactatattgattcttcctatccacgagcatagaatgtttttccatttgtttatgtcctctcttatttccttgagcagtggtttttagttctccttgaagaggtccttcacatcccttgtaagttgtatgcctagacgttttcttctgtttgtagcaattgtgaatgggagtttgctcatgatttggctctctgtctattattggtgtataggaatgcttgtgatttttggatattgattttgtatcctgagactttgctgaagttgcttatcagcttaaggagttttggggctgagatgatggggttttctaaatatacaatcatatcatctgcaaacagagataatctgactcctgtcttcctatctgaataccctttatttctttctcttgcctgattgccctggccggaacttccaatactatgttgaataggagtggtgagagagggcatccttgtcttgtgccagttttcaaagggaatgcgtccagcttttgcacattcagtatgatattggctatgggtttgtcataaatagctcttattattttgagatatgttccatcaatacctagtttgttgagtgtttttagcatgaagcggtattgaatttttatcgaaggccttttctgcatctattgagataatcatatggtttttgtcattggttctgtttatgtgatggattacatttattgatttgagtatgttgaaccagccttgcatcccagggatgaagctgggttgatcgtggtggataagctttttaatgtgctgctggattcggtttgcccctattttactgaggattttcgcattgatgttcatcagggatactggcctgaaattttctttttttgttgttgttgtgtctctgccaggatttagtatcaggatgatgctggcctcataaaatgagttagggaggagtccctctttttctattgtttggagtagtttcagaagggatgctacctgctcctctttgtacctctggtagaattcagctgtgaatccatctggtcctgggctttttttggttggtaggctattaattactgcctcaattacagaacttgttattggtctattcagggattcaacttcttcatggtttagtcttgggagggtatatgtgtccaggaatttatctgtttcttctagattttctagtttatttgcatagaggtgtttatagtattctctgatggtagtttgtatttctgtggcatcagtggtgatctcccctttatcattttttattgtgtatatttgattcttctctcccttcttctttattaatctggctagcagtctacctattttgttgatcttttcaaaaaatcagctcctggattcattgattttttgaagggtcattcgttctctatccccttcagttctgctctgatcttagttatttcttgtcttctactaccttttgaatttgtttgctcttgcttctctaattctttcaattgtgatgttagggtgtcaattttagatctttcccactttcttctgtggccatttagtactataaatttccctctaaacactgctttagcacccagagattctggtacattgtgtcttttttctcattggtttcaaagaacttctttatttctcccttaaattcattatttacccagtagtcattcaggagcaggttgttcagtttccatgtagttttgtggttttgagtgtgtttcttaatcctgagttctaacgtgattgcactgtggtccgagagactgtttgttgtgatttccattcttttgcatgttttacttccaattatgcggttgattttagaataagtacgatgtggtgctgagaagactgtatattctgttgatttggggtggagagttctgtagatgtctattaggtccacatgctccagagctgagttcaagtcctgaatatccttgttaattttctgtcttgttaatctgtctaatattgacagtggggtgttaaaatctcccattattattgtgtgggagtctaagtctccttgtgggtctctaagaagttgttttatgaatctgagtgctcctatattgggtgcatatgtatttaggatggttagttcttcttattgcattagatccctttattattatgcaatgcccttctttgtcttttttgatctttgttggtttaaagtctgttttgtcagagactaggattgtaaccactcctttttttttttttttttttttgctttccatttccttggtaaatcttcctctatcactttattttgagtctatgtgtgtctttgcatgtgagatgggtctgctgaatacagcacaccaatgggtcttgactctttatccaatttgccagtctgtttcttttaactggggcatttagcccatttacatttaaggttaatattgttatgtgtgaaattgatcctgtaattatgatgctagctggtgttttttgcccattagttgatgcagtttcttcatagtgtcgatggtctttacactttggtttgtttttgtagtggctggtactgttttttcctttccatatttagtgcttccttcaggagctcttgtaaggcaggcctggtggtgacaaaatacctcagcatttgcttgtctgtaaagtattttatttctccttcacttatgaagcttagtttggctggatatgaaattctgggttgaaaattcttttctttaagaatgttgaatattggcccccactctcttctggcttgtagggtttctgcagagagatccaatgttagtctgatgggctcccctttgtagataacgcaacctttctctctggctgtgcttaacattttttccttcatttcaaccttggtgtatctgatgattatgtgtcttgaggttgattttcttgaggagtatctttgtggtgttctccgtatttcctgaatttgaatgttggcctgtcttgctaggttggggaagttctcctggataatatcctgaagtgtgttttccaacttgcttccattctccccgtcactttcaggtacagcaatcaaatgtaggtttggtcttttcacatagtcccatatttcttggctgctttgttcattccttttcattcttttttctctaatcttgtcttcacgcttcatttcattaagttgatcttcagtctctgatatcctttcctctgcttgatcgatttagctattgatacttgtgtacgcttcacgaaattcttgtgctgtgtttttcagctccatcaggtcatttatgttcttctctaaactggttattcttgttagcagttcctgtaaccttttttcagggttcttagcttcattccattgggttagaacatgctcctttagcctggaggagtttgttactacccaccttctgaagcctacttctgtcaattcgtcaaactcattctccatccagttttgttcccttgctggtgaggagttgtgatcctttggagaagtggcattctggtttttggaattttcaacctttttgtgctggtttttcctcatcttcgtggatttatccacctttggtctttgctgttggtgacctttggatggagtttttgcgtagttatcctttttgttgatgttgatgctattgctttctgttttttcccttctaacagtcaggcccctcttctgcaggtctgctggagtttgctgggggtccactccacaccctgtttgcctgggtgtcaccagcagatgctgcagaacagcaaaacattgctgcctgctctttcctctggaagcttcatcccagaggggcacccgccagatgccagttggagctctcctgtatgaagtgtctgtcaacacctgctgggaggtatctccccatcagaaggcaggggggtcagggacccacttgaggaggcagtctgtcccttagcagagctcgagcactctgctgggagatccgctgctctcttcagagctggcaggcaggaacatttatgtctgctgaagctgtgcccacaaccgccacttcccccaggtgctctgtcccagggagatgggagttttatctataagctctgagtggggctgctgcctttctttcagagttgctgagcttagagaagaggaatctagagaggcagtcagtctggctacagtgactttgtggcactgtggtttttttaatgtcaaaagtacagaatataaattccacaaattgtgacagtcaacttgatgttgattctgaaataaatttaaattgcattattaaaagatggtttgtggcccagtgcggtggcttactcctgtaatcccagtactttgggaggttgaggtgggcggatcacaaggtcaggagattgagaccatcctagccaacatggtgaaaccccatctgtactaaaaatacaaaaattagctgggcatggtggtgcgtgcctgtaatcccagctactcgggaggctgaggctggagaatcacttgaaccagggagttggaggttgcggtgagccgagatcgcgccactgcactccagcctggcaacagaaggggactctgtctcaaaaaaataaaataataaaataaaataaaaagatggtttgtgagtacttaggaattggtcactaggaggcagcattagctcactaaaaaacaattcatgccagaaaagaattagtttcctgacctagaaattacaaatagaccttgttagaggagtgctatagacagtgttttggtatttaagcaaagcatttggcaaagtcttttatggcatcattttgagtaaattgtatgacatggttatgtagatttttgattcaagtatacttacagaacatgaagtaatggattaatgccagcctttagagaaatctgtactggcatgccatgaggcttttttcctccagtccattctattcacatttttattaatgtctaggagaaaatatttgttattctggtaaagtatgtgaatgacagaaactagagaaattagagttcttggtatattggttgatcaaatgagaatccaaaagtatctccatagtctagaacagggtttggcaaactacagcctatgggctagatccatctggcagcctgctttttgtacagctctcaagctaataatggcttttatgttttcaaagcattgtaaaaaaaaaaaaaaagaacaacaaagaaggatatgagatagagatcacatacagctcacaaagcctaaaatatttaccatactatctgaccctctacagaaaaagtttgtttatgcctagtctagaaaagtaagcagaatttaacaacataaaaaatagatgaattgaacatcctggactttattccataacaacaatcaagcaaaacaattcttagcacaaattcagtattatacaagattagacttagcagcgtgtgttaaagtgacttggaattgctaaattcaagttcaattaattatgagatgtgattattaaaagttaatatggcttaaaacaatattcatttatagaaaaagagaattcagacaatggagacagtcccatcccatttttttctacagtggtcagattacacctgaactattactagttttagagggcagacaataaactagagcatttccaaagaatctgacatgattagttgacaaaggagaagacataaggaagatatcccagtgatcttcacctgttttcacaactattcaaaaaaagagagaacagacacatgttgaggggctagaacaaggacccttatatagaaaattctgggaggcagaattttcctttttatttctaaggcagcattttgtgaatgcaggcagtattctcacaattctgaaacagggttgggcgtggtggctcatgcctgtaatcctagcactttgggaggccaaggtgggcagatcacttgagtcaggagtttgagaccagctggccaacatgacaaaaccctgtctctacaaaaaatacaaaaaatttagccgagtgtggaggcacacgcctgtagtaccagagacttgggggactgaggcaggaggatcgcttgaacccaggaggtcaaagctgcagtgagccaagatctcgccactgcactcaagcctgggggacagaatgagatcctgtctcaaaacaaaacaacaacacaattcagaaacaaacaatgtctaaagttttcacctcaagctcacatttaattggcttagtgtgaacttgtttacaatttgctctccaaaaaaaaaaaggagctcatctcatgtgtacgttttctgttttggtagacattactaatgttcaccaatatgctctggttctcctcctttttgacatgtgggaagatgtttggccaatgaaatgtgagcagaaataatgtatatcatttccaggcagaagcatttaaaagcatgattctcatgcttccttcccatgtggtagtcactgcggaagcctatataaagttgaggatgccatcagatcatagcactcaggaatacttagccactacattgaagacaggtgcagtgttctttgcgtgatcaagaaataaacttttttaaagtcataagccagtgaaagttttgaagttgttacagcagcataacctatcctgttctgactatttccctccccagtatttaacagctaatatccctggaccagaagtcaggtgacatggcttctaatcttcactctaacactaggtgtgaccctgcaaaaaaatcagttttgtttgctaaaagtgattgtttgagtaaaaattattgaccacctctttgagggaaaaaaccctgtgattttaaagtctgttttaatattttatatgttcaaagaaaataatgtttataactaaagtatatggttaaaacacaccttgccatttgatttttaaaatttcataaaatgctgcctatattaggactactattatttattttggatcagtctttttcttgtgtgatatgtgcattgttttaggccttaatatctgctaacaaagtataatctaggttatcaaacacctattaaatcactgcatggcttaattgacttgaaattatttctatattgggtcttcatggccaaaatgaagtgaggaaaaagtagttttttgtcccagatcccagattccccccccaacttatttatttttttatttttattttttgctatgtaaaggatatggcttttgtcccagaaattggactattatcaagaagataccagaattttagtttttctttcttaccaacagatttataacttatcttcacaattagaggttttttttctaagtttagttactctgtaattatttgggctgaaatatagctctcagatacataaattccttaaaatattcaatatttgaattgatttggtgtaaatccagttttccaaggtttagctttccttttaagccctactgcctttaatagaagctcaaattcttttcaaaaatctgatgaaatcatctcgtaagtatgtgtagtacgtgatccatacagtttccagtactgtttgaaattggctctttgaaaaaacaatctgtttctagttcacattttatagatgagtcaacaattgaacatcaatgtattttgctcttttaaacactttattctgaaatagattgtactctgtaggtaccaagtcagtatttactgaataaaagaatttaacagaattattaaaccagatattttgtgaagctaggattcaaagttctgcatttttaatttagtttatttctcctcattacctctatttagtttttaaaagttaagaataattattttccagctgggcattggtggctcacgcctgtaattgtagcactttgggaggctgaagtgggcagatcacatgaggctaggcgtttgagaccagcctggccaacatggtaaaaccctgtctctactaaaaatacaaaaattagcctggcatggtggcacatgcctgtaatcccagcttcttgggaggctaagacatgagaattgcttgaacccaggaggcggaggttgcagtgagctgacattgcaccatggcactccaagcctgggcaacaagcaagacacaagactgtcttaaaaaaataataattattattattttccatattgtaaaagacactttaaattcactaaaattacattacatttccatttccatttcctttaaaacaactaaatcatatggcagatcacttctgagttctaaactcttctttatctatctaaaatcagtaaaattaatttaaatacatctttattataaaaaaaatatgaattttgtttctagcaggccatggcttctggtcctgatcctggccttgtcactagctatgtgacctcatacaagttactaatgtcttggagcatttgttaccttatttctaaaattagagttgtctagtatatgctttcttagttttctttttaaactctgtgttggtttctgtttgtgcatttttaaatataattatttaatctaggttttttctttgttttcaggagcatgtataatggcccatcctctagaacacattttcatagtctctttgaccttctttaattctaatataacatatatatactggtcagcataggctagattgtgctgcagtaacagcttctctaacttcagtgaattaaaacaacaaagtttatttcaggcttctaatacctgtctgcctatgatgtgtgatttgggatctttgctctatgttgtcctcattctagtactcaggctttcaaagtacccacctgtggagttttgcaggtgctgtagcaaggtgagagagagaatagttgtatcatacattgtctttgaaagttttcaaccagaagtaaatacatgtcacttttgtccatatgacattggccaaagcaagtcacatggccacatctaacctcaagggggctagaagtgctatctcacaatgtgtcttggatatgcaaagacacaagaatatttggtgaacagcttttatgaataaccatcaggttttaaatcaaatgttgaaatctggtaggagtataaattagaactgcatttatggagggcagtttgcagacatatcaaaaggatagaaatatgtctaccatttgatacagcagtttcggttttaataaattactgaacagacatggttcatacattcatagagcttattttatggcgtgggaggcaagagggatagcaccagaaaaaattaaaatgaaacaggttaagtgctatgatagagaagtatgtagggtgatactaaaacatatagaaaacattctcatcctctattttccagttgactgattctctcttcagctgtgtataatctgctattaaatctccctttgttgaattttaaatttcaattcttataattttttgtttctaaaagagttattcttcaaatctgctaagttacttgttatggtttcctgtctctgaagatgttttcaagcttgtcttttatgaataaattgttttctcaaattatcgtattattttgagtatctacaaatcttttggtaatgaaaattaaaagttacgtggttataatttattaaaatctgacagtcttcgggggaaaaattgtccagattgtgtatatagattataacctttaaaaaaattgctcatagtgaatattataaactgatacacagaaattgtaagatttgagttaggtgtttgggattatgactgatttttaagcatttttctaaactgtttgtaaggttattttgtcatttctactttttccagctttgttgaggtatgattgatgaaactatataaaattaaggtgtacagtgtggtgatttgatgtgtatgataaaatgattaccacaatcaagttagttaatatttctatcacttcacctgattatctttttttttttgtagttagaacatataagatctattctcttagcaaatgccaagattacaatacaagattattaactacggtcatcatgctatatttcatagcttttagaatttaaaaaatgagactgggcaacacaatttaaaaacaaaccaaaagtaattatattaatggggagtaatttattaatataattggagttttaaaagatatttaccctggttttttcatcaaaaagttctgattttctatcacagatccagtcaacattgttagatgtatcacttttatccttcttaccttgatgatagaaagtttaaacctatgtggaaccatgatgcacagcgtacaaaaggaaaatgatgcaaacatacttctccttttcttctcattcttttttctttcttgtatgagctaggttcacgtcacctccagagttgggaatagagttaggaatgcacagatttttagcattaagaggaaagaagaaaataaagagaaacatactaaatttttctttgagagtatattttctgctagtaaatactatgcctctcaagaagaaaactgtgcttaataggaccaatgatatttagcattaaaaaatggttaaactcttcataatacttttcggaaaatgtcttttaggaagaagaaaggcgtatggcatctgttttagccaaaaaagaggaagagaagaagcgggaaagtcataaacaatctttgcttaaggtattttctctgatgtctacatggatgtgtgtgcacacgtagacacacataccccaaagccagctagctagtctactggaaaagtggtttctaaactttgtaagttttttgttcctatcaacagaatgtacgtacccctaaaacttttacaagttattacctataaataaacctgtacttaagaaataaaatatgatatacattataaaataaatgcaaaggctagttttaaaaggaagagatgataaataaatataattgaagttataacacttttatttcataccagtgcatcatcttgtgtatcccatggcctattcacttccttttggaacgtactgtaattgactgtcatctttactgatatattttaatgagctctgctacgttttttttttttaatgatagctttttaaatttaaaaagtttatgatatagaagtgataaagattttgtggaacttaggaatgaaaatttgttttaaactggttttaaatgatttagcagatattaatttccttaaataaaatattctcttttaaatattttatattaacattgcaaagtataagtaaaggcagctttaagtttatagttcataatatgcatcatgctgtgttctaaaattaaggacatcaccctgattatcattactcattcatgttctatatagatgcttttctttttaaaattaaagtggcactcagaattcaaaaaaatgactagccaggcaaggtggtatgtacctgaagtcttaactacttgggaggctaaggtagaggattgcttgagcccaggaattaagtccagcttggaaaatacagtgagacaaaacaaaatgtcactaaataggactctttagttacgaggtttacttagtatttttatttttagtaagaggaaaagcatggggaatcaggagacccaggttctagccctagctcagatttggaatcatgatacaacagaccctcagcatttgctgaggattgctcgtgcaactctacatattgatcattaagaaaatgggatggacattctcagcaaactaacacaggaacagaaaaccaaacactgcatgttcttactcatgagtgggagttgaacaatgagaacacatggacacagggaggggaacatcacacaccggggcctgttggagggtgggggggctaggggacggatagcattaggagaaatacctaatgtagatgacgggttgatgggtgcagcaaaccaccatggcacatgtatacctatgtaacaaacctgcacgttctgcatatgtatcctagaacttaaagtataatttaaaaaaaaaaagaatgctaaaaaataaaaaaaagaaaatggaatggattggttacaggaagagtgtatagatactgtcttctgccttgttgcttttctattttttttattttccttgtaaccttagaagtgaaggaaagtgaaacttatggcatatactggtatggtcttgcctggactatgaaaagtagactcaaatggcagaaactggaatttggcaccttctaaaatatttgtcactttagcacagacttggccatttattggcacctagctattagaaacataattgtcgctgatatcccaaatgcttctgtgatctttacactttactttgggtacccccttatgccttgcagaatctctagcattctctaacctttcttttgcttcttcttttttttttttttttttttcctccacagatgcatagagcccttatgtgtcctcctggccagccattaatccccacctgacattaagacaggctatactcctgtcttaaaatatgtcttcccttttccgggccccagtaaaattaatcattctcttagtcaacctggtaatgatctgattttaataacccaaattaaagaagcttaacttttgcactaatataggaaaacgtttgcattttcaaagattatcttattataaatttaacatactcagtggtctaaagatattttatgccctttttctaagcactgctttatctatgtcattctgagtatttctttcgcctacccctgccagccagaaatccaaaagcatgaagccaactgagaaccatcagccattaactcactgccctggcctctttcaaagtggccttgatactgagtaaaaaaaacagagttgcttagattacaaattgggttggcatagtcatcagcaagtaacttaaatagaattccttaaggtaagaagcatttttattatagaatggggaaaaaatgtttttacaataggaattgcagatttctacttgctttatataaggagcacatacatagaatgtcagaaagtctccaaagtatatacatattaaatataacccactgaattgtacacaaaattttgaaacaccaaacaacagaaaaaaagaaagccaggcccaaaacattttttttagagatggggtcttgctgtgttgcccaggctggaatgcagttcacaggtgtgactgtagcacactacagctttcaactcctgggttcaagcagtcctcctgcattagcctcccaagtagttgagatttcaagtgtgcaccactgcactcccccagaaaacatgtttaaaacagaaatagaacttttaaaactttagttttaattaagcaagccatatcactttttattcctatctaatgccatgcatacatgctaaaatcttagataaccaaaaattatgcaaacatatgcaaagaggtacaactaaaaagaattattctacatgtactgaaggagtggacagagaatcttcctactagccttctgtggcttcagggccagcaggtgaagaggggtcagtatcacactcagctgatttttcaatgcaggattgtagtcttagtaaagaggaaaaggaaagtgtctgttttcagcattctgatctaattgacaagctgtaattaaatattatcttttgataatggaaactttaccagaatagggatttttttttctattaatatatataaattgaatagaaacgtttcaatttagcacaatttctttcagtagtctagatctgctttttcacaagagggtttctatgagatgactgagctccaatgctggaagtcagtggttctcaaagtgaggttcatgaactagcaatattagaatacttaggagaattcaaattctcaaaccctatgcccaaaactctaaatcagcaatctgttataagctccaggtgatttgaggtaccctgaaatttgagaaccactaccttaagacatccgttgcttataatgaattaatttctttcctactcatctggaatggtactagttatctagagacatttcaacctagtacaatttcttttaatagtctagagaataatttttaaatttcagacagtataatttattctgagaaacttggaacattgatcaactccttcccttccccccctccaagattatttcaccttaccagtcttaattattgagtagaaaaactaaaatatcattagttttttcttactgtgttagaggcatataaatttctgtttaaaacttcagataacattaagtatgtaaaaatttatgtgaaattaaaacttcagattttgaatttttaatctctagttggttgtatatttatttttaataaaattaagttcctaaagagcaataattgtttgcatttttttcctttagagttagataattattgagatttttggatgcagagagtaaatacaggcctcttgaatcttgttttagaatgtattgggtatctacttaaaaggaacaggctccttttaaaagtattataagaaggcacaaacaatatgccccttagatgtcacttctgctacaaaaattgcattatataacttttgtcacaattaactttttcataggagaagaaaaggttaacaattaacaacgtagctcgacagtgggacttgcaacaacaacgagtagccaatattgctacaaatgaagatagaaaagattctgactctcctcaggacccctgtcagattgatggaagcaccctctctgcattcccagaggaaacagggtatgcaatggtattttttcaagatacaagcatctttgataattgaatttggagtgggaattagaaaccattttacatataattattttaaaagggttttcttaagaaaacttgctgaaattagaaattaagatggaaaagttgaaaatataaatcttactataacattctccaaattaaaacatgcttcatagggcatttcatattttttatagggaaaagtctagatttcttaatatagtctatgatgtcttttgcccacttcatctcttttatctcatgccatcaaccatgttcttctgctattgcagcatcactgtctgtctttcagttcagttacttcctacttcagaacatttcttttttattattattactattattattatactttaagttttagggtacatgtgcacaatgtgcaggttagttacatatgtatacatgtgccatgctggtgtgctgcaccaattaactcgtcatttagcattaggtatatctcctaaagctatccctcccccctccccccaccccacaacagtccccagagtgtgatgttccccttcctgtgtccatgtgttctcattgttcagttcccacctatgagtgagaatacgcggtgtttggttttctgttcttgcgatagtttactgagaatgatgatttccaatttcatccatgtccctacaaaggacatgaactcatcattttttatggctgcatagtattccatggtgtatatgtgccacattttcttaatccagtctatcattgttggacatttgggttggttccaagtctttgctattgtgaatagtgccgcaataaacatacgtgtgcatgtgtctttatagcagcatgatttatagtcctttgggtgtatacccagtaatgggatggctgggtcaaatggtatttctagttctagatccctgaggaatcgccacactgacttccacaatggttgaactagtttaccgtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatgatgagcattttttcatgtgtttttttggctgcataaatgtcctcttcagaagtgtctgttcatgtccttcgcccactttttgatggggttgtttgtttttttcttgtaaatgtgtttgagttcattgtcgattctggatattagccctttgtcacatgagtaggttgggaaaattttctcccattttgtaagttgcctgttcactctgatggtagtttcttttgctgtgcagaagctcttgagttcaattagatcccatttgtcaattttggcttttgttgccattgcttttggtgttttagacataaagtccttgcccatgcctatgtcctgaatggtaatgcctaggttttcttctagggtttttatggttttaggtctaacatttaagtctttaatccatcttgaattaatttttgtataaggtgtaaggaagggatccagtttcagctttctacatatggctagccagttttcccagcaccatttattaaatagggaatcctttccccattgcttgtttttctcaggtttgtcaaagatcagatagttgtagatatgcggcgttatttctgagggctctgttctgttccattgatctatatctctgttttggtaccagtatcatgctgttttggttattgtagccttccttgtagtatagtttgaagtcaggtagcgtgatgcctccagctttgttcttttggcttaggattgacttggcgatgtgggctcttttttggttccatatgaactttaaagtagttttttccaattctgtgaagaaagtcattggtagcttgatggggatggcattgaatctataaattaccttgagcagtatggccattttcatgatattgattcttcctacccatgagcatggaatgttcttctatttgtttgtatcctcttttatttcattgagcagtggtttgtagttctccttgaagaggtccttcacatcccttgtaagttggattcctaggtattttattctctttgaagcaattgtgaatgggagttcactcatgatttggctctctgtttgtctgttattggtgtataagaatgcttgtgatttttgcacattgattttgtatcctgagacattgctgaagttgcttatcagcttaaggagattttgggctgagacattggggttttctagatatacaatcatgtcatctacaaacagggacaatttgacttcctcttttcctaattgaataccctttatttccttctcctgcctaattgccctggccagaacttccaacactgtgttgaataggagtggtgagagagggcatccctgtcttgtgccagttttcaaagggaatgcttccagtttttgcccattcagtctgatattggctgtgggattgtcatagatagctcttattattttgagatacgtctcatcaatacctaatttattgagagtttttagcatgaagggctgttgaattttgtcaaaggccttttctgcatctattgagataatcatgtggtttttgtctttggttctgtttatatgctggattacatttattgatttgcgtatattgagccatccttgcatcccagggatgaagcccacttgatcatggtggataagctttttgatgtgctgctggattcggtttgccagtattttattgaggatttttgcatcaatgttcatcaaggatattggtctaaaattctcttttttggttgtgtctctacccggctttggtatcaggatgatgctgacctcataaaatgagttagggaggattccctctttttctattgattggaatagtttcagaaggaatggtaccatttcttccttgtacctctggtagaattcggctgtgaatccatctggtcctggactctttttggttggtaagctattgattattgccacaatttcagctcctgttattggtctattcagagagtcaacttcttcctggtttaatcttgggagggtgtatgtgtcgaggaatttatccatttcttctagattttctagtttatttgcatagaggtgtttgtagtattctctgatggcaatttgtatttctgtgggatcggtggtgatatcccctttatcattttttattgcgtctatttgattcttctctcttttcttctttattagtcttgctagcggtctatcaattttgttgatcctttcaaaaaaccagctcctggattcattaattttttgaagggttttttgtgtctctatttccttcagttctgctctgattttagttatttcttgccttctactagcttttgaatgtgttttctcttgcttttctagttcttttaattgtgatgttagggtgtcaattttggatctttcctgctttctcttgtgggcatttagtgctataagtttccctctacacactgctttgaatgtgtcccagcgattctggtatgttgtgtctttgttctcgttggtttcaaagaacatctttatttctgccttcattttgttatgtacctagtagtcaatcaggagcaggttgttcagtttccatgtagttgagcggttttgagtgagtttcttcatcctgagttctagtttgattgcactgtggtctgagagatagtttgttataatttctgatcttttacatttgctgaggagagctttacttccaactatgtggtcaattttggaataggtgtggtgtggtgctgaaaaaaatgtatattctgttgatttggggtggagagttctgtagatgtctattaggtctgcttggtgcagagctgagttcaattcctgggtatccttgttaactttctgtctcattgatctgtctaatgttgacagtggggtgttaaagtctcccattattattgtgtgggagtctaagtctctttgtaggtcactcaggacttgctttatgaatctgggtgctcctgtattgggtgcatatatatttaggatagttagctcttcttgttgaattgatccctttaccattatgtaatggccttctttgtctcttttgatctttgttggtttaaagtctgttttatcagagactaggattgcaacccctgcctttttttgttttctatttgcttggtagatcttcctccatctttttattttgagcctatgtgtgtctctgcatgtgagatgggtttcctgaatacagcacactgatgggtcttgactctttatccagtttgccagtctgtgtcttttaattggagcatttagtccatttacatttaaagttaatattgttatgtgtgaatttgatcctgtcattatgatgttagctggttattttgctcattagttgatgcagtttcttcctagtctcgatggcctttacaatttggcatgattttgcagtggctggtaccggttgttcctttccatgtttagtgcttccttcaggagctcttttagggcaggcctggtggtgacaaaatctctcagcatttgcttgtctgtaaagtattttatttctccttcacttatgaagcttagtttggctgtatatgaaattctgggttgaaaattcttttctttaagaatgttgaatattgacccccactctcttctggcttgtagagtttctgctgagagatctgctgttagtctgatgggcttccctttgtgggtaacctgacctttctctctggctgtgcttaacattttttccttcatttcaactttggtgaatctaacaattatgtgtcttggagttgctcttctcgaggagtatctttgtggcattctctgtatttcctgaatctgaatgttggcctgccttgctggattgggaaagttctcctggataatatcctgcagagtgttttccaacttggttccattctccccatcactttcaggtacaccaatcagacgtagatttggtcttttcatatagtcccatagttcttggaggctttgttcgtttctattcttttttttctaaacttcccttcttgcttcatttcattcatttcatcttccatcactgatatcctttcttccagttgatcgcatcggctcctgaggcttctgcattcttcacgtagttctcgagccttggctttcagctccatcagctcctttcagcacttctctgtattggttattctagttatacattcgtctaaatttttttcagttttcaacttctttgcctttggtttgaatttcctcctgtagctcggagtagtttgatcatctgaagccttcttctttcaactcgtcaaagtcattctccgtccagctttgttccattgctggtgaggagctgtgttactttggaggaggagaggcgctctgctttttagagtttccagtttttctgctctgttttttccccatctttgtggttttgtctacttttggtctttgatgatggtgatgtacagatgggtttttggtgtggatgtcctttctgtttgttagttttccttctaacagacaggaccctcagctgcaggtttgttggagtttgctagaggcccactccagaccctgtttgcctgggtaccagcagcggtggcggcagaacagcggatttttgtgaaccgcgaatgctgctgtctgatcgttcctcttgaagttttgtctcagaggagtacccggctgtgtgaggtgtcattctgcccctactggggggtgcctcccagttaggctgctcgggggtcaggggtcagggacccacttgaggaggcagtctgcccgttctcagatctccagctgcgtgctgggagaaccactgctgtcttcaaagctgtcagatagggacatttaagtctgcggaggttactgctgtctttttgtttgtctgtgccctgcccccagaggtggagcctacagaggcaggcaggcctccttgagctgtggtgggctccactcagttggagcttcctggctgctgtgtttacctaagcaagcctgggcaatggcaggctcccctcccccagcctcgctgctgccttgcagtttgatctcagactgctgtgctagcaatcagtgagactccgtgggcataggaccctccgagccaggtgcgggatataatctcctggtgcgccgttttttaagcccatcggaaaagcacagtattggggtgggagtgacccaattttccaggtgccatctgtcaccgctttctttgactaggaaagggaactccctgaccccttgcacttcccaagtgaggcaatgcctcaccctgcttcggctcatgcatggtgcgctgcacccactgtcctgcgcccactgtctggcactccctagtgagatgaacccagtacctcagatggaaatgcagaaatcacccgtcttctgcgtcactcacgctgggagctgtagaccggagctgttcctattcggccatcttggctccagccagaacctttcttatagggatagtgtttttctgccctaacaccaatcacttccctgcactatttctctgatcccgccctagctaacttcagcaaacccacagaggtctgaagtttaaacttcacatgttccaaaaaagccttccctaactccaagttggtaggtagttgtttcatgtgtgtcttccccattagaatgtaagcttcatgaggaaaggaatcctgcttgattgacttgactcctgctgtgtcctcagcagccagcacaaaaccttcctctttaactactggtagtaagcaattgggcatataatctgaaagttactccagctgtgatctatactatctgtctattccagtggctcacaacctcttttcttctatgatacatttatcacatgataatatatccctaggtttatgagcaatgctgaatgcattatctagactccacatgtttctcttcctcttagaaaagcatattggaatcaagtaaattcagagggacataaagcatttatatctttatagtgcatgtataatttaaatatatatttgtacagctgtccctcagtatccacaggggattggttccctgcaaatacccaaatctgcagatactcaattcccttatataaaatgggatagtatttgcatataacctatattcttcctgccatatacttgaaatcatctctggattacttaaatagtatttaatacagtgcctacacatcactccatttgcatggatttggtatagtactcagcatgtggcaagttcaagttttgcttttggaactttgtggaatttttttcggatatttttgatccatttggtttaatctatggatgcagaacccactgatactgagggctgactatatttacataattttaaaataaagcctaaaaatcaaagatagaatacattttagttttgtttaatttgatgaagcatatgtgtcttattaccttaactaaactctgaaacaccttttaaaactaaatataatatagcttttacttcaggtttttagctggaattctttaagcctttcatatgcaaaaaatatatagtaaaggaagtaatttgagtgacatgagaataatgttttggaaattgtctgtagttagagtctaacatatatttaggcaaatatgctttttaaattttagttatagaattaacttatatcagtgtatttccttcagctcacttgggatccacatgtagaccttgtcagctctttcagctacaaaaataaatcaagaataaaaattcaatcactgatacccttgcttccagttgattgaattggctgctgaagcttgtgcattcatcacatagttcccgtgccatggttttcagctccatcaggtcatttaaggacttctctacactggttattctagttagctatttgtctaatcttttctcaaggtttttagcttgtttgcaatgggttcgaacttcctccattagctcggagaagtttgatcgtctgaagccttcttctctcaactcgtcagtcattctccgtccagctttgttccgttgctggcgaggagctgcgttcctttggagggggagaggcgctctgatttttagaattttcagcttttctgctctgttttttccccatctttgtggttttatccaactttggtctttgatgatggtgacgtacagatggggttttggtgtggatgtcctttccgtttgttagttttccttctaacagtcaggaccctcagctgtaggtctgttggagtttgctggaggtccactccagaccttgtttgcccaggtatcagcagcagaggctgcagaacagcaaatattgctgaacagcaaatgtccactccagaccttgtttgcctgggtatcagcagcagaggctgcagaacagcgaatattgctcaacagaaaatgttgctgtctgattgttcctctggaggtttcgtctcagaggggtacctggctgtgtgaggtgtcagtctgcccctactcgggggtgcctcccagttaggctactcgggggtcagggacccacttaaggaggcagtctgtctgttctcagatctcaaactccatactgggagaacctctactcttcaaagctgtcagacagggacatttaagtctgcagaggtttctgccgcattttgttcagctatgccctgcctgcagaggtggagtctacagaggcaggcaggcctccttgagctgcggtgggttccacccagctcgagcttgctggctgctttgtttacctactcaagcctcagcaatggtgggtgcccctccgcaagcctcgctgccaccttgcagttagatctcagactgccatgctagcaatgagcgaggctctgtggacgtaggaaccctcctagccatgtgcgggatataatctcctggtgtgccatttgttaagaccgttggaaaagtgctgtattagggtgggagtgacctgattttccaggtgccgtctgtcacagcttcccttggctaggaaagggaattccctgaccctttgcccttcccaggtgaggtgatgcctcaccctgctttggctcacgcttggtgggctgcactcactgtcctgcacccactgtccaacaagccccagtaagatgaacccagtacctcagttggaaatgcagaaatcacctgtcttctgcactcacgctgggagctgtagactggagctgttcctattcgaccatcttggaactgcctggcctagtgtcaagaataaaaattctaatgaagtgacaatttatgtaactaatataccactcttatatagccctagagctatatttaatattatttaaatggcaaaatataattttacttggttagaactataatactttataatgttaaaactttatagcattgggctttagatttatgaaataatacaggtcagttctatttctaatttcttttttaaaaattatttttcagtttcaagtttatccaagtaatatggaatttaatattctaaaattataataaggttttagaagttagtccttcaatccgtcaaatttttttctttcttcttttggagatggagtctcgctgtgtctcccaggctggagggcagtggtgcgatgttggctcacggcaacctttgcctcccaggttcaagtgatgctcctgcctcagcctcttgagtagctgggattttccaggtgcccaccaccacacctggctaatttttgtatttttaaaagaggcagggtttcaccatgttggccaggctggtctcgaactcctgatctcaagtgatcctcctgcctcggcttcccaaactgctaggattacaggcttgagccaccgcacatggcctcaaacttatttttatacacaatgttagataagggtctaacttgattttatttcaattgactagtcaatttgctaataaccttttaaaaattaaacttcttttttcatgagaatgccatctttatctcatgttaagattttgtaaatatgtgcacatatttctggactatccatttcacttatctgttttaatgccaacaccagactcttttgattatagtaattttgtagtaagttttcacaacttgtaggggaaataggtttccactgttcttttcaagtttcaattgtcacacacctattcttccatatgagctttatttatttatttatttatttatttattgagacagggcctcactctgtctcccaggctgaagtgcggtggcatgatctcggctcactgcaacctccgcctcccaggcttgagcagtcctcccacctcagccttccaaatagcttggacaataggtgcacacctctatgtccagctaatttttgtattttttgtagagatggagttttgccatgttgcccaggctggtcttgaactcttaggctcaagtgatctgcctgccttgacctcccaaagtgctgggattacaggcatgagccactgtgcccagcctcatgtgaactttaaaatcagtttacctaaatagaaaagaaatgatgagaatcttgttcaaatcacatttaagtttacttattaatttcagaagaattaacattgttatgacagtaacgtcactttaagaaacaggtctcgtttgatatccagagggagctaactgggaaaatgttgaaagattgaaggaaaattctgaggaactaaatgaggttagagaccatgaaattatagcaactttagcctgaatggttgagtgagtttattccaagatcgcagagtagctaagtataacagaagagaagctaaatgtctgaaaaagaacaaagagacaagggatcaaaggcaaggaattaaaaaattcaagtgtgatgacaaaggaaaagatagaaatgatgggtcagatagtctaggcgagatttttaaagaattaaaaaccagaaggtttgcaacagattggaagaaaattttgtttctgggactgtaagtctaattaaagttgcaaatgaggagcatataaagtaagagcattaataatgagctggaatagtgggaatttatggtcaaagtaagtttttgaggttaaatattttagaggtagaacacatttaagtaatgaaatctaagcaatatggaagccattgttgtggttatcagagtggattgttggaaaagagtaaaagcaaaaggtcaccagaagagagatccgttgaagccattattatagatattgaagttactgatggtagaacaaggtatgctaccagaggccgtacatcctgttctcttgtgatagggctattcactgtataagttttactagttttggcagcttcagtgaatgcaggagtatcttttttattaaatgactcttttatctggcaaaactacctctgatcagtggattgcagactattaacgtgactttcatgacattttgaacttttaaagtggcatatggccaaacattttatgaccctctaaaataacttaaaatcatagcgtctttatggtctcaaaacaagcaagctgttccaagagaaagaggaagtatctgttagtgaaaattgttgtgccttatgcttactgccaagagtttcagaatttttattaggagttccacaaagtcgttagcttttaagaagggagcatagagaaagagtttgggagagatgggagaagtgatgtggggggttcaatggagaggatgtaaaaagtaatgatgaataattaggaaagggatccacaatttctggcaaaagatttactttctacaaatgtatgtttaaagtgtcatggaaacactattacattctcttagtttgattctttttttaatgaccggaaaactagcaagttgagtagccacagaagatatttatatatgaaggtagaaaaataaaattttagggataaatagtatataactggtagagattataatgcaaaatcagttacttataacttctactggttgtagatttttcttcagtttattttgtagttatctgattcctttaaaatctcctagaactgaaatttagagatatttctaaaagaactttttataccttgcattttatctaaacaaggaactcttaaccagtgcattcagtttggcttcttgaattttaagtccttattttacttgacctccttacagcatttgacgtagttgaaactcctcattcacctgattttccttttatgtatgtggctactctctcttttttttaagtggtatcttactggctccttctctaccaaatctttaaatgtatattatgcagttttttaaatttgtaagatttagatatactacttgctaaaatagatgaagattcagctccctcacctcttttcctcccaaaactatatatctatagttgctttattggtagcttttgtaatgtgtatctaaatctctgtttttttgtttcatccactataggcaataggcctcaagtctgcatttgcaagatgagtctatcctttttatttttcccactttgtacattgcaacttctatcagctacacttttgtaatttcccttgtgatttcttctttttccagtgtttgtttaagactgcagtgtttaatttgtgaatttaccagatttgttcattgtggtcagagaagacattttgtagaatttaatctttttagattgattgagacttgctttatggctgaacatatggtctatcccagagaattttccatgcgtacttgagaagaatatgtattctgttgctgggtggggttttctatatatgtctgctagttggttttatagtgtacttcaagtcctctttacttgctgatcttctgtctggttgttctatccattattgaaggtagggtattgaagtctccaactattattgtagaactgtttcttctttcaactttgtccattttgcttcatgtattttagatgttaagtgcatatacctttataattgttgtaccttccttatggattaaccaatttttcaatataaaatgttcttccttgactctcataaaaatatttgatataaaatctatttaacgtaatattagtagctactctggctctcttttggttactgtttgcatggaatatctgtttctattctttccatttcattctatttgtgtcttttaatcctgtagaaagcatatacttggagctttaaaaaaaaaatcctggctgggagtggtggttcacacctgtaatcctagcactttgggaggctgaggcgggtggataacctgaggtcaagagtttgagaccatcctggccaacatggcgaaaccccgtctctactaaaaatatgaaaattagccaagcgtggtggtgcatgcctgtaatgccagctactcaggaggctgaggcaggagaatcacttgaacccaggaggtggaggttgcagtgagccaagattgtgccattgcactccagcctgggcgacagagcatgactccatcttgaaaaaaagaaaatcctttctgctaatttctgccttttaatttgggtagtttaatctttgaagtcctgataaggaaggacacacatctaccattttgttacttgctttctatctgttgtatatccttttttggctcctcaattcttttattgctttcttcttttgtatttaactgattttcttagtgtaccgtttttgatccctttcttgttccttttaccatacattttctagctattttcttagttgttaccctggggattacaattaacattttaatttagctagttagaattaataccaacctagttgtaatagtatataagaactttgcttctgtttaactctactcccttttctgttactattttcagaaattacgtctttaaacattgtgtgcacattatagatttataattaattttatacatttttcttctaaatcatatattaaaaagaggaattaccaccttaaaaattcagtaatactggcttttattatgcacctgtgtaattacctttcttgatgttatttcttcgtatgacttcaagttaccaactagtgttctttaatttccagagaatttcctttagcatttcctgtaggtcaggtatactagtaataaattccctcagcttttgtttatcagggaatgtcttaatttatctcttatttgtgaagtccagttttgccatatataattttgggttgacaggttttttttttctttcagcactttaaatatatcatccactactttgtggtctccatgatttctgatgagaaatcagctgtttttcttagtgaggatcccttgtccattatgagtaacttctctctcactactttcaagattgtctctttatttttgtctttcagtagtttgattataatgtgtcttggtgtggatctatgagtttatcctagtcagagttcattgagcctcttggatatgttgttttatgtcttttatcaaatttgggaagtttctggccattgttttttcaaatattctttctgcttttttttttctctcatgtctgtgcttccgaaactcccattatgtttatattggtatgctggatagtgtcccacagttttcctggttctgttcatttatctttattctttatttaacctcactcctcagactacataatttaattgacctatctaagtttactgattctttcttctgcctgctaaaatctgctgttgaaaccctctagagagcttttcagttattgtacttttcaactccagaatttctatttgattcctttttaatttccatttctttattgatattctttatttggtgagacatcattctcctggttttccttagttatttcagcatatttaaaatagttgacttaaaagtttttgtctagtaagtccaatgcctgggcttcctcagggacagtttctgttcatttctgtttttcctgtgagtgggttagtctttcttgtttctttgtatgcatcatattttttgttgaaactggacatttatgtgacaactctggagatcagatcattcttcccccctagggtttgttgttgctgcttgttttgattgttgtcttctatttttttaatgactttcctaattatttctgtgaagactgtattatttagcatgtgtacccactgaaatctctgttcttttagcttagtggtcagttagtgattttcagagattttcttaaatgcctggagaaaaaaggaaaaaataaacctctcccagactctatcgattggttctgttttgaggcactctttcactgcttatctaggcagtttaccactctgccttaaccttcattcctgcttgtgtggaacctgaagatcagccaggggttagggttagggttaaggttagtgtcttctcaggtcttttccaaacatgtgtctgaccctggacatatatgtggccttttagattccctggactcacaggagcttctcaaaactctattctcccagacatctctttccctagcctcttccttctcagcctttttggtctgtctgttgcttgctgcagctactatcctttgtccaatgtggtggcagctaatacatttttgcctttaactactttcaacaaatgccacttagaagccacctcagccctagggaagctccagggcaagtgatacaaaggcaagcccttgagctaatccttcagagagccaccaaacatgtcaaaacacacaactacaactttttgagaatatggtctgcattgcttcctctgttgccagcaatctgcaccaggaatgtgggctgttcaacttcaaggccaccaccaagctggggagtggggaatggtaacagggtaagttaagatgcttcagaactctcttattgaaattcagcagtttttcttttcttcattaagtgtttccctggttttgtaatttattagattccagatttctgaaaaagttgattttgtttttggggtttttttgttcctagcatatttgttgcttttgtggagggatggagtgtttcggagttccctactctagcatttttgctctctctttgggattccaatttggctttattctatgagttatacttttaaatttcaagattaatgtcatttatatctgttctataatcataaaactttgtcagttggtaggatttaaaacttgaaaactggtaaacagtatttaagtctctataatataacaattttttactttacagtaaagaattaagctatgtttgtctccttttccgcttcctaagccactccaagaatagtcatagcatcaaattcaaatggacccctcttcattataccttaaaagttgtccaaacccatgccacattttagtttgccccatatttgagccatgcctttcatatatagtttgtttttttctggagtttctgattgcctttttaaaaaattgaacaaagaaatttactgctgtttctacatttctgacttctagaatctactctttttgaagcctgtctccgtgatctaatttagactcatcatttgcttttgggccattctttatagtttattattttatatcatattattagtagcctttgatttttttcttgtattatgtgtctttctcatatcttcaagtatttctgtcctctcaacctctcgatggtagagttcttcggattttggtcctgggctctgtttacactctctgctttcctcctaggcagtctcgtacatgcctttgactttaaatactatttatatactgaagacacaaaaatatatacctgttcctttatggtttacccacttagattgtgtttaggaaaacaagtcctttaccacattgagattttaaaaacattctcccattttgtcttcctaaagttttaacatttggccttttttatttaaatttttattatacctgtaattgatttttatatttgaggttaagttctgatttgggtggggaggggttttccttccataggaataatcagttaccctagtgctatttattgagtgttctttcctttctcattgaactgcaatgccactctgtgagacttttgttggcagtgagagaagtaggtgggagagaccttttgcagatcttcaattaatgcccctgtgttcagtctcacttctcattcccatcctccatcatacttactgttagttgctttccagagttccactgagcaatttggctgccatctttttcttatttccagtgcatatttgagaacacagcccttttttatccttcttcatcacttaacactttttctttctagcttccagaaattttctgaaatctcctgctgccaatagtcttcccctactgcacttgttgttgttgtgggtttatgtctttttcattactttactattcttcaatggggtcttggagggagagcttttaaacacatgtgcttagtctatctgctatttttttttttgtgagacggagtctcacgctctgtcccccaggctggagtgcagtggcacaatctcggctcactgcaacctctgcctcccaggttcacaccattctcctgcctcagcctcctgagtagctgggactacaggtgcccgccaccacgcccggttaattttttgtatttttagtagagacagggtttcaccttgttagccaggatggtctcaatctcctgaccttgtgatccgcccacctcggcctcccaaagtgctgggattacaggcgtgagccaccgtgcccggctgtctatctgctatttttatctgaaagtacaaagtgaagaattttaaacattagaggttatatttctacattttctgtaagtcttcaaaaagataattaaattttatcatttgggaccctgaatgatacaatttaactatttctgaacataaaaagctagtcagagggccgcaaagtttcttacctagtgtttcgatttgttttttaatactgcatagggttttccatttttaataatcatttatatttatagtctttagtatttcataatgccaaaaaagtggatatttcttgggttacaatgtctataacctttggcttatggggggggcgtgtaactaaatgcctggaaacaagtctctatgaaaaaattatagacacaaaaagggaagaaattctctaaaactttgctatatcccactaatgatttcactattcactgtacttgggacagctctacagtaaaatgacatattgcaggtttcttttctctggcagaaattggaaagtacttggtgtaatgttttttttttgcttacattggatgcatgcagtgaagctgggttatttttggtcatttcctgtctatgaacactgtggtattttagccaacactactataataaaatataatgcatacaatgaattttcacacctatgaatgttgtaatagaaattcataaaataaattattataggaatcagcaccacttattcattgggaaaagaatcttccgaaatattttaagtctttctgttcaggcctgttacgaaaagcctaaaggttaaaaaaacaataataatcctcctaaataatgtctcttttcatctagacatttaagagtatgttctacatttagctgggctttcagagtcattattgcattgagctagtcaccctgtcttttcttagggtcctttattgaaaaggcataggatattttctggccttttttttttttttttttttttttttgagacagagtttttgaggctggagcgcaatggtgcaatctcagcccaccgcaacctctgcctcccaggttcaagcaattctcctgcctcagcctcccgagtagctgggattacaggcatgcaccaccatgcccagctaattttgtatttttagtagagatggggtttcatcatattgaccaggctgatctctaactcctgaccttgtgatccacccacctcggcctcccagagtgctgggattacaggcatgagccactgtgcccagcctcctgacttattcttatgtaaagatcaagttgaattgatgaaactttggacttaaattaaccactaaaaatcttgaagagaattcatatttgatttcattctgcctgctgttatataattaatatttcagttggagaatataattggaaatgtattggactttatgggaaaacacattttaaacagatcctccagagaagaataccagctttcttagagtacagatttagactagacagaggtaggaaactgggtcagatgaccagttacccactctagaaatctgactcacacttaattccaccctttccttcattctccagtcaaccactaagtcttacttttatttattcttgaatgtctgataaatctgtgttctcttttattaataataatcatgaaaatgtactgagctaagtatgaggcatagtttagaatatttttttctaatcttcacaacaactctgaaaatatatgtattatgataatcatttacatacaagcaaactgaaactcaaagaattgaataacttgccccagaagtcatcagttaccaatggcagatctggaatttgaactaaagtctatctcactttcttgccattgccattttgactacaccatacccttttttgttatgccagcatatggtctagttgacacttttgcaatggtctcttactcatcccctacattcagcctctccctactatgtcctccacaaagttgattgacttatctgtctgaagtggggctttgagagcagagagcatatcttattcatctttgtatccctaacaccagtacctagatccatgcatgatactttggaggtgcttaaaaacttgcattgaatataatctcatcactttttaaatttaaaaacctttttctgcttctgaaccatgcaggataaaatctgacttttcaggctcatctccagctcctactcccctccatgtttcaatgttcctgccctgtattttagtgttccagccatagaaatattgttcaacccagcaatcccattattgagtgtatacccaaaggaatataaatttctctagtataaagacacatgcacatgtatgttcattgcagcactattcacaatagcaaagatgtggaatcaatctaaatgcccatcagtgatatactggataaagaaaatgtgggaggccgaggcaggcagatcacttgaggtcaggagttcgagaccagcctggccaacatggtgaaaccccgtctctactaaatatacaaaaattagctgggcaaggtggcatgtgcctgtaatcccagctactcgggaggctgagacacaagaatctcttgaatccgggaggcggaggttgcagtgggctgagattgtgccactgcactccagcctgggtgacagagtgaaactgtgttaaaaaaaaaaaaaaaagaaagaaagagagaaaatgtggtacatatacaccaaggaatactatgcagccataaaaaagaatgagatcatgttattttcagggacatggatggagctggaggccattatcattagcaaactaacacagaacagaaaatcaaataccgcatgctcttatttataagcaggagctaaatgatgagaacacagggacacactgaagggaaagacacaccagggcctattggatggtaaaaggtgggaggaggaggaaaaaataactaacgggtactaggcttaatatctgggtgatgaagtaatctgtaaaataaacccccatgacacagtttgcctgtgttacaaacctgtacatgtacctctgaacttaaaataagagttaaaaaaagaaattattcttacataaatatattatacataatcaggttttattttccatacaaaataatgtctgtgtcaggtttgcgcatgtgcccctgaacttaaagtagtcattcctgcgcccttcttcattctgttttcccaacttctgctcctgataaaaatctgctatttatctctcaaggatcagttcaaatccaaccttcctttttaaaattgacttttcccctctggaagaattagtcattcctttctctgtgttcccttagcatatggtttaaatattcgttatatcacaataagcacattatattatatttaatatatatattcatcttcctctccgccccacccatccagattgagagctctttgagggcaaatatatcttgatttattatatccccaatgcttaacacaatatctgacacataataaattctccacaaaaacctatttgtttaatgagatattgaggtcattttagtttagaaattatatcccatgtgtttattaggttgattgcagaggaggattagagcagttatatttctgaaactatgacccagtaaaagtgagcaataattttgctatatccagaaacctttgtatgatctcagtgttgattgttcttatcaatacagatgatttagtggcatgtgccagaattcttagcacagtgttttgtagatagtgggctttgaggacatgtttggtgaatgaaagaaagaaagaattaattagttaattaattaatatgtgtgtatgtataactaaaaagatgtacccatatctgctaaggatacaaggaaaactagaagaacaatccccaaaatataaacattgtttggcaagctaagtcactttttaatggagctcagaacacactttcccagaggagcaaatttgtaaacattgaccagagtttaaggctaaactcaaaagcttccttcagaaaataactgaaatgggttaggtgttatatggcctgtttactaggtgctagtgaaaaggatgagcctgtctgcagcccaggagacttgccgtttgtttttaccaaatgggcatgtgatagctatataaattggaaattacttctgctttgttttgtaaccatgtcactgttttactgaatgtagccttgtttattatgtcacttatttcctgaagagtttacttgacaagccctttacacaaaataaataatccctttctgatgacagactttttattgtggagcttatattcttaaacttttaattatgtggaaaaagaaaagcaagacacttttaaatatatgatgtggagcaacatcatttcccaaagggtttgttgatgtttttgatacataactctgattccccatcatttttacattaaacttttttgctggttactgtggccatcaggcgtccctatgtgggtaaaccttcttgctaaacctgattctgtgtctatatcactgattctgcccctttactgaaactatagcttatggttcaaacatccttcttaagatataatacatactcattaaaaacttcatcattgtcccacttcattaattcatccaagaaatatgtattgagcagagcataggctaggagctgtactagatgttggatctactatagtaatcgtgacaaaattcaagccctcaaggatcactgtgtttagtaagagagatatagataaggcaacaagtaattgcagtacaatgtggcaagtattgtaatagcagtatgcactcttttcatcttctttgttttagtggcagtgaagctgtcctttgttctgttccagtattgattatataagcaacctcaatgagatataatctaactcaatgtatcacacaaagcacaatgtatggaactaattgttaagttagtttttcctattatcagccttcacctttctaagattattatctaagaccattcatgtactactactcattggatatttgatttttgtcacataataatcattgtcttaagtgctagtctggtagaaatcaagcctttttgtattttcttggttgcatattcacttaaagtagactgatgtcattattcatcttgttattgaataaacaaatgtgtagaaggttaactggtacctctgaaataagtatgataaacaacagggcagcgctttcttagttttatcccttaacatcattgtaaatgtttgaagatatttaataattcattcagtatacattgttaaaagctgattactagattttgggtccccaaagatgaaaaaatatataatctttagcctcactcactatctggaataacaggcaaaattgtaagcataaaattgtaatatagttatgagaagtgtgttccaggagtataccaaagaccatgggagcacaaataagagcgagacactaattttagtaggggcaaataaatactggatgaaaggagaaatcccagaaggaaaatgcagaaacaaaaaccatgctttgtttaagttttgaggttgggtaaaacaaatagttatgtctctattcacaaagcagataatatgagttggattaagatatttcatttattctctagctatgatttagatagccttatataaaaaatgtggcttctaccttggaaataataattaccaaattcagtgcagtatgagaagcatgtatatatatatatatatatatatatatatatagtgtgtatatataatataaataatgattccttttcactgtttcttatttcaaagtgaggaggaaatctacactgattttactgattataactgtagtatacactttaaaaatttcaaaaaccattgaagtatccaaaagtagaaagttagagttaccccctaatacaacctctgagaaataaactatttttagcagttattacttggttcataaacatatttttatatgtatggttcttactatagaaatactaatttgtaaactgtacttttttctagtcagaaaagtttatagattgggaaaacctatctgtgttgacatggaaagataaccataatgtagtaaacggcttgttttaaaactaaagggaatattagttatctttcatggatagaaataatttgggtttagaggtgatcttttttgttcataacatgcctcttaaattaaaatatatgattagaataatacaaaactgctagatagtctattgaaaattagtctttaatgctctaggtttaattactgaaatgaaaaaagaatataaaattgtgaagagcttttctgacaggtcattatactgttaggtattctgcatgatatctttcatttaaaattatactttgggttttccaggcctctagactcaggactcaacaatgctttacaaggtttatctgtcatagacacataccttgttgaagtggacggggatacactttccctatatggctcaggagcactggaatctctggataggaattggagtgttcaaacagcaggaatgatcacaacagtctccttcactttcatagaatttgatgaaatcgtccaagtgcttcctaaactgaagattaagtttcctaattctctggtaaatatttccttttagtagtatatttgaatattcttagtcaatgacttgtgtgttcaggccaaagacctgttttaacttgtatttatgtagtttctatctggcaggaagatttaagttttgtgttgattttcttgagctaggatttaaattagtattcataaatggccttgaagttttatgttaacatttgaaattctatctcaaaaaaaatgatcctttgtggagtagaaaaagactgatataattttattcaagttatatatttctactttataagtgattcaccttaccacatagccttatgtattcacctatggtacctggtaatggtgaaatgtatatttactgtataatttttacagttgtcccctaacaatgttgaaaataattttaatagctcattaaaattactttgagaaattagccttcctcaattatggtgtcattgtattatttagtatgcatttgtagaaactgtgatttctgtaatgagttctctcttgagtttctattattgttgtgtttttctctgtcagccaagagacttccctcacctgcctttttggtgggtttttgtttttattttcacttcattctccctaaaaaagatagttagaggtgaagacagtatgtttagaaaagagcatctagattcacagacagaatgcttgcgttaacattgcagttttagtgatttgatttttctatagccagtataactatcctacgtagtgtttggcaagatacaagtaataataactaactagttcttctcaggaaaattgtgggggcctgtatttataaagttctgaaattttcatttccagtctttttaaaaaaatttatttaatgtcaatgtaaagcatataaaatcaataattcctgaaagaatctgcattatttgatatttatgtatctttaaagaatgttggtttataagtgagactgtcatttgtagaaggagtcacccagaattcaatattggatggattccatcaatggtgcattggatgaattaaagttatgtaagtttagtacattcagttgatttaatgtaattgaaaacatatttgctaagcctaaagtttacatatttacctggggaatgattagtgaagctttaatgttaatatttcaatatggttaaaatcaatgttctgatctgtatttgtgttttatcattgcagcaccttaaattcaaggaaacaaatcttgtaatgctgcagcaatttaacgcactagcccaactccgtcgtattgaccagttgacaattgatcctcaaggaaatccagttgtcaattttacactctggaaatactatgtactgtttaggctaagccatttcagtatgcagaaaataaatggaacagaggtaagctaaaaactagatgaactatagaataaaaatattccttcttagtgaaaatagttactttaaatgtttaggaatttaagtaaccatgatagaacatttgagatataatggttttttttaaattgacatttaaaatgtcaaaaggctaagaatctattttaaaacttccaaagaactaaataaattgtaaaaataaaatagtaaccaggttatagtaaatggcaaatacttatactgttgtttgtaagcattcagtgaaataaaatggtggggtgacagttaaaaataaaaataaaaaataactcttttataagtaatgtgatctttgtatttctcaaagtactttgcagactgcctgctatgcaagaggggataaggaagtaaaacctaaatgtcaactaataagggtattgtggtagagaaagggaagaataaaatggaaaaaaaaggggaggaagaagatgacttacaaaaagaagagatgaaaaggagaaataagccaggaagaaagataaaataagagaaagtgaaaataagagaaaaagaaaataaaataagtataagtaaatgtctggaaagctttgttaatagctggtagcaaccactgtgccatgactacattgggtaactcaggtctggagctgaatagctggaaaattattagtgaaaagttatttttagattgattctgctaagcttgtcacaaggtaatcccccagctactcaaaagccatgttcttttaaaatattaatttggaaggaaagagagaagctatgcttccacctctactaaatttaaacactcctccagaggaaaaaaaaaacatctttaatatgttgttagtcttattacaatatctcttgaaattcagaagacctctttattgtaagattaactgtaatcaactttctggcacagtaactgtgtttccctgcagctgatacagtacaggtagatacttaactccaaaaattcagcatactatgaggagactgtacatctctggatcaatgtacaagcagctatatgaaatttgcatcaaccatggtatttctgtaacctcagaatcagccatctgctgaagatgttgggtaaatctgaatcttcagatgacttttaatttctccagctagttctcaagagggttggctcagtcttgtgtactcatgtatactatttggtacttcccccgaggtgaggttgtgagtccctggaaggacctaataattagtcctaaaggttttcaaagttagcccagactggaaatagaatggttatttttactgtgggtgactgagtctcccttaattgaggtaacacaccgttacctcagttaaccctaaatggtgtatttacccagatatggattattactagaataatacccattattatcaaactttgaatcaggaaggaatagtgtagttatataaagtggagaagaattagaaagaattagaaagaaccaatataatttattctgatttaaatttctgaaaatctcaatgccagggatatttgacactttattaaaatacctaaaatatattcctgtttgttaggtccttgaccttagatagtaatgttacactgcatttttacttctctgtgtataaaaaagaatgatattgcttgaggtagaattaaattgaattaatagcatcaagaaaacatggagtagtggcctgcattggccactaggtgactatattggaccaaacactacttagttattagctaaggaagaatttgaagtctccttaactgtgaagatccagggaagggaagagagttagcctgcactgattcataggtatgtttgtgaattattggtttgttttaaagaaaatgcctgtgaagagtattacagatagtgtcaggaacaaattttcaaaagatccaaaatttaattataccagggtttctaaaccttggctctgttgacattttgagccagataattctttgttgtgggggctgtcctctgcattgtgacatgtttaacagcaaccctggtctctacccactagatgcccgtaatgtccagaaataactaaacatgtctccagacattgccagttgttctgtagggggcaaaatggctcttggctgggatcattgaattatatatagacaaaaaaacagtatttaaaatgtaagcaaccctattttatattaaagaaaatatccccagatagtaatacaggtactgctttcagcttttagtactttcttggttaatgtaagaatgggtcctcatagggtatacttgtgacaagttattctttttggggagaaagactgatagaatgaacaggagcatccttgctaattcagtgaaagttccatctctcaggaagggacaaaattatccctataggagcaaggtatgaccaacaccttggcttacctttgacacattattaaaatgaatctatcccattgatacttgggaattttttcctctaaatcattctaatccaagaagctataggatttctgaaaaaaaaaaatactaaaaattgaaggtacctcaagtgtaattctcaggaaagacagcttctaaatcagagctgactcatcacctccaatcagcttccatcatcatgaaccacaattatacgtcttcattttaactcaagaaagaaaaatatcaatgaaaactcttctttccacagcacaggagaatgtgcttttgtgggcttaaaagataatatttaatttggatctctctttgggattatatcagttttattcagctaagagttggtgtcatttttttacccctttctattgtgtctcttcaggtgacacagaatgatatgataatggctgaaaggctctttggaatcctagcacatgtagcatcttctgagttaccccagtatcgtctgatttccattctgggtgatgccaggtaacctttaatttttgtagttttttatagaattactgttacactagaaaaagaaataaattccacatacctcctaactatgctaattatgtgttccataaacatgtatcctagactggcctattgaaagtgttggggatcttaagataaataagatgaagtccttattctcgtatggcttatagtctaataagttaaagatatacacatacaattaaaacgtaatgtttcaggtgctataagggagggctgtaggagggactaaccatattttggaataacactggggaaggcttcacaaaggagaaaacattttatctagttctttgggaatgagtaggagttttcaggtagaggatatggggaaaagatatctgcaaaagcacaagtaattgtaaatagctcagtataattggaacatgggatgattatgaataaatgataggaaatgaagctagaaagactgattgtggtctgactttgaagagctttccaatccatgccaagcaaaaatgaaaacttgtgttttgtaatgaagcacaagcaatcatataattggatttacattgtagaaaggctgccatttgagcaggcagagcttgaagtaatgaagaccaatcaaatggttactctgtaggccaggagagattatgagggcctgagccagggcagcaagatggagaagaggaaacctgacagaacacactaactgacgaggtggagcatggatgaagaaatagtcaaggatggttgaccagtcatgattcagttacagatcatacaagtcactctggttagagtaagcaaggaattagatatctacaaaatatttgaaagcgttgaggaagcagtttctagactgagcctccagagatatctcccagaattataccatagaacaagcccacaaaggaaactgcctccttgctatggtcatggagcactttgctacagtcaaggacaacaggagactgttgtcccagctgtgagcaccaggatcataccgctttagctgcgctgaggatcaggaagttccctactctgctccccagaatctggctccagaaccatgttaccctactataatttacactaacaaagtgagtcttttgcatgctactcctacttccccacttagcccagttctgaattcaaatcttacccaagtgtatcggattgatggaatataaatcccatctaaaacccacaaaaccattctgaaaaaaaaggaggcattgaattcaagaaacaatgatgtagaaagaaatcggtaaaaattatagttgtctgaataagtattaatgtataatgttaaaaagattaaataacctacaaggaaaaatccaagaaaatcctaagagaatgtaagttaaagtttactttctttccctgtttaggtgagataataggtactaattaacaataaaaattgatggaaaaatacacgtttgtgtgtattaaaatattaagggttttcatagaaaaagattagatggataatttctaaactactaaaaggaaaaaagtgatcaacgaaaagcaggaaggaaaaaaaagcatttgggttatcaccataaatattaataaagtcttctattaatagatgctctcagattgaattaaaaacatgtttttcagagatacccctaaaaaacccctaaaggcttaaaagaaagggatgggaaatatataatgaactaaatgccaacaacaaacagatacaggaatattagtggttaataatgatagacttgatgacactaaaaactacaatccaccagaaaatagttatgaaacagtgtaactaagactacagcttttaaacatatcaacaaatacaggcatatattgacaaatttttcagttattataatagtcattaatatgcttctttcataaatcagatcaaatcaactaacataagaaagactatagaggatttgcataacatagttaacacattttatcaaataaatatacttaaaatcttgtgttgacaaccttattcccaattcagaaaaaaacatatattttattcaaacatctatggaatgtttgtaaaagttgaacatctattaaactgaaagtaaatcttcaagtatctcaaaaagcatactcatacagatcacattttctaatcataatattataaaattagaaaataatgggtcaggatagccaaaaacttatctagttggaattgggatgggtagtggggtagacagtggacacaagcttccagaaaacaaaatacaaatgcctttaaactttaagaagaggatgtttggtcaaagttatagacaaccaaattttaaaataatgagataactttgtgggaaaagactagaagtttgatgatatgcagcggcagtcctcaacctttttggcaccagggactggtttcgtgacagacaattttgccatggacggttggggctaggggatggttttggaatgaaactgttccaccacaggcattagattctcataaggagtgggcaaccaagatccctggcatgtgcagttcacaatagggtttgcgttcctatgagaatctaacgccactgctgatctgacaggaggcggagctcagcggtaatgcttgcccgcagttcaccacctgctatgtggcccggttcctaacagccatggacaggcctgaatagcacagttatttcaccatgctatatatcggggtctccaagccccaggctgtggactagggctcgggaacccctgatatacagcatagcaaaatagagttcttacatacttttggtggtaatgaaagttactgtaatacttgttcatagtaacttagcaatatctaataaattgtaaatgcacatacctttacacttagcaatttcacttaaaggaatttgttctacagataattttctttacatgagcacaaatatctatgtgcaaggattttccttgcagccagtgtttatattagcaaaaatatgaaaactcactaaatgtccatcaatagagcgagacgaattacttgcagctctaaaaataattggatgttcttatatgaaacggttaaggtgtttcagaaaataaaaatataaggtacagaacaattgtatagtatgctgcaatttgtgagaaatggggcatatgtgtcaaagatactcttgtgcaatttaaaaatatttgattttttcaatatgcttgcctctaagtgttgaactggagggagacactaggattccaaagtacatagatactttttactctatgtttctatgaacctcttgaattatcttcttgctttttgttctatcttgtttttttattttttatcctttttaaaaaagcatttaaaaatactttaatgcttctgaattaaagaggaaataaagctaaaataataaatcatatataaatgaatttgataataagaatactatatgtcaaaacctctgggatgtgaccaaagctgtgctgacaggaaattatacatctttaatgtacttattagaaaacaagaaagattagaaagtaatgaatgaagcttttacttcaggaacctagagaaataccaaagtaaggcaaaattttaaaaaatggaaaaaagaagttcataaagataatagcagcttctaaagaaataagaatttgaaagagaatagttgaccaataaaagcaaacactgacgctccagaaaatccaagaattcaactattacacttttggaattaattggaatatataacaatgaggccagatactagattaacatatcaaaataattaatatttcttcataccaataataagctgttgaaaatagtattagaaaaagtaccccatttatagaggcaaagaaactatgaaatatcagaaaatacaccttataaaaagtaactctgacatacacaataaaattgggaacaggcctggcatggtggctcacgcctgtagtcccagcactttgggaggctgaggcaggtggatcacttgagcccaggagtttgagaccagcctgggcaacatggcaagactccatctctacaaaaaatacaaagactaaccaggcatgtggctcgcacctgtggtcccagctacttgttgggcttgaggcaggagggagaatcacttgagcctgggaggctgaggctgcagtgagccatgatctacaccactgtactctgatctgggtgacagagcaagaccctgtctctaaataaataaataaataaaaatacaattaggaacaaaaaggaagcttaaaaatgaatatttacaatgttaacaaattccaagacttaatattgtaaagatgccaatttatcctaattaaattacaaatttacttaattcccaatcacaaatcccaatatgatttctcaggaccctaaaacaagatacattttatatcttagaaaggcatttatcatctcatgttaatgaaaatgttctactatactttctcatacttcctgaaggtttgtaacatgtagctcacaaacatttttacagttttatatgatgaaatacatcataaagtgaaaatacataagcagacaggagaatatatttgcagcatgtttaacagaatttttaagaaatcctacaaatttagtaagaaaaaagacagttgagataatagaaaaaaaaaggcaaagcatataaagagaaaactcacaagaagaaatatgaatagccagaaaatgtaagcccaactcacttctcatcagagaaatacaacttaaattaaaataatgcgatgtcatttttgccaatgagattgacttaaaaatttaaaaaccaataatatcaatgacttattagtattcaggacaatgtacactgtacatgttggtagaagtgtaacatgacttttggtggaaggtagtttcacaatgtctatcaaaatttaaagcatacatatatttgaacccagtagttttagtactaggaatatattctaatgaaatacacatatgcacaagttatttatgtagtaagctgccatgctttattgtttgtagttacttaactttggaaagtaaccaaatgccaaataattggtaaaactaagtatatcatagtacttccacatttatagatgtagaatctatatgatactgtttatattacagtagataatatgactgtaaaaggaggaggaggagggggagaaagattgaggtaaatctcctgttctaacatgaaatgatccagagacagttcattgaatgaaatatggcataaaactatttatattatgacccaatgttatttaaaaacaacataataaatatgtagacattaaaaatatggaaacacagaaagggaactgacaggatgaacacctgggaggatatagatatgaggagtaaggtagagtagttgaagagtgcttttcaggttttattctatgtctgtacggtttgaaaagagtagtttttgagttttaatctgtataagattaggaatatattgaacttctatttctgacaatgatgagtttggttgtttttaccatttcttgagttaaaaacaatacaaaatgctagacaaaataaaaaccttcattaaagttttggggagctggtaaggtataacataattactaggccaggatctatgggaaaatgagaacattgagaattaaggtagacacaaagctcttagaaccgaacttacttttcctgctcttacacaccattcaacacagatatgtgagggggttttccctacacactagccaggcaattcagcagcagacaccagctgggtgccctctaattcaatttaattctgacactgcctacctggagatagtgtcagatcctacaggttgaaagatcattcccacaagacggctcctccccaccaaacccagcctccctacatcacatgccagttgcaagcactagttgtgacctgtgcttctgactgaccagctaagaattgagattctgacaacccccttcttggggggttctattaatttgcttagagtggctcacagaacacaaggaaacactttaattacatttacccgtttattataaaagatattacaaaggatacagatgaacagccagatagaaaaaatgcaaagggcaaggtatgtgggaaggggcacagagcttccatgccctctccaggcataccacccttcaggaacctccacatgttcatctatccagaagttctctgaatcttgtccttttgggtttttgtggagacatcattatgtaggcatgataaatgaaatcattggctattggtaatcaagtcagttttcagctcctctcccctccccagaggttggggatggggctggaggtcccacccctctaattatgccttggtctttccagtgaccagcccccatcctgaagctatctggctcacacaccccagttaccagccatctcattagcataaaaaacattctcgttactcttgcaattccaagggttttaggaactttttgccaggaaatgggaatggagagaatacagggatggacaaagaccaaatgtatattttatcatatcacagagactgtttgatccagaggcatttcaaggaaacataaatttttgttctgctagtctagaacagtagaaatgatggaaatcaaagcccagggctccatctaaaatggtaaatgtgaattgacgtcttcctaagggttaaaatgaaaccccagtggctataccatcaggtcagaaataaacctacctcttctccccactcaggaatttccaaggaaggttgccttgatatgagcagaaaagaggaaagttgtccctaagcaaatgtaaacaaaaagcagtcctcatatagatgtgcagcctgaattcataacacataactagtttaaaataatataaagatttaaatatcactgtctctaaatatctggaaaaagcaaatatacctcctctctggaagaagttactttcatcttgtctcaaagaatcctcatggctaatttttaagggcaattaccagcatacaatgaaaaaataaataaccagtcacacaagaaaataagacatcatgtaaaagaactggaaggaaaaaatagattacagaaacagacccatgaatactttaaatattggtattatcatgcatagactataaaacgactgtgcctgctatatctcatgatatacaagataagcatgaaaatatctgaagagaataagaaattgcaaaaagtgatccagaagacctgaaaggaaaccaaaagaaattatataaatgaaatatgtaatacacaaagttaaaatttaatgaggaggcttaacagctgactagacacagttgaaaagagatccataaactgagaaacagactagaagagattttctggaatgtagtacaaaaagaaaagaagatagagtatatgagaaagtggctaagaaatttggaggataaagtgagttgggaggtttaacatctgactgaagtttctaaaagacacaatggagagcatagggtagagtcagtattaaaacagataatggcaaaaattgttcagaactgatgaaatacacaaactacatattaaataagcccagctaatcgcaaaaaggataaatgaaatctacacctagtcacatcacagtgaaactacagaactctaaatataaggtgaaaaaatttaaaaacaaccaggaaaagagaagttaccttcaaaagagtggagatcaacaaattgatttcataacagcagcggtggaagccagaagataggataatgaatgatatgttcaatgtactgaaggaaattaccaacctagaattctatgcacagcaaatatgtcttttaagaatgaaggtgaaataaagacatttgaaacaaaataataaaaacaaaatctaagagaattcccattagtattcttacactaaaagaaattataaagcttataattaaggcaggacagtgaccccagttagaaggtctgagatgcaagaaaagctaaagaacaaggaaagtactaactatgttggataaggctaaatgaacattgaccatataaattaggagtatccaatcttttggtttccttgggccacattggaagaagaattgccttgggctacacgtaaaatacactaacactaatgatagctgatgagctagaaaaaaatcacaaaaaaaaaatctcatgttttaagaaagtttacaaatttatgttgggccacgttcaaagccatcctggatcccatgtagtggcccgtcagccacaggttggacaagtttgatatagatcaacagtaacaacattttgtggggtttaaaaatataaaattaaaatacactgcaacagaagcatatgtagtcggaaggagtaaatggagatattgtattctaggacctcgtattatctgggatggagataaatatagtgactaactttagatattagtgggttaatgttgttcatgttgtaatttctatggtaaccaaataataagcaaatatatagcttccaaattagtaaggtaaggcaaagagaaaacgaaaaatagaacatgtggattaaacagaaagaaatgaaaatggtagatttaaacataaatagtggtatatcagcatgtatgttcctgtcactttgccagtactgtgtgacaaacaccccaaatcttagtggcttaaaacaggaagcatatatttttttctttgagactataggtcagctaggtggatcttatgccttcagctggggtcctcatgtgtcagtagtcacctgtggattggataggcggctctgctgatcaaaccttggctctctcacttgtttgagggttggctggctgtaacctggtctaggaaggccttagctgggacaacctgtctctgctccacatggtctctcatactccagaaatctgcctgggcttgttctcatggcagaggcagggttcaaagaaaaagcagaaacatgcaaggcctcttgagtcctatgctaagaactgacataccatcatttcacccacaaacttttggtcaaatcagataacagagcaacacttaaggggcctgagagtaggccttacgtaattgtaaaatcacattttaaaggacgtggatgcaaggaagccataatacaaccatcaatgtaatgaatccacctcaatgataaaatgcaaatatattaattgttctgattaaaatgcaaagattagccaggcctggtggctcatgcctataatcccagcactttgggaggctgagacaggcagatcacctgaggtcaggagttcaagaccagcctgttcaacattgtgaaaccctgtctctactaaaaatacaaaaattagctgggtgtggtggaacgtgcctgtaatcccagctactcaggaggctgaggcatgagaatcacttgaacccaggaggcagaggttgcagtgagttgagattgtgcaactgcaccccagcctgggtgacagagcgagaccctgtctccaaaaaaaaccaaaaaaataaaatgcaaagattgtcagactgaataaaaaaatgaagttcaactatatgttgtttacaagagatacatctgacatatgtttacataaatattgaaagtaaaaaagtgagaaaagataaacaacataaatacttaccgaaataaaaatggagtagctattgaggactcaatagacttgaaagttgaaagtaatactagaaataaaaaggatcatttcaaaatgataataggttcagttcactagaaaaatataggacatttaaatttgtatgcacttattagcataaccttaaaaatgtataaccccaaaattgacagaactacaaatccacaattacaattagtggaaagttttaacacatctctgagtaattaatagaaaaaggatataaaatgcttgaataatgtgataaatttgacctaattaccacttagagaacattgcccccagcaactgcacattcttgtcaagcatacatggaacatttataaaaattgaccaaatactgttcataaagcaaatgtcaagagattgcaaagaattgaaatcacatggagcatgttttctattcaaaatgtggtcaatctttaacctgattacaaaatgataaccaggaaattcccatatatttgaattaagaaacacatttctaaataacccacaggttaaagataatttcataatagaaatctgaaactaccttgaactgaaatataataaaaatacccatttcaaaacttgtgggatcaagttaaagtggtgctaaatggaaacagccttgcaatgggtatagtgggaaagaataaaagctgaaagtgaatgcgctaaaacacttatctcaccaagatagcaaaagagcagcaaaataatccagaagaaagttaaagaaaagaaatgatgttcaaagagtattaatgtaaagctgattatgtgaaaagactaataaaagtgataacaaatgtgtacagacattgcttctgtaattttaaaaaaatcagtaaagataataaatggaaataggggccaagatggccaactagtagtagctgtggttggagactcccactgagaagaacaaaaatggtgagtgaatcctgcaccagcaactgaggtatccaggccctcttattgagactgacttgggcagttggcacaacccatggagagagaggaaaaacagggtggtgcgatggcccacctgagagccacacagggcaaggggagctcccacccccagccaagggaggcattgagtgattgtgctaccctgcctgggaaaccacaatttttccatggatctgtgcaacccacagatcaggagatcccccttatgagcccatgccaccagggccttggatctcaagcacagagctgtgcagattctcagtgaccactcggctggagactgcctaagactactgagttcctcgggggagaggcagtcaccatcactgaggctgcctgctgcctaagacaactgaactccttgagggagggacagaggccatcactgcagctgcctgctgcctaagacgactgagcttcccaggggaggggcagatgccatcactgcatctgactgctgcctaagaccactgagctcccagagacaggaatggcagccatcactgcagtaacccatccctgcttactaggtagggcctccctgcaggaatttcagcaactccagccaggggtttagggacagacctctgatctccctgggactgagcccctgaggggcagccacagtctccacagatcagccgatttagtctttctcctgctggctctgaggtatctgggtagtccagacaagtgggattcctcccagtgcagtgcaccccttccactaagggacagccagagtgcttcattaagcgggtgctggatcccatgcctcctgactgggtgagactcccctcaacaagggttgccagacaccttatactggagcattcccactggcatcagattggtgcccttctaggacagagaccccggaggaaggagcaggcagtcatctttactgttttgcagcctccactgatgacacctccaagtgcaggagggacccagttgaatagtgtctggagtggaccccccacaaaccacagtagccctacagaagaggggctgactgttgaaggaaagcaacaacaacaacaacagcataaacaaaaaagtccccataagaaccccatccaaaggtcagcagcctcaaagatcgaagataaattaactcacgaagatgagaaagaatcaatgaaaaaaaaaaacattgaaaactcaaaaagctagaatgcctctcctcctccaaatgatcacaacacctctccagcaaggacacagaactgggtgaaggctgatttggatgaattgacaaaatagtgcaaagaagccaagaaccatgctaaaagattacaggagctgttaaccagaataaccagtttagagaggaacatagcgacctgatggaactgaaaaacacaagaacttcacaatgcaaccacaagtatcaataactgaatataccaagcagagtaaagaatttcagagcttgaagactgtcttgctgaaataagaaggcagacaagattagaggaaaaagaatgaaaaggaatgaacaaaatctctgagaactatgggattatgtaaaaagacaaaacctacagctgactggggaacctgaaagagacagggagaatggaaccaagctggaaaacatacttcaagatatcatccaggagaacttcccgtacctaacaagacaggctaacattcatattcaggaaatccagagaaccccagtaagatactccatgagaagatcaaccccaagacacacaattatcagattctccaagattgaaatgaaggaaaaaatgttaagggcagccagagagaaaagccagtcacctacaaagggaagcctatcaggctaacagtggacctctcagcagaaagcctacaagccagaagagattggaggaaaagccattaccagccactgcaaaaacacactgaagtacaaagaccaatgacactatgaagcaactacatcaacaagtctgcaaaataaccagctagcatcatgatgacaggatcaaattcacacaaaacaatattaaccttaaatgggctaaatgccccaattaaaagacacagaatggcaagctggataaaaagtcaagacccatcggtgtgctgtattcaagagacccatctcatgtgcaaagacacacaaaataaaataaaatgaaataataaaataaaacaaagggatggaggaaaatttaccaagcaaatagaaagaaaaaaaaaaacaggggttgcaatcctagtttctgacaaaacggactttaaaccaacacagatcaaaaaagacagagaagggcattacataatagtaaatggatcaaggagagctaactatcctaagtatatatgcacccaatacaggagcacccagattcatgaaacaacttcttagagacctacaaagagacttagactcccacacaataatagtgagagactttaacaccccactgtcaacattagatcattgagacagaaaattaacaaggattttcagaacttgaactcagctctggatcaagtggaccttatagatatctacaggtatttctcctaatgttattccctcccttagccccccaccccctgacaggccctgttgtgtgatgttcccctccctgtgtccatgtgttcttatttttcaactcccacctatgagtgagaacatgcagtgtttggttttctgctcctctgttggtttgctgagaataatgacttccagcttcatccatgtccctgcaaaggacatgaactcattcttttttatggctgcgtagtattccatggtgtatatgtgccacatttttttattcagtctatcactgatgggcatttgggttggttccaagtctttgctattataaatagtgctgcaataaacatacatgtgcatgtgtcttcgtagtagaatgatttataatcttttgggtatatacccagtaataggattgctgggtcaaatggtatttctggttctagatccttgaggaatcaccacacagtcttccacgatggttgaactaatttacactcccaccaacagtgtaaaagaacttcaccccagcctgggtgacagagcaagaccctatttctccacagcttcgccagcatctgttgtttgttgactttttaataatcgccattctaactgacatattatctcattgtggttttgatttgcatttctctaataaccagtgatgatgagctttttttcatgtgtttgttggccacataaatgtcttcttttgagaagtgtcttttcatatccttcacccactttttgatggggttgtttgtttttttcttgtaaatttgctttaagttccttgtagattctggatattagacctttgtcagatgggtcgcttgcaaaaattttctcccattctgtaggttgcctgttcactctgatgatagtttcttttgctgtgcagaagctctatagtttgattatatcccatttgtcaattttggcttttgttgccattgcttttcatgttttagtcatgaagtctttgcccatgactatgtcctgaatggtattgcctaggttttcttctaggggttttgtggttttaggttttacatttaagtctttaatccatcttgagatactttttgtaaaaggtgtaaggaaggggtccagtttcagttttctgcatatggctagccagttttcccagcaccatttattaaatagggaatcctttccccattgcttgtttttgtcagatttgttgaagatcagatggttgtagatgtgtggtgtaatttctgaggtctctgttctgttccattggtctatatgtctgttttggtaccagtaccatgttgttttggttactgtagccttgtagcctagtttgaagtcaggtagcgtgatgcctccagctttgttctttttgcttaggattgccttgcctatatgggctcttttttggttccatatgaaatttaaagtacttttatctaattctacaaggaaactcactggtagcttgatgggaatagcattgaatctataaattactttgggcagtatggccattttcatgatattgattccttctatccatgagcatggaatatttttccatttgtttgtgtcctctcttatttcctatttgattatttgtagttctccttgaagaggtccttcacatcccttgtaagttgtattcctaggtattttattctctttgtagcaattgtgaatggtagttcactcatgatttggctctgtgcttgtctgttgttggtgtataggaatgcctgtgatttttgcacattgattttgtatcctgagactttgctgaaaagttgcttatcagcttaaggagtttttgggctgagacaatggggttttctaaatatacagtcatgtcgtctgcaaacagaaacaatttgatttcctctcttcctatttgaatacactttatttctttctcttgcctgattgtcctggccagaacttccaatactatgttgaatagcagtggtgagagagggcatccttgtctcgttacagttatcaaagggaatgcttccagcttttgcccattcagtataatactggctatgggtttgtcataaatagctcttattattttgagatatgttccatcaataaccaatttattgagagtttttggcatgaagcgatgtttaattttatcgaaggccttttctgcatctgttgagataatcatatggtttttgtcattggttttgtttatgtgatggattacgtttattgatttgtgtatgttgaaccagccttgtatcccagggataaagccaacttgatcatgctggataagcttcttgatgtcctgctggattcagttggccagtattatattgaggatttttgtatcaatgttcatcattgatattggcctgaaattttctttttttgttgtgtctctgccaggtttcagtatcaggatgatgctggcttcataaaatgagttagggaggagtccttctttttctgttgtttggaatagtttcagaaggaatgctaccggctcctctttgtacctctggtagaattcagctgtgaatccatctggatctgggcttttttggttggcacactattaattactgcctcaatttcagaagttgttattggtgtattcagagattcgacttcttcctggtttagtcttgggagggtgtatgtgtccaggaatttatcagtttcttctaagttttctagtttattggcatagagatgtttatagtattctctgatggtagtttgtatttctgtgggatcagtggtgaactcccctttatcattttttattgtgtctatttgattcctctctcttttcttctttattagtctggctagcagtccgtctactttgttaatcttttcaaaaaaccagctcctggattcactgatttttttgaagggtttttcatgtctctatctccttcatttctgctctgatatttgttatttcttgtcttctgctagttttagaatttctttgctcttgtttctctagttcttttaattgtaacgttagggtgtcgattttatatctttccagctttctgttttggggcatttagtgctataaatttccctcttaacactgctttagctgtgtcccagagattctggtatgtgtctatttgttctcattggttttaaagaacttctttattgctgccttaatttcattatttaccgagtagtcattcaggagcagattgttcaatttccatgtagttgtgtactattttcccagtagtcattcaggagcagagtgttcaatttccatgtagtcccatgcagattgttcaatttccatgtagtttggagtgagtttcttaatcctgagttctaatttgattgcactgtggtgtgagagactgttatggtttctcttcttttgcatttgctgaggagtgttttgcttccagttatgtggtcaattttagaattcatgctatgtggtgctgagaagaatgtatattctgttgatttggggtggagagttctgtggatgtctattaggttcgcttggtccagagctgagttcaaatcctgaatatccttgttaattttgtgtcttgttgatctgtctaatattgacagtgggctgttaaagtctcccactgttactgtgtgggagtctaagtccctttgtaggtctctaagaagttgttttatgaatctgggtgctcccgtattagacgcatatatatttaggatagttagctcttcttgttgcattgatccctttaccattatgtaatgcccttctctgtcttttttgacctgtgttgatttaaagtctgttttatcacagactaagattgcaacccttgctttttttgctttccatttgcttggtaaatatttctccatccctttattttgagcctatgtgtgtctctgcatgtgagatgggtctcctgaatacagcacaccgatgggtcttaaccctttatctgatttgctagtctgattattttaattggggcatttagcccatttacatttaaggttaatattattatgtgtgaatttgattctctcatcatgatactagctggttattttgtacattagttgatgcagtttctacatagtatctttggtctttatattttggtatgtttttgcagtggctggtaccaatttttcctttccatatttagtgctttctttaggagctcttgtaaggcaggcctggtggtgacaaaatcccttagcatttgcttgtctgtaattttatttctccttcacttatgaagcttagtttggctggatatgaaattctgggttgaaaattcttttctttaagaatgttgaatataggccaccactctcttctggctttcagggtttctgcagagagatccactgttagtctgacgggcttccctttgtgggtaacctgagctttctctctggctgcccttaacattttttcctttgtttcaaccttggagaatctggggattatgtgtcttggggttgctcttcttgaggagtatcttagtggtgttctctgtatttcctgaatttgaatgttggcctgtcttgctaggttggggaagttctcctggataatattctgaagtgtgttttccaacttggttccattcactccttcactttcaggtacaccaatcaatcgtaggtttggtcttttcatatagtcacatatttcttggaggctttgttcattccttttcattcttttttctctaatcttgtcttcatgccttatttcagtaagttgatcttcaatctctgatatcctttcttctgcttgaaagattcagctattgatacttatatatgcttcatgaagttctcgtgctgtgtttttcagctccatcaggtcatttatgttcctttctaaactggttattctagttagcaattcctgtaaccttttatcaagaacattgggttagaccatgctcctttagctcaaaagagtttgttattacccatcttctgaagcctacttctgtcaaattgtcaatctcattctctgtccagatttgtgccattgctggggaggagttgcaatcatttggagaaggggcattctggttttgggaattttcagcatttttgagctggtttttcctcatctttgtggatttatctacctttgatctttgaggctaatgacctttggatggggtttttgtgtggggatcctttatgttgatgttgctttctgtttgttagtttttcttctaacagtcaggccccttttttgcaggtctgctgcagtttgctggaggtccactccagtccctgttcacctgggtatcaccagtggaggctgcagaacagcaaagattgctgcctgctccttcctctggaagcttcgtcccagaggggcattggcctgatgccagccagcactcttctgtatgaggtgtctgttggcccctgttgggaggtttctcccattcaggaggcacgggggtcagggatccacttgaggaggcagtctgtcccttagcagagctcgtgcactgtgctgggagaatccctcttgtcaggatcagctgctgtcttcagagctggcaggcaggaacgattaaatccactgaagctgtgcccatagccaccccttccccaggtgctctgtcccaggaagatggggattttgtctgtaagcccctgaatggggctgttacctttccttcagagatgccctgcccagtaaggaggaatctagagaagcagtctggccagagtcactttgccatgcccagcccagacctcccagcctccttagcactgtcaggggaaaactgcctactaaaacctcagtaatggtggacacccctccccccaccaagctcgatcatcccgggtcaacttcagcctactgtgctggcagtgagaatttcaagccggtggttcttagcttgctggactctgtgggagtgggacccactgagtgagaccacttggcttcctggcttcagaccgctttccaggggagtgaacggttctgtctcactggggttccaggcgccactggggtatgaaaaaatactcctaaagctagttcaatgtcttcccaaacagctgcccagttttgtgcttgaaactcaggaccctggtgatgtaggcacatgagggaatctcctgatcagcagattgcaaattaatgggaaaagtgtagtaacccagcggggtagcacagtccctcacggcttcccttggcttggggagggagatccctggctccttgcacttcccaggtgaagtgatgccccaccctgcttctgctcaccctctgtgggttggacccattgcctaaccagtcccaatgagatgaactgggtacctcagttggaaatgcagaaatcacccgccttctgtgttggtctcgctgggagctgcagactggagctgttcctattctgccctcttggttccttctattctgtactatttcttccaaaactattccaaacaattgaaaaggagggacttctccctatctcattttatgaggccattatcatcctgataccaaaacctggcagaggtacaacaaaatagaaaacttcaggccaatatccctgatgatcattaatacaaaaatcttcaatcaaatactggcaaaccaaatcaagcatcacatcaaaaagcttattcaacaccatcactttggcctcatccctgggatgcaaggttggttcaacataggcaaatcaataaacgtaattcatcacataaacagaactaaagaccaaaaccacatgattatctcaatagacgcagaaaaggccattaataaaatttgacatcccttcatgttaaaaactttcaataaaccaggtattgatggaatgtacctcaaaataataggagtcatttatgataaacccatagtcaatatcatactgaatggtcaaaagctggaagtattctccttgaaaaccagcagaagataaggatgccctctctcactactcctattcaacatagtattggaagttctggccagggcaatcaggcaagagaaagaaataaagcgtattcaaaaaggaagagaagaagtcaaactgtctctatttgcagatgacatggtcctatatctagaaaaccccattgtctcagcccaaaagctgcttaagctgataagcaacttttcagcagtctcaggatacaaaatcaatgtgcaaaaattgcaagcattcctacacaccaatattagacgagcagagacccaaatcatgaatggactcccattcacaattgctacaaagagaataaaatgcctgggaatacagctaacaagggaagtgaaggacctcttcaaggagaactgcttgttctattttcaagaagaactacaaatcactgctgaaggaaatcatagaggacacaaacaaatagaaaaacattccatgctcatggataagaagaatcaatatcatgaaaatggccatactgcccaaagcaatttacagattcaatgctacttccattaaactaccattgacattcttcacagaattagaaaaaaactactttaaaatttatatggaaccaaaaaagagcccatacagccaagacaatcctaagcaaaagaacaaagctggaggcatcaagctacctgacttcaaactatactacaaggctacagtaaccaaaacagcatggtactggtaccaaaacagacacatacaccagtggaacagaatagaaatctcagaaataagaccacacatctacaaccatctgatcttcaacaaacttgacaaaaaccagcaatggggaagggattccctatttaataaatagtactgggaaaactggctagccatatgcagaaaattgaaactggaccccttccttacaccttacacaaaaattctcaagatagattaaagacttaaatgtaaaacccaaaactataaaaagcctagaagaaaatctaggcaataccattcaggcataggcacaagcaaagatttcatgacgaaaacatcaaaagtaattgccacaaaagcaaaaattgacaaaggggatctaaacaaactaaagagcttctgcacagcaaaagaaactatcatcagagcaaacaaggcaacctacagaatgggagaaaatttttgcaagctacccatctgacaaaggcctaatatccagaatctacaaggaacttaaacaaatttacaagaaaaaaacaaaccccatcaaaaagtgggcaaaggacatgagcagacacttctcaaaagaagagatttatgtggccaacaaacatatgaaaaaaaggtcgacatcactgattattagagaaatgcaaatcaaacctcaatgaaatactatctcatgccattcagaatgacgattattaaaaaatctagaaacaacagatgctggagaggatgtggagaaataggaatgcttttacactgttagtgggaatgtaatttagttcaaccattgtggaagacagtgtggtgactcttcaaagacctggaaccagaaatacgatttgacccagcaattccattagtgggtatatacccaaaggaatataaatcattctattataacatgtacatgtatgtttattgcaggactattcacaataacaaagacatggaatcaacccaaatgcccatcagtgatagactggataaagaaattgtggtatggatatgccatggaatatgccatggaatactatgcaatcataaaaagaaatgaggtcatgtcccttgcaaggacatggatgatcgagatggaagccattagcctcagcggactaacacaggaacagacaaccaaacaccacatgttctcacttataagtgggagctgaacaatgagaacatatggtcacagggaggggaacaatacacgctggggcctaccagagggcaggaggagggagagcatcaggataaatagctaatgcatgtgggacttaatacctagtgatgggttgataggtgcagcaaaccaccatgataaatgtttcactgtgtaacaaagctgcacatcctgcacaggtatcctggaacttaaaataaatagaagaaaagatctatatgttactcatttttttctttacaaaggtgagaaaattatactatgtaactatcctataagaggaaccaattaagtaaattgtgatatatatcacaattgatttttattcaggtattaaaattataatttttaatgatacagaaaatacttatatagcattaagtgaaaacagtatacaaagttgtatgtttagtataatcttaattttttacaaaaatttatagaagaagtttgcaacgaaatatgtcaaatgtgaacattattattgttttttttaaagatttatttttttttatactttaagttctggggtacatgtgcagaatgtgcagttttgttacataggtatacacgtgccatggtggtttgctccacccatcaacctgtcacctacattaggtatttctcctaatggtatccctgccctagccctccaccccctgacaggccctggtgtgtgatgttcccctccctatgtccatgtgttctcattgttcaactcccacttgtgagtgataatgtgcggtgtttggttttctgttcttgtgatagtttgctgagaatgatggtttccagcttcattcatgtccctgcaaaggacatgaattcatcctttttatggctgcatagtattccatggtatatatatattccacattttctttatccagtctatcactgatgggcatttgggttgattccatgtctttgttattgtgaatagccctgcaataaacatacatgtatatgttataatagaatgacttatattcttttgggtatatacccactaatggaattgctgggtcaaatcgtatttctggttccaggccttcaaagaatcatcacactgtcttccacaatggttgaactaatttacactcccaccaacagtgtaaaagaactcctattcctccacatcctctccagcatctgttgtttcctgactttttaatgatcgccatcctaactggtgtgagatggtatctcattgtggttttgatttgcatttctctaatgaccagtgatgatgagcattttttcatatgtctgttggctgcataaatgtcttcttttaagaagtgtttgttatatcctttgcccactttttgatggggttgtttgtttttttcttgtaaatttgtttaagttctttgtagattctagataagccctttgtcagatggatagatagcaaaaatgttctcccattctgtaggtcaccttttcaaatatgaacattattaatttatgaaaacttatgggtggtttttatccatttctttatacttttcaaatttgcacttcctaaaaatctctaaaattattgtgttatacttttagatcagagaaaaataaatgtttaaaaaagttatattcctcttctgccctcaatcttcagtacacagttcacagtaaggtagtagtatcattttgagacaccctaagtggtggaaaccaaaaatccaccttcatggaggacgaatcatggctgatggctctgtaagtgatactatgagcactatgtatgttcctcttcacaatcaaatgaggcttcttgtttcaatatttaacccctactagaatcttgccatgatatgctcacaattggaggtttttggtttttgggttattttggttttgcctaaacttaagccaagatccaattccattttctagctatcagtaatattgccaagctgcataatggaattattaaccatttgtgtgatttataagtggtaattagcatgttttatgggacatgaagactttgaaagtttgacctactatatctttttgggttgttttgtgctctgtgattaatttttgtgttgatttttattaaaggagagttttttcattttagaaatgtttgagacgtattttcattgatgattagtagttatggaaaaaataattggggctgaatagcttaattagtagaaagtttggggtaccagactgaactcaaataaatcataaactcaaactcattaaaatatatattcaaaaaagtatatgttctcctctaaagtcaacaaaaaatagacatgttttagtaagtctgataagtaactctctaaatctctttactgtctttctacaggaaaaagcaatttcggtatctactagaatccaaaggaaaaaaacctggtattatcaacgaagaaaataatgacagcaaaagacttgtaggagaaaacacaaatcgtgctacattaaattatactacaagagacttttataatgaaaagctagaggtaaaactactgttaatctttgcgatctaatgccaggatatatcccacatggcttggaatttgggggttgtacattttacccttagttaagataacttttttgttctggaatatttgtcaaccttatattacaaagccagggacagtaggtacccaggcaattagggagaaatagagccctgagatgcagaagaacccagggtttcagtatcgttatttcagcagaaaaaaaaaatgctcaaaagaaatctgtaccataaatctgtagcaaaaatctagtccaaagcaggaccaagggtcccgatctatgtaagaaataggttataggcttgctgtaggtacttagccacatcatgccagaccatcagagaacacagcaggacctccgtttttgttctccttactgggaccattgatgttttaattcatacctttcattctacaccattttttttatgattacttaatcatataatttcaacttgttctattcctaatatagctacttagccaggaaaatggtaactaaacctttatgttttatgtggtcagaggttcagagtgttttgtataggggaatacaatgttgtggtgctgcaggaactacaaagaagaaaactatgtagtatttaccttgatggagctcataggaaagctgaagaaacaacttatctacataacaatacaacgttgtgacccttcaagagattttgagggaacaaaggggcaaaagaacaagaaagagaaaacacatttactgagcatctatgactcatgtgcaaggtgctgtatgaggtgatacatctatatccagatataagtatatctatagatcccctcacacaggttatacgattgatatataatagatatctttcaatatctacatatgtatctctagatatatagatataacatttagaagtgtgtgtgtggcagggcgaagtgtgtatactgtagatgtgaaatggctagtcaagtggttttcaaatgtttttaacagttttggacctctttattcaaaccaccgtattatagctgaaaacccagtgtatcagaagaaagcaaaacagcagagctgctgttgttatagaggaaaagtaggaaattcagagtttcatttgattgggtcttcttttccttttcctttcctttccttccccacccccaatcctgaagtgtctctttggaacccatagggctgtaggcattacagcttgaaaattacttgaaaactcaatgcaagactatttttaatagtatcctacaagatgttctactttaagttcttctagtgtgaaaggtcaatgtttcatgacattgttgtctatcacagaacaactctaaacgtgaagaaattcttactgatattaagcttaaatctgcctcttaataaccttcacttagtgatcctagtaccaccttacatagtaaaaagaacaagtctgttccttatgaaaatgcttcaaatacttgaagtcaactacctttttcatctcagcactctctacattcatactttcattcattcaaaaatcatgtattgaacacctgtcatacacaacacactgtgtaatatactagggctataaaaagacactgtccttgccctcatggatctcacattctaatggaggagatagacatatatacggataagtatcaatcagtttatcaagagcatagagagataactaacccagatcaaagtagggttttagaaaaaatgatggccgatatgagtcttaaaagataaaatatagctatattaaaaaggggaaagaggcagttctggcaaatagcacagtgcaaataaggcatagaagtataaaacatgtaaggagagggccaggaactataagcaggtcattgttgtggaagttcagagattgaggtagacagtattaaaagatgagaccagaaagatagtaagagaacaatgtgaaagagattgaacataatcctttggccaataggggtttcctagtgttgccaaaagaagaaaatgaaagccaaggtggcaggattatgtctcctcttcctgaatacagctggttctatgagtgaaaaaattaatatgtatatagttgtgtttggtttctatggacgattggtttcaggacctcctgcagataccaaaatgcacagatgctcaagtccctgataaaaaatgatgtagtaacgtagtatttgcatgtagcctatgcacatcctcccatatactttaaatcatttctagattacttataatactacaatgcaaatgccatgtaaatagttgttatactgtattgtttagggaataatgacaagaaaagtctgtacagatgtgttttaaaaaaatgttttcaatctgcagttggttgaattcacagatgcagaatccacggatatggagggccaactgtatttagtaaatctaaacatgccaatttacattaaagaaatttagtaaaatatcgaaaagctgcattcaaaccaaggatttcacagtaaaatctaccaactttttaagaaacagagaattctaatgattttaaaattgtttgagagtattgaaaaagaaggaaaactcttccatgttttcaatacagacagcataacattgattccaaaaatgccagtattgcataggaaaagaaaagccaaaccatacatttaaaaatattggtgcaaaccccttttaaaaatattgtcagccagaatacagcagaacattaaatgaataacaaacattatagccaagtgtagtttatcctagaaaggcagggaagattcaatattagtgaattaatagatctaatgtgaaaaatcatgattatttctatagacattgaaaataaatttcacacaattcaatacctattcttaattttgtaactcaataaataggataaatggaaattgcatagtgttatgcttgatggggaaactctggaaacattagcattagtagtaggcagaattctaactaaggtggcctctgtgatccccacaccccagtatccataccttatataatcccctcccatgggtgtaggtaaaacctgtgtcttgcctttaaccagtggaatatggcaagggtaaaggggttttgcagacatgattaatatccctcatcagttgactttgagttaatgaagagagagatcatcctgagaaagtctaacttaatctggcaagtcctttaaaagaggattcaagcggccgggcgcggtggctcacacctgtaatcccagcactttgggaggccaaggcaggcggatcatgaggttaggagatcgagaccatcctggctaacacggtgaaaccccgtctctattaaaaatgcaaaaaaattagccgggcgtggtggtgggtgcctgtagacccagctacttgggaggctgaggcaggagaatggcgtgaacctgggaggtggagcttgcagtgagccgagattgcgccactgtactccagcctgggcaacaaagcaagactccgtctcaaaaaaaaaaaaaaaaaaaaggattcaagctttccctgaaagatttttctgttggtcttaaagaaataagtcaccatgttttgagaggcccacatggcagggaactgcaagaagcttttaggacctgagaacagccccagaccaacagccaacaagaaaacagggacttcattcccacagctgcaaggaactgaattctgccaacaaccacttaggcttagaagaggactctgagcttcagaaataaacacaacctaggcaacaccttcatttcagctttatgaagtcctgagcagaacacccagctaagccgtgcctgggttcctgatacatggaaactgagctaatagatgcacgttgttttaagctgccaagtttgaggtaatttgttagacaggactagaacaccagtgcatcactgaagtaagtaacaagacaaggatgcctaatatcactattatatttttctcaatacagataatgcaatgaaacaagagaaggaaatcaatggtcatttgaaaagaaggaagtaaacttatatttgcagataatattattgaatacctggaaatcccaagaatattaatttagaaatcataaaaagctataagaaaattcagtaatatagcagaagtcaacagcttccatattacagataacaagcagaaagaagatataaggaaaaacctaactcacagtagcaacacagaaagataatgtatcttgtaataacctaataataaatatgcaggatctataaataaacttttcaaacattagtgaagcatacaaaagatttatacaaatggaaaaacatgccatgttttagataagaagaatttcaagcaaactttgtcaattttctttaacttaaaaatttcatataatcccaatgaaaataccaaaaacttttttgttgaggctttttgacaagttgatactatagtacatgtggaaaaataaacataattagctacaaaaactccaaaaaagaacaatgagaagaaggctagcactattagatattaaggcatattataaatacctatcaattaaaacagggtggttgtaaagagatagtctaatgggataaatgatactgaggaaatgggatattcaatcagaaaagcatattgaaccccttctttgcaccatgcaacaaaaaattaactccagaccaaataaaaacccaagtattaaaagcaaaagtttcaagtttttattttaataagaagagaaaatctttatgatcttgattgggttggctatgattttttaacaccatagatgcacaaactataaaggaaaatgttttggtaaattggacagtcattcaaggtgattgtgttttttgtttttgtttttttctatgttgcccagtctgtccctgagctcctgggctcaagaaatcctcctaccttgtccttccaagtagctgaaactacaggcatgcagatttttaaaaacagatagcttcagtgcagtcatgtaagcagagtcttgattaaagtgatatgagcaataattaagctataagaaagtaaagacagggaatgttgactcctgctttgagaaattttaaagaggaaagaaggaatctgaagccccaaaatatttggaaagaaacactaatctaacaatcaggagatgtggatttgagcccctgattctacttctgagtacttgaaagaccttgctgaagtcccttaatcactctctcgactcacagcccagcattccttcacttataccatgctccttacatcttgaaaaatacttaaatcactgcagcacaaagtgctcagtctctcttccatacatcctgagttgttgagaaaattaattgaggtaagttcttcacaaatcaggttaagcagaccctttcattatacatgtcataactctgttgcttggtagttgtccatctattctcctgactcatctaaaaaagatttaagatggacatagaatcagagtgctgaaagggactttaaagaatctaatgctattcttagatgaggaaaactggaaactcagatgagttactgagggtcacgttgaattattgactgagccgcctctagaatggagtcctaattctgaccttggacacgttcacagtatatcatggtgctctctcaagttttcttgaccaccctagtgcaaagggctctctcttttctgaacactgtttgtaatttgctgtctgaacgttttactcagcatgtatctactgttttatgtttttagttgactttttatatgtgcatgccatctcccaactagactgtaagttcttcaaggactagattagagagttttctctatggaagtattaatagaagatgcttaatcctgagcagatctctcaatctctatagaccttgtttcccacttataaaatggagatatggattaaatcctaatacaagtaccattatagttaaaattgctctataacaaaccccactgttgaccttctttttcccaaaccatcttcataacaacaaaattctagtttaatgaaataatgtaaacaatattgtatatagtttatctcatcagaattgaacttgtaaaatacttgctttatgaatcccacagggatattgtgagacaaaaagagatgagtatatgaaagcatttgggaatggaaaaagcattactcaaggagcaacaactccttgacaggtcagggcaagagaggtgtctctaacgtgctttcaatgggatcatcctggacaggcagagtgagtcatcctggcagacacctgatgacttatagggcatattgtaaggagatgcagaatagttggcttggaggagaggagaaatcatgaagtagaaatgctttcaaacacagttactaaattaaggattattatagcagatacaattctatatcaacatgtccctagagaaacagtggaagtaactatagcagaaaattttaaagcactgtaaattatactgtgccagttatgaagaatttattttcaattgtataatacataaatgatttaacaaaatatatcatttaattgttttaatttttgttatccctaaattattataaaaaatcttccaatcttaataatagaattttgtctttttaaattcaaaatcctattttaagcaatttggaaatctgtaaaagaagcattcactaaatatgctctatgctttctacttgtaaatgcattgcttgtaaaatattgctcattttagttgctgatctctagtgactcacacttgtccttctttgtaggagttcctatgtagtccagatttactgagtgcgaaaagggagcagctacattctgttctcatcaacaagctaacttagtataggtggctaatgttcagactatagtatttcagagtgagggaagatcttcagagaagaggccagctggaaccatttgttgcttatcacacatcaaaaatctgtacatacttttaagactggtcaatctatgacctattgttttagtacatgactatatcaaatcagcattttgacctgtgaatggtgattgattgcttagagatgccttatatgtcataagaaaattcttaaaatatgcctctgttaaggaaagttagtgcaggttggacttattgttaacttacattaattaatcaggaatttaaaacatattttattttaaacatcataagcatttgggccaggtgtggtggctcatgcctgtaatcccagctctttgggaggctgaggtgggtggattgcttgagttcaagagtttgagaccagcctaggcaacatggcaaagccacatctttacaaaaaataaaattagctgggtgtggtggtgcacgcctgtggtcacaactgctggagaaggtaaggtgggagggtcgtttgagcctgggaggcagaggttgcagtgagcggagatcatgccactgcactctagcctgggcagcagagtgagaccctgtctccaaaaaataaattaatttaaaaaatcataagcattgggaaacagaagaaaatattaaaaaggaggaaaacatactaatgttctcagaactcagaaacaatctttttttttttttttttttttttgagacggagtctccctctgtcacccaggctggagtgcagtggtgtgatcttggctcactgcaagctccgcctcccaggttcatgccatttcctgcctcagcctctcgagtagctgggactacaggcgcccaccaccacacctggctaattttttttgtgtttttttagtagagacggggcttcaccatgttaaccaggatggtctcgatctccagacctcatgatctgcccacctcagcctcccagagtgctgggattgtaggcgtgagccaagaattcagaaacaatcttaatgagacttcaatatattttcttcaatagtttttatgcattcttttctaactttttaataaaaatttcaaacatacagcaaagttgaaagaattttacaataaacatccatacgtccaaaacctacactcaactattagcatcgtaccatacagtgtacttactttatcacatatctatgtgtctatccatccatcagtctaccttcgtattttttaaattcatctcacagtcattgcagacattagtatgcttctgcctaaataattcagcgtgcatttcattaattgagattcagtattctacagagtatttttctttgtaaatttttccatttagaggtaaaacttatatactgaaatgtaaatcttaggtgtacaattgctgagttttgacaattcatacattcatataacccaaaccctatcaaaaaaaattttatttttttcacataacattatgatttaagcattttttcttattatgaatctttattttattttatttttaaatatttcaccttttagatatggggtacagtgcagatttgttacatgagagtattatgtgatgctggggtttggagtatggatcctgtcactctagtaatgagcacagtaccagacaggtagttgtttagcccacacccctaccaccctctatgttgttcccatatttatgttgttcccatcttccatgtgtgcacagtgcttagctcccacttataagtgagaatatgcagcatttggttttctgtttctgcattaatttgcttaagattatggcctccagttccatctatgttgctgcaaaggacaggatttcactctttgttatggctatgtagttactattccatggtgtatatatactatattttctttatccaatctaccattgatgggcacctgggttggttctatgtctttgctactgtgaatagtgtagcaatgaacatatgagcgcatgtgtctttttggtagaatgatttattttctttggagtatatacccaggaatgggattgttgggccaaatggtagctctgttttaagttatttaagaaattgccagactgctttccacagtggctggactaatttaattatattcccaccagcagtgtatgagagttcctttttctccacagcctcgccagcatctgttgttttttcactttttagtaatagccattctaactggtgtgagatggtatctcactgtggttttgatttgcatttctctgatgattagtgatgctgagcactatttcatatccttgttggccacttgtatgtcttcctttgagaagtatctgttcatgtcctttgcccattttttactggggttatttggtttttgcttggtgatttaagttccctataaattctggatattaagcctttgtcagatacatagtttgcaaatatcttctccaattctgtaggttgtctgtttgctctgttgatagtttcttttgctgtgcaaaagctctttagtttaattaagtcccatttgtctatttttgtttttgttgcaattgcttttggggacttagccaaaaattctttgccaaggccaatatcaagaagagtcttccagaatttttatagtttgaggtcttacctttaaattattaatcccttttgagttaatgtttgtatatggtgaaagataagaaaggtccagcttcaatcttctgcatatggctagccagttatctcagcaccgtttatagaatagggagtcctttccccattgcttgtttttgtcagccctgttgaagatcagatggttttcggtgtgcagctttatttctgagttttctattctgttccattggtcgatgtatctgttttttaccagtaccaaactgttttggttactgtggctttatagtatagtttgaagtcagatagcataatgcctctggctttgttctttttgcttaggattgctttggctattcgggctcttttttggttccatatgaattttagaattttttttctaattctgtgaagagtgacattgggaatttgatatgaatagcattgaactgtaaattactttgggcaatatggccatttttatgatattgattcttccaatccatcagcagggaatgtttttccatttatttgtgtcatctctgatttctttcagcagtattttgtagttctccttgtagaggtctttcaccttcttagctgtattcctacgtatttcattttctttgtggctattgtaagtgggattgtgttcttgatttcactgtcagcctggatgttgttggtgtatagaaacgctactgaattgtgtacattgattttatatcctgaagttttactaaaattgtttcaatttgagagccttttggcagagtctttaggattttctaggtatagaaatcatattgtcagcaaagagagatagtttgacttcttttcctatttagatgctttttaatttctttctcttgcctgaccgttctggctaggacttcctagaaatcttcgtaggtataattttaatgacactatctgtgatttttaggatttcatttgtttgtttgtttgttttgttttgttttttgagacagagtcttgctctgtcgcccaggctggagtgcagtggcacgacctcagctcactgcaacctccacctcctgggttcaagcaattctcctgcctcagcctcccgtgtagctgggactacaggcatgtgccacaaccctggctaatttttatatttttagtagagatggggtttcaccatgctggccaggctagtctcgaactcctgaccgcaagtgatccacccaccttggcctcccaaagtgctgggattacaggtgtgagccactgcaccgggccaaattttttttttttttttttttttttagaaacaaggtctcactctgttactcaggctggagtgcaatggcatgatcatagcttaaactgtagccttgaactcctgggctcaaacgattctcccacctcagcctcccaagtacctggaactacaggcatgtgctattacacctggctaaattttttattcttgtttttctgtagagatggggtctcgctatgttgcccaggctggtcttgagttcttggccttaagcgatcctcctgccttggcctcccaaagtgctgggattacagatgtgagctaccatgcctggcttatgatattttaaatttagctcatttaatttatcttgaaattattttggtgttttgacttgagttggagatttaaatggatcctttttctagtagttaaatgtattgtctcattgacatttattactttccttcttcattgatgtgcattacttcccttgtaattctgattatctgatgtgttacattgattcttccatgtatattatacattccatgattatgccttgatactattcagaagtatcaatagccaaaataaatgttaaattcttgattaaacaaaatcactttgttttagtctctgtgatgaaattggggcacaatattcaaatatcctcagctccaaaattcctctgttgtgtttaggaccaggtttttcattttcacactgccagacccagaagttgagtgggagacctgtttctttagaaggcaacgtcctgggtcccaggtttctatatgtttactcttcctaattgtacacttccccccaactttctccaaatggtcaaggctgcgtaagtcagtgtagtgtaccattttatgctttcccataatagagggtaaattcagagtatacatacttaaagtattacatagatattaactaatatcataccaattgaaattgtcactatctgtatcctgatacatttaccacaggaatctgtgagtctgcattcagctgacttgtgtgagctaaatgacctgaactgagataggagaaatagtagttatgattcaacaattccagtaaagaaacacattttctagcagagctgtccaacagaggtaggagtagactgagaagtactgagacccttgttgttatctttactcaagcagaactctgtcagcagtgactaggaaagaattcctgctctgaggagtagatgggggaggaatagggggtcagaataaattatttcaattttctgtggttcagctaattgttgctttgacttttggattagttatgatttaatacaaaactttctcttttttttaacaggaaataaaggaaaagaagaaattctgtaaaacatatatagaagaccttgtgaaggaagccacagaaatcaacatgaaaaatgaggctttgcagaagctttggccacagatgttcattgagcttgttagggatgcagtcatagaaattcgcaataaaaattcctatatgaagctctgcctacagcagataacagaccaaaaataaaaatggcctttagttacagttgattttggcagttttattttttgaaggttgaaaatatgcaggttatacatgttaaaacaacaacaacactatcctataaactagaaagactagtataaaagcattattgcccactgttctcatagctaaaagttaagaaggaaggaaggaaagcaggagaaaggaaggattaattgcctgtatgtgaggaccaaacaacctttgggaactaaacagttttcagagatggcgtggcactgcatccttggttcttgctttgattggtgccctgctatagcccaaagcacgtagtatttgctgatgattcagcatgagctgcatctacctacttttagctgataattttcagttatttccctttttattttatgtcatgatttcaaagccaaaaatatgttctttttatgagtgaagaataaacttactaacaaattagtcaaaataaagtatgtttgcctccttaa

SEQ ID NO: 1189 - DNA, 157509 bp, Homo sapiens; identical to SEQ ID NO: 1187

SEQ ID NO: 1190 - DNA, 95 bp, Homo sapiens
gctgttgaggctgcgcagccaggccctgacggtggggtggctgcgggccttctgaaggtctcccacgttgtggcccagcagcgcagtcacgttgc

SEQ ID NO: 1191 - DNA, 13499 bp, Homo sapiens
ctagagctggcccgtcagcccaagtgggcgtccagctgaatctaacacctctgtttttcctgcacctgacccctgtgaacccagccaccctgaggcaacgctgtccacagaaaccaggatgcaagtcccccagtgcagcaggcacaggaggctgcaaggcagggccatcgccaggggcaggtaccccaggggggcccacaggctgcctgtagatggaacagggaggccaccatcagtcccaccagacgctacccccatatccaccccctagagccagacaggcctgggcagtccctccctctggctggggagggtggggacagccagcgaggacacccacctgcggctgctctcctgggacccaacaaaggtctcaaagtttcccctgctcccactttctgctggtcagtgggttttaggagaggcagctgtatctctaactcagtggtcaatgaagggtgaagcagggttggccagcctcatcccaggaggcaatggacaaagctggtggacaggcctgtgggagtggccacgaggcggggacgggtctgagagggccctgggcagagggggccaagccggaggggtgcgggggccatacctgaggtggaggcctgggcatcgttcgtgggcaggcccgaggtgtggaccagatggagcacttggtgggtggtgctggggggccccctggtgccgtgggctgggccagtggggctggtggggctggcgtccaggccgagctggcccagggtggagctgttgaggctgcgcagccaggccctgacggtggggtggctgcgggccttctgaaggtctcccacgttgtggcccagcagcgcagtcacgttgccaacatccaggctctgcggagaggggtggggcagaggggccgtggggccaacttctgggccaggggaagacccacagggtagggccagacccaggatggggcagatggcgggagtgaggcccagaaacggcctggaggagggaagtgggggtatgctggctgtgacctgtgacctaggggctcccctgcctgggacagccctgcacccccacccccacccccacccccacccccacggggtagcccagccccacctgcagctcgagggggttcaggctggtgaaggtgtcgatgtccatggagatgttggcgtgggccaggtgccgcagctcctccaccggggcgccgcctggggggacgggtgaggggggctgggctccaccaggggagccgcctggggggacggggtgaggggggctgggctccaccatgggagccgcctggggggatggggtgaggggggctgggctccaccagggaagctgcctggggggacggggtgaggggggtggggcttctgggggaggggtgcccacccatggacagggctcaccgaggtaggggcgcatgaggcggtagtaggcagctagggtcccgctgctgccgaaggtctcatgggccttggtgtagagcacgtccttccggctctgggggcaggaggagaggtccagggccccggccagcctgtgggaggcgggaggctgaggagttggtcgccagccccccacccttccaacgctgggcatggccctcccttcccaagccacagctttcctctcaccctctgtcctgggggaacagggtcccccaaattcacatccacccagaacctcagaatgtgaccttgttgggaaacagggtcattgcagatgggtaagatgaggtcagactggatcaggtgggccctaaaccaatgactggaggccttctaagaacagggaaagctgagggctgggtgcggtgctctcacctgtcatcccagcactctgggaggcctgggcaggtggatcacgaggtcaggagatcgagaccagcctggccaacatggtgaagccccgtctctactaaaaatacagaaattagctgggcgtggtgggcgcctgtagtcccagctacttgggacgctgaggcaggagaattgcttgaatccaggagacaagagagaggttgcagtgagccgagatcacgccacttaactccagcctaggtggcagagtgagactccatctcaaaaataagcaaacaaacaaaaaagggaaatctgaggctgggcgtggaggctcacgcctgtaaatcccagcactttgggaggctgaggcaagaggattgctctgaatccaggagtttgagaccagcctgggcaacatagtgagaccctgtctcttaaaaaaaaagaatacgaaatgtggacacagacgggggagagcgcagcgtgaggatggaggcagagctggggttgatgtatccataagcccaggggcgccaaaccttgtcagcaatgccagaagctggaggaggcaggaagggtcctccctgcagggttcagagggggcggggactgccagcaccctgatttcagacctctggcctccagaactgagagaatatatttatctttaaaattacccaatttggccaggtgcagtggctcacacctgttatcccagtgctttgggagaccgaggagggtgaatcgcttgaggtcaggagttccagaccagcctggccaacatggtgaaaactcatctttactaaaaatacaaaaattagccagacatggtggtgggtgcctataatcccagttactcgggaggctgaggtgggaggattgcttaagcccagggggcagaggtggcagtgagctgagatcgcgccactgcactccagcctgggtgacatagtgagactgcctcaaaaaataaataaataggccaggcgcggtggctcacgcctgtaatcccagcactttgggaggccgaggcgggcggatcacaaggtcaggagattgagaccatcctggctaacacggtgaaaccccgtctctactaaaaatacaaaaaattagccgggcgtggtggcgggcgcctgtagccccagctactcgggaggctgaggcaggagaatggcgtgaacccgggaggcggagcttgcagtgagccgagatcatgccactgcactccagcctgggtgacagagcgagactccgtctcaaaaaatgaataaagtcacccagtttgtgtactttgctcaaagctagagtccagccagggcagccctgggactaatgcacccctgatggcctggctgagctgcactccctggcctcagtttcccctcgcggtcctccttggctgaggcgggagctgcctccgaggcagtggggggttggggttgggtttggctcaccggagctcctggggatggatggtctggatctggtgaggactcatccagcacaggcgggtgcccccgatggccagcagcagggcaccggagactgtgccattgtgctccagaaacttctgcagcacagcctgggggcagagcccgggtcagtggggcaggctggggcctggggccacccacctgcccgcccacccaggtgccctcacctctgtctggttctccagggccacgtcggaggccagcagagccatgaccgtgtcctgggaggtgatgctccactggccgatctcggtgcgggagtagaggtagaccagcgaggtgatgagccgcagctgatcctccgggaggccttgtgggtagatctgagcaggtgggcagggctaggcagggtcagcagaggtgccgcgcccaccggcctccctgtccccacagcccagccgtgcacctgtgcgagcttggccttgaccacatgctggcactcagtgggcagcaggtgctgcaacagggtgtccaggttggttctgaggatgcagccatccaggcaggactcaagctctgcacagtcgtagtgcaccaggaagaggtcgtcccgcagcgtggcggccgtgatgttgcctcagacacagggtccccctggggggtgtgtggggtccaggctggtaaccggggcctgggccaaccaccactgctggctctgggcgccttttttttttttttttttttttttgtgagagagtcttgctctgttgcctagcagcagggtgccaaaggctggagagcagtggcattgatctcagctcactgcaacctctgcctcccgggttcaagtgattctcctgcctcagcctcccgagtagctgggattacaggtatgcgccaccatgccagctaatttttgtatttctagtagagacggggtttcaccgtgtcggccaggctggtcttgaactcctgaccttaaatgaatcatcccgcctcggcctcccaaagtgctgggattacaggcctgagccactgtgcccagccccctttttttttttttttttttttaaggcagagtctcgctctgtcgcccaggctggaatgcagtggcacaatcttggctcattgcaacctccacctcccaggttcaagcgattctcactcctcagcctcccgagtagctggcattacaggcatgaggcaccacgcccggctaatttttgtgttttcagtagagatggggtttccccatgttggccaggctggtctcgaactatggacctcaagtgatgtgcctgccttggcctcccaaagtgctgggattacaggtgtgagccaccgtgcccggcccaggccccctctttgaccccttcccctccacttctgaccttggtcagaccttggctttccctgagttctaaccaagaacttgtccaaactacttctctgaagtcagccaggcccgagggaaaagctggaccggtgaggtgcagggtcgcaggcctcagtggccatcctgacctgtgctgagcctgggcctggaggacactggtttggtcttggactccaggaagctggtgacgaagcacctggcctcgcgctggccgagccttcccacctggcacgaagccaccacgctgcggaagaagcccaggcccacggcctggcggggcaggtgtgggctgaggttggtggcccaggtccccgtgccacggcccgcttgtgcccaccccggggccccctcctacctcctgcacctgcgcccacaggtgagggctgatgtatgtggccaggggccccagggcctgtagcccctccagtgtccaggagccagggggccttgtgcacagaatggggcgcagtgttgggtccagggcaggccccccgccctgggagcccctgcccctctgtggacacccagcaggccggaggagcacccagtaggtgcttgaccacccagcccccgactggcacccacgagagggatgcccccaccacagccagcgggacagcaccccaaccctctgccccctcggccgcaggacccagtgaggctgaggccagaggtcagatgtcagtgggctgcggacatcggtgacctcttgggccgaccccgggctgcctcccgtctcgtccccgcctccttgcccagccctgtgaccccacccacccgagcgaggtcttcccaccggccagcagtgagttaagggcaatgcgctgggcagcggtcagccgggggcagcgccgcaggttctccagcatgtgggggtctgcggcaccgatgctggacgcgtccatgtcacacaccagggccccgagcagttgctggtcggaggcgctgagtcgcaggcgggccaccccctgcagggccagcaggtcggcgcccagcgggaggctgcctccaatgcaccgggcccatcctgcccaggcgcccaccagacaggccacagccaccccccacacgctccggcccaccccacccagcgcccaccaggcaggccacagccgcacgccacagggcgaccctctggtcgggtagatggctcagcagctccacgtccccctgggcggcacggcggatgaaggcccggcagtcggcttcccgcacctggctcaggctacaggtgagtgtgaggctgtcaggccgactgggggtggggccggacctcccagcagccctgagatgcccctggggctttgagggcccccaggactcctgtggccgggtggccgggcagggaggggcactcacttgtagaagagcagcaggttgggtgggtggagcgtgaagtcgtcctggaggccgcaccgtgacgccaggttggccaagcagctgagctgggcagaacggcgctccctcgtgactctggactcgccgtggcagcccgtgggcgcccttcccctctgcggaggcctcaggccccagtccccacccacttctcggccccgtttcccacatgtcgggtcatccccacggccacccgtgcctgcccctctgcctggaggggaaccccgcacagcagaacaggcctccaaacggccgcccccagccccaaagccgcctcctcactgacggggtgttaaagcacacgtccggatgctgggcgggtgtagacgattgcctgtctccaccaaggaggccccacgacgctggggttgggggtctcctccagcacagccccttggcagcttcccaagtggactctgggtggtgcccctcggctccacctgacagcctcctcctggcatcggggctctgccaggcccggcctccaccccccaccccatgctccctgaggctctgcttgcccctctcagcctatgcagcacgctgcccagcctcagcgccccctgcctaggcttgtctagcctggcctttggggtcatttcaagggtttttagccctttgctcagagggccctttgcctgattttatgtcaagcaagcccttgggacgtacggtgcataaggcgaggggctccgaggcagacaaggacagccccagagttttgtgcggccctcaccagggtctcatccctgaggaggagcccacccagggtgggggctcggggaccctcctgcagcctgaaaggagccccggggaatggagcaggggctgccagcctcctgcagcgcaaggtcctcctggctgagagggaggggaagaaaaactcttacccacaaacacccagaacgcctgtgagctggaacagaatgttcagcctgtttgattatcaaaagaaaggccaaaagcaggccaggtgtggtggcccatgcctgtaatcccagcactttgggaggctgaggagggctgatcactggagctcaggagttcgagaccagcctggccaacatagtgagacccctgtttctaaaaagaatcacaaagttaggccggacgccgtggctcatgcctgtaatcccagcagtttgggaggccgaggcgggcggatcacctgaggccagtctgagaccagcctgcccaatatggtgaaacctcgtctctagtaaaaatacaaaaatattagctgggcgtggtggcggccgcctgtagtctcagctacttggaaagctgaggcaggagaaccacttgaacccggaagacagaggttgcagtgagctgagatcgtgccactgcactccagcctgggtgacagagagagactccatctcaaaaaacaaaaacaaaaacaactgtcccagctactggggaggctgaggtgggaggatggcttgaatctgggagttgaggttgcaatgagctgagatggtgccactgctctccagtctggacaatagagtgcgatcttatctcaaaaaataagtaccataataaaattttatatgttttaaagaagagaaaggccaggtgcggtggctcatggctgtaatcccagtactttgtgaggccgagacgggcgggtcacttgaggccaggagtttgagaccagcctgggcaacatggtgaaacctcgtctgtattaaaaattcaaaaattagctgggcgtggtatcacgcgcctgcaatcccagctatctgggaggaggctgaggcaggagaattgtttgaatccgggaggcagaggttgcagtgagccgagatcgtgccactgcactccagcctgggtgacagagtgagactctgtctcaaaaataaataaataggctgggcatggtggctcaagcctgtaatcccagcactttgggaggccgaggtgggcgaatcacgaggtcagaagatcgagaccatcctggctaacgtcgtgaaaccttgtctctactaaaaatagaaaaaattagccgagcgtggtggcgggcgcctgtagttccagctactcaggaagctgaggcaggagaatggcatgaacctgggaggcagagtttgcagtaagccgagatcgcagcactgaactccagcctgggcgacagagcgagactttgtctcaaagaaaaaaaaaaataaataaataaataaataaaagagaaaaaaagactgtggcaataagataccaaattataaatgagacctacggccgtgccaggcagaggggaggtggtgcctgctggctgtccctctgtccctcctgtggcctccttgtctgagttgaaagcattccctattgctgagtccatgttttacacagggctttattcctttaaccggttacaaacgaaagagtctctgaatccacctatgacttataagcccccaatttgagatatcctgccttttcagggagaacgggctgatatctgcctaccccgtgttccctgcctctttgcctgtaactcctgcttcctggatgcctagaaaaccagcctgcaacccgccggcctcagggcgctcacacctcttgagtctgtttcctcgggccgggatcactcataccgctcagataactctaaactatgtcactgtgtggttttcccgtgaaggggtggaggtctttctgcctttcccttttcctggacggccccgcacaggccaggatcctgcagcccgtgcagggagaagcctgtgggctgtaaaatccgctctgggggccccgagtatgcaccccaagttgggcaccattccccgcggaggtgggtggggaggggagggtgaaccctcgtcctcactggggacacagtggggagcatctgcaggcaaattggctacaacgtcctggaattagataagcctgggctgcacccgaaagtcaccctgcctcctggtggacctcccgtcctggggggccgcagagacacactccaggtggctctgaagttggtgggttggcttccacacagccctcctgctctagggggccacacaccctgtcccgaccgtggtcacactgggttgtgccccagctctcgcttagccgtccttcgcctctcacacctgagcccatgtgcccttccctatccgggcccatccctcagagcctggcctcggtcacccgcccacccactcacactccttcccgctcacctgccaggcctggagggggacctgcagcaaggccagcctctggattagggctgagagctggtcccggggcagctggctggccggctggcaccagaagccttgcagcagggagcagttggcactgggcagagaggaggagacaggggcagggagggtccaggaggggtggaagcagctgaggggggctgcctagcagaagggcatgggccgcacgcagcctgcaggaccaaggtctgactccaccgctccccagcactgaaggagggagagtgggaggtggtgccccggacacaggcaaggtcctgcttcactcactcactcattcactcattgactcattcattcattcactcattcattcactcactcactcattcactcactcactcattcactcactcattcactcattcattcacacactcatttttactcattcactcattttcactcactcattcactcattcattcactcattcactcatttttactcattttcactcattcactcattttcactcattcactcactctttactcattttactcattcattcactcactcattttcacttattcattcatttacccactcactcattcactcattttcactcactcgttcactcatttttcactcattcattcactcattcattcggtcactcattcactcattcactcactcactcattcattcattctgtctttcattcattctctccagaacaccctgtggggccaggctctgggctgcacacagagccttatgtgtggcccctgcctagaccctgggacagcacttcctcctgaggctgggtcccagccggccgggagctcaggtggctccctgaacatccccgctggctgctgaggcacctgaggaggagacacccccacccagggctttggcacctgctgggcagccccggggaagccgtctccccagccttccttgtggtgtgagtctaatccagtccaacacagagcgggccttgtgccactcaggaccccagccctgcctcacagacgccctggttagtcaactgaccagcctgtcactgtcactaactctgaaggatggggaggagggccgagcccagcatgaggttccaggcagtgcggggaaccagagtgtcctctggggtgggcagaggcggcagggcctgacggttgaggcctcggcagtggctgaaggacccacacccggctatgtagatccaaagctggacactggacgctgagtcatctcagggccccccaaggtggagcaagagatgacagcctcagcgtgcagactgctggcggccagccccagacccctccccatcccctcgtctgacccctcccctggcctgaccaagaagcagacccctactgcaggagggctgcactcacctggcccacaggttggccccgctggcatccagccctcctggggaaagaaccttggcctggggcccagagcagtgggcagcaagggacagcaggagggtgaggcctgagctctgcagggcacctggaataaggtgggctgtgagggtcccggcgggagcaggggccggggcatccgggtcccagggtggacctgtgacccccaccatgggggtctgcttgaggccagaggacatggaggaacttctggagccccacagcactggccacctgtgcacagcctgggcccaagcgcaggacgtgtctggtggagcatgcacaggcgtgatgctgtgggtgcatgcaggcacgcacatgtaggtgacagtgtgcacgtgtaagtgacagtgtgcacgggtaggtgacagtatgcacaggtatacagcacaggcatgaggctgtggatgcgtgcgggcacgcatgtgtaggtgacagtgtgcacatgtaggtgacagtgtgcacgggtaggtgacagtgtgcacgggtatacagcacaggcatgagactgtggatgcgtgcaggcacgcatgtgtaggtgacagtgtgcacgtgtaggtgacagtgtgcacaggtaggtgacagctgtgtgcacgtgtaggtgatggtgtgcacgggtaggttacagtgtgcatgggtaggtgacagctgtgtgcacgggtaggtgacagctgtgtgcacgggtaggtgacggtgtgcacgggtaggtgacggtgtgcacgggtaggtgacagctgtgtgcacgggtaggtgaaagctgtgtgcacgggtaggtgaaagctgtgtgcacagggaggtgacagttgtgtgcacagggaggtgacagctgtgtgcacgggtaggtgacagttatgtgcacggggaggtgacagctgtgtgcatggggaggtgacggtgtgcagaggtaggtgacagctgtgtgcacggggaggtgacagctgtgtgcacgggtaggtgaaagctgtgtgcacgggtaggtgaaagctgtgtgcatgggtaggtgacagtgtgcacgggtaggtgacagttgtgtgcatgactctggcagcgtgtgcgcatgtccacctgtgttgcacatgtgtgagatggcaggtgcatgtgtgtgagctccttctacctccctccagacgccccatggctctgtgttctcacagtggagccctgagacccctaaggcagcagagctgtgggggcagaagccaccttcaagggccccggctgctcagctctgcagtgggggtcacggcagggcctcccagcaggaactgggagcccagcccatgttcctgctttggaaacccagcccaggaagggggtttgggtgcaggggagcccccttatcttgctggccctggggagaccacgtggtgaagtctcttctccggcaggcgtcaagcaggggttgccacagcccacacagaaatctgaccacggcctcctgggctgctggggcccggcccacccctctcagggagggtgaggcattgggcaaccctggcctcagagcccagccctgcctgtggccggactgcccgagagaacgctgtctccactcacccccacaccgtttccccagaagccatgtccagctgcctgggccaggagtggccccctctagccaaacttgcctgccctgcctcaccctcccaggacccccatgcctgctggggagggctgggctcacagtgccctggcagcccgacccccgtcctgctgctgctgggcagggcccaccttctccttccttggcttgggacagaccctcgctcaggagaatggggtggccagggccctgggcactcccatgtctacgggatggctttgccatgagggcctggcactctggaggccccctttctgcatggaggtctcgtctcacccactctggggcccacgtctgtgcggcggcgtgcactggtcatcctggctgagacgtcccagggcaggaaggtgctggggccaagggcagtgggtccaggactagctggagaggcgtgacagaggcgagacacaggtgagacacacaggttggccccgcactgcctcccaccccctggggtgtggagagggagggtgcagtctaggttcacccagggcagcggggccagagctgcgcctctcccaccttcgaggggaaaggatcccataaacagtaaaaggcaggagcagggagcgggagccgggtgaaaccctggggcctttcttattgcaggtcggggcctaggggacccatgggctgctgggtctccaatgaacagatttccaacaaacagcgagtcccccaggcagcctcgtgcagccctggcttcatccccacacccggcagccctggcagctccctttccctctttgagccccagctgttgggctctttcgctgacatccagcccccagtggcagctggggtagcctcaaccatgctggaaatggaagctgcaaggccagggaccctagaggagtccggtactgctgtgggtcactgcctcctcctggagccagcctgatggcttttgggcacctctgggcctcctgactgtggcccaggagggagacagggaggctgccccatgcagaggcaaatgcagaggttcaggcccagccacaggtccgggaccggccctgcgggtgggctggtggtggctcccgccagcgtttctcacctgagcagaaaccctgggtgtggtggagggaggtgctgcccaggctgtggggtggctgctcctggcagggagttgtggaccaggtgatccagacgcaatcccagcccgccaagtgcgtcagccgctaccactgagcgcccgggtgcagaggcggtgcagggcggggatgccggggtccccgctcacctccat

SEQ ID NO: 1192 - DNA, 9453 bp, Homo sapiens
gcagtgcgcgacggcggcggcggcgcgggaggttcggagcgggagctcgggctcgcggacggtatggaggactacgagcaggagctgtgcggcgtcgaggatgatttccacaaccagttcgcggccgagctggaggtgctggcagagctggaaggtggggcgcggcccccggccgttggggaggagctgcgaaagccgggacagtggcgacctcggggagggcgtgccgggggccgaaggggcctccacgtcgccgctggcgggatctgctgtctcggggcggccgctgacaatctcctctcccagcaggggcgtcgactccgtcgccctccggggtccccctgttcaccgcgggccgacccccgcggacgttcgaggaggcccttgccagaggggacgcggcctccagtcccgccccagccgcatctgtgggcagcagccagggcggcgccaggaagaggcaggtggacgccgacctgcagccggccgggtccctgccccacggtaggttggcggcattgccccagggcctccggagtgggcgcgaggctgaggaggcctctggttccctgcatgtgtctcccccagcccccaggatcaaacggcctaggctgcaggtggtcaagaggctgaacttcagatcggaggagatggaggagccgccccctcccgactcctcgccgacggacatcaccccgccgccgagccctgaggacctcgcagagctttggggccacgggtgtgtggcttggacatgggcgtcccatcccatctgtccagtgggactcagatggagcccatcccgtgccctggatgaggcctggggggtggggagggttccatggctgagagcagtctcggacacccatatccaagggtgaccccacgcttgagtttctgccactgagccccggtctctctccagagtctcagaagctgctgccgacgtgggtctcacacgggcctcaccagctgcccgcaatcccgtcctgaggcggccccccatcttggaggactacgtccacgtgacatccacggagggcgtccgggcttatctggtgctgcgtgctgaccccatggccccgggggtgcaggtgcgtggctgtggccttcctgcacggtgggtgggccagtgctgctcaggaaagggtccttggagcccctcacccctgccatttgcttaaagcgggtcctgtgcagagccccaggggtgcagagggggaggctgcgtcatggggcgtagacttagaggacacagcctccccacagcaggttgctgtccagcctgtttgtatggcctcgggtggagagggcctccttgcttcccctcctgcttttgccctttcctcctttctcctaaagctgcccccaatttccctttgcagctgacccatctggatggcttcattcctttggcacccctgtccagtctcccacccctcactggccagcttactggggttgtcccacccgggtccctgagcactgatgggggctgacgtgaatcctgtgacctaggaggggcccagaggcaattgtcctcccttccccacagggctctctcctccacgtcccatggcgaggcggtggccagctggacctgctgggtgtgtccttagcctccctgaagaagcaggtcgacggcgaggtaggggctgcgggtttgctggggggcggtggcggggccgcctgagccctcctgattccagcctgttgtttgcacagcggcgggagcggctgcttcaggaggcccagaagctttcagacaccctgcacaggtgacttggttggcccttccgccctggggacccttgttggctcttgcaccaactcctagctcctagcgtgtgggttggcatggtccctgcgagttgtttgtggctcaggacgtggtcctctccagtctcaggtcgggggaggaggaggcagcccagcccttgggggcccctgaggaggagccgactgacggtcaagacgcctccagtcactgcctctgggtggatgagtttgcaccccgccactacacggagctgctcagtgatgacgtgaggtcttgttctcactcaagtgtggctggcttcctctgttcccaagatggaagaacctgggcccagtgatttttgcacagccaatccactgggcctcggagacggagtgggctctggtttgcccttttgagttgtaggtggtgaactgagcacagggctgtgtgctactggtcccctgtgacctgtgaggcaggctaggggtccagggtgtcacctgatccaagtctctgttccctttcctaccttcacagcagctgacactggagtgcccctggggagggcaggggcctcccagatgggttgtggccagagccgtgggggtggagcccctggtgtgagccttgcggtcactcgctggcaggaagacgggggtggccattcatcctgtggcttggcatcccatggggcatggggctcatggtggcaggtggactgtccgtgcctggaggcggtgccctcaggctgtgcttcccttcccgtccttcccgcagttcaccaaccgctgcctgctcaagtggctgaagttgtgggacctggtggtgtttggccacgagaggccttcccggaagcccaggcccagtgttgagccggcccgggtcagcaaggaggccacagccccaggcaagtggaagagccacgaacaggtgctggaggagatgctggaggctgggctggacccgagccagcgaccgaagcagaaggtgagccccgctggctgtgccgccgggaacaagcctgaggctttgcactcggcgccggcacccttgcagcctgttgactttctccaggagccgtgggtgtggtgacgtgtgggtcttggcgtgaagcgccattagcgtgagttagaactggagcgttgcagtaacaactcgggggaagtcgttgtccctgaagggctctgcggctggccaggatgatctgggtggacggtgggtggtttctgggggccagtcacactggtatcagctgtgttttgtctgcacgaactttgctttgtgtaggtttttttttccgttgccatcttggtgtgtgaaagtgctcaattttgttcttatttgatggctggagtggggtggagggagcgcccagcctgtgggacacatgtggcagtccctggctgctaggccgggagcgtcctgtaggtgcggtgcacactacgccttcatctacctgggctgcaggtggcactgctctgtgggcccccggggctggggaagaccaccctggcacacgtgattgcgcgtcacgcggggtactctgtggtggagatgaacgccaggtgagtgatgtgaggtccgtctctggctcgccttctgtcctgacgtgtttgagttctggtggcggacctgaaaccgggtgtggatgttcccgtcttgagggtggtgggggcctgggtgtgtgggccgggaaaacgtgtccttcctcggggttcacgggatcggcagcagccgcgtcatgtgacggtctccacgcaaatgcggcagccccggccttgggaggctgccctgccagggacgcccactgccctgacgacccctgacctccccattgcagtgacgaccgtagcccggaggtcttccgcacacgcatcgaggcggccacccagatggagtcggtgctgggtgctggcgggaagcccaactgcctggtcatcgatgagatcgacggggcccccgtggtgggctccttgatgcctgggtaggtgggtgggcgggcaggcaggcgggcagcagggcctggactcaccgtgtcctctgacctcccccaaggccgccatcaacgtcctcctgagcatcctgaaccgcaaggggccacaggaggtggggccacagggcccggctgtgccttcgggaggcggccgacggcgccgggcagagggggggctcctcatgaggcccattatctgcatttgcaatgaccagtgagtgcatgggcgggcgccacagtcaggagaggctctggtgcctggagggagggttccggcccgtccctgtgtcctgggctgtggtgccaaccctggggtccctggccctgccgcctctcctcaggttcgcaccgtccctgcggcagctgaagcagcaggccttcctgctccacttcccgccgactctgccctcgaggctggtgcagcggctccaggaggtcggtggagccccaggagccgtgtggctgatggcggggttgggggcgtggcctcgttctggcccctgtttccctgcccctccccatggaaccctggtaacccctgaaaggatggggcataccatcgggccctccagcagcccttctccaccaggtctccctgcggcagggcatgagggccgacccaggggtgctggccgccctctgtgagaaaactgacaatgacatccgggcctgcatcaacaccctgcaggtgggcggccggcaggcaccgggtggggtggggtggggtcaggagttggccgcttctcatgcccccgccctatgtctagttcctgtacagccggggccagcgggagctgagcgtgcgggacgtgcaggccacacgcgtgggcctcaaggaccagcgcagagggctcttctcggtgtggcaggaggtcttccagctgcctcgagcccagaggtaggcggtggccacagcctcggcccagatgctcacggtgcccggacctcaggacgctagccctgtgtgcaggccagcactaccttcgaggcggggactcagtgtcctgagcccgcggttgcctggtccagcctccagggccctcctcagccttttcctggcttgttctcgcccctacagccttggggggtcagctagagaagcctccagggccccctgtgggaaggacacccccagtgtggtggggcctccagggcgtccctctccagggcgccccttgactcagctgctgtcccagttgcaccctcatttttgccacatttggcctgggctgtggtctctgagcccctgcctgcccacactgcttggcctcccgtgggcaggagcagccagcatgtctctgtcctgacgtgccatgggaccccaggggatgctggcctggtcgtgctgcaggatatgggagacgctggcctgggcctgtgggatgtgctgctcctggcctggacccggagggggactttccctggggtcccctaaccccagagggtcagggcagggctcctctcagagtggggctcctcggcttaagggaatgtttcagggggttgaggtccgggcgtgtctttggctgtctccacctgagcgaggcagcaagggccctgctgagaagaatgaagtgggtggcagctctgatggggcctctgagtgtcccggggagacgggtggggctgcctgtgcttttaacacgggtccatctagcttcagcaccccacctgcaggcgccgtgtgggccaggaccccgccctgcctgctgacacactcctgctgggtgacggggacgcgggctccctcacctccgcctcacagcgattctaccgtgtcctgcatgccgctgcctctgcgggcgagcacgagaaggtggtccaggtacctgtcttccaccaaaatgcctgcctggggccgcctggctaggacctgggctgtgcccctgcccctgccggtcctcccgtatggacggggaggcgctttgggggtgctgagagaggcaggttcgggaaatggggtgccaggaagtctctgaggtggggagcaggagccaggagggtgggaggggctgcagggcacgggccggcaggcaaggaggtaggggcggccgtctgacgggggaggtcgctctggtggctgcttgggactctcagcgggttggggtggagcccctgccggacagcctggcctggggctgcgaggggctggattctggacttaagatgcacatggggtggagagcagtgcggtgagggcttcctgccgccctgcccgcgggagtccccgcctaagctgtctgctgactctaagcggctttggattagcagctggggatccacaaccaatccccaaatcccaaaagccgcgatgtggaggggcagcgtggagcagcggcggggatagactcccccacggaacaggggtggggacgccacggcctggactctggtgggcggaacttcctcaggcagtctaaggaggggctgagtgaggctggatccctttggttcctggaggcctcctggtgggtcaccccctcgtgtcagtctctgtcaagtcagtctctgtcaagctgtagcgaggatgctcagggtggaccctcccccgaccccttgggcccagtgaccccttgctggtgtgtgctgctgcctcagacgcccagcgtcgtggggacccttgtggagggtctgcgaagcctcgtggggcaggcggcaggcaggagtggagggtctgtggcgggaggtggagggtccgtggtggtgcaccttccctggggtgggcaggagctcaggggttgccggccgcctgcagggcttgtttgacaacttcctgcgtctgcggctgcgagactccagcctgggtgctgtgtgtgtggccctcgactggctggccttcgatgacctgctggcgggggctgctcatcacagccagagcttccagctgctgcgctacccacccttcctgcccgtggccttccatgtgctgtttgcttccagccacacacccaggatcaccttccccagcagccagcaggaggtgtgctcgtccctgcaccacgcctgcccccggccccgtgcccgcccccctgtgctgcccgtgtggctgcccccggccccgtgcccgcccccccaaacacactgcccgtgtggctgcccccggccccgtgcccgcccccccaaacacactgcccgtgtggctgcccccggccccgtgcccgcccccccaaacacactgcccgtgtggctgcccccggccccgtgcccgcccccctgtgctgcccgtgtggctgccctggccccacccaccattcccccctcgcccgggaggcccaggtgaccaggccttggctcaccccctgccccaggcccagaaccggatgagccagatgaggaacctgatccagacgctggtgtccggcatcgcgccagccacgcgcagccgggccacgccccaggccctgctcctcgatgccctctgcctgctcctggacattcttgcacccaagctccgccccgtgagtgccgtccccggggtgggggattccccgcctgctgccctcctgtcctaggtgagcacacatttgtacagcctgctcagctccctgtctgctgcctcccatcccctaggtgagcacacagctgtacagcacccgtgaaaagcaacagctggccagcctggtgggcacgatgctcgcttacagcctgacctaccgccaggagcgcacgcccgatggccagtacatctacaggctggagccgtgagtcccccagtgcctggggtgtgctccagggtcatgctccccggctgtgctccatgttcagggcccgcatggggccaggagtctgaaagcacggtcatggcgtctgggggtggcgggccccagcttatcttttgctcagatgtaaccgtgaaggggggtcacttccagctacttgagattggctctgggacctgagttttgctgcagagctgctcccagccttagcacccccacatggaactggagccgggggccccgagagtgactgcactttccaacactccgtttcccgctgtgggatggccatgggggtggtgggggtgaggcatggggcagtggccccggggtcctgctgccccagcgacggcaccaacttgcaggacgctgagtcactctccgtggcagccatcggcaggtttcatcatcatcccacgtacacttgcagttggggaaactgaggctcggggcagttaaacctggctgccgcagggttggggtgcggtggcaccaggactcagccccacattcctgctctggccttgtggcttttggggtttgcggttggagtgcccggcggctctctggccctgagcctggccccgctgacctgccctggtgtccccctgtgctgagcaggaacgtggaggaactctgccgcttccctgagctgcctgcccgcaagcccctcacctaccagacgaagcagctcatcgcccgcgagatcgaggtggagaagatgcggcgggcggaggcttctgcccgggtagagaacagcccccaggtgagcccacccaggctctggagcaggttgcagtctgggcgtgcaccatccccactgtatccctgtgtggccagatctcacaatgcctgctccctacaggtggatgggagccccccagggctcgagggtctgctggggggcattggggagaaaggggtgcaccgacctgccccacgcaaccatgagcagcggctggagcacatcatgaggcgagcggcccgggaggaacaggtgtggaatgggcagctgtgggggtgggaccagggtacatacctttgggggtgtggctagggcagtcatgaggcggggccaaggcacccatggggtggggccagggtacctttgtgggtgtggctagggcccctcatgaggcagggccagggtaccttcagggctgtggctagggcagtcatgaggcggggccagggtatctttaggggtggggccaaggcacccatggggtggggccagggtacctttgggggtggggctgagccacaggaggagtctggctgagggtggggctggctcagtgccctaaggggggctctgaaggaccagctccttaccctcagcatgaccagggttctacccaggcctcagtttcccatctgggcagaagagtggctgtattggctcttcttgattggcacctggtggggagcagatggcagtgaggggtgaggggcagctggcctgggccaggttccgaaaggtgtctcagaggtgttctggtccctcctccctgggaaggctctcggtcctcctgtcttgggtaggggctggatggggcatctgtcctatacgactgactagtccttcctcccatcagcctgagaaggacttctttggacgtgtggtcgtcaggagcacagcagtcccgagtgcaggtgtgtgtgggggtgttgtggggttgtggggggcctgggggttgtgggggggccttacagctgaggagcaaccctgtggccccgcaggggacacggccccggagcaggactcagtggagcggcgcatgggcacagcggtgggcaggagcgaggtctggttccgcttcaacgagggtgtctccaacgccgtgcggcgcagcctgtacatcagggacttgctctagttctctgagccgcggacatgccctcgcattgcttcccgcagagtgcagagacaggaagctggagatgtctttataaagtcacacctttacagactgtaa

SEQ ID NO: 1193 - DNA, 2693 bp, Homo sapiens
tgtctttataaagtcacacctttacagactgtaatcacgtgcgagtggagtggggttcacaggatggtgggagtggggccgggcgtgggctcataggatggtgtgagtggggccaggagtggggctcacaggatggtgggagtggggccaggcgtggtctcacaggatagagtgagtggggccgggcgtggtctcacaggatggagtgaatggggccgggcacagtcttacaagatgttgtgagtggggccgggagtggggctcacaggttggtgtgagtggggctgggagtggggctcacaggatggagtgagtggggccgggagtggggctcacaggatggtgggagtggggctgggagtggggctcacaggatggtgggagtggggctggaagtggggctcacaggatggtgggagtggggctgggagtgggactcacaggatggagtgaatggggctgggcatagtcttacaagatggagtgagtggggccgggagtggggctcacaggttggtgtgagtggggccgggcatgggctcacaggatggtgggagtggggctgggagtgggactcacaggatggagtgagtggggctgggcacagtcttacaagatggtgggagtggggccgggcgtggtctcacaggatggtgtgagaggggccgggtgcggggctcacaggatggtgcatttgcccttttccacccatgggttgttcttcatcaggtcggggttcaggaaggggtccttggggatcccgtcctcgatccacttcagcagcctgcgggtgggcgggtggcaggtgagtggtggcacctgacccccgagggcctcctgctgcacctgcctgtcggcggcggtggtcgtggctatggaaatgagcagccagcgcagggcagacaaatgagaggcaaatcaggcaggtggggcactcactcggggatggtcttggacgccatctcccgctggaaggccagctggtacttgaggctctccacctctttcttcatctgtggcacgtcccactcctccatggggtcaggggcttctgaagcagccagcctggggctggagggcacaggaggaagccacagggccgaggccaccagcctgtagtccccacccccgctgctccccgcaggcctgagctgaaccccgcaggatgaagcggggagagtccacaccactgcctgggccagtcccctaggcgttgctagggtgcagggcacagagcgagttcccacaaggccccagctcccgcctcctgcactgggactaattaactgcaagaaactttacatcctcagctactcccccataggcccccacaccttacgaagatcccttgcaggcaggagaaagggtgctcagcacggcaggcccccagctcctaccctcccactgaggcccacgcaggctgacccagaccacggtgtgaggtgtggggcgaggtcctcaggaggtggcccctgccccgccccgctgtgtgcccctttgctttgcatggcagagcccagtccagagccaggactcctggacaggaatgttctgctgcagtttgcttctctggcaggtggggtgtgtgctcaggatcttgggggctcaggctatactacccgagtctgggatatgggctgtgggtggcccctgggtccccagtgtgtctgggaaccacacacgttacctgcgtgctttctgcttgtggccagcctgggaaagccacaggttgacacccctcagaactgccacaagttcgaggcaagtgggggtgggttgccccctgcctctccccctacccactccaggggcccagggagtccctcactccgtcccaactctggcccccgtccccaaggttgggagacagggctgaaccttgggagggtgggtgggggttggcgtcaagtttcggggagcctgcctctggctgtgaagggggctcctggcccaacagtctccccatcctttggtcgtgcagctgcaccggccacctagggaggggcccagggcctgaggctggtggggtcccggtggtgaattgggcagactcccagcagccagcagagggtctgcccgtagtggggtgggaggccggggagcgagcgggggcaggtttctgggggagtgatcagggtcatgcagaggattccctcccggagactctggagttccagcacccctacccgcccccatccccggtgcaggccttttctcggagaccctacactcagccccgtgggcgcaggactagctgcgtgcgggtcctcccaggcccggggtgttggcgccccgcccacagcccagtccttgctgcccagccctaccttcgcgcagctgccgccaagcctggccacccaccccgtgcaccccgtggacgcccccagccacgggactcggtgggcactgcaggcggcgcacggcgctcagatggacacagctcccccgcaccgcgagagccgcctccctgcctgcagcaccggctcgggttgggttttgctgcctgcggggcagctgccctcgccccgggagttagggtgagcccaggggactgacctgggccagctgagagtcgaggggcctccgggccctccctagccccgggcgcctgttcatcggacctaccttgaaaaggtgacagcggagggacaatgacaacggccaggcgaccgcgagtgagagcgagggccaag

SEQ ID NO: 1194 - DNA, 8419 bp, Homo sapiens
atggcccgaactgaccagaagcccccgtgcagaggtggctgctggggacagccaggtcaccccaacacgggtggggcagctgcacaccccacttaccaccccatgggtcacaggcctcgaacgtgcatcctgctacgtggagaccagaccacaggtggccaagctccgtctcgggaaataagcctggggccctgggcggccggcactcacttcctggctatctctaccaccccatggggcaggaagacacccgcctgcatttctgagctcccaaccagctcaggaacagcgcagccgctcgcaaatgcagtgtgcgaggtacagaccgttccagggcctggcctgcgcccacagggaactcctgccatgcgggccccttctcacaaggggacaccgcccacccccaacccctggggcccagagcagccccagaacagacacaagcatcccaaaaagggggtcactggggtagatgcacacatctggggaccctgtgtgtcatcccaagtgggccatagccctgggcatctggtcttaggtcccagggctttgccagcagaagcctccaggtgtgcagggtctgtgctagaggcctccaaccggccaccatgggctgtccacccgtgtggcagcacccgggtccctgcagcgcctgagactcctcgcactcagtggacagcagagcgcccctgagcagcctcggtatctgcagatgcacaaggctggctggggcagaagcaggggagggaggggctctgaggaaggcgcctgcgtccccacagatcaatcacttgatgtttgacatgacctgcaaacgttttatttgcaaaatacagagagtagacgacaggaagtagcggcttacacctgtaatcccagcacttatggaggccaaggcgggaggatcccttgagctcaggagttggagaccagcctggacaacaaagtgagaccctgtctctacaaaaaaatacaaaaattagctgggtgtggtggtgcgcacctgtggtcccagctattggagaggctgaggtgggaggattgcttgagcctgggaggtggaagctgcagtgagctgagataatgtcactgcactccagcctgggcaacagagtgagactctgtctcaaaaaaagttgaggccgggcatggtggctcacatatgtaatcccagcactttgggaggccaaagtgggcagaccacctggccaacatggtggaaacctgtctctactaaaaatacaaaaattagccaggggtggtggcctgcgcgcctgtagtcccagttactcgggaggctgaggcaggagaatcacttgaacccaggaggtggaggttgcagtgagccgagatcatgccattgcactccagcctgggcaacagagggagactccatctcaaaaaaaaaaaaaaaaaaaaaaaaaaaatgtttgggccgggggcggtggctcacgcctgcaatctcagcactttgggaggcggaggcaggcggatcacgaggtcaggaggttgagaccatcctggccaacacggtgaaaccctgtctctactaaaaaaaatatacaaaaaaattagccaggtgtggtggcgggcgcctctagtcccaggtactcgggaggctgaggcaggagaatggcgagaacccgggaggcggagcttgcagtgagccgtgatcgcgccgctacactccagcttgggtgacagagcgagactccgtctcaaaaaacaaaacaaaacaaaacaaaacaaaaacaagtttggagccacgcggccacaagcctcttaaggacgcctggagctcccagagcccccaggagctcaaagaggcaggaagggtcctccctatagcctctggagggatcgtggcccccattaccttttcaaaatgtcacctctccccgcggtgtgaccctcgaaagctagacgtgcccaggaggcagcagcccaggccccgcaccttccctcccgctccctctggccgccgggcctcagccagcgctgctccctgacccgcctgtgccctcgccagggcccctcgccgccgcctcctgccgcctcccgatatggccaaacacccgggcgcgagccccgcgtgcaggcgccgggcctgggcccctgtggccgtcccgccagcggccgtcttctgtccctgcatttagagaagggggatggcaaagggacccgccagcggatccctcttacaggtggggaaactgaggtaagacggtcagggctggccccagggcgtggcgggccctcggggcagtcgcccagaccacccggacggccccgctcgcagccttcgcccgccccggccaacttttcaaccgaccgtcgcgcgccgtttacttccgccttgggagataatttccgggtcccggcaggaaagggtcagccgcgcacggtggccgcccgcgtgacgtcagcgctcgtcgcagccatcttggctcctggcagcggctgcccaggcctcggtcgtgggctgggcggccatgttggagtcgggcagggctctcatatccggtcactctccactggcgatgatcgattgcatttgacggacgcgacgctggtcgagagtcgctcgcgttgctcgacgttttctgcaactccaggaccgtaaaatatctcgaagacggcgaaagtcgcagacccctgcagaatcagatgatccagaaggatgcccgctgtctttttggtccatttcagttgtaaaccaagaagtagccgggacaggcctcggtgggcttcggagcgtggctcggcaaggtcgaggtcgcgcctggggggacaggtcgatgcctttctccagagatggttttgaggcctccgtatttaaagggggaaagcgggctgcggggtaaggaaggctccggtcctgtttctgagcccacggtgggaagagaaaaggaggggcggggggtggggggctggggtcgccgatgatgcgtccgcaagatgagggcaatggagagtgagatctgacctcgcgtctgtagttacctgcccaacaacacagggagaggcagtaacttgaccggctccgtcttcggcttcgttctgtccttttggcagcctgaattggggtcctgagcttttactttcacaccgtcctccacagtttcctaaatgggatctggaatgcttcttccctggcacgcctgtgagatctgaggcagaagccagtgtacagaaacaggtgtcgcatcagtaggcattctccagaggccgaccaatatattggagagacggattaatagacggatgatagtgggtttgtcaggggaattggcccatgcggttagggaggccgagaagtcccgggagggatgccatctgcaagccggagacctgggatgctggcagcctggctcggtccaagtcaggaaacggaagaaccaggggagctaaaggtgtgactcaggccagggctgaaagctgagaatccaaggagccgctggtgttaagtcctggagtcccaaggctgggggccctgtccaagggcaggaggaggaagagagagtcccagcgccaggaacaagagcagaacttcttttccctctttttttttttttttttgacagagtctcgctctgtctcctaggctagagacagaatgcagtgcagtggcacgacctcagctcactgcagcgttcacctcccaggttcaagcgagtctcctgcctcagtctgcagagtagctgggactacaggtgcatgccaccatgcctggcaatttgttttgtattttttaggagagatggggtatcaccatggccaggctagtcgcgaactcctgacctcaagtgatccgcctgcctcagcctcccaaagtgctgggattacaggcgtggaccatcgtgcccagcccctttttgttctatctgggcccccaggcgattgatggtatccgcccccatggagggtcttccccttggtcccccgacccccaggcaggctcctctggaaaccccctcgcagacacacccagaagcagcgccttatgaggtctctagggatcccttcacccagccaagtaggtgcttgagatgacccacggcaggtcggacatctccctcctcgtccactaggacagtgtctgatttgccctctttccctccctgcataagctgatccagagaattgtcacaagacagagttacaaatttagtttaaagatcctcgtgggctccattcgtgatgctagattcgggcaaccgcttggctctacagagagcagggagtgccccggggggctgaacagaggaggctggttttctagacggaagggctgaggaaagcggaaacagaaaacacggatcgctcacttcgaagctgcttttcttgtaagggtgaaagcagaagagaactccttattgtaccggcaaggatcagcctgtttggggatttggctgttattactctcctggtttctcagaagttcagataaacaacttagcttcagtttggtgacatggaactttttttttttttgttgttgagatgaagtctcgctctgtcgcccaggctggagtgcagcggcgtgatctcgggtcactgcaaactccgcctctccgggttcaagcgattctcctgcctgagcctcccaagtgtctgagattacaagcacgtgccacaacgccttgctgatttttgtattttcagtagagatgagggtttgccatgttggccaggctggtctcgaactcctgacctcaagtgatcctcccgcctcggcctcccaaaatgctgggattacaggcgtgagccaccgcacctggccaccaatggcttcctatagatttcatttaacagaaggaagggaggggagagggaggctgtggtagaggctgggggatttgaggagaggctgcagaggttgctgtgggtgaggaacgggtcccctctggttccctgaggagggctgggagatgcagtgaggtctttctgatgcaattttctataaaaatgccgcccaaatctggaccccatggtacctgggctttgagggttagcagagcctttcatgatgtcccagatggatcttgcagagacctcagtagagacggtgcagcggggagggtgtgggacaggtctgggtgacttgggacatggagccaacaggatagggtgttcctggcggcttctcccaaacaggccacatcaggatgtcccagggaagtagcacaaacccaaactccgtgtgcgcccttggcccggaacctctgggttctggagcaggctcggatctatggagggtttgcctttggagcttccccgggacgtccagtgggctctgggctgccccgggctgctctgcccaaaaggaggctcccacactgagcagccagtggctagagcactgccctgtggggaggcagacctggttctccggacacttgatgtggacggggaccggctggcctctccctcagcagggaggaggtgtggcatggagggacggctgtccacacggctgtgtttggcttgggctcctggctggctctgccacttattaggtggctggcatgggtgagtggcccagcctctctgaggtctgctcgttagaggacggggaggacagtgctgcccagggcttttgggagggttgactgcagcgctgtgtaaagtgtttgcacagtgcccgccaggggtaaggtgggcatcatgaaaaataatagaggctgggggcggtggctcacgcctgtaatcccagcactttgggaggctgagaagggaggattgcttgagctcaggagttcaaggcctgcctgggcaacatagcaaaacactatctctcaaaaaaaaaaaaaaaaaaaattggcgtggtggctcacacctgtcgtccgggctactcaggaggctgaggcaggaggatctcctgagcccaggagtttgaggctgcagtgagctgattccagcctgggacacagagcgaggccttgtctctaaacaaaccaaaaaacatgaatactggggtatgcaaagcgcttagtcataggtgaacttaaatggaaactattaattgaaatcagggctttggccaggcgctgtggctcacacctgtaatcccagcactctgggaggctgaggcgggtggattgcttgagtccaggagtttgagaccagcctaggcaacatgacgaaactctgtctctaccgaaaatacaaaaattagccagtctcttaacccagtctcaaaaaaaaaaaaaaattaaaaagttaaaaaaaaattggaggttacgtggttctggatgggattttttctgttgcctagaaattgtatctaaggcttaaatgtgaaaatagaaagtgcaaagtactcccatgaccgagggtgggacgtagcctcagaatgctggggtctgatacctgcccagtcccatgcgagaggctgaggctggcgctggcgagactcagtggctggtgggggctcaagctctgtggtgagaattctcaccatggtcttcagttacccctagagatgcctgcaatggtgtgggctgagtcccactccccagacggggaggtggaggacctcagacagccactgtacccacaagagcaggacaaggagaatggagtgagctggcagggctgggggtgggggcacccccgcacctcaggagcaggcgggcaggctgctagtctgagaagaggccacggtcttgctgctcgcaggtgtggggggtgaacatctcagacttgagacgctcttgtgaagacccagttcagggctggagcacgtcgtaaggttggtcagagacaatcctcaaaatcctctgcctgggacccccgacccccactccacgagggcaggtgcaggaaagaacaaccaaatatattccagcatcggaggacatgcaggctgcacacaagcggtcagcccacagagcagcacgtcgggggttgcagccaaggaataacgtgaagggggtcttgaaagagctgtgtttacagttcccaaggagataaatgagggaagaacaacaaagaagcaagaacagggaaacatgcaaaaagaacaaggagccaccttcacatgaaaaaacataattgtggccgggcacagtggctcacgcctatagtcccagcacttggggaagctgaggcgggcagatcacctgaggttgggagtttgagaccagcctgaccaacatggagaaaccctgtctctactaaaagtacaaaatcagctgggcgtggtggtgcacgcctgtaatcccagctactcgggaggctgaggcaggagaatcgcttgaatccaggaggcggaggttgcagtgagctgagatcgcgccactgcactccggcctgggcgacagagcgggactctatctcaaaaaaaaaaaaaaaaaacagtaacataattgtagaaataaaacctcaccgatgagttgaatgacagttgagtccccgctctggagtgaaggagtgagccctgacagaaccagggaggttacccccgacagggaggaacagtccctcacttgatcaggtgcgggctcctcaaggttgatttgtttgcttttctgtgcgtaaacatttggcttcataagacatagaataaaaccatgtcatttctcatcctactaaaaaccagtctaccaaaaaatgccaccatgaaccttttcacacctgtaactttatatacgtgtgtgtgtgtacatatcatatatatctcatacggggctgagggctcaggcactgccccttggtgcagccgtgggtggggggcctcaaggactgtgtgggagtccccggggtctgtgaggcccgcaggaggcaaggagaggccgagacccccagggagcgcccaggcctgaacccctcctgcgccgctgaccctgcagatgctgccgtgggcggcgaccgcacagacatcccctctgctattgctgcgggaccggcaaggacgccggaccgacacggcctccccatccctgggtccaccccgactcccatggtggggagcggccggcttggagcccctgtgggacggagtggaggtggagcaagtgcccggagctctcggccatcatgtgcgaatgttttgctccgtgctgacgcctccctcggcaccgtcctgtctgtgttgtggactgggcagctctcacggggttgggcgcttctgcccccgggggacgctggccggcatctggagacgtctgtgatctccgctggtgttgccgcaggcatctggctggtggagcccggggaggccgcccaggaccctgcgacccgcaggaccgccccgccgcggaggacggccagccccgaacccccagcgcccggggcacccctgcctgcctgccctgggcggatccccggggccgcgcggttcgggccgcgctcctgcccgctggggtctcccgccgtcctcgccgtcaccaccgggtggagccacaggtccgtgtga

SEQ ID NO: 1195 - DNA, 3410 bp, Homo sapiens
tccttggagccagtcactgaacatttatttggagtccctggagccctgctgtagccaggagcccaggttgtggcatgggggacagaggaggtgggacctggcagacccacagctcccaagctggggtcccggaggcagagtgacaatgcatggctgtgtgggagccaggcaggcggtgacgtggcagagctgccagcaggggcccaagagactgcagcaggttggtgctcacagtggatctgagggatgggcgtgcgtggcagggccttggccatggcccctgaccaacccctgtgcaccaaacaccacactgagctcagaatccgggcagagagggaaccactggtacagtgaggccaaggcacacgcagccgggcctgcagactcgagcccagcagggaccattaggtctcgggaggaggcagctgagggcgacaggatctgcacagagcagtgaggggcagaggacgcagggaccagatgggtctcccaggccaggtgagcccagaacggcccttcccagcccctctagagggtaggttgggggcagtagctcaccaggcccaggagcagcccatcctggaggcaaagcctatcccaaaacctggccctgcctcttcctgaggtgaccttgagtccgtaaaactgacgcccctggggtgacgcttgagagccggaagctgttccaggaggagggaggggcctcggtttctcccggggcatgtgggcaggaaggccctcgggatcccgcatcagtcccacggccgcggtgcggtcgtcacctgtgatcacggctgcctggcgccccctgccggccccacctcagcccttcctcgcaggcctggccggggcaacccagtgggcctgatgctgcctggcacctcgaggccccagagccagtgagcagacgctcgctcgcccatctccctagagtcccgctgtgcagctgacaccccctgccccagccccacggctctcagctgtccggttccagcgtccactccgacagccactgcaggcaggggccccgctgtgcctcagtctcagggggcttggttgggggtggaggaggccggccgggcccaggcaggagtgcggaggggctgcctggcctggggcccctatcctcggggtcagggtcgggggtggcccgtaaggcctgcacgagctggtccagcgactgcagcagtgtgtgggggctccagcaggcatccagggagggcaggaaggggtcaggcgtgcagacctccacacactcggtgtccgtggggatgcgcaggtagaaagcgtgcagcatcattctgaacggccggtcctcccggcccgagacttctccgtaggtcaggtcgcccaccacggggtggcccagggcactgcagtgcacgcgcagctggtgtgtccggcctgcgggatgagggcggtgccggatcaagctgggagcggggccgatccacacctatctccctgaccaggacccacctcccgtcatgaccccgctgcagtcttgaagcagcctcttggggtggaactctccctgtcccctgccatgagtgaggatgacagtatttaggacagaagattgtgttcaggtcaccactggtgaggacagggccagggtggtgctcggtcctggagaatctaggccagccagacccccaaggaatcagtcaggagccagcagggaccctgtgtcaggtgagaagctgagaggctgcagggcgtggagttaagaacgcaggagtgcttgttgccagctctgccctgatgctcagggtggcccaacataagcttcgtggccctgtgcctcagtttcccttctgtcaccaccaggacaccgcccaccccagacacacccgtgagcggcttcagcagcactttggagacaggatcgcctgcgtacagcccgtgttccagaaccacgagatctgtgaggcttggctttgggttctcacaacctggggcgcagaaggcaggtgtgaggttagtgggactgacccggggcccaggcccaccccaacgcacgatgcccgcccggtgggtccctgcctgcccaggcccaccccaacccacgatgcccgcccggtgggtccctgcctgccacaccctgcgagccctcgatgcacatggtgtgggcccggccctccgtgctgttcctgccaatggcatggctgatggttacccggctctcctggatgtgcccccgcagctgcaggagagggagaatcgcacgcagttcacggggcagcccagtgctgccggggagcccacctaacaccaagcaaccacgtagagcgtggtgggaggctctgagccagggctgcccaagtggggtgggaatcctgagtccccacgccccaccccaggactgaccaggtcttaccaatgccaggtaagccttggtcacgcgccgctccttgaagcacctgtacgcgctgccggcggctgccttgtttagggccacgcacagcgccccgctggtggagaaatccagctggtggcagaacctggagtgggacagagtccagagtctgagccactttcctccacagacgccaccgtggggctccggccgccccccctacctgaacccgtagcaggtgtcagggtcggccagctcgggaaagcggtaccgcagctgcttctgcagggtcagagtctcccgccacgccttgctgtcaatgcgaacgtcccagtgcttgttgaccaccaggaagtcgcggctccggtacacgatggacaggttctccacgctgcctggctccatggccggcctgccgagccacgcgtgggtgcgtgtgctgtgagcacgtggtgcgcccccagcccagcatacagaggtacccgcaccgccccacccgggctccggtgcgaagccaccgagccgggtccgcagccctactgtgcacctgcatcctcagtccccgagatcagtccccagggcgtcagctggggagtcaaggagtcagcctgctccgggctgacctgaagggccctgcctgacctaagcctggagaaagagcccgttccaaacctgccccacagatcctccccacagaccctcccctccaggggatgcacgtgaatgcctctgcccgacggtgggggcggggaggggctgcagcactaccaggcccggcagccaggtctgcccgcagcgcgggttagggctggggcctcctcgctccccgcagtccgcgcagacccgcgccccgcacaggcccggtgggcaggccgaccctggctccgagcccctcccgcgcccacgcccacgccaagaccaacctgctgccgggccgtgcagtccaggcccccgatgccgtgcccggcgccggctccagccgcgcgcccgcgcgctggcgacccagagaccctggaagctccgctccggacgcctggcagcgcttccgccc

SEQ ID NO: 1196 - DNA, 29778 bp, Homo sapiens
gctggttgggacccgggaaggcctccctcttaaggtctttcccacacctctgcaccttgttacctgactttcggcttcaggatccgcagcgtgcacccgcgttccgtgagtgccctataggcagtcagcatgcccctctgcgtgtccctgtgttacggggacgccggctgggagccgcagagctatctcagaactagggcgctctcctttgggcacctccaggccattttcctttcattcgagcccacagggttagagataaaccctcactccgttgcttggggacaagggcttcactccctgtcccgagcttgcggctgagcttgagggtggctgggtcatcctggccccccactggatgggaattggctgctctggtgatttctgtgacatcccagaccccaactgtggggctctggagcggactgcgcttcacttcgtggggagggtgtttccacctaggccactcttatttctcttcacatccccagatctgtcttctgagactttgcccttctccaggaagagcactcaggagaccaggaaaatggccacagggctcctgagagccaaaaaagaggtgagaattaactgtaattctatcttggctgtcaacagaatgggtcccattaccttttcttgtcctggaggctgccttgttggtattgggcaaagtcattcctagccctagtcattcctagtccatagaacaaggaggattttgatatagtcttgtagagcgtccgattctgtcgctgttcagggcgccacttgtaacctgcacggacctggtggactgaacaaaaggaataaaagacaagaaacaaaaaagtatatttggaagaaggggtcgggggcactttgtctctagtggacaagggccctgagctttacacaaccctcccgtatttattggtaaaacagataacaagttagggggtggtgattgtcaggtaattgtcagttggccgtttggttcgcaattgcaagactgcatccttccaacaataggcgctagatttcctggtagatcacttcaaggagccaggcgccaggcagtgatggctctcagcacatcttttggtggcagtgtgcgtttgctcacatcctgcattcatgataaacagtttaccgtttaatcatataacctccagtggaatgctgagttggtcacaatccctttggtcttttcggctccaaacatagtctgacctgaattttacctttgagttcattcctagtcctggaagagtgcctcgttctaacaggagtcttccctcagcattcctttctgctccatccttaccgcagtcactcatgaagtagttaattgtgaacaacacatatggagcagtttaaataaaagtaaagagacatacatgcgtaattgttcagtgatgtggatgaagggcagggacagcacagatgcctgtgatttcaaatggttagggaggcctcctagaagtagggctgtctcaattgcccctgactggtttgttaagttggagattggggggaaggcattccagtgggaggcggcaaggaagcatagatagtttcagaggctggactctcagtgtggaaggattatggtggccagtggacttgcttaagattgaattttttttttttttttttttgagaccgagtctcactctgtcatccaggctggagtgcagtggcgccatctcggctcgctgcagactctgcctcccaggttcacaccattcttctgcctcagcctcctgagtagctgggactacaggcgcttgccaccatgccaggctaattttttgtatttttagtagagacggggtttcaccgtgtcagccaggatggtctcgatctcctgacctcatgatccacccacctcggcctcccaaagtgctgggattacaagtgagattacaccacacccggctacctatgcatatttaaaaatcaaccttggccaggcgtggtggctcaggcctgtaatcccagcactgtgggaggctgaggcaggcgaatcacgaggtcaggagatggagaccatcctggctgacacggtgaaaccctgtctctactaaaaatacaagaaattagctgggcatggtggcaagcgcctgtagtcccagctactcgggaggctgaggcaggagaatcgcttgaacctgggaagcgggggttgcagtgagctgagatcgcaccactgcactccagcccgggcaacagagtgagactccatctcaaaataaataaataaataaatatacatatgttaagatacagactatctattcacacatagaacaaggagaatttcgatatagtctgacctgaattttacatttgagagcactttcagcttctggcaattgggacatttccaaaattccagattccctgcttctctgaaaataaatctgccctaaatctgcactgttctttggtgtcagacaatttgagctgaacaacgtctttatcatttggacgtgaccttcagagtatcagctgcactttctgcagtgtcctttatactgaggttgaaaccattgactacctaacatttcacccccctctcatttttattacctacctgacccctgaagggtttgccttttccacctctcggtcagggtggggacaaatcagaaaatgctgagtgccaggctgagcagggtagactttgtctttgagtaagctgagttttgaaggatgttaagaagggacttgacataaggaagtcaatggtatgtgggaaatagtgattgactgtgtataaggacttaaggggaagcgttcttcttttttttgaaacggattctcggtctgtcttccgggctggtgcgatctcagctcactgcaccctctgcctcccaggttcaaacgattctcctgtcccagcctcccgagtagctgggattacaggtggcgccaccaggcccagctaatcttttgtatctttagtagagacgggatttcaccatgtttgccaggctggtcttgaactcctgacctggtggtccgcctgcctcggcctcctaaagtgctgggattacaggtgtgagccacagcccccggccgaggggaagcttttctaagccctgagattggtgacgatgatgcccctgacttaattgaatgcaattaacattcattaagcaccaacacagttgccaggctgtttaacagtcatttttgatatgggttaacttggttatttcagatttgccttgactatccttatcaagaaatctgagtggaatttagacaggaaaagagatttcttaattctggactccagtggtggggattatgcattcctggatgttatcagagcaacactgagaattctgtttctcatttctaaaatagttaattcatttgagagtgttaataccaggaatacataagaaatccaattcaggacatttcccaaggtaacattgaatattttttgtgcgtactttctcttttctttgaggcggagtcatgctctgtcacccaggctgcagtgcagtggcacgatcttggcttactgcagtctccgcctcctgggttcaagcgattctcctgcctcagcctcccgagtagctgggattacaggtgcatgccaccacgcccggctaatttttatgtttttagtagagatggggtttcgccatgttggccaggctggtttcaaactcctgacctcaggtgttccacccacctctgcctcccaaagtgctgggattacaggtgtgagccactgcacccagcctttttgtgtgtactttcttcaccactcccagtgttaccagggaagcattctttctgattggctgggaaaagtcagaagtttgtggtagctgacttttcctgtgccacctccttcattctcagtaggtctacccggaactgcctcctgtatataaacaacttgttcttcaatgtagctttttaacatagtatttactcaggaaaaattaaagggcatgagcatttaaatagttgtttaagatgaaacctctgtgtctctcatgcctagcacacatgaaatgtttggtgcatgaaggaatcacaaccttaagtaaacgatttgaaggaactaagtaacaaaggagtttctgttgtttgctttggtttgttattttgggcatgtggttaatcacatgtttcaggagcgttgggtagaatttccagatactcttgatatgcatggcatctgaattatacaaaataatcaaagcaagactatcttaggacattaggtattactgccaaggacctttgcctgagaggataaattaaaatttgtgttaaatttgtaacaatgagatgaactggcaggcacattatgttattttttttcttagcatttttccttttccttggtgccatacaacaaacttgagtgtctgctatgtgcagaacactcagtagattacagttaatgatgggtaaaacacagtctgcacactcaggagtcttccattttattttaggattcctttctcatttggatttaatttaattttatatgcgctcacacccctgcaaacatattttgacaggccctaatggtaaaatcataatggagtaaagttactggcagtgtatctacccagctctatttttaaaggtgtagaaacagccaacacttatcccactgaaaataatttccatagtaatccattgaatggatgaactcatccattgtttcccaatttttggactcctgtttccaatgtttaactgttgcaaataatacttctatgatcagctttgtacatgaaattcttatataggtttttattctcatacaaaatatgacaaggtgaatagacatgactgttttgaagcattgggcacccacagcagttggagatttgaaccctgccagttttttttttttttttttttgagacagagtctcgctctgtcactctgtcccactgcatcaggctgggatgcagtggtgcaatcgatctcgcctcactgcaacctctgcctcccaggttcgagcaattctcttgcctcagcctcttgagtagctgggattacaggtgcccgccaccacaccaggctaatttttgtatttttagtagagacagggtttcaccatattggccaggctggtctcaaactcctgacctcaagtgacccacctgccttggcctcccaaagtgctggaattacaggcatgagcaccgcggctggccctgaaccctgccagttctaaagaatttgaacttccaattacttctttcttttctgagactcccttcttcaccatgtgtttctttatactgtgcaatttttattttattttattcatttattattattattatttttgagatggagtttcattcttgttgcccaggctggagtgcaatggcatgatctcagctcactgcaacctccgcctcccaggttcaagtgattctcctgcctcagcctcccaagtagctggaattacaggcatgtgccaccgtgcccagttcattttgtatttttagtagagatggggtttcaccatgttggtcagattggtcttgaactcctgacctctggtgaactacccgcctcggcctcccaaagtgctgggattacaggtgtgagccaccacgcccagccctactgtacaacttttatttgcttttattttaattattacactgtgcagattttgattaccggggtagacctgccaacttaggtctctttcttctctcacatgaaagctcacatagtatcctgatttgtttccaaatgttgacatggtcctttgccacccactacatgtttctgtaatcctcgttttccccaacattgcagtaacatcacttttcagaaacctttagtgcctcatttcagtgtcttagatatttaggacagtcttcatttcaaatattgtatcctgttgtctgatgtcatgttctgattattcagtctgaaagtgtgtttattgttaccacaggggagtcatcttatgtgtacttttttttttttttttttttttgagacggagtctggccctgtcgcccaggctggagtgcagtgtcacgatctcagctcactgcaagctccgcctcctgggttcacgccattctcctgcctcagcctcccgagtagctgggactacaggtgccgaccaccacgcccggctaattttttgtattgttagtagagacggggtgtcaccttgtcagccaggatggtctcgatctcctgacctcatgatctatccacctcggcctcccaaagtcctgggattacaggcgtgagccaccgcgtctggccttgtgtacttttaacttagatacatttactttttatccactcagctgaaaaaagaggagaaaaataaaagtaggtcaggtcaatctgtttcctttcccatttaatgaattcatgcccaggagtgagtgagaaatgggaggactgaatctgctgttctccaagactagcttaggagtttctgacatcatgggcatcccagcaagccaacggtcacattagtcaccacgtatttttcatatcacgtgatccctctatcagtgtatcagcctttgctgtataatgaacaatcctaaacatcaatggcttaaaacaaaatcacttattagcacataatttggtaggttcatattttgggctggccgcaggtaggttttgcagatttcacctggtcttgtcattttgctgcagtcggctggcattttgaccagggctggaggactatccatgtgtgacaggaagctggttggctggggtgcctagtttcttcttggttctcttccatgtgggcttgggcttggtcaaatggtcttgggtttctctatgcaggaagagaggacagccccaattaacaagtagttttaacgttttggcttttgtcatgttcactgatgtccttttggccaaaggaagtcacatggccaagtccagagtcgtcatagaacgggataacataagggagtagatacagggagacatgatttattggtcccaatgattcatacccttaccatgtgcaagattaactcacccccctcccaagatccccaaaagtttcatcttgattcaaaagtccagtatcttatgtgtaacagtctggatgtagctaaagcttcttcactggatcctttttgagtcagatacctgtatactaaaaaggcaagtcatttgtttccctccaccccaaacattccctacctaacatacagtggtgagagagagatactgcagtagatgctcccattcagaaaggacaggaattaagcatagaggaggcctctccattttgaactgtttcagatcctttggacttccttgaaagctctatgggtttcccatgtaccagatttgggactgctctattaaacaaaagctgaaatcacagtcagacaggcctcacatctttggcaaggtgtcggtgctatgggacaatgcccataagaatctcagaagcctttttgtccagcgtggagactccactaggcatccccttaacacttcagaggttctaaagtttgggtcttttagccaaacttttgattcgaactttactctgagtttatttttttattttgagacatgtgctggctggagagactgaagatgtaaaataattttatttccaagctagcaagtcctgacttgtctatatttcctctgaattacgcttgcaagctgtataattgcttcttcagctcttctgtttctggacattattatatgtcactagaaacatccaactgaattttttttttttttttttttgagatgaagtttcactcttgttgcccaggctggagtgcaatggagcgatatcggctcactgcaacctccacctcccaggttcaagcaattctcctgcctcagcctcccgagtagctgggattacaggcatgcgccaccacacctgggtaattttgtatttttagtagagacggggtttctccatgttggtcaggctggtctcaaactcccaaccttgggtgatgcgcctgcctcggcctcccaaagtgttgggattacaaatgtgagccaccacgcctggcccaagtgaaacttttaacaggctttttggagatctctttagctagatccaaaaattcatcaggtatattttctgttttccaagttcatgcaggcaatagctttgctaatatataatactagttgccttgttcaagctgccatatcagtttcatcactcctttcccagtccccactagcagtttgtttactggttttccagcctgtgctaatagttttcctggatgctttccaagcctctgcccatgtcctgctcccaaagctaatgccacatgttttaggtattttgttatggcagcacttcacttctgtgtaccaacttagtggcctaaagaacatagcggcttaggcctggtacagtggctctcacctgtaatcccaacactttgggaggccgaggcgggcggatcatgaggtcaggagttcgagaccagcctggccaacatagtgaaaccccgtctctactaaaaatacaaaaattagccgggtgtggtggtacacacctgtagtcccagctacttgggaggctgaggcgggagcaggagaatcgcttgaacccaggaggcagaggttgcagtgagccgagaccacgtcattgcactccagcctaggtgtcagagtgagactatctccaaaaaataaagaataaataaaataaaaccaaaaaaaaaaaaaaaccaaacaaacttagcagcttaaaatgaaatcattttttcaaaatcctgtgggtcagcaagtaggcccggcatggctgagctgatcctcttggcatcctcatgtggctgtagttagctggctgctcagctacagctggatggtctcaacctgtctggtggttgacagcttggttggctgggatgcttcaattcctggttcttctccatgtggcctcttcagcaggcaagctcaggttattcacatggtggtctcaaggtttcttgcacagcgagaaggccagccctgaactcagatgcctctcaaacatctgcttgcatcatgtttgctggtgtcccactggataaagcaggtcccatggccaagcccagggttaatttaggaggagactgcatgaagggtagaaacagggaggcatgattcactggggccatcactgtacccatccactggttagatacaatgcttttggccgcaagcaacagtaaacctaatttaggctgttctaaacaataagtaacttagcctatataaaaagaagttcacagagagagtgcactttggggttggtccttcagctccataagcttcccaaggactggggtgctttcatctctgcagtctaccctgttctctacagtgtcagcctcatccaggctggttcccctcaaagccataggatgtctgccaatagcaactttgtttaattctcacaatggccccataaggtaagtactattataatatcgattttataggaaattgagacacagatattaagatatcaacgcaaagtcataggggagggaggagagaggggactgtaatttgaacacagtttgtctccagagtttgtgcttttagccactgagtagttgttaaactttagtgtgcatcagaattacttggaagccttgttcaaacattgctgggctccccccgcaatttctgattcagtagccctaggatggggactgagaatttttatttctaacaagttcccaggggatgctggtgctgcaggttcagggaacacacattgagccagtgcactaagccctgctgcctcttttgggtaatctgtgcccatgtttctgagcatcaggaaaagtgcttaattcctgtgactccatcttacaaatgacgaagtcttttgctagaatcctacggtaaggcttcttgtggcctgttggttaccattcatttttcatatatttatttttcagctggcaagcagatgaattaactcccccaagcttctagctgtgtttctactcagtgggagagatttggagtgaatcatgagggtcaaccacacagtgtctacaatgctccctacatgcatggttcacagacaaaccatgagttgttccggggctggaggaataacggttgtattaaatgtgttaaagtaacactaattgctctgtgatgtagctccttcgtgggagattttcaaggggtgtatgtgtgtatgttctgagaaggggttgtaaaagcaaatcacaacagggactaggcagatacctgaatagcctttttctctccagtgtttaatgatgaacagtttcagacatatggaaaaaaccaggaagccttgtacattgaacactcacatacccatcacctagattctcagtgagtacctccttctcatgaacttttcctgatcctcaatcctacagtgacctctccctcttgagattactctgacccagtgattcacaaccatcacactacttttaggagcctttgaaagtacaaaagccccatcccctggttttacggatttgtggtgggactcaagaatccataatttaaaacaccacccaggtagctctaaaatatagccagagagagatgaggtatgagaaccaaagccctcactcatctgtgctcttctcttgcgattaagtacattgggactggctgggtttggggacagctatcgatataactgagtgtaggtagagtcttaaggccatttcatagtccagccagtgtagaatagtggagctggtaggggacaggaaatgtagggaggattccctgggaagggtacagtgtggaattagttttagagacacaatgtcataccctcaaggagtgatggaggcattctgagaaggggatgcaaaatcaaagagacaaggcatgtacctaaatgaatgacgctggtgaggcagtctccaatagtgtgttgcggctgatagacccccagcatgagtcaccgtcagccaactgtggtcctacagcagtgcaaagcccagggtggtcagatttatggatttttaacataacccatagattgagattttcatatgaaatcttccaacatttaattgatataaacacaagttttaaagcagtatatgggtcaaattaaacccctctatggactgcagattgtacctaaagagaataagtgttgggcagggaagaatcccagtgctagatttccagactcatttggaaatctcaccgaacttccatgccaaggacggttatatattcccatcctccaaagtacagctttctaggtagcagaggttcgtttgaaactttgttgcttgtctaataataataaatcatttttggttatttaaaaatatttgactgctaagtgtttgcagattctgttgtagacaccagggcaatcacagtgatccagccatgcacatggaactgatgtcttagtgggaagtcagaaaatagaaatgaatataatgtattatcttagagttaaggcaacacaataaagcaggagaggggaatgaaacccgcatgagagcatggaattttacatagaacggccagggactgcactgggcattttgtctgagcccttcacagtaatcctaatcctcaccacaagctgtgagataagcactgttatttttagttcgcaggagaaactgacgtgctgagcagctaattcagtgcctgaggttacactagttgtggacagagatgggttccaaatccagatagtatgggttgaatccacgctcttcatcaccacccactttccctccttaggcctgagcaggcacgtggcagcatttggtagaggaaggagtgagccctgctgtaggaactatatatattggtgagttatttgcccccaagccccagaggcaccactgcttcaagtagaacaaatagtgagaccaagtagtctcagaaaattttcaaactcagcaagataattctttactatttagttgtacttgtgtggtgtcttcttctccctgcctagttttgaaacgccctctaggtaagggctttggttttgtttgctcttatcctccctagcagctagcctgggatattgacagtaagtaacaggtgcataaatgatgctggctcggcagagataggagaataatggtctttcactccttggtgccaaggtcacaatccaaagtagggtctagaaatctttcctacttccctcagggaagccttttgacctctcattctttttttttttttttgagacagagttttgctcttgttgcccaggctggagtgcaatggcgcaatctcggcttaccgcaagtaactgggattacaggcatgcgccaccacacctgactaattttgtatttttagtagagacggggtttctccatattggtcaggctgatctcaaactctcgacctcaggtgatccgcccaccttggcctcccaaagtgctgggattacaggcatgaaccaccgggcctggccttgacctctcattctaaagtgtgggagggaaagacaggctcctgggtgagcagaggtgtgttttgtgttaaaggcgttcgtggcattcagggatgtggctgtgtacttcacccaggaggagtggaggttgttgagccctgctcagaggaccctgcacagggaggtgatgctggagacttataaccatctggtctcactgggtaagaatggcctcccttggcacttaaaatctgccctacagagtattttccactcatcgtgaggaagggctacctgcagagcacctttcccttagagttgagcttgaaaacaatttacttttttcctctgggtaaatctggatttagtagaattgaaagcagacagattgatttattcatgttatggatgacactacatttccaggcctgtttcccaaggcttgtgctctctctttattttgcttcaaacccaggaaatttttcatacaccaagtgttcataatatgccatctttctgactggagtcacctttccttagtcaacccttctacttcagagagagaactattcataggtcttttttatcctctgggtttcctcacccatttcagctctgagttctagaatgccctcttgagcccataaccaacaatgtcctcattttcttccctatgaacagaaattccatcttctaaaccaaaactcattgctcagctggagcgaggggaagcgccctggagagaggagagaaaatgtccactggacctctgtccaggtgagtgttgagtgtggggtagacgggataatccacagcttggcagataggaaggaggaggcatctctcagatactgggaagaagctcttcttcaggcctcctaagccaagagaaacgttgcctgacatggtcttctttccggaacataatcttcagttgagggagggacttccctggttcccttgtctcttccctacaccaggaagcctcccttcctcatttgtcttctccgtaatgcttagtctttcctcattcactgtcttctttctcacctgatcttaaaaattgcatctacccatgaatgttaagtctacgacacttctagatactttctagctactcttatgctaagattaattgattaactccacctctccaattcccataacttattacacaatacttaagctatgactaataataaaatacatactcatgtgccaatgtcccagcttaagaaataaaaaatgacctaaacagtcgaaacccctatttccccttccctgatggtatcctctacccatccctccaatggaattgtttttcagtattagggatttgtaattctcatgcatggctttatcatttccttcatatgtatgaatcgctaaatcatctatattgttgtttggcatattttaaaactttatatcaatgtcatcatattatgtatgtattttgttttcttccctgagactaattttgtactatgttggtatatgtagctctgcttcattcatttttgtggctatataatattgtattttatgcataattataatacaattcatttatccattccatttttgttggacagttacagttctaacagtgtattcttttgacccactaaagaatgttgctgtgaaccttctcatagatatgtccttgggcacataagcacccgtttatctaggatatgtacctaggaataggacagctgagtaaaagaatatgcacctggtcagtctgacaaggtaatgccaaactattctccaaagttgttgtattagtgttctagggctgccacaacaaagtaccacaaactgagtggcttaaacaacagaagtttattttctcacagttctggaggctagaagtagagatgaaggtgttggtagggttggttccttttgagggttgtgaggaagaatctgtcccatgcctctcctctagcttctggaggtttgctggcaatccatggcgtggaggagcagagtcccagtctctgccttcatcttcatatagcattctccctgtgtgtgtgtctctgtgtccaaattttccttgtttgtaaggacattattcatactggattaggacccactctaatgacctcatcttaactaattacatctgcaacaaccctgtttccaaataagttcatcttttgagatattaggggtttggactccaatatgtcattttttggggaaacagaactcaacctatagcaattgcttacactcacatagcattttattgtttgaggattctagttgccctacatccttcctaatactttgtgtggtcagactttaggttttgatcatcttttgggtatgaaatggcctctcatagtagttgtaatttgattagttttgagtttgagcatctttttatatgttcattccttgactggccttggtgtttgctcttctgtgaagccttttcaattcttttgcttttcttcttgttgatttgaatttgaatttttaaaaataaatcattgaggtgaactctttatcagatgttccaatctgtggcctacctccttgctttttttatttttttttattgagatggagtcttgctctgtcacccagccaggagtgcagtggcatgatctcagctcacagcaacctctgcctcccaggttcaagcgatcctgctgtctcagcctcctgaatagcggggactacaggcgtgtgccaccatgcctggctggtttttgtatttttagtagagacggggtttcaccatgttggccaggctggtcttgaactgctgacctgaagtgatccacctgccttggtctcccaaaatgctgggattacagacgtgagccaccacgcccggcccccactggcctttttttttttttttttttaatacagagtctcgctttgttgccaggctggagtgcaaaggcgcaatctcggctcactgcaacctccgcctatcaggttcaaggattacagacgtgagccaccacgcccggcccccactggccttttttttttttttttttttttttaatacagagtctcgctctgttgccaggctggagtgcaaaggcgcaatctcggctcactgcaacctccgcctatcaggttcaagcaattctcctgcctcagcctcccgagtagctgggactacatgcatgccaccacgcccggctaacttttttgtatttttagtgttagccaggatggtctccatctcctgacctcatgatccgcccacctcagcctcccaaagtgctgggattacaggcgtgagccactttacctgatgccctgcttgctatttaaacaaactgtgaaataatttgtctcaatttataaaaataatacagagagtttccatttactcttcaccctgctttccccaatgataatatcttatataaccacagtacatttcaaaaccaggtaactgacattggtacagtactattgagtaaactaaagactttattcagattcagatttcatcagtttttgcatgtactcttttttttaattgttgctctatagtagtatgaaatttcattacataaataagatttatgtagccaccatcaccacaataaagatgtagaactcttctatcactacaaagaaaactctcctgtgctatcttccctccaatcttaacccctggcaactactgatctgttccccatcactataattctttttgcttttttttttttttttttttttgagacagaattttgttcttgtcccccaggctggagtgcagtggtgcaatcccagctcactgcaacctcggcctactggactcaagcgattctcctgcctcagcctcctgagtagctgggactacaggcatgtgccaccatgcctggctaattttgtatttttagtagagacggggtttcaccatgttggccaacctagtctcgaactcctgacctcaggtgatccacccacctcggcctcccaaagtgctgggattacaggcgtgaaccacttgtgcccagcctcaaattttatttctactaaaatatataattattcttatgctacatttcttcatgtgtcagtctttttaaatttgtgtattttaattaatttgtccacttaacctcagcagttaaatttgttggcataatgttcataatattcccaaatttctttaaaagtgtgtatatttctctagtggtgcttcctctttcattccccatattgtgatttaaaacattttgggggtattttatctaaaggtttattaattttatggatttttgcaaagagtcaacttttggtttcattgattttctgtagtattaatctatatcccatttaagtgatttttatttgtatctttttctgcattctactttctttgggtttaatttcctcttcttcttacttcctgaggtagaagcttaggtcattggtatagaccttcttttctaatacaatcacatatatatctgtacatttatttctaagccttgctttagctgaatcctacaacttttggtgtgttgtgttttctttatcatttagttcatgatattttctaattttcttattttttaacctattggttgtttagaagtgagctgcttaatttccagatattcaggtattttctaaatgttttatttttattggttttcaatttaattgtattttgttgagagaatgtattctgtatattttcaatctttcaaagtctgttgagattaattttatggcacagcatatgatctatttttgtgaacatcctatgagctcttaaaaggaatgtgtattctgcagttgttgagggtactatcctataaatgtcagataggtcatattggtaatatttttcagatgattgatatccttactgagtttttgatcttatttttctatccattactgcaaaggtgtgttaacatatcattgtggatttgtctatgtctctgtagtgatctctaaggttttgattcatacagttagtaattttgctatgaggcacatgtacattaataattgttacgtcttcttattgacctttttatcattatggaatttcctcctttgttttttagcaataccgcttgtcttcaggtctgttatctgatattaatatagctactccaggcttttttttttttgagacagagttttgcttttgttgcccaggctggagtgcagtggcactttctcgggcgtggcttggagatgccacgaccaaacacctcttaaaggcctcctggcttcaagtgattctcctgcttcagcctcctgagtagctgggattacaggtgcccactaccacgcctggctaatttttttcctatttttagtagagacaggatttcaccatgttggccaggctggtctcgaactcctggcctcaggtgatccacctgcctctgcctcccaaagtgctgggattacagacgtgagccaccatgtctggcccattccagctttttaatatttactctttccgtggcatacctttgtccattctttatatttcaatctttttatttgcgtctttgtatttaaaatgagtctcttatagacagcatatagttgatttttttcttctttatccagtttgccaatctctacgttttgttggagtattgaatgcattagcactcaaatgttattgttgataagtaaggttatttctacttttgccagatttttctttgttttctccaatgtgtttttacttgctctgttttctttagcctacttttgttttaatgttttaataaaatactttttagattcttttttcttttttttttttttttttgagacatagtctcactctgtcaccgagactggagtgcagtggtgagatcttggctcagtcatcctctgcctcctgggttcaagggattctcctgcctcagcttcccgagtagctgggactaggggcgcacgctactacgcccagctaatttttgtattgtcagtagagatgggatttcaccatgttggccaggctggtctcgaactcctgacctcaagtgatctgcctgcctcagcctcccaaagtgttcagattacaggcgtgagccaccgcgcccggctcctttttcgatcttcatgttaatttctctcagctatctagctatgtatctgccttgtgtgtgttcatgacttttccagggcttacaatatgtatttttaacttaaaccaattagagttattatttgtttaaggtaatgtaagaatctcacaagagtatgtttacattcccctcatcttcagtgctgttgtcatatacattatttctgtaaacatcctaaacccaatactacagtgttaaaatttttaagccatcgtatagtaatacgtatttttaaagaaattaaggtaaatgtatgtagaaatatgtgtgtgtgctttatatctgtcacatttcttatgctcttcactccttaatgtagatacaagttgccatctgataccattttccttcatcctgaaagacttcctttaacatttagtacagttacctggcattggattttccattttaatctgaaaagattattttctctccagtttgcgaaaattaactggagatagaatcgctggttaacatatttttctctggcattgcagtgtcttctggctttcatagttttgtaatttttgttgagtaattattatattgttcttttatattttgatcttctctggctgtcttcaagattttctcgttatctttggccttcagcagtttgaccgtgatgtttctatgagccgttttctttgtgtttctactacttaagcattatgaagcttcttggctctctaagttttattttctattcactgtgagaagtacttggctattatttcaatatttttcctgtcccttttactctttcctctcattctaggactcccaatttacctgtatattggactgctggaaatatgtttctgaagattcatattgtctcataagcttctgttcatttttcttcagtcttttttctcttttttgaggggtgggtggatatatgtaatttctattcttttattttcaaattcactaatctttcttctttttctgtttgctattaaacctgtctagtgaatttttaaatttcagttgtttttttctttccccctcccctcctctcccctcctctcccctcccctcccctcccctcccctcccctcccctcctcttgtttctgtgggttttaggagtgctctcaggcaagaaagccacaaacaaaattattacccctttctgttgcaattttttgagcataaactcttccccatcttctggctggttatgtatattttccagtgcctttgagtagttatttgttatattttatccagtcttattattttctgctgcagggttcttgtgaccatttcagtctgctggcattttcgttagtgggcttcctcatacttatttttgaattgatttttggaaattgcttcaaaattacagaatatttgcaaaaataaaaatagtagaataaatatatatggtgcagtgagttgtatgtggtttgtccccaccacaactcatggtgaaatttaattgccagtttaacggtattgaaaggtggtggggcctttaagaggtgtttggttgtggcatctctgccctctcgaatggcttatgcagactgggttagttcttttggactgggttggttctcgtgagatcaagttgttataaaacaaggcttcctctgatgtttggcctctttgcatgcacttgctttcccttcctctttctgctgtgatttgaagcagcatgagaccatcaccaaatgggctaccatccaacctccagaattgtgagccaaataaacttttttgtaaattacccagtctcaggtattctgttatagcaatacaaaacagattaagacatatggcatatatgttattatataaatggcatcataaaatgacctactattttacttagtttgctttatcatttattcatgtgctcttttgcatgcatacccttcctccttccttcccctttctcagtacatatgtatgtatgtgtatatgtatatgtatgttcatatgtgtttgttttgtttttgtctttgtttttgtttttgttttttgagacagagtctcgctctgtcacccaggctggagtgcagtggcacgatctcggctcactgcaacctccgcctcctgggttcaagcgattctcctgcctcagcctcccaagtagctgggattacaggtgcacgccaccatgcctggctaatttttgtgtttttagtagagacagggtttcaccatgttagtcaggctggtcttgaacacctgacctcatgatctgctcacctcggtctcccaaagtgctgggattacaggcgtgagccaccacccccggcctgtaagtgtttgtttctgtgaattttctaagaatgtcgatattgtctcatataaccacagtgtggttatcagcctcagtaaacttaactttgatacagtcattttgcctgttatctaccattcgtattataattttgtcaacatatagaataatatggttttttactttccagaacataatctagtccaaggttagttagttcattttcatgtcatgtctataattattattaagggaagggaattattatttcaataatctttctctgtcttttataacattgacatttcatttgtttatttaattttagattcagagtgtacatgtgcaggtttgttacatgggtatattatgtaatgctggggtttggggcttctattgaacctatcacccaaatagtttacatagtacctgataggtagtttttcagcccttacctccatcctttttcccctgttttggagtccccagtgtctattatttccatctttatgtccgtgtgtacccattgtttagctcctacttgtgagaacataggttatttgattttctgtttctgcattgattcacttaggatgatggcctctagctgcatccatgttgctgcagaggacatgatttcattcttttttatggctgcatagtatttcatggtgtgtgtgtaccacattttatttatccagtccactattgatgggcctatacgaagattccatgactttgctgttgggaatagtgctgcgataagcatacgagtgcaggtgtcttctggtagaacaatttattttcccagtcttgggattgttggattgaatggtagttctatttttagttccttgagaaatttccatactgtttgccatacaggttgaactaatttacatgaccaccaacaatatataagcattccctgttctgtgcatcctcactaacatctgtttttttgtttgtttgtttgtttgtttaactttttaataatagccattctgactggtgtgagatggcctatcttcttgtgggttttcttttcccatccttcactggtaccaagatctctttgtggttgtaatttgtatttctctgatgattagtgattttgagcattttttatgtttgctccctgtttgtgtaccttcttttgagaagtatctgtttatgtcctttgctcactttttaatgaggttatttgggtttttgttgttgatttgtttaagttccttatgtttctgcatattagtcctttgtaagatgcatggttcgcaaatgctttctcccattctgtaggttgtctttttactctgttgattgtttcttttgcagtgcagaagctcttttgcttaattaaatcatatttgtccatttttgtttttgttgcaatcgcttttgaggacttagtcataagttctttgccttggccaatgtccagagaagtttttcctagttttcctttaggaattttatagtttgaggtcttacatttaagtctttcatccatcttgagttgatttgtgtatatgagggggaagggtccagtttcattctcttgcatgtggctggacagttttcccagcatcatttattgaatagggtgtcctttccccattgtttatttctgtcagctttctcgtagatcagttggtagtaggtgtgtggttttatttctgggttctctgttctgttccgtagatctatatgtctatttttgtacttacaccgtgctgtttcagttaatatagccttgtagtatagtcaaagtcaggtaatgtgatatttccagctttgttctttttgtttaggattgctttggctagtcaggctttgttggtcccatatgaattttagaattgttttttctagttctgttagaatgttagaatgacaaatgatgttggtaatttgataggaattgcattgaatctgtagattgctttgggcagtatcatcattttaactatattgattcttaacaatctatgagcatagaatgtttttccctttgtgtcatctgtgatttctttcatcagtgttttgtagttctcctcgcagagacctttcacctctttggtttgatgtattcttaggcattttgtgtgtgtttgcattcgtgtggctattgtaaatgggatcttgttctttatttggctctaagcttgaatgttactggtgtatagaaatgctattgatttttgtacattgattttgtatcctggaactttactgaatttttttttttaatcaggtttaggagtcttttggagggacctttagagttttctaggtataggattattttctaggtataggattttctaggtaaaggattcttggcgaacagagataatttgactccctcttttcctatttggatgccttttatttctctgtcttgcatgattgctttctctaggacttccagtactaagttgaatacgagtggtgagagcagacatccttttcttgttccacttcttagggggaatggtttcagctttcgcccattcagtatgaagttggctgtaggtctgtcacagataactcttcttattttgaggtatgttcctttgatgcctagtttgttaaagatttttatcatgaaggggtgttggattttatccgatgctttttttacatctattaagatgatctttttttttttttttttttttttttgtttgagacggagtcttgctctgtcaccctggctggagtgcagtggcgcgatctcggctcactgcaagctccgtctcccaggttcacactattctcctgcctcagcctctctgagtagctggaactacaggcgcccaccaccaagcctggctatatttttgtatttttttagtagagatggggtttcaccgtggtctcaatctcctgacctcgtgatccgcccgcctcagcctcccaaagtgctaggattacaagcatgagccaccacacctggccggtttttgtttttaatcctgtttatgtgatgaatcacatttattgaacactgacattttagaatacaattcctcagttctcactttttttttttttcttttttgagatgaagtctcactctgttgcctaggctggagtgcagtggcgcgatctcggctcactgcaacctccacctcctggtttcaagcagttctctgcctcagcctcccgattagctgggactacaggtgcgtgccaccatgcctggctaagttttgtatttttagtagagacaggatttcaccatcttggccaggcttgtcttgaactcttgccctcaggtgatccacccaccttggcctcccaaagtgctgggattacaggcgtgagctaccgcgcctggccagttctcactttttaaaatagctttactgaggtataatttacatgccataaaattacttattgtatgtatacagttcaatatatatatattttttttttgagatggagtttcactgttgtagcccatgctggagtgcagtggcacaatctcggctcactgcaacctctgcctcctgggttcaagtgattctcctgcctcagcctcccgagtagctgggattacaggcatgtaccaccaggcctggctaattttgtatttttggtaaagacagggtttctccatgttggtcaggctggtctcaaacttccgacctcaggtgatccgccacctcagccttccaaagtgctgggattacaggcgtgaaccgccgcacctggcctgtgtgtgtacagttcaataatttttagtaaacttatagagttatatgattgtcacctctattcaacatttctgtcacaccagaaagttctcatgtgcccatttgcattcatccgtcctcccatcagaggaaaccattgatttgtttactgtctatagatttgctgtttctagacgtataagaatggcattgtgaaatatatagtcttttcttttttttttttttagatggagccttgctctgttgccaggctggaatacagtggtgttatatcggctcactgcaacctctgcctcctgggttcaagcaattcccctgcctcagcctcctgagtagctgggactacaggtgcacaccaccacacctggctaattttttgtattttagtagagacggggtttcaccatgttggccaggatggtctcaatctcctgaccttgtgatccacccgcctcagcctcccaaagtgctgggattacaggcatgagccaccatgcctggcccttttcattgtttattaaccatttgcatatcttttttagtaaaatgcctattcaattcttttctttattttaaaattagattgtgttcttattgaattgtaagaatttttagtatattctagacacaagtcctatatcaatataggattttcagatatttctccctgtctgtggcttatcttttcattttctcaatggtgtcatttcaggcacaaaagttttaaatgctgattaagtttaacttaccaatttttaaaatgggttgtgcttttggtgttgtaactaagaactttattcttaactcaaggttatgaagattttcttcactggtttcttctagaagttttacagttttagctcttacatttagagctacaatccattttagttaatttttatgtatcaaatgaggtgaaaatctaaattcattttcttgcatatgaatattcagttgtccttacaatctcatataaagagtatccttcctcccattgaattaccttggcacctttatcaaaaatcagctgactgtgaatctaagtgttcatttctagtctcctgattttgttccatgatctccatcttcctcctatgacagtagcacactatcttcattactgtagctttatattaagttttgaagttagaagtatacactccccaactttattttctttttcagaaattgttttgtctattttatgtcctttgaatttcaatgtaagttttaggatcagattgtgaatttccaaaagggaaaaaaaccaaaagcctgctgtggttgtgataccatgattatgttgaatctgcagataaattttggtgagaatcaccatcttaataatagtaagccttccaatctatgactgtctccctatttatttggagctttaacttcattcaacaatgtttgttaattttctttttaaaaatctttcttcttttcctcctttcctttccttttctctttctcttctctttctttcatcccactatgttgcccaaactggcctctaacttctggcctcaagcaatcctcccacctcagcctccttaagtgttgggattacaggcatgagccaccgtgcccagccttaattttcagtttacaaactttgtgctactttgtcacatttattccttagcattttattatttttatgctatcgtgaatagtattgttttctcagtttcatttttagaatagtcattgctagtatatagaaatataattattttttatatatttatcttatatgacctaagtacaattatgacttctagttgcttttttgaaattttatgcttacaaaattatataatctgtgaacaagagattttttttacttcttcctttctagttaagatgcctttcatttattttctcctcattttgtttgtcttctccttttttttttttttttttttgagacagagtctcactgtgtcaccaggctggagtgtggtggcacgatctcagctcactgcaacgtccgcctccggggttcaagcgattctcctgcctcagcctcccaagtagccgagactacatgtgtgtgctaccatagccagctaatttttctatttttagtggagacagggtttcgccatgttggccaggatggtctcaatctcttgacctcgtgatctgcccgcctcggcttcccaaagtgttgggactacaggcgtcataagtttttgagaacacgtgcaatatttgccacttcttctttcttcttctccttttccttctcctcctcctcctccttcttcttccttcctttctctttctcttttctgtgtctccctcttttgaattcaaccccttaaaaaggtaaaaaccatttttagctggcaggccatacagaaacaggtttcaggctggatttggcctgtcaggtgagtttgccaactcctgcaatagaaaatgtaatgcatagggctagacacagtggcttatgcctgtaatcccagcactttgggaggcttaggctgacctgaggtcaggagttcaagaccagcctggcaaacacggtaaaactctgtctctactaaaaatacaaaaattagctgggcgtagtcttggacgcctgtaatcccagctactcgggaggctaaggcaggagaatcgcttgaaccctggaggcggaggttgcagtgagctgagatcgcaccactgcactccagcttgggtgaaagaaagactccgtttaaaaaaaaaaacaaaaaaacaaaagaaagtgtaatgcatgaagtgaaatgaaaaatagatgctgggaaggatgtctaactgggagatagcttgtgatgtaaatatgtaaatatattatgaatgaccagtgggcaaggcaaaattgcctacacagccctacctatggcccctctgaaaatgttctttcttcagcagaatcgaagccagaaattcaacttagtccctcctgccctctgattttctccagtcagcaagctctcagccaacatgtgtggctgagtcatctctctcagctgttttcaagtttatgggcaggaaatcctctccacctgggaaaacactatccagaagatcagaaacaacagcaggatccattctgctttagtggcaaagcagaatggattcaagagggagaagactccagactcctgtttgggagagtaagcaaaaatggcacttcaaaggcactttccagcccacctgaagaacaacagccagcacagtccaaggaagacaacacagtggtggatatagggtccagccctgaacggagggcagatctagaggaaacagacaaagtattgcatggtttagaagtctcaggatttggagaaatcaaatatgaagagtttgggccaggctttatcaaggagtcaaacctccttagcctccagaagacacaaactggggagacaccttacatgtacactgagtggggagacagctttggcagtatgtcagtcctcatcaaaaacccaaggacacactctgggggaaagccttatgtgtgcagggaatgtgggcgaggctttacgtggaagtcaaacctgatcacacatcagaggacacactcaggggagaaaccttatgtgtgcaaggattgtggacgaggctttacttggaagtcgaacctctttacacatcagcggacacactcagggctcaagccttatgtgtgcaaggaatgtgggcagagctttagcctgaagtcaaacctcattacccaccagagggcgcacactggggagaagccttatgtttgcagggaatgtgggcgtggctttcgccagcattcacacctggtcagacacaagaggacacattcaggagagaagccttacatttgcagggagtgtgagcaaggctttagccagaagtcacacctcatcagacacttaaggacacacacaggagagaagccttatgtatgcacagaatgtgggcgtcactttagctggaaatcaaacctcaaaacacaccagaggacacactcaggggttaaaccttatgtctgcctggagtgcgggcagtgctttagcctgaagtcaaaccttaacaaacaccagaggtcacacacgggggagaagccatttgtatgtacggagtgtgggcgaggctttacccggaaatcaaccctgagcacgcaccagaggacacactcaggggagaagccatttgtatgtgctgagtgtggacgaggctttaatgataagtccaccctcatttcacaccagaggacacattcaggggaaaagccttttatgtgcagggagtgtggcagaaggtttcggcagaagcctaacctgtttaggcacaagagggcacactcaggtgcctttgtgtgcagggagtgtgggcaaggcttttgtgctaagttaactctcattaaacaccagagagcacacgcaggggggaagcctcatgtgtgcagggagtgtgggcaaggctttagccggcagtcacacctcattagacaccagaggacacattcaggagagaagccttatatttgcagaaagtgtggacggggctttagtcggaagtccaaccttatcagacatcagaggacacactcaggatagaaactttatgtgtatagggaatgtggtacagcctttagccaggagtcatacttcatcagacaccagaggacacacacagtgctgtggctttttcagccattgctagataccaaagtggagacattctgtgtgtgattatgcatgagactgtactggtaagacttgtatctccatccacctgaaggagaattgctggctcattttcaggagccctgcccttcctcactgtggatggtgggttgtggaaacccggtcaggtaatgatagtggcaggaggcagtcaaatgcccaggcagataggggtgggtacctggtgaaacccaaccttaaagctgaagacagtcccggctaaatcctcatactgaattgagaacctgtcttcccatttggtgtgctttcctccgattgatcccaacccttcacctattttacgtatacctgccctttcctaattggtttttacactgctgtgcccaccttttgagtggtgcctttgcatacttacaaatcagtcaacgtgtattcccctattctgagcccataaaagacccagactcagctgcagtgaggagagaaatcaccctgctgtgggggttggggaccactccctgcatcccctctccactgagagctgttcttttgctcaataaaattcttttctacccatcctcacccttcaa

SEQ ID NO: 1197 - DNA, 4771 bp, Homo sapiens
gtccagaaaatgtccctttttattccatacgcaaataagtagattcatttaaaaaaacaacaacccggaggctgcgacgtctgcagagagccccagcctgcctgctcctggaacggacgatgggacccacaggtccagggtcctttctccaccagcacccgcgagaggggtagcacagccctccgggccggcctgctgtctgggtcccaggaaagggacgtttagtgttgggggcagtctgtggggacagtcaccgctcagccttggacagccggttcgtagttttcctttgttgcgctgggcttggcctgagggcagctgccccgggtggccatggccgaccgctcctcgctgaggccggggggtggccgtggcgccgggggctgcgcagcccagagtctctgcatggccccctgttcgagtggggatccagcctggcaaatgggtggggcgtcccattacattctagaggcgctccccacagaagctgaggcccgcccggccgcggcctgcgctcccgaggtatctaggaggccgcaggagcgaccatcccttccctaacgccccctgagccctgcgcctgccgctgaatcgcgcgtccacacaggtccacagggtcgtggggagagggcccggcaggcggggctcacaccaggccaggcatctgcgcccgcagaaagggcacggaggcggcggccgggaaggcggccagcgggtaggcgagggccccggagaagccgagcagcggtgggggcggcgcgggcgcggcgggcgccagcgggaagggcagggtggccgggggcccagcggcggctgcggccggggggctttcgtggtagagcaccggcacgcggaccaggcgctgcgctcccggcggggacaggctggccgcctccagctcggctgccagctgccgcttccacttgttgcggcggttctggaaccagatcttaacctgcgtctcggtgagctgcagggaggcggccaggccggcgcgctcggcgctgctcaggtagcgcttcaggtcgaaggtggattccagctggaagacctggctgcgggagaagactgtgcgcgtcttcttctttcggccgccgcccacgccaacgccgccgcgtgtctccccagccgccgcagggacctcggccagctccgacgcctcctccgtgccggccgccgggccacgcgccgccagctccgctgcctcccgctgcaccgctcccggcccggggcctcgcggccaggcgccctccgcacggcccatctcctcgcccgtctccggtgagtcccggtcgctggctgcaggggagagagggcaccaccgttggttctagggcactgattaccagactcaatcactgaggccagccgtccccaccttgaggtcgctcacagccacaagcaggaagaccttccagcacagggctgggcacccagcagctctggggatgcacacattgtcagaaccgtgggaggcggcccagagaccaggcagcagctccaaaccaacaccccgcaacacaccaacaccccgcaacacacaaacacaaacgcacacccatgccagaggacaacaaagggatgcagagcaaagaaaagaaacaaaaatactacacaagaaaagcaggctgaccccagtgagcactccccactcccagctgcaccacgggcggcccggaaaaacacacaaacctcccgcagaagtcccgggacaagaggaaagatgtccttccgagaaatgttcacaccgaaaaacaagcacaggacaccccctgccacctggcatccagccccacgccaagctccccagaaggaggaatgaagagttcacaggcctcttcccgcgccctctgcccgcttgcacagaaacattccatagtaggaggacaaaccaatgcaaaggatccccaaaagagaactcccatcaggtgaggctgtcacccccacaccacatactcctgtagccctgacccagtgtccacaaggcaagtccacaccagccacaatcatgctcaaagggaacacgggcacatgccactctaagcaacatgcagcagctgagtcctgccccaaacactttcaagactggaggttcagcctcatgggtttgggctgaaaccagaagctcacaggcggtgtctgagttcatgttccaagtaccaagctcccctactcatctcctaggaacaagaagaggcccacaggctggcaagggatgatgtcaggttaaagaggccagccgggacccagaagcacttgcccagattgaagagggcagcagcctcccactgcagggctctggaggctgactcggacccgctgcttttctgccttggtctggagcctcccgtgcaaagggcaggcccaggttgacaggttagaggtggaggcagagtttggcctggccctgggcccctggaaggctgtgcactcggccgggtgtgtgcctgcagtgtatttgcagcatttgcacgctcatgcaaggggtgcgcacactggtgggcttctgtgcgtggttccagctctgtgcctcatgcccaaggagtgtgcacatcccactcacgcccgtggccaatccccatggtgtgtgccctcacagcacccacaggggagtcaggcagcaggttgtggtgcatgctactagatctggggagtccctgcctccccccaataccccaaactcacagaggcccatgtgctgccacaaggcactaggctgacttgccagctccagtgaggaagtgggaccctaacccgcatggcacgaaataagggggagccgcctctgcaggggtgccacctgggctgcaggaggggatgcaccccagggatgagtggagaacaaatttcaccctgagaaaccctttccatagtctcccccagaagggcactagacagagtcgctcgatttctgggaaaccacggaagccctgctcaagtctacgtgaagggggtgggggcctagacttcctgagtgtgggtgccgagatgtgggggcttttgcaaaggatcactccacgacatggaaagggttatctaacaagtgagtgagggtcgtaggccacttactccccagcacacactaatattcatacagaggacagcatggatcccagagccggagcctgcagagggcccacgtcctcagctggcctcaaggtccaaaggctgtgttgggggtggggggctggctaagccagggcttggggggttggactggctttcctggccttcctcccaggggtcttcctaaagggcaggtacaaaagggaggcagcgaccctggaaccctggggaggggaagcagaactaaggggtcagatacccaagcaagggggcaaaggggttctggggttgagaacccccagccccagtctcaagccctcagcagggaacaaaggcaaggagggggaggggcagaaaaagaagagagaggggttggactgggggcctcagaacaggctcccttcttgcctggcacagcccatgcccctcaaggaccaagagggagacccaggcccctgccccaggctgtctgcagcgggcacagaggaaacaggactctgggggggcacagctgccatgttagatggctcccctccccggccccacccccacaacactgcaccctctgctcaatgcccccttttatttttccacgtctgatgctactttgtctccctttccctccatctcttcctcctcttttctctctcggatcactcttgggtttctttttcctgcatcttcccctccccccaccccattctctctcccgcagcacattcctttcttcctccatcctcccattttctttctcagcctctttcgccttctcctgtatctttccctatcctctttcactctcctttcttttttctttggcctcctgttgtcccctgtccccagcctccctgggaccggaggagcccggcaatgggtgaagctatggcctgcaaaacctcctcgttagcggagctcctgccccagagggtgggcctccaaaccagcccaaccaggggctcctgggggccccacaaggcccagacgccgttccacagaagggagaggatggcccagaacgggcggcgacgagcccgaagtcccccagcaaatgcgcagggaggaagtcgggccccaccgcctgacccaccctccccgcgccctcactcactgtcaggactgaggccgcctccatagccaccgtgcgcccgtgggtaccagcgcgctgcgcctccgcagcccagagcgaagggcggcccgggaccggggggcggccgaggaccgaggcccagcgcgcccggcccgagcagcgcacgggcccgcgcctccccgccgggcccggtgcccgcgagcaactgtcgccgccgctgtagccgtcgccgccgcgcctgctcggcgtcctcgtcttcggggtcgtcgtcgtcctcctcctcgtcctcccggctgccgtcgccctgggtcgcgcgccctgcgcccttggcctcggccgccagcaggttctcgatgaggaaggaggaggcgcgggccggcgtggcgcgcccgggctccgtcagctcgtcaggcatcgcggccgcgggcttctcgggctcggccgggctcctcggtccccgctggggatggtggcgcgcggctcccgggcgcacgcgcgggccggccctggagctgctacccggaccgctggcgtcgggccccgcagggcaggcggcggcctccgcgccgggctgggctgggccgggccgggagcgagtgcgcgccgacagctgatcgg

SEQ ID NO: 1198 - DNA, 5811 bp, Homo sapiens
atgatctcaggagatgtgtatgggttcagcttgacaaggggtggacttaccatggttaatactgagtgtcaacttgattggattaaagatgcaaagtattgatcctgggtgtgtctgtgagggtgttgccaaagaagattaacatttgggtcagcgggctggagaaggcagacccacccttaatctggtgggcaccatctaatcagctgccagcgaatatacagcaggaagaaaaaggtgaaaaggcaagactggcctagcctcccagcctacatctttctcccatgctggatgcttcctgcccttgaacatcagactccaagttcttcagttttgagacttggactggctctccttgctcctcaagcttgcagacagcctattgtgggaccttgtgatcatgtaagttaatacttaataaactcccttatatatatatatatatcctattagttctgtccatctagagaaccctaacacaagtgttttcttcattttccttcatatttatgaagtgtgctttcttgccatcctttccagactcatcaccttatgttattagttgactttttaaaaatcattattattatttgagatggagtctcgctctgtcacccagactggagtgcagtggtgtgatcttggctcactgcaacctccatctccccagttcagccgattctcgcgccttagcctcctgagtagctgggactgcaggtgtgggccaccacgcctggctaatttttgtgtttttaatagagatagggtttcaccgtgttggccaggctggtctcaaactcctgacttcaagtgatctggctgccttagcctcccaaatcgctgggattacaggcatgagccactgtgcccagcctctaactctcttttaacataaattaattcctcttcctatatttgttctcagtgctattgacttcctgaagaaactgtgtcaattctcatgtagagtttttacactagggatacagtcacttgcttctttatacttcatgggataccttgtaagtctccagtgcatcacacctggaggcatatgatgtctgctggtcttgcttttaatgatgctaagatctatctttaggttcaggcaatggcaaccttacccttcactgagaagttctccatcaacctttcactgagtgattttggcatccattgaaaaccattgcttgaatcagttattttcttaggggcttaaaaaatgataattttctgattctaattttttcttcatgtagtagctgaaattcttctgcatagaagagctttccttcattcattttggctatttaattaccagaaaatgcagttaggcataaaaaatgcttaattcttttcctttaattaacaatttttagagtaataagttggtgccccaacttccccaacggtgcccagtaacttttattttctttctgtatcttcttttcttctcctgctctttttcatctgctggctagaagtagggtacttcaataccctaggagatggcaagacctcatgaaggaagttgcctgggtccctgaatgactacatggagctaattccttcctgtgacttggggaagaatgggactgtgatgggaacaagaaatgagctttcttagtcacaacccactgagattgtgatggtttgttacagcattgaccctatcctgaccaaacagctattacatttttattcttttttattttttttttaaattctttttgagacagagtttagctcttgttgcccaggctggaatgcaatggtatgatatcggctcactgcaacctccgcttcccaagttcaagcaattcttctgcctcagcctcccaagtagctgagatttcaggcgccccccaccaggcccaactaattttttgtatttttagtagagaccggtttcaccatgttgtccagactggtcttgaacttctggcctcaggtgatccacctgccttggcgtcccaaagtgttgggattacaggcgtgagccactgcgcctggcctacatttttaatttctaagagctctttcttgttctctgattgtttcttttccatagcatagtgttcttgttttatgcatatctcttctgtttctgatgatgtttaactcttaatgacacattcttctgttctgtgcatttttttctgcctctcctgacttcctttttattgtttgtgggttttgctctcaatttcaactaaaactagtttaacatttatttggaggaggaacaacattatgtggaggaaggtttagaaaaaggaaggtttcttttgacagtccttggcttctctttcctgtcctaaacaattcagctgtggtccacatttgctcaccctaattactagcaaagcaagagcctaatatttacccagacagaatcttctaggaaggcaatcaactcccagccattatgattgaggcatgcctcttagagaactcactgacattccaagcagcttatcaaacaatccttccaacacttcattttctcaggttttagcacctcttacgaatgagtgtctgagcagccaaaaaataaataatgaatcatccaggcaaaggggaagaaaaatggacttggccagagatggggaagaacgtacgcaaaaaggtgagatgagagggagcctaggtaatatgacttattacaagcagagcagctctgcggaggggtggataatgaggagggctacaatgcaagatgaggcagaaagaaaggtctgggccagactaagcgggggctcctaagccctgttcttgacgttctcatgaaatacttcaggagagagaacacaccctactggggaactggggagaagttccatttgaaccagacctggaaggaagactgggacttgttaaaacagataacaggctgggcgcagtggctcacgcctgtaatctcagcactttgggaggccagggctggcagatcatgaggtcaggagatcgagaccatcctggctaacatggtgaaaccccgtctctactcaaaaaaaaaaaaattagccaggcatggtggcacacacctgtagtcctagctacttgggaggctgaggcaagggaattgcttgaacccaggaggtggagcttgcagtgagccaagattgcaccactgcactccagcctggtgacagagcgagactccatctcaaacagacaaacaaacaaacaaacaaaaaaacagataacaatagaagtaccattgaaatatatatatatatatatatatatttttttttttttgagatggagtctcactctcccaggctggagtgcaatagcatggtcttggctcgctgcaacctccgtctcctgggctcaagcgattctcctgcctcagcctcctgagtagctgggattacaagtgcgtgccaacacacccagctaatttttgtatttttgtacggacggggtttcaccatgttggccaggctggtcttgaattcctgacctcaggtgatcagcccacctcatcctccaaaagtgctgggattacaggcatgagtcaccgtgcccggcccattgaaagattttcaaaagggattaaccatgatcacatctgttcttagatgaggtcgttcagattggaagttggattggagggcggaccaaaggagaagctgctgaagtagatgttaaagatggagagaagtggacggcagagacatagaggaggaaaagtcagcaagacccgagatgtgtatggagagttagagtgtgggaagtgtgacatgtaactgaatcggatgatggcaactttcactgggcagtgaaaggtcaggttggtggtaaaagtcatgagttgactttggggcatcttgatatagtcacttccaatatcatgtgtttcaacaagcccgtgttccttcctggtcagttcccccagctagagtgtgttttacatcccgcagcattgtatgagaactgctagaatatcactcaccacttcccatagagattctgtttgttcatctgcttgtcccactgtgtgccttacacatagtaggtgctcttggaatgtgtgtgagatggattaacatgagaagtgcttctctgcatgatttcaccattgaagtgttgaaagcaactagcactcctccttcctgacctccaggcttccacccagctgtggggactgctgtggtggaagggcctagtctgaatctggacaggggaggtgcctgcaaatattttcgtgcctgcaaatatttttgtgcctcgggacagatggatgtccagtttactgtctgcttcctcagtggttctagaggtaattgcatcctgctgtgtacagttaggtcgtggaggagacaggcaccttctctcgtctttctggaaggtaaccagaggtctttcccctttcctatcatggcagctgctcagtcgcaggctccagatgtctgcttcagaattcaagaacaccttcctgagctgggaaacagatccaaggaaatatcagccagaggcttcattttatcatctgtggaaatgcaagatgttagagcacctaggagggtcttaacgtgcaaaacactgtcttgaggctgcctgcagaacagagggtcatctgctttcattagattctcaagggagcctcaacaggctacacctgaaccccaggtttggggcatctctccagccctcccagctctgacatcatcatcaccattaacagctgaaatgtgtgaggtggttgggatgtaccaacaaccctcccaagagtcccatatctacctgacctcatttgaccttcacagcaacccagtgactcagctgctatttggcccacgttttacaaacctgagtcagtgtgctttacctcagtgacccaagaacccaggtgctagagtcaggcctgcatccaaatcaggggtgggatcagtggtgtgccctgaacaaatcattatcctcttttttgttttattttttggagacagagtctcactctgtcacccaggctggagtgcagtggtacagtctcagctcacagcaaccactctctcctgggttcaagtgattctcctgtctcagcctcccaagtagctggggactacaggtgcgtgccaccacgctcagctaatttttgtgttttagtagagacagggtttcaccatgttgcctaggctggtctcgaactcctgagctcaggtgatccacctgccccggcctcccaaagcactaggattacaggcgtgagcaccccacccagctcattaccctcttttaacttcaattttctcatccacaaaatgagggcaataatctcctttcttccccactagccatgttcatgaaagtacttatttgcccattttaaaatatgtagcaatgtgccccagaaaggctggggcatgagtcctgcttggggtggagcagggaaggcctgctctgccccactggggtgtcctcagatgaaagtgggtgtgggctgactttctctgagctccctgtggagtcacacggggaactgggttgagtcacagcacaagggcactcacatgccccaccccgaggaggtccctgttctgacagaagccctgagccgtgactgtggactgacacccactgcctctgtgaccttgggtgggttacataacctcccacatgagaaggaggcggaggcacccgggcttgtggcctgagctaacctgggtagtgggagccctatctgtgaattgccaagggactgccatggggactggtgagaacacagctctgcaaggcccttttgatttgttttaacctttaacttttcaaaaatttcaaatttaaaggatgcatgacacagtt

SEQ ID NO: 1199 - DNA, 86611 bp, Homo sapiens
agtctgaagagaggcgggacgcggggtgataacagctggctctggtgggcgggcgggagctggggaggaggagcaggagaggcccacaggcttcatttggagtcaggcctggctgttgctcaggtgaccagcttgtgtctctgggagggcgctgctttccccggccacccggcgcgatgatccagaatgtcggaaatcacctgcgacgggtatggagggtgggctggggcagcgggagggctctggaagctgggcacccagaaagagattgatgtttccattttaactcagacgctctgcatctcctcacactctccacgggccattttctagctctctttggaaggagaaatcgcagaacccctgggctggtttattatcagcagcaatctccaaacaagccccaggggctgtcagatcccccacgggctggctgtgtagagtggaatcaccttcagcaagtgtcggcctctggaattctattcggtgggtgtatgtttctccctgcagagttctgtgtatgtttctgggggatgtctgagctccatggccttgtggtgcttcatgctcagagctcaggaccccaaagccacaaagctgatgggagtgacagggtgtgaggtatgggtgtgagtgagtatgtgtggtggggtgaggtcggcgttcttggggagcagaacctcttggggagagcaagcacaggatcacatgacggctgcggaaagctgtcctgcaaggtgaccttgaagagaacttttccctgcgctttggagctgagattagttgctgaggcacacggcagacccaagtgcccagcagcgcctggcagtggatggagtgtatggagatgggctcaggacagactggcagaggttgtaagactggcagaggctgacctctgaggatattttcaggaaaagcctttttttaaaggggctggaacaattaaatgtcttatctatcctctccctccatctgcacagccactgcacaactcagcatcctcaccgggccctgtgcatcttgtctcccctggctcccccattccatgtcagcccctttcagtccactctccacactggagggatgcttctaaaaagtaaatgtgctgactcctcacctgctcacacggctacccgaggatgattttcacatcccttacttgagacgaagggatgttggcactctggctcctgcccatgcctccctttttcttccaccatccccacccctctgctgtccctgcttcagccatagtgagctgctctccgcggcttcggtgtcccacttttgttctctcctccaggctgttgtacttgctatgtcttctgccggagttacccccagccttcctgcatctccccaaacttgtgtccccagcaagttccttctgagccctcagatctcagctcaggtgctgcctcctctggaagtccttctcagatttctcatgacaccatgagcctctgtgttagccccttttcacactggattgtgtgctagactggcacatacatccctcccaccagccagggagcaacacgaggctgctcttggtatacccagcacggggacgggtgtggccagaggccagggaatgcttaatgaatgaatggggacaggcagcttttcagcagcgaggctaagggtgggatctgagtagcagggccgcttgctcttgtcacctgagtgcagggcagagtgtctcccaggagggaggggctcctcgtatcttctcttgtgccctgttgtatttaaccctttatgactttttccttcatcagtaactgggggcaaggcactggggaagaggcatatcgttatcactgttttacagagataacaatagtaacaaatcttcacatagctctttgcatttatgaactcattcagttctctatgaggtaggtacagttatcatccccgtatcccagataaggaccctcacagagggtaagtgacttgcccaagatcacactggtaggaagtggcagagctgggattagaacccagcagtttggccccagagtctgagctcttaaggagcctgaggctcagccagatgaaggcgcagatgtgggattccaacccacacgtcctgactctgagcccagctggcattcagcttccttgcactacctttgttgagtctgggggtggaggtgggtattgggagtggaagttgggctcttgaggacacaggtagcctcctgtcagctaagaacactctggccttgattgccacctctgcaccattgtctggatggcagatctctttggatttctcttgaattcccttagttcctctggaatacaagagggtttgggaacattttctggcttggtaccaaagctgtttttaatgaaaagcaaacaagcaaacaaataaacaatccctggccagctgtggtggctcacacctgtcatcctagcactttgggaggctgaggcaggtgaattgcttgagctcaggagtttgagactagctaggccaacatggtgaaaccccatctctaccaaaaatacgaaaaaaaaaatagctgggcatagtggtgtgcacctgtggacccagctactcgggaggctgaggtgggaggatcacttgagcctgcctgggaggcggaggctgcagtgagccaagatcatgctactgtactctagcctggatgacagagtgagatcctgtctcaaaacaaaaacaaaaacaaacaaaaaaccccaccaagctgggtgtggtgacccatgcctgtaatcccagcactttgggaggccgagacgggtggatcacttgaggccaggagttcgagaccagctcggccaacatggtgaaaccccatctctaccaaaaatacaaaaattagctgggcatggtggcatgctcctatagtcccagctactcgggatgccgaggcaggagaattgcttgaacccaggaggcagaggttgcagtgagctgagatcacaccactgcactccagcctgggcgacagtggtctcaaaaaaaaaaaaaaaaaaagaaaaaaaaccagcaacagcaacaacaaaaaactcaccaaattgtctttaatagggactaaactgggaacagaagagggggtctcagataatccacaagccccactttgcatggttgggggccattttcagtgtcctgtggcactgtagacagagtcagcattggagttcaagggctctggtccctactcgcccctgggtacccagcaagtgagtgggcgactgaatgaagtggtcagcctgctgccacgctcggggctgggagaactgctgagtgcagtgtggtggtgcgggaaaggtctccctgtcccgcttcaatccttgcctctccccgtggagagctcttctttccctttccaagatgtcagtctacactgggcactgagtctcacatttctgggctagcagggacccactggtgccctcgtaggaggtgggcaagggtcctgggaagcctgggaacctctgcccagcctcaggtctagcctggcccaggtcagctctcagtggggctcagaagctttttttactccagaaatggtgatggggctggctgtttttgttttgtttttgtttttgttttgttttgtttttgtttttgtttttgtttttgtttttgttttgagatggagtctcattctgtcacccaggagtgcggtggtgtaatcttggctcactgcagcctctgcctcctggattcaaggaattctcctgcctcagcctccggagtagctgggattacaggtgcccaccaccacacccagctaatttttgtattagcctccaaccacacaatgcaatcctactgttttaccttgaacctgaggacagctggagggctccccacaacctctcagcttcataaggggtctaacccagagtgtggggaggttcaggcacaacagttggatgttcaccccacggttcacggtgtgacctttggccaggggttcctctctctaggccttagggtgctgggtgatccctgaggtccccaccagcctggacatcctggggctctgaatgtttgtgaagggtttgtctgccaccatgaagttgatcctgacagtgagaggcagggtcccgtctctcttgaggaccctactctgtgttggaggtggggagaccttagacataaaatgatgggcctatcatatacgaggagtcccaaaactgctgaatgaatgagtgaccacaggtgctcagaagcaggctgaggtggtcctagaaggcttcctggaggaagaggtgagacttgaacatgtagcatcagcctgttcaggagccatatgtgaacccccagcctcagccatgggcagacactcttagtgttttttttgtttgtttgtttttgaggcagagtctcactctgtctcccaggctggagtgctggagtacagtggtgccatctcagctaactgcaacctccacctctctggttcaagcgattctcatttctcggcctcctgagtagctgggactacaggtgcgtgccatcggctaattttttctatttttagtagagacggggtttcaccatgttggccaggctggtcttgaactcctgacctcaggtgttctgcctgccttggcctcccaaaatgctgggattacaggcatgagccaccatgcccggcccactcttagtgttgttgttgttgttgttgtttgtttttgttttgttttttttttttttgagacggagtttcgctcttgttgcccaggctggagtgcagtggtgctattttggctcaccgcaacctctgcctcccaggttcaagcgattctcctgcctcagcctcccaagtagctgggattacaggcatgtgccaccatgcctggctaattttgcatttttagtagagatggggtttctccatgttggtcaggctggtctcgaacttccgacctcaggtgagccacccgcctaggcctcccaaagtgctgggattacaggcgtgaaccaccatgcccggccagtgttcttaatttatctggaggactctttttttgctctccaaaattttattttaatatgcatagcataagggaatgattacctcattaaaaaatttttttttaatgggccaggcatggtggctcatacctataatcccaacactttgggaggccgaggtcggtggattacttgaggtcaggagtttgagaccagcctgaccaacatggagaaactgtgtctctattaaaaatacaaaaataagctggatgtgcccagttgaacctgggaggtggaggttgcagtgagccgagatcgcgccactgcactccagcctgggtgaccgaacaagactctgtctcaaaaaaacattaaaaaaaaaaaatggacaggtaatattctatgtttttatcatgtacaaatgatgttttgaagtacgtatacattatgttatgactaaatctaattaacagatacattacctcacatagttttcatttttttggtgatagtgcagaacatctactctgcatttttcaagaatacaatatattgtcattaaccgtatcaccttactgtataatagatctcttgaaatttattcctcctaagtgtaattatgcatcctctgactaagatctctccatccccccaacaacccctgcctctgataagcagcattatactctatttccatgaaatcaactttttaagattgatgtctgagtgaggtcatgtagtatttgtctttctgtgcctggcccttatttcacttaatataacatactctgggggaggtggctcgtgcccataatcccagtacttcgggaggctgagatgggcggatcgcttgagctcaggacttcgaggccagcctgggcaacatggcaaaacccgatctctacaaaaaccacaaaaattgccaggtgtggtagcacgcgcctctagtcccagctagttgggaggctgaggtgggaggatggcttgagcctgggaggtgaaggttgctgtgagctgaagttattgcatttcagcctgggcaacagagccagaccctgtcacacacaaaaacaaaaacaaaagaaaacaaaaaaaaaaactccaccataacatactccaggttcatccatgtagttgcaaatggcaggattttattttatttttatggctgaatagtattccatagtgtgtgtgtgtgtgtgtgtgtgtgtgtgtgtgtgtgtgtgtgtatatatatatatatatattttttttttttttttttgagatggagtcctgctttgtcacccaggctggaatacagtggtgcaattatggcttactgcagcctcgagctcctgggctcaagcaagcctcctgcctcagccacctgagtagctgggaattagaggtatgcaccactgtgcccagctaattttttttttaagtttttgtagagatgggttctctctatgttgaccaggctggtcttgaactcctggcctcaaactatcctctccccttggctgttgggattgcaggtttgagccaccacacccagctttataccacattaaaaaaatccattcatccactggtggacacttagttggttccatgtcttggctattgtgaagagtgctgcaataaacacgggagtagaggtatctcttcaatatactgatttcatttcctttggctatatacccagtagtgggactgctggatcatatggtaattctatttttaattttttgaggaacctccatactgttttccataatggctgtaccaatttacattcccatgaacagtgtcaaaaggttgccttttccccaaatccttgccaacacatattgtcttctggttttgtttgtttgtttgtttgttttgagacggagtctcactctgtcgcccaggctggagtgtagtggcacgaccttggctcactgcaacctccgcctcccgggttcaagtgattctcctgcctcagcctcccaaatagctgggattacagacattgcgacaccatgcctggctaattttttgtattttcagtaaagatggggtttcaccatgttggtcagcctggtctcgaactcataacctcatgatccacctgccttggcctcccaaagtgctgggattacaggcgtgagccaccacgtctggctctggttttttgatagtagctattctgacaggtatgagatgctatttcattgtggttttgatttgcatttccatgatgattagtgatgttgagcatttttttcatatacctggtggacatttgtatagcttcctttgagaaatgcctattcaggtcttttgcccattttaatttttttttctattgagttgttttacttctttgtatattttggatgttaaccccttgtcagatatatagtttgtaaatattttctcccattctgtaggttgtctcttaactctgttgattggttcctttgctgtgcagaagtgttttggtataaagaaatcacatctatttttgcttttgttgcctgtgcttttgagaccctatccaaaaaattcttacctagcacaacgtcatgaagtgtttcccttatgttttcttctagtaattttgtagtttgggggtcgtacatttaagtctttaactcatttttattttttattttttatttttttttgagatggagtctcactctgtcgcctaggttggagtgcagtggcatgatctcggctcactgcaacctccgcctcccaggttcaagtgattctcctgctgcctcagcctcccaagtagctgggatgacaggcacatgccaccacgcctaactaacttttgtatttttagttgagatgggatttcaccatgttggccagcttagtctcgaactcctgacctcaggtgatccacccgcctcagtctcccaaagtgctgagattacaggtgtgagccactgcacctggcctgatttttttatacagtgagagataagggattgatttcatttttctacatgtgggtttccagttttcccaacatcaattgttgaatagactgtcccttccccaatgtgtgttctggcacctttgttgaaaatcagttggctgtaaatgtgtagatttattttggagctctctattctgttccattggtctatatgtctgtctgtttttataccactaccatactgttttggttaatgtagctttgtagtatatttcgaaatcaggtagtacagtatgatgcctttggctctgttctttttgctcaagattgctttggctatttggggtcttttgtggttccatatgaattttaggcttgttttttctgtttctgtgaagaatgtcattggcactttgatagggattgcattgaatctgtagatcactttgagtagtatggacattgtcaccataattcttctgatccatgaacatgggatcttttcatttatatcttcttcaatttctttcattaatgatttatagttttcattgtagagttttttttttttgagacagagtctcactgtgtagcccaggctggagtgcagtggcatgatcttggctcactgcaacctctgcctcctgggttcaagtgattcttctccctcagtcccccgagtagctgggattacaggtgtgtgccaccatgcctggctaatttttgtatttttagtagagacagggcttcaccattgttggcaaggctcgtctcgaactcctgaccttgggtgatccgcccaccttggcctcccaaaatgctgggattacagacgtgagccatcgcatctggtcttcactgtagagatctttcatctcctttatttattttttaagagacagtgtttccctctgttgcccaggttggagcgcagtggtctgatcatagctcactgtggctatgaattcctgggctcaaatgatactcctgcctcagcctcccaagtagctgagactacaggcatgtgccaccacacctggcagattttttatttaaaaaaattaaaaaaaatttttatacttaggccaggcatggtggctcacgcttgtaatcccagcactttgggaggccaaggcaggcagatcacaaggtcaggagttcgagaccagcctggtcaacatggtgaaatcccatctctactaaaaatacaaaaattagtcaggtatggtggtgcgcacctgtaatcccagctactgaggaggctgaggcaggagaattgcttgaacccgggaggcggaggttgcagtgagccgagatcatgccactgcactccagcctgagtgacagagaaagattccatctcaaaaaaaaaaaaaaaaaagaaaaaaattaaattatttatctacccttgtgtgcactgaaaaaaacattttaagagatagagtcttgctatgttgcccaggctggtttcaaactattgggctcaagcaatcctcccacctcagcctcctgagtagctggaattacaggcatgagccaccactcctggtttttacctccttggttaaatttattctcaggtattttattttattttatttttcgtagctattgtcaatgggattgttttccagatttcttttttagatagtttgctattagtatatagaaagactactgacttttgtatgttgattttgtatcctgcaactttactgaatttattattcctaccagttttttagtggaggctttagggttttctatatataggattatgacatctgcaaacagggacaatttaacttccttctttccaatttggatgccttttatttctctctcttgcctaattgctctggctaggacttccggtattacgttggatataagtggtaaaagtgggcatctttgttttatcccacattttagatgaaaagctttcaacttttccctgttcagtggaggactctttttcatctttcaaaacccagctgggctatcatttcccctttgaatcctcatcttgtctgtccctagagttaatgacgtctcctcaggatgttgtatatacttcactcgttccctccacgggtacttactgtactgggggattaacagttagccagtgctgggtatgctgtggccaatgatatatatagcctgtttcctggagctgacagctagtgcaggagagatagggagaaggtattcaaataaacaatgatgaaaatctgcaataagtgctatgaatagtagtaataacagtaaatgccatacaagtgctagctgtatgccatgcctgcagtaactcattattccttataacaactctgtgaagtagataattgtgtccgtattaaagatgaaactgagacagacaggttaagtaagttgcccgaggtaacacagctagtaagtagcattgctgggattaaattgagactgtctggagaacagggagctgtgagagaatgatgagggggtcaggggagagctctctgagcagacgacagctgagcagaaagctagcagctgagaaggcagccttgggaagatctgagggaagagcattccagccaaggggaacagaatccattggcaggctccaaggctggggcgagcttggtgcatctgagcagctgaataggggcccagcagcccctgctgctcactcctcactccacttggagtggagggagcaaagggaacagctggaagaggctgagggcaggcttccaggacctgcaggctgggggtccaggccttgtaggctgagtttgggctttcgagcgctgtgggtcatgttgtcttgcctacctgcctgtgagagccatgagggctcccttgtccccaggcttagtgccaagatatgcagttcccgcacgctgggctcagcgacccagggaaacacatcatcatggttccccttctttgtatggccagcaccttgaaggtctcagctgcctccccattcaccccctgactcctcacaacagggaggtgggtaaaaggctcagcccccgtgagagacgaggcacagagaagtgaggtgacatgcctgggtttgcacacctggcaagagacccagagctctcatctgctagactgggtccccgtttccagcccttgtcttggctagcggggcatctggaacttccgtgcacctagaatgtggcctcactgttacatgtggacccaccccatcccagcctcctctgcccaccctcacacactgacagtgtagattcagggccccaggctgagctgaccccaccccacacacctcagggtcgagggaggctgcccactgcccctcacctgtgcctgggctggagcagggccaagctggcatcccgggagccttcggagagctgctcatcactcggcccgatgacgaaaagggtgctgccttagaggcactcactcacctcacctctgtgggcatcagtttcctaatatgaaccagttctcttcctgcagatcatgccaaattgttgtcaggaatagagatgttgaaaaaatggagaactcggcacataattggccatggtgaatagttttctttttttttttttccatctcatgtgaacctcagttttctcagtggttcaatggtagggtcagttggtcagatgagatggtgaaagcaaacttttctgttgaggacctactaagtgtcgggcatatttaaacttcccaacagctttgcaaggcttctggtatttatctggctttacaagttagaaaaccaaggctctggtatgaagccactgtgatctaattagagaattcaaagcctcatctgaccccaagctccagctgggcaggggccctgggtgctgaagctcctctccttgtcctgggctgacctggctgagccaaggaactgacacctctgccttatgcctgctctgtcctgtggctccagggacagatggtgctgctggctgggtcctctgccagctccctggctgcaggcctgtgtgctcctgccattcccaggggcagccttgcgggttagaggtgacattggggcagtgacggactggggcagaccagagtctgacactttggggacacagggatgagccagactagacgtgtcctcagatgccctcaggttgatggagagacagagggaggtacaaacctactatggcagcacagcacagcacagccaggatgtgacagagggaagcaccaagatagcccctcaccagcccagtggtcagggtgggctccctggaggaggtgatgggttaggttggccctaaaagcttttctgggttaggaagaatgatccaggcagaggcacctgtatgtaagagatgtgaaggagccaggtccacagagaaatgagggagttaagggcaccctccttgacccccttgtccatgtaatatgtatatcctgcctagggcttcttcagtagtaataatttgtcctcagcaaatgatatattaactaattaatatcagtggacgtgaattattaagcatctgtttttgttttctcgagacaaggtctcactctgttgtgcaggctggagtgcagtggtgcgatcatagctcactgaagccttgaattcctaggctcaggtgatcttcctgctgtagcttcccctctcagcctcccaagtaactggtacacctgacctagcaaccaaaagaacaatgtgtcaactatgcttggctatttttttttttttgagacagagttttgctctgttgcccaggctggagtgcaatggcgcgatcttggctcactgcaacctccgcctcctgggttcaagcaattccccttcgtcagcctcctgagtagctgggattacaggcgcctgccaccatgcccggctaattgtttgtatttttagtagagacggggtttcaccatgttggccaggctggtctcgaactcctgaccttaggcaatctgcccacctcggcctcccaaagtgctgggattacaaggcaatccgcccaccttggcctcccaaagtgctgggattacaggtgtgagccatcgtgcccagctgcttggctgattttttattttttttatttttttttattttttaaatttatttttttattgataattcttgggtgtttctcacagagggggatttggcagggtcatgggacaatagtggagggaaggtcagcagataaacaagtgaacaaaggtctctggttttcctaggcagaggaccctgcggccttccgcagtgtttgtgtccctgattacttgagattagggattggtgatgactcttaacgagcatgctgccttcaagcatctgtttaacaaagcacatcttgcaccgcccttaatccatttaaccctgagtggacacagcacatgtttcagagagcacagggttgggggtaaggtcacagatcaacaggatcccaaggcagaggaatttttcttagtgcagaacgaaatgaaaagtctcccatgtctacttctttctacacagacacggcaaccatccgatttctcaatcttttccccacctttcccgcctttctattccacaaagccgccattgtcatcctggcccgttctcaatgagctgttgggcacacctcccagacagggtggtggccgggcagaggggctcctcacttcccagtaggggcggccgggcagaggcgcccctcacctcccggacggggcggctggccgggcaggggggctgaccccccccacctccctcccggacggggcggctggccgggcggggggctgacccccccacctccctcccggacggggcggctggccgggcagaggggctcctcacttcccagtaggggcggccgggcagaggcgcccctcacctcccggacggggcggctggctgggcaggggggctgaccccccccccacctccctcccggacggggcggctggccgggcagaggggctcctcacttcccagtaggggcggccgggcagaggcgcccctcacctcccagacggggcggctggccgggcggagggctgaccccccccacctccctcccggacagggcggctggccgggcggggggctgacccccccaacctccctcccggacggggcggctggccgggcagaggggctcctcacttcccagtaggggtggctgggcagaggcgcccctcacctcccagacggggcggctggccgggcggagggctgacccccccacctccctcccggacggggcggctggccaggcggggggctgaccccccacctccctcccggacggggcggctggccgggtgggggggctgacccccccatctccctcccggacggggtggctggccgggctgaggggctcctcacttcccagtaggggcagccgggcagaggcgcccctcacctcccggacggggcggctggccgggcggggggctgatccccccacctccctcccggacggcacggctggccaggcggggggctgacccccccacctccctcccggatggggcggctggccgggcggggggctgacccaccccccacctccctcccggacggggtggctgccgggcggagaggctcctcacttctcagatggggcagctgccgggcggaggggctcctcacttctcagacggggtggttgccaggcagagggtctcctcacttctcagacggggcggccgggcagagacgctcctcacctcccagacggggtctcggccgggcagaggcgctcctcacatcccagatggggcggcggggcagaggcgctccccacatctcagacgatgggcggccgggcagagacgctcctcacttcctagatgtgatggcggctgggaagaggcgctcctcacttcctagatgggatggcggccgggcggagacgctcctcactttccagagtgggcagccaggcagaggggctcctcacatcccagacgatgggcggccaggcagagacactcctcacttcccagacggggtggcggccgggcagaggctgcaatctcggcactttgggaggccaaggcaggcggctgctccttgccctcgggccctgcggggcccgtccgctcctccagccgctgcctcccgggcggcgctcgctggcgcggcggcaaagactctgattttttaaaaatgtattctagagatggggtttcgccatgttgccaaggctggtcttgaactcctggcctcaagtgatccttctgccttggcctctgaaagtgctgggattataggtgtcagccactgcacccagcttaagcaacttggagaggcagcccagtgagtagaaatggctttggtattgagaaaagcgaaatctcagctccatcgctcaccggcagagtgccattagacaaggcttttataacccaagcctcagttcccttttctgtgcaggaggaataattgtccctcacagggttttggtgaggatgaatggtgttatggatataaagcaattttatataatgtatagaaaagcctgaaacttagtaggtgcttagtaaggatgcaccaggattccagagacacatgagatgtggcccctgtcttcaaggagtttcttattaccacatgtgtgtattcttttacagcctagaaagctctatgggccaggctcagtggctcatgcctgtagtcccagcactttgggaggcagaggcaggaggatcccttgagcccaggagttccagaccatcctgggcaacacagacctcatcttactaaaaataacatttaaaaaattgggcttggtgccgtggctcatgcctgtaatcccagcactttgggaggctgagggagcggggggcggatcacttaagatcattagttcaagaccagcttggccaacatggtgaaaccccatctccactaaaaatataaaaattagctgggtgtggaggcttgtgcctgtaatcccagctactcgggaggctgaggcaggagaatcgcttgaacccagaaggcggaggttgcagtgagccgagattgtgccactgcactccagcctgggcaacagaatgaaactccatctcaaaaaaaaaaaaaaaaattagccaggtgtggtggtgcgtgcctgtagtctcagctactcagctactcaaggggctgaggtgggaggattgcttgagcctgggacgtagaggctgcagtgagccatgatggcgccactgcactccaacctgggtgacagagcaagaccctgtctccagaagaaaaagaaaaaataaaataaaaaaagaaaaaaagaaagaaagctgtgcacagctttacgtcgtctgttattcagaagcctggtaggtcagtgcttggctaacagcacccgggctgtggcccagagaggaccaggttcaggttgcctgcggggggtggggaatctcaggtctctccactccttggcattgtcttatttacgacctctagaataggctgtgatctgccctggggcgtggccctgcccaggtgtggccctgtgccagacgtggactcggtgagaggtcggaaggggagtggccttgggacttcctttcagcagcctctggtttccagcaccacacctgggccgagctgaagcaggtaggtctgacttttcttttgatcccttagggagggtgtggagagacccaattcctctttttcttctccagggatacagccccgtgagtggtgggagggacaagtgggaggtccgaagtcggaagactctggctggttcttgaccggctctcttccccagcctcagcttcctcattcataacatagggatgtcggggttggggcggtggggggtgataatggtccctgcaactggagcctgcttcgtgccaggtagcttaatgccatggcaggtatttacagagaaggggtgttaagagatcagatgtacatgtgcctataggctttgagagcagggcgaacatgggagaggaaggggcccaagcataaagtgactttggggccaagggaggggccctttctgaagagagtccaaggggaaaagcatagccttgcatctcagcaccgtcttcccccacaccaccccaggccctccttggcctttgagtttacttggtccccaccctccccttgcttttgaagactgaactggagcttccaggcagcaaggcaaggagaaggtgtgtctgtgcagactggttctcagctgggaaaacaggaaggcaggccttctggatggggagtcgaggcagtgatactctttacccggcagatcccactgcctgggtgggatccacaggtcggaaaccacttctgcagtgagctcttttcctataggctcatatcatgcagaaggtaggagtgctgggaggcaactgataacaaggtgtccaaagtcccaggctgtgtatcagaagttccagttgttgggtgacctgatcgccctccagctgatgtcccctctgctgcactcctgccaggctctggagtcagaaggacccaggtccagtctcccctttgccttttactggccaggagtgcatgggtggccctttccttgttccctgtccatttcctttctcttatctgtaaaataaggaatgaggaggattcctgcttcagagtgagaattaaagggcccccaagaacgagacctggcatacagtaggtacatggtaagtagcagtcatagatttctgaaaagggatctttgagcttctgcaaaggcaattcttagcccccgtcctgtagaaagctctcttgtctcagtaggatccctcctactggatctgtcccaggaccagatgaaccaaccagctttagtatctcccagactctaggcaaacaaagccccttccaactgctaccttgtttctttgctgccttttcccacacacattttggaaagagttttctctgttcccatggtattacctctcattctttccctaattcactctaactggactcctctcttccccctccctccctccttcctaccttcctgtcaaaaatcagtgatagcttgtttccccatctgccttgactcagagctcacgcaccagcagggcccccttccctctggagagccagactctcctggggtcctcccacctcactgactgcttgctcgcagactcctttgcagattcctcctccccacgtgacttctaaatagctgagtgtgagggcaggcatggtggctcacacctgtaatcccagcattttgggaggccgaggcaggcggatcacttgaagtcaggagttcgagagcagcctgaccaacatggtgataccccatctctactaaaaatacaaaaattagctgggcatggtggcgcgttcctgtaatcccagctacttgggtggctgaggcacgagaatcgctagaacccgggagatggagattgcagtgagccgagattgtgccactgcactccagcctgggtgacagagcaagactgtctcaaaaaaaaaaaaaaaaaaagccgagtgtgaatgtctctgtcaacccatcttcttggatgatgtctgttctagttacagtggctgtgtaacaaactaccccgaaccttagtagcttaaagcaacaactggtttctatcatcttgtgattctatgggtcaggaattctggcagggctgggctgggtggtttgtctgctctatgtggcattgatggaggctgcttagtggaacttagtggtggatgggctgaactgggggctccatgatgccttcactggcacctcggtggggagtgctggaaggttgggtttagctgggactgtcatttggagcacccacgtgtggcctcttcaatatgacagtcttgggatagttagattttctacctggcagctggctccactagagcaagagttctaagaggcctggggggaagctgcaaggtgtgtcatgatctagtctcagagtcactgttgaaatgtcactaaaaatgactcagattcaagaggaggaggttagactctacctttgaatgggaggagtagcaaaaattggtggccttctttcatttaccacaacgtctcaaaatcctgtggatcttaaatacccatatatgttagtgtctccaggtgtagcctcttctccagtgagctccaggcctgagttccttgattcctctctttaaatgtttaataggatctcacaaattcttgtcccctacttatttctacactgatctccccaactcagtaaccagtaccaccatctgccagtcactcattctaagcttggatcctcctttcttatttatttattttgacttttttccttttttttttttttgagatgcagtctcactgtgtctcccaggctggagtgcaatggcgcgatctaggctcactgcaacctctgcctcccaggttcaagcgattctcctgcctcagcctccggagtagctgggattataggcacctaccaccacacccagctaatttttgtatttttagtagagacggggtttcaccatgttggccaggctggtcttggactccggacctcaggtgatccacccgcctcagcctcccaaagtgctgggattacaggcgtgagccactgtgcctggccttttttccctaatttttatcctgcctaccacctcccatcatctccacgaccaagtcccctagccgctcgcaaaccctccctctacactgcccgcaggtgtagctgccgcttccctcgaccaccctctccaactggcaccaccctgtcccttctcacacacgtggagtccttcagcaagacctgttgcttctacctcccaaatacatcctggctccacctctctgcccagccagccctctcccctgactgcagtggcccgctgagcagtctgcctgctgcttctctccatcctaaagttcacctccacacagcagcagagtgatcttacaacgcaggccagaccaccaccctcccctacagcctccagttcttcccctcacacttggagtaaaatccaagctccactgggacatacaagaccttaggggatggggcagagtctgctctctgcatttcttaggtccttctgtcccaacacgtccctgttcttcctctgacagccggtccctgcgcttccttggggtttttgcactgtctgttctcttgtccgcaaccctgcacagtcttgtgcaattgctccttctcatcattccttcagatcctagccaggaagcctctttgattacacagcctaaagaagctcctccctgtccaccaccttctttctgttacatcccgttttttctttctcatagcacttttccctcttcttgttcctcttttgtttattgtctgttcatgtgagaagacactatgtctgtttaaggttttcccagcacctttttttttttttttttttttttgagacggagttttgttcttgttgcccaggctggagtacaatggtgcgacctcggctcactgcaacctccacctcctgggttcaagcaattctcctgcctcagcctcccaagtagctgggattacaggaatgcaccatcacgcctggctaattttgtatctttagtagagacggggtttctccattttggtcagactggtctccagctcccaacctcaggtgatccactcacttcggcctctgaaagtgctgggattacaggcgtgagccaccatgcctctggcccccagcacctttatcttttggcagaggctggggggcccagtgtggactgaacttcatgggagtttttagatttattttttatttttattttattttttaaaagacagggtctcactctattgcctagcctggagtgcagtgatgtgatcatagctcatcgtaaccttgaactcctggctcaagtgatcctcccacctcagccttccgagtggctggggtgtggctaaaaactttttcttttaccagactgggcaacatggcaagaccccatctgtgtaaaaaataaaaaattaaaattagctgggcatggtggcacccgtctgtagtcccagcaacttgggatgctgaggtgggaggattacttgagcctgggaggtcaaggctgcagtgagccaagattaagccactgcattccagcctgggcaatagacagagcaagactctctcgaaaaaaaaaaaataattttttttttttttgtagagatgggatcttgctctcttgcccaagttggtctcaaacgcctggcttcaagcaatcctcctgcctcagcctcccaaagtgctgggattacaggcatgagccactgtgtctggcagtgggagtttttaaaaagatttatgttgattcccagctagaatcggccccttcctaaccttgtccacccctttggggtcttggttttacactttactaggcctctttctgtcctctaatccagccagcctttggatttgcagccagaggcctgacacccaggccacacgcagcctggccccctcactgtccctccgacggcctggttgtcatcctgagccactccttgttccctctgttttccccttcacaggactgggcctcatgctgcctgccaaatgccagtcttgggctgtctcctccctgccactgagtcattccttcccgaaatgcactcccttcaccccccaacccctcaccacagggtgaagccttcaacagccacagggtgcccatttggttacagcaggaattgttattgttgagtgtgtggacagatgaaataataaggctgttttcccataaacaactattaagctggagccaccccagcatgcatacaacttaaaaaagtgatagcaacagaaaagcttaaatgcaggttgatagaatgagtctttttcattttcatctgcttggttttaagtttatgtgttacaacctttcaagtggtcatctaggaccaggtgtctcttcaggtaagccatttgatcacatgttgaatggagcaggtacatgtggtacttaattggagacagctcccaggttccattgaacacatatttactgagcacttacaatgttctgggtctatgcaaatgcaaattttgtccattcctaacccagtggtctgctcctgtgtgcccagcatgccttgttctcagtgaacccgagctgctttctagtgactgttgccttctattccaataatccatttccctcatgaggtgtcttgagcctctcgagggcctacaaaatgcaaaggcttcccagcagttgtggagtctggttagaccatatgtgggcgtctgcgggaggcttcgtagagtgccacagactctgtcctattccacatcttgattcttggttgaaatgaaccacaaaccaatgaattctgtcttggtagagagaggatgtgttcaactggcagtgccaggagggaaagcagatgccattgtcatagcccagggctgaaaggctccatctgacccccactgctctgcaaaggccatctggccagtcacagcacttacccttgggacctgtttaggcccttcctcactagaatggttttctgggtctttctacaacaccttgccctttttattttttgagacagagtctcgctgtcacccaggctggactacagtggagtgatctcagctcactacaacctccacctcctgggttcaagcgattctcctgcctcagcctcccaaagtgctggctgggattacaggcatgagccaccgtgcctggcctttttttttttttgagacagagtctcgccctgttgcccaggttggatggagtacagcagcaagatcttggctcattgtgacctctacctcccaggttcaagcgactctcctgcctcagcctaccgagtagctgggattacaggcacccgccaccacacccagctaatttttttgtatttttagtaatgacagagtttcaccatgttggccagcctggtctcaaactcctggcctcaagtgatctgcctgcctcggcctcccaaagtgctgggattacaggcctgccttggctttttaacaacatgaaggcacttcctatgagtcagatcctgttctaagcactttacatgtataatctcattgaatcccaattatgatattctctctctcttttttttttttttttaaagagacagggtctcactctgtcacccaggctgggtaactatgatattcttattcccatttgacagatgtggatatggaggttcagaatggctcaagtaaaatggcttcgggttatctagccagacagtctgaagcccttgggccttgctgtcctctttgccagcccccatgccttcctgtttctttcttctctctttctcttcacccttctgattatttcaataaaccttcttgtaggctcaaattcctctgagacagtgtaggaaaatatggggatgggagtggaattggaacaggtctgatagggctactttgcagccagagagcttgaggctgaaggcagcatctggagtgtggatggtgccgcgtagagagttgctggcacacctgctgagctcagctgcctctgccagagactagattgtgctcagctctggacctcctaatgcccagatttggcagcttgggccttagaagcagcaccacaggttcctctgctaagccttgttctgagacctgctctgcaacacctgcagtgtaagggcactccttcagtgagtaaaatcacagctcctctcccacctctctgctccgctcaggaatgttttcttgaacactcctgggaaaatgaaaatgttgttatgttgtgcaaggggaagctgggtaaggtgggaagaagagagccagaggatagcaggcctgggcaggcaggagggccctgggaaccatctggggccttggggtagtgagggggatgctgagtggggaggtgctgctgggggagctgggagaaggggccccactttctggggaggaagaggacatcatccccagcaggaagggcccgcaggaccctggagcagccgctggggccttgaaggggcccactgggctgctggtttcctggggcaggaagtcctggctgcagccagaatttggccaggggagggcagctcaggcaggaggaaggtgcacagtgggggaggtctggagcctgtcctcccttcctgctcgcctctcttctgcttgctctgttccctgccagcctctgtttttctctcgctctgacctctgcattgttccttccctcctgtctttgacgcctttcctttctctctctctgactctggtttcttctcctttccctctgctctctctcattctctctctcttgctctcctgaaggggaattgtgatgcctgtagctgctgtgcccagctccagggtaaacagagttgcttgcaggatggtagggcccgggtccattgcctggccacctgttgccatggtgacccagaggcagcacaggcagcagccttggctgtctggcaggtagggcaggggtctgaggaggggaagaggccgggtctgtccttcacagccccagaatggcccaccccaccgtcagggcctgtggcatgggggtgactgcctgtgaacatgggttctgtactgggtgctgtcaaagcagctcccctgagggggggggtcacacggaaagggcgggtcattcatacttggggtcagactcagactgcctgtgttctaatcgcttctggccacttttgtggtctgctggaggtagagggtgggaggtggcaaatagccccaagggaggaagccacagggaggcagctagtgagtgggacatagggaagaacaggcagatttgctctttagcagaagggtctcccttggaagggagtgagccctctgcttctgggagcaaacaagctcatgctggacagccaccagaggcagtgtggcgggctgagatttctgcacctgagagaggcctgtctagctgaacctgaggtttcctcccactctgagagctgagaatttataaagtacagttttcagctccctgagagtttgcaatttcctcactgacagtggcccagtgggacagtgttctggaaagtgccttgaccctggaccatgctggaaaagggtactgacaccatcacggcctcctgcagaggacataagggtagacagggaggggagcttcttggaagtcctggctccaggtatgggtcctggcctagcatgtctggttaaggaagagccggtggatgtcacagatgcctgggatgcagcagcaactgtcctgcctgccagatgagagagaagcagttgtacaaagtggtcaagcagtcttagcttttgcggtaagcagacttgggttgatgtctcagctctgccctttcctggctgtgtgattttgtgtgcatatatgtgcaagttaccttttctgagactttgtttccccatctgtaaaatgggaataataacaacattcaggtattaaggctgtgtgatgattaaaagagataatgtgtaaaaatattcagtacaggctgggcacagtggctcacgcctgtaatcccagcactttgggaggccaaggcaggaggatcacttgaggctaggagttcgagatcaccctggccaacatggtgaaaccccatctctactaaaaatacaaaaagtatccaggcatggtggcacacacctgtaatcccagctacttgggaggcagaggcaggagaatagcttgaaccccggaggtggaggttgcagtgagccaagatcacaccgctgcattccagcctgggtgacagagtgaaactctctcaaaagaaataaaaaaatgtggctgggcggtgactcacacctgcaatcctagcactttgggaggccgaggcaggtggattacctgaggtcaggagtttgagaccagcctgatgaacatggtgaaaacccgtctctactaaatacaaaaaattagccgggcgtgatggcgcatgcctgtaatcccagctactcaggaggctgtggcaggagaatcgcttgaacccaggaggtggaggttgtggtgagccaagattgtgccattgcactccagcctgggcaacaagagcgaaactccatctcaaaaaaaaaaaaaaaaaatagttcattacagtgcttggccacattaattaaatatacaaggaagaatgattgttctcaatcttacctgccgcccaccactttcggttttataaactgaggaagctgagtccggagaggttgaaacacttgctcctgttaggttgttagttttgggcataaggcagggacagcgcccaaacaatacggaggagctgaaccccggcccacccagcctggcccctgtcctgcaggttcctgtccatctgcacacagggtcagactctgctcacactctgcagcccagctgcccctcggtgtagcagatctcctagggaacttcatgttcagcggctgtctccctatctagaccttggctctgtgagggcgcggctcaggcttgcccacgctccccactccctgcaggcctgactcagtctctcagtaagtgctggcataaaaggaaggcaggaccatggcaacttacaaagctgttcatgtgttccctcctttgcacctcacaacaatctacaaagtatttgggattcccattttacagatgaggaaaccggtctgtggggggtgctcacttgttgaatgaatgaatggagagaggggaagcaagttgcccagagacctccccatcatccccaccccgctccctgtactgagggtggggccgggattcaaatgcaatctacctgtctcaagaacccactgtccaccagcaaaccctctttccacatttctgtttcccaaagtgagaacaaacgctgctagagtctggttgtttaggaaagacaagtccccatccagcccagctgctgcatcctctccagcctccttgacaccgcttcctcacacgtgcacaaaactgcacagttagccaggtgcctttagcttctctcctttcatccacatgcagcaattcatggagctgggtgggagtgcttgtctttctttaaccaaggaggaaacagcttctcaataacttgcccaaagtctgcctaactaagccctttgactgaagaccttagacagagagccccctggggctcagtttctccacccatacaagcaagcaggtgtcttcaaagccctattcacctcgtggtgccgaggaaagggctgtgctcgagctctggctgggcaccttaggcaggacttgagatgtctctgagtgcgggatccctatgtacctcaccagtgatagcacctcacatatttgcttatgggtcaaatgagatgtgaatgggaaagcattcaggaaatgccctccctactcccccaggcccctggtggtcacctctgggacaggggcaattctcaagatgacccacagagggtaggtgtcagatttcagacaaggttatttttacccttgggggtggagggaggcaggtgacatttggactgacagttctagaatggggtgagggggcagggatgggagcagggcctctagcggagaaccttgtctgacctcaaggtccatattctccctgcctgtgtggggtgacactagggagaattcggaacgcactgaaaaaaatctcatgcatttggtccacagcgagccaggctctgtcccctctgggccctggagataccagaagtagaaagagtttctgcatagtagatcttcatggtctggtgtcaatcaaattctcccacaattaattgaaccttgtcacaatggagagcactgcagaagtgaggtacacgggtgcccggggtgctgagggataaggagcattacagagatggcggagcaggacaagtgttccaggcagagggagtggcacgggcaaaggcccagtgctgggagatggcaagctgcacatgaggacctgaaagaaagccagtgtgactgggtcacgccatggtgctatataggaccacaaggttcatgtctgttgtgtgtgcagtaatggagcaatgcaccaaaacagcaggaactgaggcagagaaagtttcataatcaaaaggcagccaaacaaggaggtgggagagaacctcaaatccacctccctggggagtttctcagactggggtttttaagggaatttgaaggagctgggggttgctgattggccgaggagtgaggggtggagtcatgggacagggagaggaagaaactacattcttgtgttgagttgtctctttggaaggaggctttagactgacaggtgttggtggacccactgaaatgcaggatttggggccgggtgcagtggctcacgcctataatcccagcactttgggaggctgaggtgggcagatggcttgaggtcaggagctccagaccagccttggcaacaaaaaattagctgggtggcacatgcctgtggtcccagcaactctggaggctgaggtgggaggatcactggagcctgggaggtggaggctgcagtgagctgaggtcacccccactgcactccagcctaggtgacagagcaagatctaaaaaaaaaaaaaaaaaaaaaagcaaagcagaattttgtaaatatctcaaaatagaaaccttgaggtttttttaatgttaaagatgttatctggaaaagttaggaccctgtggcaggggctgtgtgacttttaagcaataagcagctataagaaagtgggctatagggcaagccggttaatgcttagctatgcttttacttacagcttatgcttttgttaaaaacttagcaatttagcttgattaattttgtgaggatggcttcagtgtgagcgagactggaggtgtgggcgagactggaggtgtgggcaggggtggcccatgaagggcctcagagaccttgttaataaggagttcttcctataagccaaaccctttcaggattggaaagaatcttggagactctctggttaaatgccccatttgacagatgaggaaactaaggcccagacatctaataataaaactcacctttttataatcacttaccatgtgccagagatcaggctatacactctgctttctgctttcaccatatcttccccttaaaatatagctggcatttcacatcttatttaatttaaattagcagattgacttgatttttgccaaagatgttttctctcaataattaaaaaaaattaattattgaagtaaaattcacataatgtaaacttaaccattttaaagtgaccagttccatggtttttggcacattcacggtgttgtacaaccaccacctctgtctagctctgaaaatttccatcacactaaagtactacaatcccttactcattaggtagtttttccccattccctctgcccccagccccggcaaccaccaatcagctttttgtttctatagatttatccgctaatatggatacatacaatatgtgactttttgtttctggtatgtttcacttagtatatctttttgaaattcatctatgttttagcatgtatcagtacttcatttatgtttatgtctgaataaccattcatttgataaagatacatatacagatatacatatatatctatatacatacatatatattacaatttattcatttattaatggatatttgagctgtttctaccttttgcttgctgtgaatagtgctgctatgaacgtgtatgtgcatgtatttgtacttgttttagttcttttgggtatataactaggagtggaattgctgggtcatatggtatttctgtgtttaactttttgaagaactgctaaactgtttttcatggcgactcaaccattttacattcccaccagtaatgtacacaggtcccgtgaatttcctggcagcaggcccaggccagagacctcacatgactgtgaggctggagcaaagccgcttgtgcgctgccccatgcagctctggtcctgttcctccttccaagtttttcagtaccaaaaagccctgtgtactggcttttctcccattctacatgtccttggttccttaggatccctctcggggctgcatgagccaggcaccaggggtcatgatgcttccccctacccaggctgtgcagggagagctctcaccttcctttgacacttagaagtcctgtgtcaatagtgccagttctatgagtgaggctgtcacatatgcagactcctttctgacccccataccaaggaagatgccaaagtgacaaggggaacaaacacattggcctggctgtgcttgctgcccgttaagaatctggctcagcctcagcctggtgaccctaaacagcaatggcagggtctgggtcagcaagacacagctctctccatgcaatgttggaatgagtgtctccagtctcttattgctgatgggaaccttgtgaaaggacctgcatctcctggacaaaccaagacacctatggcagtgcaggccccaccccctgaaaagcatcacactacttgactgactgaccacgccagcactatggataaacctcaagccttttaggttaactcctgtctgccacagattctcaggaaaagagatcatctttctaaatgcagattcacaggcagatgacagtccatgacctgaataacctcttagtgaagattttcagattctgctccacattctgggatgcttaccagggcttcagatttaggaggagaaagtttattttattttattttatttttattatgacctctatccaggcctcctttccttgcatgcaaaatcagtgtgatagaaaggagaatgaacaacaagcatattgtggtattagtgaaagaagcacctaccatttggaagcccaaagaggaatgtttatttttttaatttttatttttacttgtaaaaataaaatatttaatttatgatcttgaaaaaaaaaagaattgctagggtaatacgtatgagaactgctagcataggacctgagacttagtaggcattcaataactgttcaccaaatgaatacatataggagatgcttcataaaaatattggttcaattctctacctttccaactcccaaatcttgaagaatgtcaagtgtgaacacacttagtagctaaaggaaaattaagatgtttgataggacattgggaccatcgtttgtcttctagaatgaagatatgatctgatattgtatgacaatcagaagcctgaggaacagcctcctggtatccttcctcccagccctggggctagctttgaggacgtatgctccctattttacccatgagtttgctgcccaccactactaccctttttttttcttgtctgctgggaacctcaaggcccatgcagctctctttggcagcatctggattcctaacaatcctctcctctcttatttggttccttaactttatttgtttgtattttggttcctagtgcacgtgcatcctgtgtgtgtcccgggtatgtgtgtaggctgcctcagagccttttttgggaagaaggcagggaataggccaaaagaggagctttggaatgttgacaggcaggaatactcctgccttgttggtggggaaagcaccaggaggctgcccttgggtttctctgagaggctgggggagagggaaggggctggggccacctttgtggggacagagcatggaatttagtcagctccctcatactgcttagagtgacctggttcagacaatggggcctttcatggggcctggcccacaactctggagtgggtgcaaggcctcttctccctgcccgcccctggggcccaccttccagtaccttgtgagaggcaggggcgggagagtgggaggaacaggggctttgcagttttgcaccctgggtttgaagccctgctccataatcactggctttttgaattctcacagaacctctcaaacaagctcgtaatcttgccctgcacagggttgctgtgagactctggagagctcatgggtagaaagcactgtggaaacagtccactttgaactatgtttgggtccctcccagctgtatttctgtagaaagcaccaactttataatgctaatagtaagcactcaatacatgttagccacagggtatatgtgtgccaggagcttcatatacttggtgttgtttaatttcctccctatgatgattcttggaagtgagtataataatcccatttttatagacaggaaaccgagacccatagaggtgtagcagcttgctcaaggttatcaacgttagttgtggaattggacttgaacccaagctaggctgacccccaaggcctgtgcacagcctgtgtcagggtgggttactccagaggtcacccaggcgtgctcttccccttcagggcaggtaggtctcctttgcaccaggcctgttgctccagttggggtctgcaggcactgtgatctcagctggcttatcactttagggcataccttctccagaagtcttccatcgtttctggggacttcttggcctggcccccaagcccctcttcctctgtctccacccatccaggtatgtagagcattttcccacctgctctcatttgccccagtgttcacatcacctgaaccctttgccctgacattcctgtcacctgaaccacagccgttctgtttctcctttttgctgttccttatggcctctctgtacctcagaccttcctcccactgtgagtctcagctctcagaccattagtcttttcctttctctcttccatgggcatttatttagccccaaatctgtgccaggcacgtgtccctgtcccgtggaagcatctgtctgatgggggtggcaactgtgaggacagtgactacccagcttggtcagtgccatgatggagatggtgaggctgcaggggcattctaactctccctggggaagagagatgcaggatgaggaagagctcacctagcagacaggcgcagataaacggattctaggtggaagtggcaccttcatgttgggggaagacagcgggagtgagagtggtgctctaaggaaacgtatatggtctggagctgagagtggctgctggggtgagtggcaggagctacggtggctggttcttgatcctgagagcagtggggagccatcgaagagtcctgagcaggggaagtgcctggtgaggcttgctctttagaaaggtctatgtgctcctaaggggcagagcaaagtcccatggtgggtggagttatgaggaccaggtctccccgaaaggaaggtagttgttgagttggatttgctttttggaaagatccctctggtgctgtgtggaggctggaaggagttagatcagaggcctgtttaaggtcggatcattgggacttggatactgggcagagggaggaaaccaaggtgaagccttgggcctgtttccagccccagtagcctgtgggcccagtagcctgtgggtctgttgtcaacttgcctagaaggagccgtggcccagcagggcttatattggcccccgcagctgggtggccctgggccagcttttccctctgtgccttagtcccccaggctgtgaacggattgggtgagggggtctctcctgccctgaccctgcaggtctgtgacatgactctggctcaggaggagggacacagagcccatggtgtggctagctggggcctagtctagcattatcaagtctggccaggtctgccagggcctggggccagcacttggcacagctgctgtctgagagggcacatctccgacctctgggtgtcctcctacccttgcagtggttcagcccccgccaccctggtagctctcttggctcggcctgcctggctgcccaggccctgactctatccagggcctctcctctccctatgactggccctgggaggagtggcccagctctggagccccattggccaaaacttgcctgggctgcacacacccctgcctcccagactggctgcctgcccaccttgggactaggaggcctggcctggcatgccctaatgtgggcagactgccttggagcccaaggaaggagtggagtctgaaaggctatgcctggggccacctgctgctctgtccctgctgcctgtgctccagcccacggcttctgcgcccctctctttgaggggagtggtggggatagcaactgcgaggcttgtctctcagtgtgcttcaggggccctgcttagaggagcacagtatttccattctgacagggttctagagcttcctccctgggaatctcagctgggtatgcaaatcccaggctgagttaggccctggactcctggaaccaggggtactttagggactggcaattctctgtcctacttggtgagtgacagatgtggcttgggaagggggagaccctgctcaggatcacacagcacttgagggacacaggtagaatttgaactcaagtccgtctctgtttgtccctccacaaacctttgacgatgtcctcctgtgtgccaggcccctctaggcccaatttgtctttgtattctctatctttgcccagggccccgtacagaggaagtgtttggtgaatgaacaaatgaacaaatgaaccagtgagcaaggcacaggtcctggctcccgtggcatagggtccaacaggaaggtagggactcctgattcacagaacaggaaacgggagtgcatgggaggaggggttgaccaggtgagaagcagagagaggaccagagcttaggtatcatgactgctggtccaggactgtgcccgtgttcccttgttggtgaaatgggtcaatagttcttgccctcgtcctcgtgagggctcagagaagtggcggacgtgcccaggctggtaaagcgggggtgctgtgtgtcggcgtccctgtgtgtgtgtccagactgcccagaaaccccaggcagtctgccccttttgttctgccccttttgttctgcccagttgccctctgcaagtgggcattgtctccccatttcctcagctctccctagggcttctttctggaatttcttcccaatacccctggctatgggaggggtttgggaagagtgtggacgaatggagtcctgcctaccacctccctctacccactcccacaccccgaaagccagccacccgtatccatgcaggcccccagcgcacaaccaagcgggaagtgccttggcagtggttaccatggcgatgggtcctgctgcttggacaacatcggccttccagctacctgtgagagcccgcaagccaggcagcctggcaccctgcaggcctccaccctggctgagagctcctgggatggctgtcttcctgcctccccttggtgcccagcctcctacccaggggctcttgggaataagccgtgtttctgggaacccataagccgttctgggtcagacaggcctggttcaaatcctggctgtaccacatgggggtcagtgactttgaacaagccacctcggagtgcttgaaattgaattagctatgggaggctcactggggggaattatctaaggagtatacaccaggtgcaagagctaccactgccagcatcctgcagccgtggcaggctcaccattggggcatgctgctctttgccactacagccaagcccaggtccctggactcctcatctcagccccaggaggccctgcaagcagtgtagtgtcgggggtaggagctcaggctgcagcagacctctggagtcacagctgagctttgtcacttacttgggctcctcatctgtaggataaggataataaggcatctgtctcataggtttgttgggaggataaaattggattagtacaaataaagtacttgtaaaattatgtgacacctaagtgccatataaacattagtggcgactgtcatcaccaccacacaattggcattggccatgagaatcggaacccatatgcctgtccctcctcatttttctcacacatgcaggtgtgcccagctcttgagctcatggtctgcttagggatggcaggctgctagcccctttcctcttcctcccttccaaaggactgatgggcacaccccacctcttctgcttggagagtaagacatgctggttccaagcagaaaccccagctctaattcattagttggagaattttctcagccagttttccagctggcagctgttgtacccagccctggatcagacagctggtctgtgactgcccacagccctcccagtcaatagatccaagtgctagacattagcgggccacagaggctgtcctgatggcctctgaagatggagggagcccaagaaaggagccctttggggatgaaatcagagcggcttcttgaaacactgtattaggaacagttccctgggcttgactgctatggagctctctaggcctccctgcatagagaggcgactctttccagaatgaacgtaaatctaaggcaacactttaaacagttggcccaggagctgaagcaaggaggactgacttctctgcatggttttgtctccactggcccactcgggtgcaaggccgtgttcatgtgcagttcttggccaaaaggaaactgggcagaagcagcaatcacagatatcctggggtccgagaccacgggctggagggtggtgaccactctcgggttggggtctggtgggaggtggccctaggtactctctctcccccagaccctaagttctcagggctggacagacctgggagaccctgcagcaagcagacctctctgtccccacctgtccccacctgtaccccagggcttggcctctgtgttctccaaccgcacatcccggaagtcagccttacgtgcggggaacgacagtgccatggcagacggcgagggataccggaaccccacggaggtgcagatgagccagctggtgctgccctgccacaccaaccaacgtggtgagctgagcgtcgggcagctgctcaagtggattgacaccacggcttgcctgtccggtaaggctgcgctccccatggttccctacctgccccacaggcccagagcaggggccgtgctttcagagatggtcaccgtccaccctaagtgccacacttgtttctcatcttggcctttgctcatgctggtccctttgtctgaaatgcccttcctgatgtctcaatgctcagcacagcccacttttctctcactcagaccccttcagccctgagtgttggtcccaggccctaagtccctgcctcaacacagtgcagccttccacatggctgcttcagattggcttggagatgctgttgagcaaagcccctgactgcctgccctgcagcgctccttcccttgagttgaggtgcgctggactgagcccatttcattccttttgttgcaccggtgttctccaacctacagcgctcacagcctggtagggtggggatgggggatagacaggtgacccgactgttccccagcactgtttcagaggccctgacccaggcctgggggcagggaagggatgcctgaggggctaaggcacctgagtggagtcctgagggtgagtgagaatgactcaggcagggaacaggtggttgaagggacgggggctccagaaggccgggaagcaggccagtgtggtgtgatcactcattcaacagctacttactgagtgtgtactatgtgccaggcactgttccaggactggggtacagcaatgaacaagacaggcaaaaatccttgtcctcaagtaatttacaatctagtgggagggagagacagtagacagacgaaaagcagatatacagaagatggtcggggtggtgcccacggtgaggggtgtaaggaatggtggcagcagggtgtggtgggagttgtggccttggcttgggcggctggagaagcctcctgaggaggtgccatctgagcagaggcctgtgatcgggggaggctgctaatgtctggctttcttctgctgacaccagcggagaggcacgctggctgcccctgtgtcacagcttccatggatgacatctattttgagcacaccattaggtaagtggcccctcctgcctcaaggtcctctgggctccctcccatcagcctggggcctgtcctcctgactccctgcctggtcagcgtctgtgctgcctagagcctgactcaactgactgaaaatgaggtgggggcagcctctggggaagtgtgaacccctctgcagtgtttctgggggctaggagttgacctgctgttctgtgcagtgggtgggtgggtgggtgttccctcagccagggtgtggccgagatagcatagtggggtgctgcgtgactttggggaagtcagtctctctctctgagcctcagttttctcatctgcagaatggatggggttagacttaatcattgagtgcctttttgagcttggacattctctttgggtccttggtcattgggctgtagggaggccccctagacaaggtgccttggcaaagtcggagccagaagcttgggccattcaacctctgctcacatccttccagggatgaggagctcgttacctcattactaaagtagacttttttttttttttctttttttttggagatggagtctccctctgtcacccaggctggagtacaatgacacgatcttggttcactgcaatctctgcctcctgagtttaagcaattcttgtgcctcagcctcacgagtagctgggattacaggtgcctgctacaaggcccggctaatttttttgtatttttagtagagacggggtttcgccatgttggccaggctggtctcgatctcctgatcttaggtgatccacctgccctcgcctcccaaagtgctgggattacgggtgtgagccaccacacctggccttttcttttcttttctttcttttaatggctgtacagaatagaagaatattcatcacacgcactgggctttgcctccccatagctttgcccatagatcctgcttctgggatccaaggagcaggctgagccctcagcccaggacaggctgcagggccacacacagagctcttgtctctgggcctgatcctaaactcaccagcactagctaggacatcaagtgccaagggcttattcaggactcactgggtgctcagtgtgtcaccattaaggaagaagattggccagtccctgtactcactcattcagtcatcagtcattccctcaccacacacttaatattagatgagcaccttttccagaccagaggccttgctgagactgggcatgcaaagtccactggagcacagcctcttccgcggacctcccagtcttcaggggaggcagatgtaggaacgtcattcaattcgcagtgagaagttctgtgcaataatgggctctgggccaggcatggtagctcacgcctgtaatctcagcactttggggggcctacgcgggtggatcacgaggtcaggagttcaagaccagcctggccaacatggtgaaaccctgtctctactgaaaatacaaaaaattagccgggcgtggtggggagcacctgtaatcccagctactcgggaggctgaggcagagaattgcttgaacccaggaggcagaggttgtggtgagctgaggtcgcaccactgcactccagcctgccaacctgggcaagagagcgagcctccatctcaaaaaagaaaaaggctctggtttgtaatccttttttttttttttttttttttttttgagacagagtcttgctctgtcacccaggctggagtgcaatgatgtgatgatcttggctcactgcaacctccacctcctgggttcaagtgattctcctgcctcagcctcttgagtagctgggattacaggtgcgtgacaccacacccagctaatttttgtatttttagtagagacggggtttcaccatgttggccaagctggtctcgaactcctggcctcaagtgatctgcctgccttggcctcccaaagtgctgggattacaggcgtgagccaccctgcccagctgctttgtaataccttttattttagaatagttttaaatttataaaaacattgtatctctaaagatagtacaaggccgggcgcagtggcttgtgtccaattccagaactttgggaggccaaggcaggcagattacttgagctcaggagtttgagactagctgggcaacatggcaaaaccctgtctctaccaaaaattagctaggcatggtgatatacgcctgtggtcccagctacttgggaggctgaggtgggaggatcacttgagcctgggaggtggaggttgcagtgagccaggattacaccactgcactccaacctgggtgacacagtgagatcccgtctcaggataaataaaaaaataaaaataaagatagtacagagagttcccatataccccacacccaggtgccccatgattaacatcttacatttgtagggtacctttgtcacaattagtgcaccaatactgatacattattttgatgcctttttaattacgttaacttatttgatcctcaaaacaatactatgtggtcatagctattagtatccttattttacagatgaggaaactgaggcacagagaaatgaagtaccttgttgaaggtggtacagctaatggaggacccaggatatactaccaggcaggcaatctgggcccagagcccttgctcttaaccaatgggctgtatttcctgtatgtctgggggtaggtgtcgtggcactgagggtagtcaaggggggacttcctggaggacgcatttgagctgccagtactgtcagctctgtgtatagtgatactttgaagccagtggagctgtgtctgggccagctccaggtccctgtagccaacacaagttcttttacttaggggagcaaggaatagagagggttaggggtacatgcatgatggctggacctgctgcagggctcagcagagtgaaggtgaatctgggcagaggaggctgtggttggaagggaaagccagagaggatgccgggaaggaggacaagctggggaggggcctggagcatggttggtggccagggaaggcctggacacacctgaggaaagattaagaagtttttttgtttgtttatttctgcttttgccacttaagaatatttccaaatgtatccctaagggctaataactctttttatatttatttatttatttattgagatgatctgtctcccaggccggagtgcagtggtgcaattttggctcactgcaacctctgcctcccaggttcaagcaattctcctgtctaaacctcccgagtaggtgggattacaggtgccggcaaccaagctgggctaatttttgtatttttattagagatggggtttcaccatattgatcaggctggtcttgaattcctgacctcaggtgatctgcttaccttggcctcccaaagtgatgggattacaggtgtgagccaccatgcctggccctttttttttttttttttttttagagaaggattctttttaaacacaacatcattaccacatctaaaaaattaacaataatttttcactaacgtcactagtcagtgttcaaatgcccaaactgtctcatgaatttgtttttattttgtttgctttgcagttatttattttttcaagatggagtcttgctctgttgcccaggctggggtgcagtggcaccatcatagctcactgcagccctgaacttatgggctcaagcgatccttccaccttagcctccctagtagctgggactacagacatgtggcaccatacctggctaattaaattttgtattattattttgtttttttgtagagatgaggtctcgctatgttgaccaggctggtctcaaattcctagcttcaagtgatcctcccacctctgccttctaaagcattaagataacaagcatgagccaccacacccagcctgcagttattttgttattcaagtcaggatgcaaataattgtaattggttgcttctctatagggaggccgaggtggacagatcatgagatcataagatccagaccatcctggctaacacggtgaaaccccgtctctactaaaaatacaaaaaattcgccgggcatggtggcaagcgcctgtagtcccagctactccggaggctaaggcaggagaatggcatgaacccaggaggcagagcttgcagtgagccgagatagtgccatagcactccagcctgggcaatagagcgagactctgtctcaaaaaaaaaaaaacaaaaaaacccaaaaactctgtagatacccaccaatcctccaccagctctctggcaccgtctctctctctcaaaatatatttgttgaggaaagctggccatgtgccctctagagtccttcatcacctgggtttgctatttgaatttctgtggtgcaattaacatgttcctctgtctcctgagagtaaattggtgtagggaaggtctcgatgggggtcagatttgttcatggggggtcgcttgtctgcgttgtgaagaacacctggaagggtgtccgggagctccggggccctgaggaggctgggcagtggccctggggaaggatccggtttgggccagagctgtggggacagagggcagtcaggaaggaggaggagcttagaaacccagatgggtgtctgcttggctttgggggaaggtagagagagaaggagggagaggaggaaaaatcacaaattcctctcagcaccacagaaaatagacttttatttttatctgggggaccacagaagttttttgccgtaatttttgatcatgaaaactttcaaacatatagaaaagttgaatagtacaatggtcaccaccactgagacccaataattaacatttttctaaatttgctgtatctatgtatggacaaataaataaatacatatactttttttcttgttaagagacaaagtctcactccgtcacccagcctgggatgcagtggtgcgatcttggctcacggcaacctccgcctcctgggttcaagcggttcttgtgactcagcctcccaagtagctggaattataggtgtgccctaccatgctcagcttatttatttatttattgtatttttagtagagtttcaccatgttggccaggctggtctcgaacatatgagctcaggtgatctgcctgccttggcctccctaaatgctgggattacagacataatatatacactttctctctctctctctgctaaacgatttgaaagtgagttgcagacatcgtgatgcttcatccgtcactatgtcagcatgaatctcctaaaaatgaccctcccctccgtgaccattagtattactaaaaaaatgaacaggaatcaacaaatgtctggcaaatgtgagcttgtggtatttattgagctccggctgtgggccaggcctggcgcttggctcagtcccattctctctcacttgaccctcagaaccacaggcagtactttacacagaaggaaatggactcagagaggcaaagtgactcacccaaggtcacacagctctgtagtgtgatggttaaggtggagcttgactggaacccaggcctgtgtggccattcccactgtgttcacggtggccccttgaccagcaggccccttggaatggacccttcctaggcttggccagaagactgtgtcatttgagaaagaagttggcatggcactctccatgttcatgagccaaggcccagagaagtgaaaggacctgctggagatcacacagcaattgaacagggccggcctttagcctcctgcccctcctccccacagtccatcagctgggcaccctctgccccctccattaggcacagcccaggctaggtggctcccctggggattcatatggatgtgggaatcattccaggaggacaggctgcagctgggaaaagaggggctggtgcagtcaacagagtcagtctagaagtctggctctgccactttttagcttggtgaccttgggcaaatgacttaacctctctgatgctcagtttctcctaaacctacctgccaagcttattctgaggttccaatggcagtgcacagtgcctggcacctagcaggcattctttaaacatttccttttctcatcttgccctttgtttatagcatcttgcccttaccaggcattcaatacatgtagaatgcattaattcagtcagctaccctttatgggagacccaccctgtgccatgtgctaggccttggagagtcaatggggagcaaaaccatgacccttaccctagtagagcttaagaactgtgggagacagaggtcactctgccaggagagtgccgcagggtgagcctctgcagggcctctgttggtgggtgggccactgcagggcagcgaggggtcccctgaggaggggaccattgagccgagagcaaaaagaagcacaggcattaattggacaacggggatcagggaacgggggagcagatgagtgcaatcatgctacttctctcagcctcagcttaaccatctgtaaagtggggtgctgacactatcttgctagctggctttgaggacttggtggtatcgcagatgtgaatatgccctgcaagccatgaagttatcctgccagctccccgcaagagaggctctgcaagtatctgaggcccctgttcctccctctggcccctctggaaggctcacctcctactttcctctccccagtgttggacaagtggtgaatatcaaggccaaggtgaaccgggccttcaactccagcatggaggtgtgtggggtgggcactgcttgggagtgggtgcgtgggtgggtcctctacctcctctctccattcttctccctgcagcccagggccactcacacttgcagggccctgattagagcagcagagttctgtaatggttggcagagcaaggggaatcccaaggatcttcctgtcccaaatcccagaacacagacaggaaaatcgaggcccaggaggggaagggacttgccccaggtcactgagctacatagattccagtgtgggacttgacttccaggcccctgagtctcacatccagcctcagcagccaggtttttgtgggaatggagggaaggcagcatgagcgcctgatcttggaggaggagctggggcagggagagtgctgggtttccagcccatgagcttgcctcccacagcccgtctcctcatctgcaaaagggaacatgattcctctgtggcagggttggaggactgctggtgatgcccagggttctgtgagctgtgggggagggctctatttcccacctatggacttcaggcccaggcaacttcaccagctgggccagtggttcctgagggagcactgaggctgggtgacatagccctgactatgcctctgggcaccccatgaatgctcaggtacccccaggtgcctgttcttgattttttattttatttttattattgttttgagatgaggtcttactctgtcacccaagctggagtgcagtggtgccatcatagctcactgtaacctcaaactcctgggctttagcaatattcctgcctcagcctcctgagtagctgggactacaggcatgtgccaccacacagctaatttttgtgtgtgtgtggtttttttttttttttttttttgcagagacaggggtctcactgtgttgccctggcttgttttgaactcctggcctcaagtgatcctcccgctgcagcctcccaaaattctagaattacaggccattgagcctggcctatcctttaaatttagccaacattctgcctgtatgaagccctgttgtagacatagtctcattttaatcctctcaacaatcccacaagggtaggtctgatcactcccactttgtagatgaggaaactgagacccagagaagggaagtgacttgcccaaggtttcccggggacccaagggcagagtcaaaccccccctcagatctctggcctcccagacctggtaggtggtgcagaaactctggaggcctggcctgggctgggacttgctgtctggtggagctgcggggcttctaactggtgagtgcaatgttgttcctcattccttcgcccttactgttcctctccaggtgggcatccaggtggcctcggaggacctgtgctctgagaagcagtggaatgtgtgcaaggccttggccaccttcgtggcccgccgagagatcaccaaggtaactgggtgcgcctggctgctggaacgctgctcagtgacctgggcacctgccatggcgagtctggctcaggggaatgaggttaggggttggcagaggggatggggagggacacagcaggaatccacagctccctgaggaaggcccacccctcattgcattggaatcccccagccccctctcccctcctttccccacctctccctgtgcttctccagcgaagattcttctggtctcaccattctggtctcaccattctgtcacctacagtgacaccccccatcctctgagcctttggccaaggaagggacctgggtgggagctggaggatgaatatgtatcaggtcatcgtggaggcaggaagatggggcaaagagggaggaagccttggaactgagcagcagcccacgcctgctgtgtgctagcctcgggcatggcatggtgctggggacaggcccttgtgctatttcaggagacttgccctgagtgtcccccaccctgtcccctggccgacaggtgaagctgaagcagatcacgccgcggacagaagaggagaagatggagcacagtgtggcggctgagcgccggcgcatgcgccttgtctatgcagacaccatcaaggacctcctggccaactgcgccattcagggcggtgagcagctgccagctgtgcatggggagggtagctggcgtcctgcatggcccctctgccccgggctcccactgggcagaggcaggaagggaggctccggggacttccacccactggtggccctgggcctctcctagccctcttggctccgaggtctcctccagggaaggggagtgtttgggcctctctaccagctcccaggaaccatgaagctgccgttaggtcatgtggaaatccctttgttggccacaaaacgcatttgggtctccagaagccaaggtgtttgggaagatagtattgagctataacttgaagactgtagaattttttaaaaagcatatatatatgtatgcatctataaaaagcatatataggccgggcgtggtggctcatgcttgtaatcccagcactttgggaggccgaggcgggtggatcacctgaggccaggagttcaagaccagcctggccaacatggtgaaaccccatctctactaaaaatacaaaattagctgggtgtagtggcgtgcacctgtaatcctagctactctgggggctgaagcaggagaatcgcttggacctgggaggcggagattgcagtgagccgagatcacaccattgcactccagcctaggcaaaaagagtgaaactccatttcaaaataaataaataagtatatagcatatataaaacatgtaaaaagcatatatatatgcttatgtgtatgtgtgtgtatatatgcgtacactcacacacacgtatatatattctcacccctcaaaagataaaataaaaagcaagactcctttctatcccagaatccaggtcgtctccccagaagcatctactattacccattttagggtatctttccagaagtattccctgtatatctaagcatagcatgtattatttagctcctgaaaaggggcattcagtacatactgttttgtatcttgcagtttccccttaaaaatatatcctgggggttgttctataccagtacagaaagatctactttggactgggtgggattttgacagatgggagataaggaagggtttctgacagagggcacagcctgggcaaaggcctagaagggagaccttggacttgtttacttatccccagaatgttcaaatttgagtcttccttgaaaccaaaaggaggcgatcttagaagaaaatctccccggagtggggagagagcaggcagaactcgccaagcccagaggaagcctcaagctatgccctgagttccatgtgccctggttctactgggcttggaggccggagctggggaggcccagctcttcctacagtcatcaaggcccctttgatccatccatccccttgcagccctcctaaatctcttctgtcctaacagcgctcccacctaagaatcagctcaagtgcctttgcctggcactgggccttctggctggccactcagcttcactgggtactgtctcttgacctgctgcagctcctgttaagccacaggccccattgccctgtgaataccctccccgtcctgtctccagaccttggctcaggccaccctcaacttcccctcctgtctgcccccaccctgtctgtggtctctctgagagcctgcaagccaagccaagggcaatgccagctctttgatggaccctccctgaagaagtctctccatgggagataggagacaaatgacaccaccttgggtttggtggggcatgccagcatctgctgccctgaagcccaggaccccatgcactgcctggcctctcctactaaggatattctaacactgttgctgccaaggataagggaatcaccagggcagaaggcagggaaaaaccatcctttttgagagcatatttactggagtcaagtactttgtgattattattttttttgagacagagtctcactctgttgcccaggctggagtatagtggcgtgatctcggctcactgcaacctctgcctcccaggttcaagtgattctcgtggctcagcctcctgagtagctgggattacaggcactcgccaccatgcccagctaacttttttgtattttagtagagacaaagtttcaccatgttggccaggctggtcttgaactcctggcctcaagggatctaccctccttggcctcccaaagtgctgagattacaggcatgagccattatgtctggccttgagtcaagcactttgtgacaataatcacatttcatcttcaaacagtcctatcgggtcggatttcatgcctgcctttacagatgaggcaaccgaggctcagagggattacttgatttgcccaaggccatacaggcagtctggagtggagctgaggctcagacctgctgtcttgtctcagagctggtgctgcatccactgcactggacaggctcatccctctcatccagggccaccctctgcctcatgtgcactctgtgctgagtaaataaaagaacctgagtggggtagagtggtgggggtcccagggctgcctgtggggaggggctgcccttgggaatgttctcacctccctgcttccctcccttatcccatccctggtcagatctggagagcagagactgtagccgcatggtgccggctgagaagacccgtgtggagagtgtggagctggtcctgcctccccacgccaatcaccagggcaacacctttgggggccagatcatggcctggatggagaatgtggccaccattgcagccaggtgagggcagggtgtgctgcctctgcctcccctcctttctcctcctcctccccttggctacctccctctggaggggaaaccccagcttggggttggcattcaaggcttcagaagcttggctgttctgaatcagagaaatgaatttttgtgaactgaccattccttgttctactaaaaaagctagcatcttttacatgggaaacaccaggtctcttggcctggcactagatcctccccttgatctggccctacctgcactccttctagtatctatgttcccttcacatcaagccttctagtatctatgttcgcttcacatcaaaccatttgctgttctctgttcccatcctccactttcccagcccctgcctttgctcctgatgtagcctcctgccgtgcttcccctactcttctttgtctgctaatatcctgcccacttcctccataaagccatctctgactgttcccttcttctaaggggtgaaaattgttttctctcctctaacatctgtttctgtccggggcttgttctaccctaaatatcagggtattttttatagttatggtaactgaccttcactaattgacactctcacacctccaagactttgctcttgctgttccctctaccaggagtgcctttcccaacccatgccctttccagccaggtggattcctccttattctttagagcctggcttaaatggcccctcctccagtttaacctgtgggagacagtgcataagcaatgctgttttgggcaggcctggctatgagtgcagtaagatcctggaggagcctgatggtcagggaaggctgcctgaaggaagagcacttcagctgggacttgaatgccaagtagctttgggtaaggggagggcttctggatagtgggaacagcagctaccaaggtgtaaaagttggaaggaaaatgggaaaggggtttacccaaagccctgctttcttctgtcccctcaaacttggcttctttccagccatgcatagacctcagtattctaaactatgaaatgggactttagttctgtgcctctgggcagaactgccactgggttgggtggcagtgggtgggtcagaatgtgtagttccaggctgcgtctggggatgggaccagggtagaaggctggcccaagctggcctagcatggtggctcacacctgtaatcccagcgctttgggaggctgaggccacttaggccagaagttcaagaccagcctgggaacaaggtaaaacctcatctctactaaaaatacaaaaattagccaggtgtggtggtgcgtgcctgtagtctcagctacttgggaggctgaggcaggagagtcacttgaacccgggaggcggaggttgcagtgagccgagattgcaccactgcattccagcctgggcaacagagtgaaaccctgtctcaaaaaaaaaaaaaaaaaagagaggccaggtgtggtggctcatgcctgtaatcccagcactttgggaggccgaggggggtggatcacctgaggtcaggagtttgcaaccatgctggccaacatggtgaaaccctgtctctactaaaaatacaaaaaattagctgggcatggtggcggacacctgtaatcccagctactcaggaggctgaggcaggagaattgcttgaacccaggaggcagaagttacagtgagccgagatcctgccattgcactccagcctgggcaacaagagtgaaactctgtctcaaaaaaaaaaaaaaaaaaaaaaaaaaaaaaaaaaaatatatatatatatatatatatatatatatatatatatatataaaaatctggcccaaactagtggctgaagcaccaggggcattccttctgtctccccacccctgcctcctcagccggctctgccgtgcccaccctacgctgaaggccattgaaatgttccacttccgaggcccgtcccaggtcggcgaccgtctggtgctcaaagccatcgtgaacaatgccttcaaacataggtgagggtctgggatgggtgcggccacgtccattcagggctgagggctcttcctgaccctagaaaggaccctacttcaaactgtccaggagccctttgccctgcagacagggtctaaatccctgcctggctgatgggttcctctgaaattcagctctgattttcccttcttgggagccttccctggctcccagtcctgcccacccctggctgggtcagggacccctcctctgggatcccccagcccctgtctcccgctgtctcagatcagtgtctctgtctccctccttggctcctggctccatgcctggaccgctgtagatgctcagatcacagggccacttcttgccagtgtttggttatttatcaaaccctttcccacacatttcctaaaataattagtccacagagtctttgcctttgcaatgaattctgaaacctactcccatgaaagctgactttaaataagtaaattttttgagaatttcagaggtcattatttaattattaaaagtgagggatcaggagccaggctgccggattcgagtttggctccacctcttactggctctgtgaccttagaagtaacttaacccctctgagtgtcagttctttcacctataaaatggggctcatcacaactacctcagagttatgaggattcaatgagccgttactagtagaacgccagagaaaatgtccggtaaaggtcagccattgtggctgctcttactattattgttgttatttgcagtctgacttgcacacgttctgccacggtgcaggggaaaagcccttttgtaggagctgtgaagcctggattttagtccagattccaggaatctggaatccttggaaaaatcattgcccagttctaggccttggtttccccatctatataatgtccacactctgcaatcatagaacttccaaagtgagggggaatggtggtggctgctattttataattaataaggatggtaagtggctgagcgcagtggctcacgcctgtaatcccagcactttgggaggccgaggcaggaagatcacttacggctcggagttcaagactatcctggccaacatggcgaaaccccgtctctattaaataaacaaaaaatgagccaggcatggtgcacacacctgtaatcccagctactcaggaggctgaggcacgagaatcccttgaatccaagaggcggaggttgcagtgagccaagattgtaccactgtactccagcctgggcgacagaatgagactgtctcaaaaaataaataaaggaataaagaaataaagacagtaagatacatgaatagcagcaactgagctgtttgaagcaaggctgccacagcacttgtaaatatgcacataatgaacattttctaattaggccgtccacctccacctcctggtttatgtccttacatccctttgcagtttttgatggcatatttatacctttgctttcttgttggttgcctcctcccctgactgttagcccatgaggcatagactggacaggtttattcactctcgcatcctcacagggccggacacacacaagaggtgctctgtaaacaatggtggagggagcggtcccaggtgtcctgtcactgggactctgatccacgttgctggaagaactgcaggagtgtatgtgagtgtgtgtgtgcatacatgtgtgtgtatgtgtgtgcatacatgtgtgtgtatgtgtgtgcatacgtgtgtgtgtgtgcatgcatgtgtgtgggcgcatgtgtgcatgtgtgtgtgtgagtgtgtgtgttggggaggaggcatggcccttgggaaggtctgtccaggttggaagccacactccctcccctcagcatggaggtgggcgtgtgcgtggaggcctatcgccaggaggctgagacccaccggcgccacatcaacagtgcctttatgacctttgtggtcctggacgcagatgaccagccccagttgctgccctggattcggccccagcccggcgtaagtgggaccagcgccctgccccaccagcagctcccctcccctccctctctgccctggcatggtggagactgccagccccctacagacctagaggcgtgaggggcccaccctacccccgtgctggggcacagccagctgagtgtcctggctgtgagccctgggatgccccttgtgcagggcgggcttgttctgcctgacagaactcggagtatgtgtgggtctggctcggagttgggggttaatgggctgtcatgagcctgcagggttggaagagtactggctttggagtcagatgtgggttggaacctcgcctctactacattcaagtgatgccccctcgagctttcagtctccatttgtaaaatgggtgtatctgcagtccctacctcacaggactgtggggcgatagatgcagtactgactccatgcctggctgcgccctgggagcggtcaggaggatggtgaaagcaacgcaaggggcacgggaagacagtcaggagcctggtgcaaggtcctctcttacaaaatgctccctgtgcctcctgtgggccaggccttggagaggccgctccctcccttgggggaggtcccctggccttcctgctggccttccagagggtagcgtgggctgtggagttgggtggagcctcgggactgggagctgggggtcacagccatagccgcttcccaggcattttccttgtacttggggctggaggacgttagatgtggcggtaaagagggtgggcttgaggcaggccattggggtgctgatcctggcctcggcccttacccctgtggccttggcaagccctcacccttccttgtctcaggttcctcctctgtagaatggatacagcaccagccccagcctcagagggttgttgtaaggatttggtgcaattccacatggaaagcccttgagaagagtggctggtgtgtagtgagtgctcagtaaatgtggactctcattaccattgtgagtggcctgtaaggatccccattttacagaggaggaaactgaggtctggccaggggaggtggtgttcccaggtcactcagagagtttgaggggagctggggctacagcttagtttcccactttgctggccaggatgttttgattccagctgccccagcgacacctgaactccacgttagggctgcaggaactccttgggccctgggggatggagagggggcaggacggagggtgggggtagctggttgcctatcccgacttcctccccaggatggtgagcggcggtaccgagaggccagtgccagaaagaagatccgcctggacaggtgagtaggggctgagtggtgggcagaatgtggattcggggctgttcacgctccgctgaccccagggcactcgcttttcttcagagctgcctgtgcgttgggccctgggccgggccctttacatcctctcgttttggtcttattacacagcggtcttctggcctgttgtacacacgaggacgctggggacagaggggttaggtggcttgcccagggacacacaaatatcatcagcagagtcagaatttgaagctggctgagtccagccgattttaaatcctgtgttcttgccattgattctgatgcccatttggcagatgaagaaacgttcagagaggagatgcagttgttcaagaggtaaagccactttgggaggccgaggcaggcagatcccctgagttcaggagtttgagactagcctggccaacatggcaaaaccccgtctctactaaaaatacaaaaattagctgggcgtggtggctctcgcctgtagtcccagtgcacctatagtcaggaggctgaggctgaggcaagagaatcgcttgaaccgggagttgcaggttgtagcaagccgagattgtgccattgcactccagcctgggcaacagagcaagactctgtctcaaaataaataaataaataaaaatgaagccaggtgtgtctgactctgctgtgaaagcatttatggactttagaggctgtaagcacagcagggatcacaagctgttgttagtaagaaagtgtgcatctatggcatttactgagcatttaccgtgtgccaagcactgttattgtgatgtccccatgaggcaggggtgactgctgatcccatttcacagatgaggacacagcagcaccagggtgaggtcactcagcaggggtatggggtgtgggaatcgagccttagacgccatacccttccttgctggctcgctcccacctctgagctttccctggtgtaggggccgagctggtgtgccctcagctgctgtgtcctgtgtgaccatccagcctccctacccagacaggagtctcccattctgccgggctcagcacagggcctagcacagagtaggcctgcagtagagtctgtggaaagtgctgaacttccaggggaccaaggttgtcatcttctctccttcccaggaagtacatcgtgtcctgtaagcagacagaggtgcccctctccgtcccctgggaccctagcaaccaggtaaggctctctgctccgagaggacagtcttcagacccaccgggcccccacccttccctgcttgtcagaacgggtttggaggaaggccggggagagcaggatatgaatgacacgcctcatgattgctaccattagcaaagagctggcctgcgtccctgtttggtaggtggaagcggagaccctgagaggcagagtagcttgtctagggtcacacagtgggtctagccaagcccaagcctggacctcccttctcaacgcccaggactctttccacagcacctgccgcaccacccacccaccgcccaacccattcctggcccaggttcctctctggcacacccttggccttggctcaggggccctgaaggaagggggtggggtagtggtagcacctgtgtactctttcaggtgtacctgagctacaataacgtctcctccttgaagatgcttgtggccaaggacaactgggtgctgtcctcggagatcagtcaggtagctgaccccacccacccaattttcctttctcatctgagccagaggtggctaatggcaagcaacaagaactctcccacaccacttatgtcaaaaaaagatctcttcaaagaattgggtgagatcaagaaaccagtccagttatggaaacgtacccacccctgcagggcctggagtcgagaacccctagattcttctctcctgcctgccccccttcctgttctcaaccactcaggtctgctgctgtctgaccaggcacttcctccctctctgttcttctgcagtgatcactgcagggatcggggcagccagcaggcacgcgcttacaggagacctaagctctgccagctgcctgttcccctagacaagccacttcctgcctgtgccactggggcttggatgggcacctggctgacaggaaccaccacatgttgccttagtcactgttgtcttaagccaccttcctgtccatttgtgctgaattcataattcgtggggatgcagctgagactcagagaggttgagctgcgtgttcacattcacacagcaagtcagctgtagccctgagcttccagtctcagcctccagcatccccatcagtccactccaccacccagcaaatgaggctgccctctatcccatgcaggtccgcctgtacactctggaggatgacaagttcctctccttccacatggagatggtggtgcatgtggatgcagcccaggccttcctgctgctctcggacctgcgtcagaggccagagtgggacaagcactaccggtgaggggccagggtgagggcagggcagtgtcccttctccggcctgatgagggagagagtgtctccttctgcgggtcatcctccatgatgctctgccctgctggggctgggggtgggttggagttccatgctgggtgggggttcagggtcatgggtattttgagcccttagggaagagactgagcacggaattagagctggaggcttgagttgaagtcctgcttctgtcccaaccagctgtgtgacattggataagtcaaagtcacttcctttctggcctcagtttctctcttcttaaaatggatgcttggatggcgggtcatggattcacactcagagatactgattttcaaaccatgtgctgtggagttctgtgttcccaaaggggcttccggaactgctgggggtggagttggaaggatgaagggtgatcgggacatagcatggccagtttgttgaacttaccaagtttgctgattttcctcacaaatatattatttttgaatataatgaatgattatgaatagaaatatgttattcctttacatacatttgttcctccaaatttattgattgttcacatgactatcttcttctcgaatttagtcaaggaagataaatatgttcttaggaaaatagcaaaatttgtgtttttcaagtccccttaaagtcattttctgttctgccatcaccggggctcgagggggttctttgataattgcttgttatgaggagcctacattctggagaatttccgtaaggaggttctgtgtgtttggaaattcagtccgctggtcacttggtgaattgtattttgacaaactggctttccccttcccaccccatctattttctccagagcaggcttgtagctctttatacatgggcttcctgctgaaggtgtctttgcaaaaagggccatgttgccttaaaaagccctggcccagctgactcaggcctgctggttgtccccttccagaaggcagagaggtgatttggtggtggatgtcgtgtagggggagggcggttgtgcatgtggtaggtgggcttcttggagggaggctggggtgggccttgaaggccagaccaaatcttgatacttgatgggatttgtgggggagtggcctgaggggaaagagagcccctagtttcttccccataccctgcctactgctgagtgcaggcaggggagtggggaggaggaggtgggtctggacatggccatgcctgcctctgtgtgggtgtccttgtgtgggtgcacgtgttggtatgaacctgtgtatgcccatgcatgtatgtgtcaggtgcctgggcctggggatacatctctgccacctgatagcctggacacaccccagccctgcttccttattagctctgtggccgtgggcaggttatcttcctcatctatgagataggaatactaaaagcgtctacagcatggggctgttatggagattaagtgacacatgtaaagcatttagaacagcacctggcactcagtgggcgctcagtaaatattaagaacaactgctaaatcatcacacatccttgtggtgtctgcacctgcgcagacatgtatagacacacgtgggtctctgtgtacactgatgtctgtccatgtgcctgtgcacatatgaccacatgtgtgcatgtatgtgcacatctttgttcccatgtctgtgtgtatgtgttcatttacttgcatgcatgtctacatgtgcctgtgtgtgcacacgcacatgtgtgtccatcttggctgggctttgctgccttcctgctggcccttgctgagcagtacagggggtgacatcccatcacagaagctgctcaggcactgcagtgtggcagggcccgggcagacccgctgcttgcatgggagctggaagcttcctggggcactgagatcccggcctccccacaggagcgtggagctagtgcagcaggtagacgaggacgacgccatctaccacgtcaccagccctgccctcggaggtcacacaaagccccaggacttcgtgatcctggcctcgaggcggaagccttgtgacaatgggtgtgtgcctatctgctgtggggtgggggacacaactggacagggtggtagggtggccgcttctccctcccagggaagggcatcagcctggagccagagctctgcttcccattggctgtggggccccaggcaccactagacttttctgggctgctgtggctttactatgggtaaaatgagggataggggcacacatttcccctcttgtcgcattccctagagcagggccacccttacccagggtggctcaggctgcctcgatgcaggccttgggcaggatatttctcacgtggccacctccttggcctcctccctctgacagccctgtgtgggctggagggcctaaacatctcttttgctggagagacagggacagaaaaaaaatcccaaagcccacgagtcttcccctgagcgttgaagtggagtggcttttccagaaagtccacagtgaagtcaggttggctcctggtgaattcagtgctaacccacaggtacctcctccctccagcctggccctgagccccgcattggggctttaagagtcgatgtgccttgcatccccctggtgaggaatctgtgctagagggggcagggtctcggccttggttgggcagaacaggcccccactttcttctgtggctgacccctgtccccttgctacccttccttcactcagggacccctatgtcatcgcgctgaggtcggtcacgctgcccacacaccgagagacgccagagtacagacgcggagagaccctctgctcaggcttctgcctctggcgcgagggggaccagctgaccaaggtgaggccggtccccccaaccacgcccccagcctggctccaccccaacaccacacgtgtattgagctcagcactgctgggctaggatagtctcagagctggccccccagcaggctcccccttccagcctgggggagcctgagagtgtcaggggctgaaaatgatctaatctgtgtacaggtaagtcagaggccactgcatggtcttggaaaaagctctgggtgctgaaggcagaaggcctgggttctgaactgaaattccatctcactcgtcattcacttggatagcccttctcatctaggaaggctttatatgactctgagggcccataaaacccagcagcgcagtccgtgttgatggaaaacatggggaggaggctgagggaaagcgagggtggggtactgcagcctcccccctcacagcttctattagggccctgcagcctgggtctggccttgagactcacccagcagagactcagccggtgtttgctgaattcatatgcttgaacccatgagcgcctcagaaccatccctgggctaatgtctaatgtgtctctatggccgagattcagagctgggccctggagatgcagcccctgccctccagggcctctggctggcggggaagatgcatgatgacaatgtggtgtgtggtgtgggaagccagggttgtcagtgcccgaggaagggttgggggagatcagctggaggaggtcatgctgggcaactgtgtaatctaagaccctggggagttgggttgaatattctgccctcccagaaggccagcaaggctgactcaccaccagcctcgtgcccactgggctcccaccccttcccaggaccctcccctagcttggtccccctgagcttggcttcccaccctgcaggtatcctactacaaccaggccaccccaggtgttctcaactatgtgaccaccaacgtggccggcctctcctctgagttctacaccaccttcaaggcttgtgagcagtttctcttggacaaccggaatgatctggcccccagcctccagaccctctagatgccctcagtggccacatcatgcccactcccactccatcctgtccccaaggactcacatacagtgcctggagaaagccaaagacctttatttcttcctgcctccccgtgggaagcctccgccctgaggtccgctggcccaccacccctgggtgctcagtttctaccaacatgagccagcaagtccttgtggtagccctggggtagcctgtagtagactcgggtcctgtccacagccctagctgccagcaatgctgtcctcacagaggcatagtcgcccccagctgggttgtgctccactgtgacggtggcccggggggaggatgccagcagcctgcctatggctccagctgtgctgtggcccagcagcatggcctgcatctggaaggacacaggttgccagagcccctggcacaactctagcatatctgtgagcagctgttccctgtagccactgcccagcacctcctcaggccagcctggtgccacagtcacgtgggggaagacctcagccacagctgtaagcagctctctgccagccacatggccggggaccgaaaaactcccgtgggagattttggccccaacccacacaggccaatgcaagaggccaaggctggagaggcgtgccagcaaggccagggatggccggagggctgcgggctccgctatttgcaaatggatgccccagtgtccgggatgtgtggccagctgctgcaggcaggactccagcgtcaggatgttgccacttggagtatgaacaatgggcacggggttttcagccacagttccctcgaggccagtgttcagcaggatcatgccttctgtgtctggaagaggcggcagaggcaacagtgtttaggatttgggttatcataaggtgttaagagtcccttgttaaaggggcagtgggagttatggggtcatcaaggaccttgcctctctggaatctgtcaacccagttttgggctccaggtggatgggttgctttataaatgtgcctggtgcatgagaaactcttgtttcagctcttggcctttacccatgactcagcctgggggctggtgccggccttgcctgcagcaatgtagctgaggactggtctgaaggccaggagccctgtgctcttgacatcactgtactccctctccctccccgcaaccctgccccaccttgcatccagggtatggtgtaaataaacctgtgttgccatggcaacagagaccggcggtacctgccccaagcaaaggacacccctgcagatgagctgggagcaccggggctgaagggtagaccttacctgggagggtcattgttgctgttttaccgctgccctggacgtcaggaaccagccactccacattcagaccgtcatccccaggcagctggagaagagggatcaggctgcctcccgtgtagtacattggtttccgtgtggcattcactgtggggccccaaatcgccaaggtgaagtggctgccattcacagaacaccttacctggttgctagggtcccataggccacagctctacgggcatcctctctaagcctcatagcaccctgccaagtagctctcatttccttgccttgtagactagaagaagtgacttgcccaaggtcttataagcagtaagcaaagttgccaggagtggaacctgatgggaccaggtctgcctggctccagagctggtatccttcccgctcgcttaggtggctcccatggcaggaatgctgagtctgatggggcctctttgagatggcttaactgcggctcttctgggttcggggtcaagggaatgaggggtttggatagtggcatctgatcactgcttaatgaatacagtggaggcctctgaaacattagagtaaccagcagtggagctatgcaccaagggaaataatggggggtttggaatttgctggtttcctacctgctgggccacataaaagctgagtgactgtataaattcctgaactgttttgagccgctgtttctctataaaatggaatccctcagtttctctataaaatgaatgtgtgggtcaggcaggtggctcatgcctgtaatcccagtactttgggaggccaaggcgggcggatcacttgagggcagaagttcgagaccagcctggcccaacatggtgaaaccccatctctattaaaaatacaaaaattagccgggcatggtggcgcaggagaatcgcttgaacccaggaggcggaggttacagggagccgagattgcgccgctgcactccagcctgggtgacagagtcagactacatctcaaaaaaataaataaataaaaataaaatggatgtttgaagcttagcataccatcccagggcctggcacacaaaatgcagccgcctcctgtcccaccccggccttcccccttctgatatcccttccacccagctctgctccagtgcccaccaggtgctgctccatgcagaatccagcccacaccacccttcccaattcctctccttacaggccagctgcttgaactgtgacaggagaggctcaaagatgtcatagtagacttggtggacagcagtgttatcccggacgtagagcagatcttccaccgacatggggtccgaggcagcctgccacagcgtcaggctgtacctggggacacgagagctggctcagtgcctgtctgggcccagcaagaccctcagccccactcctgtgctcagaactggatgtcagctgggcgcagggtagagcatctgtcctccagtcgcccacctgccacttctccctgagtcctaccccttcccaagggcaggagccagagggaattcaggaaagatgactgaaagcagaggcccaggagggagggggagcctgtgctgcctcctcacttgcagtgtctatttctgagtcctgtcttaggaaaggggcaggacagatgggggagggtgtggaagggtaggtcaggcatcaagagggggagggggcagctttgggagtcctatggaaggtagggggtatagtgggggcaggggagtctctaaattcctatagggctatcctagggcaggggttaaaggcacaatctgtgtagccccaggggtacagcgggctcctattggaggaagctgtggggagacaaattgtgtcttggtataaatattttccagagggcagagaattacccaccaatgaaagggctctcttgggaggtagtgagtagcccgtcaccagaggtatgcaagcagaaagcagggactctgcagagggcatgagcactggcaggggttggacgaaatgacctttaagacccttccagccatgagcttctgggatcttgctgggggcatcagtgcctccaggagggtgggggtgggtttggtggttttcacctctcagattggctcagcagccagctgaagtggggccaggcagcccgcaccatggaagaccgtacagggaaggtgaccctctggggcactcctcccaccagctcgtgcatcttctccaccatggcttgggtgtacgtcctgtttggggacgtggacatgtagaaggtggtccagcctggagatagggtagccttgggatacttctcctggaccagggccaggaacctgcaaaaaaatcagagatgttggtctcacggagctgcagcggccccttcctctcctctggggtctcatcacagtgctagggagtggcagagcctattggatctatgataaggtcagaagcagagtcccaaaggacagaatggcttgtttcaggtcccataaattgggcgtggactttggagtcagggaagtctgggttcagatcctgattctgatcttgggcaggtaactcagcctcatagacagcatcccttccagcagggcaggcttcttaaacatcctcatatagacaggaaactgactcagagcccccagcgtgtgggaatctgagctctgccagctgggagtctctgaagtttctcaggttttctttaaaaatctccctcctgccaggtgtggtggctcacacctgtaatcccagcactttgggaggctgaggcaggtgaatcacctgaggttgggagttcgagaccagcctgaccaacatggagaaaccctgtctctactaaaaatacaaaattagctgaacgtggtggcgcatggctataatcccagctacttgggaggctgaggcaggaaaatcgcttgaacccaggaggcggaggttgtggtgagctgagatcgtgccattgcattccaacttgggcaacagagtgagactccatctcaaaaaaaaaaaactttttttcctgtcttcctgctttcctccctccttccctccctcccttttcttcccttcatgtctttctctcttttctttctatacgtggtctcgctgtgttgcccaggctggtctcaaactcctgagttcaagggatccgctcaccttggcctcccaaagtactgggattataggtgtgagccactgtgcccagcctaaaattttatttgaactttgccttgatgaaaatattttagtttttttctttgtacttttcttcttcaaaagatgcaaactttaataggcaaattatgttgccacccactgcccacccaaaaaaaccctactgagtaaaattagcactccaggaagacaggtcatatttatcttgggccattgattacattttccaaactgctatttttggaaggcacctcagcttgagaagcacaataataaattggatggatggaggaagagatggatgggaaagagcctggagcttagaatcagaaaggcctgggtttgaatctttgctctgccacttaccagacttaggcaggtcttttaacttctataatatagttcctgcattaataaaataaaagtaatactacctacctcattctcataagagttaaacggtgttctgcaagtcaagtgcttaaaacagttctgggacacataataaacttcgaacaaattgagcttccactattgtcagctttatcatctgcaatatggggagaaagccctaacctggcagtgctatgtaaggatgagatcaaagacattctctctctttgtaaactgtagagcactgtgcaactactgtatgtgagggctgtgagcagcggtgctggaattcatgaggggaattccagctggggaaggaatcaaggttttagacttctctagcaggccaaatcctgtgctggtcactggggaatacaagggggcacttggccctgtctgccctccaggagttcaatgtagtaggggtgacaaatctatgaacacccagtgacagccccatgaagtcagggctgtgttagaaggaagtgtaggggttgaggggcccagaggaagtcctgcagtggcctaagatgtcaaggaagtttctaggagataatgactggccagtggtttgtcagaaaaggggggaaaggcattggaggaagagggaacagcatgtgcaaaggctcagaggtgaggctatatatagtatgattggagacaaactcagaggtcccctaagatccccatcctgtggtaggtgttgacagaagagggctggacacagctgggacagagaggcgaacactcactgtgtggcattgacctcagttgagatgagcatgttggggccctttaagatgtcagcgttgatccatatgggccgccggactttgccttcctctgtcagctgccgcaggaggtccagggaggggcccactgccttgatgttcttgaagtccagtttgatgcctgtggggaaaggaacaagggcttggggaaatggcgaaggaactaggaatacatgactccctgggcagaaagcagagcgggtgtgtgtgtgtgtgcatgtgcgtgcacagtggagtcaggggagggcggaaggaccagcaccacatccctgcagggtgtgaggaaggcctttcgaagagacagagctaactcagagaagaagggcctgcctctagaggagttcccatctcctgcggggaggaaacagaggccaggtaaggacttgggcttgtggctgctgcagctgggaatcaagtctctgctgaaaagggcctgtggttcctgagcagggcagactcagagggtcctaaaccaccagagcctgtagggaggttactcagcctccaagaaggtgcatttgagtagaggaggagatctctgcagagaaaggacttggtacttttcagggtggtgaggagatgaggctaggaagatatagagggatgttgaaagccaggccaagatcacactttttcctgaggacaatggggagccacggagggttaaaagagaggcgtggcatgacaaaactggtgttttgaaaagatccttcaggtgcgtgtgtgtggtcatggtagtcaagggaagcctggaagggctgaatttggggcaggaagccagtgaggagggaggtcctggagagatacagtgttgctgcgactagatgggggcagggttaggggttaggattggtggatgcagcaactgagttgccgtgaggatgagggagagggaggcattatggtgacgcctggattctgactgtgactggtgaaggggtgcagaggggaagggtggggctgggctttgaacatgttacgtccagttctgtggatacaggagggagcactctgagcatgcgcggcactttgcagttcacactgtactgccggctgtctcccctctgtgtccaggagaaaacaccaggacctgcactgacatgctccccatctcgcctagtcctcactgagcctgggcatctataacattgtgatgagaaagccaaggcaatgagcacctcgtgtcagggctggacttgcttcccagtgagggatctctgcacatgctgccccagggccagagggctgggggccggagagggtttccagagaggcccttacccttttgggaagagcccagcacagcgtccagccactgctccagtgtgttgtcactgtagatagtgggggggtgtgccatgatgggaactcctgtctcattggctgtgccgagcccttctacattgacgtcagcctccaggactgtgatgttgcctgtggaaggggcaacaactcagtgagttcctttttttaaaaaaagaaaacttctttctcatcataaaagcattacaaattacagaacatttgagaaatacagaaaagtggaagaggaaaatattcacccacacttccatcatagtttcacatttcgatgattttttttcttccattttcttctatgcataggtttttgttttttttttgagacggagtcttgctctatcgcccaggctggagtgcagtggtgtgatcttggctcactacaagctccacctcccagtttcaagcaattcttgaaattctcctgcctcagcctcccaagtagctggaatttacaggcgtgtgccaccatgcctagctaatttttgtatttagtggagacggggtttcaccatattggccaggctgctctcagaactcctgacctcaagtgatccgcccacctcagcctcccaaagtgctgggattacaggcgtgagccaccgtgcccggccctatgcatagtttttacacagttgagactccactgcatttataattttttatgttttttcaacattatgacacatttccacgatctttttttatgcatctctttagagcaaacaaggcaaaaaagcaaaaagcttcaaaagccctggttgagggtgttcactactatgtagttgatcatcccccatccctgagatgctttggtaagtttctgatttttgctattagtcttgctatgttgccctgtctggtcttgaactcctgggctcaagcaatcctcccactttggcctctcaaagtgttgagattacaggtgagtctcagtgcccagcccacagggtcatttttaaagcccatgttatcaaactgctttccggaaaagttgttctgattcttgttcctgcacaaggttgcccatctcaccacatcatcactgacactgagttatcttttagcttcacatagttaactcaatcaggtggacatcttctgattcctgccttcaagaattcagtctagtagggagctcagacctttctaatgggaagctgtctctagataatcatgcaaggggcactcacacttgaagagtgtagtggaggggagaggggccgcttttggcccttgcagcatcacaaacgactgatgccagaaggggccttttctcctgctttctccctgactcctgaccattcttctcacctctagcactgcttccctgcaagtctgttctctatagagccggcaaagtgagtgtcctaaatatgtacctgatcatgtcactttctgttaaaaaaaaaaaaaaaaaggccagaaaacctacccattgctctaaacttgaaacccaaactctttatcatagtcttcgtggtctgtacaatcagggcctgccagattttccaatttcatctcacgttccactctccttcattctctgagttccaggcacccagcttctccaactttaatgtgcacatagatcccccaggaactgtaaaaatgcatgttctgatcactaggtctgcagcagggcctgagatttttttttttttttttttttttttttttttttttatgaagtctcgctctgttgcccaggctggagtgctgtggcgtgatcacggctcactgcaacctctgcctgctgggttcaagtgattctcctgcctcagcctcctgagtagctgggactacaggtatgcaccaccaccatgcacggctaatttttgtacttttagtggagatgcggtttcaccatatcagtcagccttgtctcgaactcctgacctcaggtgatccacccgcctcagcctcccaaactgctggaattacaggcatgagccaccaggcctggcccgagattctgcatttttaacacactccccagggatgcgcctgctgctggtccatgggccacacgttgggtagcaaggctttaatttgttttgtcctccccatctctgggctgttgcctggcaacactcttctctcaactttactatggcacctcctgctcatcctttagtgttggcttaaaaaaatcacctcctcagccgggcgcggtggctcagacctgtaatcctagcactttgggagcccgagaagggcggatcacttgagtttaggagttcgagactagcctggtcaacatggtgaaaacccatctctactaaaaatacaaaaattagccaggcatggtagtgggttcctgtaatcccagctactcgggaggctaaggcaggaagaatcacttgaacctgggaggtggaggttgcagtgagccaagatcacaccagtgcactccagcctgggcaacagagcaagatcctgtctcaaaacaaacaaacaaacaaaaactcttttcaccttaaaaattgtgacttgccttccagaggctgaacctgggggctgacttgcttgggggtgggaagtgaaggaggagaaagagatgagaggaaaggatttgtttcctgtggccacagctgtagccctggtcctcaggaagccatattcaggagggaaggggacatggagtcaatagccctccttgtgccagctttacccatctgcaggagctcgcggtggctgtgtgcagaccgtgaattgacactgctagcttccagtccccaccctaacactttccagctgtgtgatcttgggaaggttatttgatctttttttgcctgtttcctcatctacaagaattaaataataaaatatccctggttaggcattcactaagtgttaattatttatatggagttgattgcttaactagtgtaaggggccatctggtatatttctgttgcttcagcgtaattattaataatgacctcaaaagagccctgctttggttgatttggtcattctaccagccctcagaccccagtttccttgtctgaaatggaaggagtttgcttgagcagtgattctcaaagttggtcctggggccagcagcctcagcatcacttgagggtggggccagcagcctgtgtcttctgaaacgtgcccaggtttgaggactgttcccttcatcttttatagctactgctttaaagttcactagcatgttcgtgaacattatctactgagcttcccaacagccctgaaggagagggtgggggtcaagcgtcacgcagtggcttggagcgtgcactctgggactgaccactctgggctccaatgttggcttaactgctttcagacagtgtaaccttggctaagtcacctaacttttctgagcctctatttttctcctgtgaaatgttacccatgaaacagattgcatggtagtcccaggagaacctgtgtgtaatgtgcgcccagtgagccttggccaactggttactgtaaccatttttgaagtgcagatttctggcttcttgaggctttgaaggtaaaggcttccttacagtttggtccctgacaggtcgaggaaggggtagctgggagggaggacagtatagtcattactttggagtcagacatgtggtttaaatctaagctcagagtttgtcagctgcacaaccttgagctggtcacttaacccctctgagcccctatttcctcatgctgaaagacatgtaaacagccatcatgccaccacagtgaccagtgtctgatcctcacttctctccctctgtcttctctatcccttgccctggcctgcctcagtcttggcagctggacttactgttcagggcagctgtcatggctttcttgctgttggctgcgtggtaccaggtgacctccaaggcatctcgccggctgatctggcccaggctcagcaggtagtccagcatgtcggcatcagggctgcaggcctccagctcacagcctggaaggaatcccaaggggctgttagcgtctgtcctcgccccagcccaagactcatgttcgttcatcccatgaccctccctgggctcccactgtgtccagtaccccatctggcagagggacggtgaggctcagactcactggtgctacaatagagggaaatgaatgggctcctggggcccaaggaagcctcattaccagcctgaggcagtcaggaaagggggcaggttcacagagaagggaacacttaaggaagaccttgaaggatgggtgtaaatttcacagacaagggagaataggttattccagacagagagaaagcaaaggcttggcttcaggagagtgcagttgcctgaagagccattggcctggtagagatggaacataaaagtggaatgtggaaagattggaagagggggccgggcatggtggctcatgcctgtaatcccagcactttgggaggccgaggtgggtggatcacctgagattaggagttcgagaccagcctggccaacatggtgaaaccatgtctctactacacatacaaaaattagctggatggacgtggtggcaggagcctgtaatcccagcactttgggaggccgaggtgggtggatcacctgagattaggagttcgagaccagcctggccaacatggtgaaaccatgtctctactacacatacaaaaattagcgggatggacgtggtggcaggagcctgtaatcccagctactcgggaggctgaagcaggagaatcacctgaacccgagaggtggaggttgtagtgagccgagattgcaccactgtactcagcctggatgacacaaagagactctgtcaaaaaaaaaaaaaaaaaaaaaaaaaaaaaaaaggctgggtttggtggctcacacctgtaatcctagcactttgggaagccgaggtgggtggattgcctgagctcaggagttcaagaccagcctgggcaacatggcgaaaccccatctctactaaaaatacaaaaaattagttgggtttagtggcatgcgcctgtaatcccaaccactggggaggccaaggcagagaatcacttgaacctgggagacagaggttgcagtgagccggagatcatgccactgcactccatcctgggtgacacagtgagacactgtctcaaaaaaaaaaaaaaacctgcgcgcggcggctgacgcctgtaatcccagcactttgggagaccgaggcaggcggatcacctgagttcaggagttcacgatcagcctggccaacatggtgaaaccccatctctactaaaaatagaaaaattagctgggcgtggtggtccatgcctgtaatcccagctactggggaggctgaggcaaaagaattgcttgaacctgggaggcggaggttgcactgaacccagatcatgctactgcactccagtctgggcgacagagcaagactctgtctcaaaataaataaataaataaataaaattttaaaaaaagataaaagattggaagaacgttgggatcaggttgtgaatggcctcgaactttagcaaaggagttgctgtgtgctgagggcagtgagcgagggttgcttggaaagatctgggctgcagagctaacaggagctgacaaaagcaggcagagggaccttgtaagaggggtccaggaggagacttcgaagcttctcacagggcagggctggagggctggagggcagagggcagaaaggcagagcccttgaggctcaggactgaggaacacaggcatgaggtgggggcatggtggctactccaggtacctgtgtgaatggaggagcccttcactgagaggctgcaggggtgagcagctgttggggggaagagatgagctcagcctagtctgctgagtttgagattgcttgtgtgactcccaagaagggcacaggaggaaggtctgggctgaaagccaagatctgatggtcttcaggcaagtgaagtagtaaaaaaagttaaagggggccaggcacagtggctcatgcctgtaatcccagcactttgggaggccaaggtgggcagatcacctgaggtcaggagttcaagaccatcctggccaacatggtgaaaccccgtctctagtaaaaatacaaaaaatttagtctggtgtggtggtgcccacctgtaatcccagctacttgggaggctgaggtggaagaattgcttgagcccagggggtggaggttgcagtgagccgatatcatgtcaccgcactctaggctgagtgacagagtgagactctgtctcaaaaaaaaaaaaaaaaaaaaaaaggccaggtatggtggctcatgcctgtaatcccagaactttgggaggccaagatgggcagatcaggaggtcaagagatcaagaccatcctggccaacatggtgaaacccgtctgtactaaaaatacaaaaattagctgagcgtggtggcgcacgcctgtagtcccagctactccggaggctgaagcaggagaatatcttgaacctgggaggcggaggttgcagtgagccaagatcacactccagcctggcgacagagagagactccgtttcaaaaaaaaaaaccacaaaaaattagctgggtatggttgcacacgcctgtgatcccagctacttgtggggctgaggcaggaaaaccacttagatccaggaggccgaggctgcagtgagttgagattgcaccattgcactccagcctgggggacaagagtgaaaactccgtctcaaaaaaaatagttaacgggactttctgctggggaagtcaacgggactttctgctggggatgaagtcatgtagggttgggggatggaagagagaaagagctgtggatgggggaatgaggcttggtggggacgagggctcaagaagagctggttggccaggcatgatgactcacacctgtaatcccagcactttgagaggctgaggcaggtggatcacctgaggtcaggagttcgagaccagcctggccaacatggtgaaaccccatctctactaaaattacaaaaaattagctgggcgtggtggcgggtgcctgtaatcccagctactcgggaggctgaggcaggagaatcgcttgaacctgggaggcggaggttgcagtgagccgagaatcgtgccattgtactccagcctgggcaacaagagcaaaactccgtctaaaaaaaaaaaagggactggtcagagctgtaagtgagaagtggggataaggagcgagcgatgagggaagccactcaggatgacatggggggaggcacctacctggccgccgcagggtgatggcaaggactattgcggcaatgaccaccacagacacacaggtaatgccggcaaacacccacttgacctgattctttgataactgctccctgcagaccatggcgacgctctctggggaatgcccccaactccgtgcggcccagagtccctgaggctccctgcagctggaatcctgtgggaggcaggagctcccagcagcacctaattctccaccgggcctggtctgctctgcagccctgtaatatcccctctggagataacccctgaagcccctcctccctccccgccccaatcctcttccccacaccctcccaggatcttaacaggctaaccagaatatctaccatatctaaaatgacctttgagcacagtaagaggcagcagagaatgttggaccgagccccgacccctggctgtctgcccctgcttgggagtcaggagaccaatcccagcccctgttgcttttctggagtcctggagcaagtgtctgccggtctctgggcatcatttccttccgtgtaaaaggaggcactagactgggtgatcccgaacattctgttctttccctttctaactccaggctttctgccctgccctcagggaatcctgcattatcaggcaagggtggtgacaaagacagattagatctgcgtaaggggcaataatcttcctttcatctgagattatggttaacagattatctacctgggatagaaatggatagtcctggcatgctggcatgggttactgcaggccggttctggggcagcgagtccatggggaaggggctgagtcaccacttcatgcagagggagttctgggggccctggtatgggaagcaagttagaggctgcccctattctgaggaccccagaatttaaacgagtccaggaatcacctgtaatgtgcacagagacttcagcgtctacacattggggctcacagagagatctggaatgtgaggctgtgataggccacccgaggcagagccgggcagttggtggctttgattgtgtgtgtgaaagggtgtctagaatgatgcccaggtgggcagatggtcgggactgaggggtggaggggcagggtgggagggattttggtcatggggcttgtcgtgggtcattcctgagtccattttcctgcctcggccttcccgaggagggaactggatatagaggctgtgggctcaggactgagatcagggccaaagacaagggcatgagcatcattttctggccaaagcaaagagagaaagggatggaggctgacttctggggaccactgacaggcggagagttggaggaagaggcattagtagaggaaaggggacagcagagggcggtgaggggtgtcaatgggaaggtcaagaagaaaggagtggtcagccaggctgggagatggagccctgtaaggacagcaaggcccccgatgctggccaggacagtttccctggatcagtggggagggcagaggtcagagcagagcctgtttagaggggccaggaaagaccagagaggctgaaggtacaggagggagaggcactgggacaaagtgaggatgggagcaggaggacctggtgctcagggggtgctattctgtaggatgtggggaacggtgggcattgtgagtggtgagtctgggggtgctggttgggaggtgatgtggtgaagggggacaatgagggagaggtttgaggacagggaggttctgttggctggtcggggcatgtgtggtatgcctacagggatccaacgagacccaagctgtgggctgctagatggacaggaccccattcaacaccccctccccaccactgtgtatatccggaaatgtgagactgtgatgggccacctgaggcagagccagccctggagcccaggctcaattctcagttcttggaacctctggagagagggagatctagtctgtctgggcttctggctcattctccaaatcaactcaacaaactcagcagctgccaggagccaggccctggtgaggtgtcagggctgctggctggaatggagcagggtcagtgctctggggtctgctcaggagacagtaagggggctgtagacaagcaggaacatttttgtgagtcccctttcttattggggctgctctctcaggccacccactccggactccaggatccaaatgctaactgggcctcacccagatcccttctgtaataaggcatggaagggtgtgttaactgggatattatgatagccgcaaaaagttaacagaatgacagaagctacatctcgagtaacaaccacatatgctttactctacagttaaagtctagaggaaatttctgtttaagagttggccataaaaaagaaaagaaaatgctgagccaggcgcggtggctcatgcctgtaatcccagcactttgggaggctgaggtgggcggatcacctgaggttgggagttcgagaccagcctgaccaacatggagaaaccccatctctactaaaaaatacaaaaattagctgggcatagtggcgcgtgtttgtaatcccagctactcgggaggctgaggtaggaggatggcttgaatctgggaggcggaggttgcggtgagccgagattgtgccattgcactccagcctgggcaacaagagtgaaactctgtctcaaaaaaaaaaaaaagaaagaaagaaaaaaagaaaagaaaaggccagcatggtggctcacacctgtaatcccagcactttgggaggctgaggcgggcggatcacttgaggtcaggagtttatgactagcttggccaacagagtgagaccctgtttctactaaaatacaaaaattagctgggcatagtggcacgagcctgtaatcccagctactcgggattacagtacaggctgatgcaggagaatcgcttgaacttgggaggtggaggttgcagtgagccgagattgcaccattgaccaccagcctgagcgacagagtgagaccctgtttcaaaaaaaagaaaagaaaaaagagaaaagacaagaaaagaaaagaaaagaagtctagaggaacaacaaaccactagaattatacaatgtgactccagggttgtccccaagccccatactgataagtctcacctagtctggcttgcattttttctgcttttattaataatattatttgtgatttcctacaaagtgtcccacattttaatttcatccacttgtcacacaacactgccaaatgactctcatgtccccatgttgcaggcaaagaaatcaaggcttggagaggtcgagacttgtcccaagtcacctctatgttaagttcaaatgcaggtcaggctgactgtgggcctatctgcctgattttatccatctacttgtcccttcttattcacacccatttacaatgggacagtcacttattttggcaagaatatttaacagcaatgctggacaaatctatttttgaaagaaaaatcaagaacttagttcttacggtccatgagggcaccccctgcacaaaccattctcattttggaactgctgcttatttagtgtttgtgacactcttatgaaggaggcattcttttatttatttatttatttttgaggcagagtcttgctctgttgcccaggctggagtgcagtggcacaatcttggctcactgtgacctctgccccctgggttcaagtgattttcctgcctcagtctccaagtagctgggattacaggtgcgcaccaccacgctcagctaatttttgtatttttagtaaagacggggtttcaccatgttggccaggctggtctcgaactcctgacctcaaatgatccactcacctcagcctcccaaagtgctgggattataggcgtgagccactgtacccagccgaggaaggcattcttatgcccctttttcacagaagggagccagagtcagtttgcagcagaaagggatgcccatgccctgtcattccaactccgcgggccgtgtgtcacctgtcctccctgggaaagaggccggcgagccgagctctgaggcacagagcttcgccactctcttggttccaaagagctctgcaggatgtctgggaggaaagagacttcatctggctctggtttttggcaggaggaacagccctggaaccgactccaagctgtgaagactcctccattgtctgtgacacttctcgtggggcataaattactaaacaagttactgagcatgcattctgtgccaggcactgtgctaggctctggggatccaccccgtggcatactgtgggagagaagaaagcaggggctgtcagggggctccagcatttcagatgtgaaacagccattttattaatagagctggtgcacatcaaaaacacagagcaggcttatagcctgtaaggatgtcagacatggaaagtggcagtgggcccaggttggggcatgcaggatggagaagacacaggttagaaaccccaaactcctgggtgggccaggaggctttcagaagaggcttggctgactcggagaaccatcagggacgggggctagggaagaccttccagacaaagggtgcagtgtgtgtgggagagggcacaggcatgagggagaagagcctgtttgggagcgtgagtggtgtggctggagcagcaggtgggaaatgtggggaggcggagggggagagaaatgagactggggagccccggaggcctgggtcaccctgataaagaatttggcttcaacctggatgggttggggagcccttacccatgggataagcagggagcgccacactcagcttgcatttgggaggtggctggaggctggagttgagaaatggttctggaggcctgactgcctctgcatccaggctgtcctgtttcagcactgctcacccctgcaccccggcagagccacaggacttcccacactgcattgcttagaacagcaaatggcccagggaagtgtgtgcctcaggctgtgttatgtgggttactctgatactctccccactcccataccattgcatgttacaggggaggtgaaaccaggggtggttcagaggctccaacatttcagacatggagctgtcatttttagaactggtggctcacacctgtgatcccagcactttgcggggctgaggtgggaggattgcttgagcccaggagctcgagaccagcctgggcaatgcagagggatctcatctctacaaaataaaaaaataaattagcgagacatggtggtgcatgcctatagtcccagctacccaggaggtgggaggatggtgccactgtactctatcctgggcatcagagcaagaccccatcgccccccccccccaaaaaaggaaaaaagaaacccatttgcctattttgacactgtcatgaatttgtactgcttaggtggtctcagcactctaaatggtggaattttatttaaagtagtttcatgtcggtagtgccccaagataactactacaagcaaaaacatgttttattaagaggaagatagaggctgggtgcagtggctcatgcctgtaatcccaacactttgggaggctaaggcgggcggatcactcaagatcaggcattcgagaacagcctggccaacatgacgaaatcccgtctctactaaaaatacaaaattagcggggtgtggtggctcatgcctgtgatcgcagctatttgggaggctgagggaggagaatcacttgaaccggggaggcagaggttgcagtgagccgagattgtactgccgcactccagcctgggcgacagagcaagactccgtctcaaaaaaaaaaaaaaaaaaaagaagaagaacacagctttaatccaggcctcaaggaattgtgagacaaaatttcagggaaaataagcagttccctgtcaacaaccccaaaaatcataagaaaataaggcaccatgggtgaaaaccaagagatgatgtaaacagcagaatcagacccacaaagtattcagaatacaaacttatcaaaagtaaaataacatggtttttttcttttttgttttttgttttgagatagagtctcactctgttgcccaggctggagtgcagtggcgcgatctcggctcactgcaacctctgcctcccgggttcaagtgattctcctgcctcggcctcctgagtagctgggactacagatacatgccaccacacccggctaattttttgtatttttagcagagatggggtttcactgtgttagccagggtggtctcaatctcctgacctcgtgatacgcctgcctcagcctcctaaagggctgggattacaggcgcgagcccccgtgcccggcctgttttttgatttttttgagacagtgtcttgctctgtcatccaggctggagtgcaatgatgtgttcatgtctcattgcagccttgacctcctgggctcaagctattctcccaccacagcctcccaagtagctaggactacagctgtgcaccaccatgcctagctaatttttttgtgtgtggagatagggtgtcactatgttgccaggctggtcttgaactcatggactcaatccatcctcctacctaggcttccccaaatgctggaattaaggcatgaactaccacacccagcctgtttaatgtttatttttttatttttatttttatgtttgagacggagtcttgctctgtcgcccaggctggagtgcagtggcacgatctcagctcactgcaagctctgcctcccgggttcacgccattctcctgcctcaacctcctgagtagctgggactacaggcgcctgccaacatgcctggctatttttttgtatttttagtagagacgaggtttcaccatgttgaccaggatggtctcgatctcttgacctcgtgatccacctgccttggcctcccaaagtgctgggattacaggcgtgagccactgcgcctggcctgtttaatgtttaaagaaataaaaaaaacaagccaggtgtggtggtggctcacacctgtaatcccagcactttgggaggcctaggtgggtttggagcaagccccccacagtctggccataaactggccccaaaactggccataagcaaaatctctgcagcactgtaacatgcccataatggccctaatgcccacgctggaaggttgtgggtttacgggaatgacggcaaggaacacctggcccgcccagggtggaaaaccccttaaaggcattcttaagccacaaacaaaagcatgagtgatctgtgtcttaagggcgtgttcctgctgcaattaattcggcacatcccttcgtttcccataagggatacttttagttaattcaacatctatagaaacaatgctaatgactggtttgctgttaataaatacgtggataaatctctgttccgggctctcagctctgaaggctgtgagacccctgatttcccacttcacacctctatatttctctgtgtgtcttttaattcctctagtgctgctgggttagggtctccctgactgagctggtctcggcaagtggcttctattcctgggggctcgaatccaggtcaaagggtcgcaggagcgacggttggaatggaaaactagctggaggacacctgagtactcttaaagcaatccccgtggtgagtaagaaggggagtccggaagcgtcagggtaacaatgggatgggtatggggtctggttcgtttcaccttagaactttttcacactgataacgaggaggaacaacagtatagcgaagtaacagaagaggttacagagcatgtttatttgccagctgaagctaaagcggcaaaggaaggagagtttcatccctacccttctgcatcccctcattattattttgaagaaaatgactccccagatctttcttttccggaggacactgggcgaaaagtagttgccccagtgactgttcgagcagcgccttgagcgacgtctcttagttctattcaggcaggaattcagcaagctagacaagagggtgatttagaggcttggcagttccctgttagaatacaccccccagatcaacagggaagtattacagctacatttgagccttttccttttaaattactcagagaattaaaacaagcaataaatgagtatggaccaggttctcctttagtaattggactgttaaagaatgttactgtttccagtcagatgattcctactgactgggacgctcttacttgagcttgtgtaactcctgctcagttcttacaatttaaaacttggtgggcagatgaagcttccattcaggttgctcgcaatgcccaggtccaacctcaaattaataggactgcagaccaactttcgggggttggcggctgggctggtttcgatgcacaagtggtcatgcaggatgatgccatggaacagcttagagcagtgtgcattagagcttgggaaaaaatcacttcaggtggggaacaatacccttcctttagtgctatagagcagggaccaagggaaccataggttgattttatagctcggttacaggagtctcttaaaaagatgattgcagattcggctgctcaggatacagtgttgcagttattagctttcgacaatgctaatcccgatggccaggctgctctgcgacctatcagagggaaagcacatttagtttattatatcaaagcctatgatggtatcggaggtaatctgcgtaaagctaccttgttggcaatggcaatggcaggactgagagtggataaaggaaatactccatttcctggagcttgttttaactgtgggaagcgtggtcatactaaaaaagaatgtagaaaaaatcagcgagtcaggccaccagataggggaaaaaagaaaactgctgatcctgaaatatgtccaaaatgtaaaaaaggaaaacactgggctagtcagtgtcactctaagttggataaagaagggaacccaatttcaggaaacgccatgaggggcccgtcccgggccccgctctaaaccggggcgtttctggctcaggccattccctcacccctgtacaatgtctgtcccctgccacagccggtagtgctgcagtagatttatgctgcacaaaagctgtgagccttctgcctgcggaaccccggcaaagggtcccaacaggagtctgtggacccttgccagtgggtacaataggattacttttaggaaggtctagtgtaagtttaaaaggtatacaaatacatacaggagtcattgattcagattacagtggggaaatccaaattgttacatctacttctgttctctggaaagcagagccaggagagcgcatagcacagctcctggttgtgccgtatgtgggaatgggaaaaagtgaaattaaacgaacaggagaatttggaagcacaaataaacaaggcaaagcagcttattgggtaaatcaaattactgataaacgtcctacctgtgaaataactattcaagaaaagaaatttaaaggtttggtagatacaagaacggacatttcactcatttctgtacagcactggctgtctgcgtggccaattcaacccgctcaatttaacatagttggagttggtaaagctgctgaagtatatcaaagtagttatatattgcattgtgaggggcccgatggacaacctgggactattcaaccaattataacttctgtacctataaatttatggggaagagatgtattacaacaatggggagcacaagttctaattccagaacaatcatacagccctcaaagtcagcatacaatgcatgaaatggggtatgtccctggtatgggactagaaaaagatttgcaaggtttgaaagaaccacttcaagcggaaaaacaaagttcccagaaaaacaaagttcctgctaaagattaggaaaaaatttttggtggcagccattgttaagcctccagaacctatacctttaaaatggttaacagataagccaatttggatagcacattggccactaagtaaagaaaaactggaggttttagagaaattagttgctgaacaattagaaaatgggcacataactccaacattttctccttggaattctccagttttcataattaagaaaaaatcaggtaaatggagaatgttaactgacttaagagccatcagttcagttatacaacctatgggagcattacagccaggattgccttctcctgctataattccaaaaaattggccttttaatagtcatagatttaaaagactgtttctttactatacctttagctgagcaagactgcgaacagtttgcatttacaattcctgcattaaacaacctgcagcctgctaagtgttatcattgaaaagtgttgccacagtgcatgccaaacagcccaacaatttgccagacatatgtggggcaagcaattgaacctacccgtaaaaaatttccacagtgttacattattcactgtcaactaaaaacattaaatgattttcaaaaattactaggggatattaattggatacgacctgctctaggcattcctacctatgccaggagtaatctgttttctatccttggaggaaatcctagtctcactagccctcggcaattagcaaaagaggctgaggcagagttacaactgattgagaagcaaatccataaagctcagataaatagaatagatccagagaagactctagatttgctaatcttttcaactcagcattcacctactggtgttattgtccaagaacaggacttagtagggtggctttttcttccacatactaattcacagactccaactccttatttagatcaaatcgctactatgatagggattgggagaactcggattgttaaattacatggatatgatcctggaaaaattactgtccctctcacaaaggcacaaatacagcaagcttttataaatagtcttacttggcaaacccatttagctgactttgtgggtattctcgataatcattttcctaaaatgaagctatttcagtttttaaaattcactaattggattctccctaaaataactaaatttaaaccaattgaaggtgctgagaatgtttttacagatgggtctagtaatggtaaagcttcttattctggctcaaaaagtaaagtttttcagacgtcctgtactcagctcaaaaagcggagcttgtagcggtaattgaggtattgactgcttttgatatgcctattaatgggatttctgattcttcatatgtggttcattccacacagttaattgaaaatgctcagttatgatttcataccgatgaacaactgatgataaaaacaaaaaaggtggaaaaatagggattacagaacagcccatacacaattgaatctagcattatttggtgaagagatccaataacaaaaagttgggaaataggtaaaataataatttggggtagaggttatgcttgcgtttctccaggccaaaatcaacagccgatttggataccttcaagacacctgaaaccttatcatgagc

SEQ ID NO: 1200 - DNA, 62199 bp, Homo sapiens
agtctgaagagaggcgggacgcggggtgataacagctggctctggtgggcgggcgggagctggggaggaggagcaggagaggcccacaggcttcatttggagtcaggcctggctgttgctcaggtgaccagcttgtgtctctgggagggcgctgctttccccggccacccggcgcgatgatccagaatgtcggaaatcacctgcgacgggtatggagggtgggctggggcagcgggagggctctggaagctgggcacccagaaagagattgatgtttccattttaactcagacgctctgcatctcctcacactctccacgggccattttctagctctctttggaaggagaaatcgcagaacccctgggctggtttattatcagcagcaatctccaaacaagccccaggggctgtcagatcccccacgggctggctgtgtagagtggaatcaccttcagcaagtgtcggcctctggaattctattcggtgggtgtatgtttctccctgcagagttctgtgtatgtttctgggggatgtctgagctccatggccttgtggtgcttcatgctcagagctcaggaccccaaagccacaaagctgatgggagtgacagggtgtgaggtatgggtgtgagtgagtatgtgtggtggggtgaggtcggcgttcttggggagcagaacctcttggggagagcaagcacaggatcacatgacggctgcggaaagctgtcctgcaaggtgaccttgaagagaacttttccctgcgctttggagctgagattagttgctgaggcacacggcagacccaagtgcccagcagcgcctggcagtggatggagtgtatggagatgggctcaggacagactggcagaggttgtaagactggcagaggctgacctctgaggatattttcaggaaaagcctttttttaaaggggctggaacaattaaatgtcttatctatcctctccctccatctgcacagccactgcacaactcagcatcctcaccgggccctgtgcatcttgtctcccctggctcccccattccatgtcagcccctttcagtccactctccacactggagggatgcttctaaaaagtaaatgtgctgactcctcacctgctcacacggctacccgaggatgattttcacatcccttacttgagacgaagggatgttggcactctggctcctgcccatgcctccctttttcttccaccatccccacccctctgctgtccctgcttcagccatagtgagctgctctccgcggcttcggtgtcccacttttgttctctcctccaggctgttgtacttgctatgtcttctgccggagttacccccagccttcctgcatctccccaaacttgtgtccccagcaagttccttctgagccctcagatctcagctcaggtgctgcctcctctggaagtccttctcagatttctcatgacaccatgagcctctgtgttagccccttttcacactggattgtgtgctagactggcacatacatccctcccaccagccagggagcaacacgaggctgctcttggtatacccagcacggggacgggtgtggccagaggccagggaatgcttaatgaatgaatggggacaggcagcttttcagcagcgaggctaagggtgggatctgagtagcagggccgcttgctcttgtcacctgagtgcagggcagagtgtctcccaggagggaggggctcctcgtatcttctcttgtgccctgttgtatttaaccctttatgactttttccttcatcagtaactgggggcaaggcactggggaagaggcatatcgttatcactgttttacagagataacaatagtaacaaatcttcacatagctctttgcatttatgaactcattcagttctctatgaggtaggtacagttatcatccccgtatcccagataaggaccctcacagagggtaagtgacttgcccaagatcacactggtaggaagtggcagagctgggattagaacccagcagtttggccccagagtctgagctcttaaggagcctgaggctcagccagatgaaggcgcagatgtgggattccaacccacacgtcctgactctgagcccagctggcattcagcttccttgcactacctttgttgagtctgggggtggaggtgggtattgggagtggaagttgggctcttgaggacacaggtagcctcctgtcagctaagaacactctggccttgattgccacctctgcaccattgtctggatggcagatctctttggatttctcttgaattcccttagttcctctggaatacaagagggtttgggaacattttctggcttggtaccaaagctgtttttaatgaaaagcaaacaagcaaacaaataaacaatccctggccagctgtggtggctcacacctgtcatcctagcactttgggaggctgaggcaggtgaattgcttgagctcaggagtttgagactagctaggccaacatggtgaaaccccatctctaccaaaaatacgaaaaaaaaaatagctgggcatagtggtgtgcacctgtggacccagctactcgggaggctgaggtgggaggatcacttgagcctgcctgggaggcggaggctgcagtgagccaagatcatgctactgtactctagcctggatgacagagtgagatcctgtctcaaaacaaaaacaaaaacaaacaaaaaaccccaccaagctgggtgtggtgacccatgcctgtaatcccagcactttgggaggccgagacgggtggatcacttgaggccaggagttcgagaccagctcggccaacatggtgaaaccccatctctaccaaaaatacaaaaattagctgggcatggtggcatgctcctatagtcccagctactcgggatgccgaggcaggagaattgcttgaacccaggaggcagaggttgcagtgagctgagatcacaccactgcactccagcctgggcgacagtggtctcaaaaaaaaaaaaaaaaaaagaaaaaaaaccagcaacagcaacaacaaaaaactcaccaaattgtctttaatagggactaaactgggaacagaagagggggtctcagataatccacaagccccactttgcatggttgggggccattttcagtgtcctgtggcactgtagacagagtcagcattggagttcaagggctctggtccctactcgcccctgggtacccagcaagtgagtgggcgactgaatgaagtggtcagcctgctgccacgctcggggctgggagaactgctgagtgcagtgtggtggtgcgggaaaggtctccctgtcccgcttcaatccttgcctctccccgtggagagctcttctttccctttccaagatgtcagtctacactgggcactgagtctcacatttctgggctagcagggacccactggtgccctcgtaggaggtgggcaagggtcctgggaagcctgggaacctctgcccagcctcaggtctagcctggcccaggtcagctctcagtggggctcagaagctttttttactccagaaatggtgatggggctggctgtttttgttttgtttttgtttttgttttgttttgtttttgtttttgtttttgtttttgtttttgttttgagatggagtctcattctgtcacccaggagtgcggtggtgtaatcttggctcactgcagcctctgcctcctggattcaaggaattctcctgcctcagcctccggagtagctgggattacaggtgcccaccaccacacccagctaatttttgtattagcctccaaccacacaatgcaatcctactgttttaccttgaacctgaggacagctggagggctccccacaacctctcagcttcataaggggtctaacccagagtgtggggaggttcaggcacaacagttggatgttcaccccacggttcacggtgtgacctttggccaggggttcctctctctaggccttagggtgctgggtgatccctgaggtccccaccagcctggacatcctggggctctgaatgtttgtgaagggtttgtctgccaccatgaagttgatcctgacagtgagaggcagggtcccgtctctcttgaggaccctactctgtgttggaggtggggagaccttagacataaaatgatgggcctatcatatacgaggagtcccaaaactgctgaatgaatgagtgaccacaggtgctcagaagcaggctgaggtggtcctagaaggcttcctggaggaagaggtgagacttgaacatgtagcatcagcctgttcaggagccatatgtgaacccccagcctcagccatgggcagacactcttagtgttttttttgtttgtttgtttttgaggcagagtctcactctgtctcccaggctggagtgctggagtacagtggtgccatctcagctaactgcaacctccacctctctggttcaagcgattctcatttctcggcctcctgagtagctgggactacaggtgcgtgccatcggctaattttttctatttttagtagagacggggtttcaccatgttggccaggctggtcttgaactcctgacctcaggtgttctgcctgccttggcctcccaaaatgctgggattacaggcatgagccaccatgcccggcccactcttagtgttgttgttgttgttgttgtttgtttttgttttgttttttttttttttgagacggagtttcgctcttgttgcccaggctggagtgcagtggtgctattttggctcaccgcaacctctgcctcccaggttcaagcgattctcctgcctcagcctcccaagtagctgggattacaggcatgtgccaccatgcctggctaattttgcatttttagtagagatggggtttctccatgttggtcaggctggtctcgaacttccgacctcaggtgagccacccgcctaggcctcccaaagtgctgggattacaggcgtgaaccaccatgcccggccagtgttcttaatttatctggaggactctttttttgctctccaaaattttattttaatatgcatagcataagggaatgattacctcattaaaaaatttttttttaatgggccaggcatggtggctcatacctataatcccaacactttgggaggccgaggtcggtggattacttgaggtcaggagtttgagaccagcctgaccaacatggagaaactgtgtctctattaaaaatacaaaaataagctggatgtgcccagttgaacctgggaggtggaggttgcagtgagccgagatcgcgccactgcactccagcctgggtgaccgaacaagactctgtctcaaaaaaacattaaaaaaaaaaaatggacaggtaatattctatgtttttatcatgtacaaatgatgttttgaagtacgtatacattatgttatgactaaatctaattaacagatacattacctcacatagttttcatttttttggtgatagtgcagaacatctactctgcatttttcaagaatacaatatattgtcattaaccgtatcaccttactgtataatagatctcttgaaatttattcctcctaagtgtaattatgcatcctctgactaagatctctccatccccccaacaacccctgcctctgataagcagcattatactctatttccatgaaatcaactttttaagattgatgtctgagtgaggtcatgtagtatttgtctttctgtgcctggcccttatttcacttaatataacatactctgggggaggtggctcgtgcccataatcccagtacttcgggaggctgagatgggcggatcgcttgagctcaggacttcgaggccagcctgggcaacatggcaaaacccgatctctacaaaaaccacaaaaattgccaggtgtggtagcacgcgcctctagtcccagctagttgggaggctgaggtgggaggatggcttgagcctgggaggtgaaggttgctgtgagctgaagttattgcatttcagcctgggcaacagagccagaccctgtcacacacaaaaacaaaaacaaaagaaaacaaaaaaaaaaactccaccataacatactccaggttcatccatgtagttgcaaatggcaggattttattttatttttatggctgaatagtattccatagtgtgtgtgtgtgtgtgtgtgtgtgtgtgtgtgtgtgtgtgtgtatatatatatatatatattttttttttttttttttgagatggagtcctgctttgtcacccaggctggaatacagtggtgcaattatggcttactgcagcctcgagctcctgggctcaagcaagcctcctgcctcagccacctgagtagctgggaattagaggtatgcaccactgtgcccagctaattttttttttaagtttttgtagagatgggttctctctatgttgaccaggctggtcttgaactcctggcctcaaactatcctctccccttggctgttgggattgcaggtttgagccaccacacccagctttataccacattaaaaaaatccattcatccactggtggacacttagttggttccatgtcttggctattgtgaagagtgctgcaataaacacgggagtagaggtatctcttcaatatactgatttcatttcctttggctatatacccagtagtgggactgctggatcatatggtaattctatttttaattttttgaggaacctccatactgttttccataatggctgtaccaatttacattcccatgaacagtgtcaaaaggttgccttttccccaaatccttgccaacacatattgtcttctggttttgtttgtttgtttgtttgttttgagacggagtctcactctgtcgcccaggctggagtgtagtggcacgaccttggctcactgcaacctccgcctcccgggttcaagtgattctcctgcctcagcctcccaaatagctgggattacagacattgcgacaccatgcctggctaattttttgtattttcagtaaagatggggtttcaccatgttggtcagcctggtctcgaactcataacctcatgatccacctgccttggcctcccaaagtgctgggattacaggcgtgagccaccacgtctggctctggttttttgatagtagctattctgacaggtatgagatgctatttcattgtggttttgatttgcatttccatgatgattagtgatgttgagcatttttttcatatacctggtggacatttgtatagcttcctttgagaaatgcctattcaggtcttttgcccattttaatttttttttctattgagttgttttacttctttgtatattttggatgttaaccccttgtcagatatatagtttgtaaatattttctcccattctgtaggttgtctcttaactctgttgattggttcctttgctgtgcagaagtgttttggtataaagaaatcacatctatttttgcttttgttgcctgtgcttttgagaccctatccaaaaaattcttacctagcacaacgtcatgaagtgtttcccttatgttttcttctagtaattttgtagtttgggggtcgtacatttaagtctttaactcatttttattttttattttttatttttttttgagatggagtctcactctgtcgcctaggttggagtgcagtggcatgatctcggctcactgcaacctccgcctcccaggttcaagtgattctcctgctgcctcagcctcccaagtagctgggatgacaggcacatgccaccacgcctaactaacttttgtatttttagttgagatgggatttcaccatgttggccagcttagtctcgaactcctgacctcaggtgatccacccgcctcagtctcccaaagtgctgagattacaggtgtgagccactgcacctggcctgatttttttatacagtgagagataagggattgatttcatttttctacatgtgggtttccagttttcccaacatcaattgttgaatagactgtcccttccccaatgtgtgttctggcacctttgttgaaaatcagttggctgtaaatgtgtagatttattttggagctctctattctgttccattggtctatatgtctgtctgtttttataccactaccatactgttttggttaatgtagctttgtagtatatttcgaaatcaggtagtacagtatgatgcctttggctctgttctttttgctcaagattgctttggctatttggggtcttttgtggttccatatgaattttaggcttgttttttctgtttctgtgaagaatgtcattggcactttgatagggattgcattgaatctgtagatcactttgagtagtatggacattgtcaccataattcttctgatccatgaacatgggatcttttcatttatatcttcttcaatttctttcattaatgatttatagttttcattgtagagttttttttttttgagacagagtctcactgtgtagcccaggctggagtgcagtggcatgatcttggctcactgcaacctctgcctcctgggttcaagtgattcttctccctcagtcccccgagtagctgggattacaggtgtgtgccaccatgcctggctaatttttgtatttttagtagagacagggcttcaccattgttggcaaggctcgtctcgaactcctgaccttgggtgatccgcccaccttggcctcccaaaatgctgggattacagacgtgagccatcgcatctggtcttcactgtagagatctttcatctcctttatttattttttaagagacagtgtttccctctgttgcccaggttggagcgcagtggtctgatcatagctcactgtggctatgaattcctgggctcaaatgatactcctgcctcagcctcccaagtagctgagactacaggcatgtgccaccacacctggcagattttttatttaaaaaaattaaaaaaaatttttatacttaggccaggcatggtggctcacgcttgtaatcccagcactttgggaggccaaggcaggcagatcacaaggtcaggagttcgagaccagcctggtcaacatggtgaaatcccatctctactaaaaatacaaaaattagtcaggtatggtggtgcgcacctgtaatcccagctactgaggaggctgaggcaggagaattgcttgaacccgggaggcggaggttgcagtgagccgagatcatgccactgcactccagcctgagtgacagagaaagattccatctcaaaaaaaaaaaaaaaaaagaaaaaaattaaattatttatctacccttgtgtgcactgaaaaaaacattttaagagatagagtcttgctatgttgcccaggctggtttcaaactattgggctcaagcaatcctcccacctcagcctcctgagtagctggaattacaggcatgagccaccactcctggtttttacctccttggttaaatttattctcaggtattttattttattttatttttcgtagctattgtcaatgggattgttttccagatttcttttttagatagtttgctattagtatatagaaagactactgacttttgtatgttgattttgtatcctgcaactttactgaatttattattcctaccagttttttagtggaggctttagggttttctatatataggattatgacatctgcaaacagggacaatttaacttccttctttccaatttggatgccttttatttctctctcttgcctaattgctctggctaggacttccggtattacgttggatataagtggtaaaagtgggcatctttgttttatcccacattttagatgaaaagctttcaacttttccctgttcagtggaggactctttttcatctttcaaaacccagctgggctatcatttcccctttgaatcctcatcttgtctgtccctagagttaatgacgtctcctcaggatgttgtatatacttcactcgttccctccacgggtacttactgtactgggggattaacagttagccagtgctgggtatgctgtggccaatgatatatatagcctgtttcctggagctgacagctagtgcaggagagatagggagaaggtattcaaataaacaatgatgaaaatctgcaataagtgctatgaatagtagtaataacagtaaatgccatacaagtgctagctgtatgccatgcctgcagtaactcattattccttataacaactctgtgaagtagataattgtgtccgtattaaagatgaaactgagacagacaggttaagtaagttgcccgaggtaacacagctagtaagtagcattgctgggattaaattgagactgtctggagaacagggagctgtgagagaatgatgagggggtcaggggagagctctctgagcagacgacagctgagcagaaagctagcagctgagaaggcagccttgggaagatctgagggaagagcattccagccaaggggaacagaatccattggcaggctccaaggctggggcgagcttggtgcatctgagcagctgaataggggcccagcagcccctgctgctcactcctcactccacttggagtggagggagcaaagggaacagctggaagaggctgagggcaggcttccaggacctgcaggctgggggtccaggccttgtaggctgagtttgggctttcgagcgctgtgggtcatgttgtcttgcctacctgcctgtgagagccatgagggctcccttgtccccaggcttagtgccaagatatgcagttcccgcacgctgggctcagcgacccagggaaacacatcatcatggttccccttctttgtatggccagcaccttgaaggtctcagctgcctccccattcaccccctgactcctcacaacagggaggtgggtaaaaggctcagcccccgtgagagacgaggcacagagaagtgaggtgacatgcctgggtttgcacacctggcaagagacccagagctctcatctgctagactgggtccccgtttccagcccttgtcttggctagcggggcatctggaacttccgtgcacctagaatgtggcctcactgttacatgtggacccaccccatcccagcctcctctgcccaccctcacacactgacagtgtagattcagggccccaggctgagctgaccccaccccacacacctcagggtcgagggaggctgcccactgcccctcacctgtgcctgggctggagcagggccaagctggcatcccgggagccttcggagagctgctcatcactcggcccgatgacgaaaagggtgctgccttagaggcactcactcacctcacctctgtgggcatcagtttcctaatatgaaccagttctcttcctgcagatcatgccaaattgttgtcaggaatagagatgttgaaaaaatggagaactcggcacataattggccatggtgaatagttttctttttttttttttccatctcatgtgaacctcagttttctcagtggttcaatggtagggtcagttggtcagatgagatggtgaaagcaaacttttctgttgaggacctactaagtgtcgggcatatttaaacttcccaacagctttgcaaggcttctggtatttatctggctttacaagttagaaaaccaaggctctggtatgaagccactgtgatctaattagagaattcaaagcctcatctgaccccaagctccagctgggcaggggccctgggtgctgaagctcctctccttgtcctgggctgacctggctgagccaaggaactgacacctctgccttatgcctgctctgtcctgtggctccagggacagatggtgctgctggctgggtcctctgccagctccctggctgcaggcctgtgtgctcctgccattcccaggggcagccttgcgggttagaggtgacattggggcagtgacggactggggcagaccagagtctgacactttggggacacagggatgagccagactagacgtgtcctcagatgccctcaggttgatggagagacagagggaggtacaaacctactatggcagcacagcacagcacagccaggatgtgacagagggaagcaccaagatagcccctcaccagcccagtggtcagggtgggctccctggaggaggtgatgggttaggttggccctaaaagcttttctgggttaggaagaatgatccaggcagaggcacctgtatgtaagagatgtgaaggagccaggtccacagagaaatgagggagttaagggcaccctccttgacccccttgtccatgtaatatgtatatcctgcctagggcttcttcagtagtaataatttgtcctcagcaaatgatatattaactaattaatatcagtggacgtgaattattaagcatctgtttttgttttctcgagacaaggtctcactctgttgtgcaggctggagtgcagtggtgcgatcatagctcactgaagccttgaattcctaggctcaggtgatcttcctgctgtagcttcccctctcagcctcccaagtaactggtacacctgacctagcaaccaaaagaacaatgtgtcaactatgcttggctatttttttttttttgagacagagttttgctctgttgcccaggctggagtgcaatggcgcgatcttggctcactgcaacctccgcctcctgggttcaagcaattccccttcgtcagcctcctgagtagctgggattacaggcgcctgccaccatgcccggctaattgtttgtatttttagtagagacggggtttcaccatgttggccaggctggtctcgaactcctgaccttaggcaatctgcccacctcggcctcccaaagtgctgggattacaaggcaatccgcccaccttggcctcccaaagtgctgggattacaggtgtgagccatcgtgcccagctgcttggctgattttttattttttttatttttttttattttttaaatttatttttttattgataattcttgggtgtttctcacagagggggatttggcagggtcatgggacaatagtggagggaaggtcagcagataaacaagtgaacaaaggtctctggttttcctaggcagaggaccctgcggccttccgcagtgtttgtgtccctgattacttgagattagggattggtgatgactcttaacgagcatgctgccttcaagcatctgtttaacaaagcacatcttgcaccgcccttaatccatttaaccctgagtggacacagcacatgtttcagagagcacagggttgggggtaaggtcacagatcaacaggatcccaaggcagaggaatttttcttagtgcagaacgaaatgaaaagtctcccatgtctacttctttctacacagacacggcaaccatccgatttctcaatcttttccccacctttcccgcctttctattccacaaagccgccattgtcatcctggcccgttctcaatgagctgttgggcacacctcccagacagggtggtggccgggcagaggggctcctcacttcccagtaggggcggccgggcagaggcgcccctcacctcccggacggggcggctggccgggcaggggggctgaccccccccacctccctcccggacggggcggctggccgggcggggggctgacccccccacctccctcccggacggggcggctggccgggcagaggggctcctcacttcccagtaggggcggccgggcagaggcgcccctcacctcccggacggggcggctggctgggcaggggggctgaccccccccccacctccctcccggacggggcggctggccgggcagaggggctcctcacttcccagtaggggcggccgggcagaggcgcccctcacctcccagacggggcggctggccgggcggagggctgaccccccccacctccctcccggacagggcggctggccgggcggggggctgacccccccaacctccctcccggacggggcggctggccgggcagaggggctcctcacttcccagtaggggtggctgggcagaggcgcccctcacctcccagacggggcggctggccgggcggagggctgacccccccacctccctcccggacggggcggctggccaggcggggggctgaccccccacctccctcccggacggggcggctggccgggtgggggggctgacccccccatctccctcccggacggggtggctggccgggctgaggggctcctcacttcccagtaggggcagccgggcagaggcgcccctcacctcccggacggggcggctggccgggcggggggctgatccccccacctccctcccggacggcacggctggccaggcggggggctgacccccccacctccctcccggatggggcggctggccgggcggggggctgacccaccccccacctccctcccggacggggtggctgccgggcggagaggctcctcacttctcagatggggcagctgccgggcggaggggctcctcacttctcagacggggtggttgccaggcagagggtctcctcacttctcagacggggcggccgggcagagacgctcctcacctcccagacggggtctcggccgggcagaggcgctcctcacatcccagatggggcggcggggcagaggcgctccccacatctcagacgatgggcggccgggcagagacgctcctcacttcctagatgtgatggcggctgggaagaggcgctcctcacttcctagatgggatggcggccgggcggagacgctcctcactttccagagtgggcagccaggcagaggggctcctcacatcccagacgatgggcggccaggcagagacactcctcacttcccagacggggtggcggccgggcagaggctgcaatctcggcactttgggaggccaaggcaggcggctgctccttgccctcgggccctgcggggcccgtccgctcctccagccgctgcctcccgggcggcgctcgctggcgcggcggcaaagactctgattttttaaaaatgtattctagagatggggtttcgccatgttgccaaggctggtcttgaactcctggcctcaagtgatccttctgccttggcctctgaaagtgctgggattataggtgtcagccactgcacccagcttaagcaacttggagaggcagcccagtgagtagaaatggctttggtattgagaaaagcgaaatctcagctccatcgctcaccggcagagtgccattagacaaggcttttataacccaagcctcagttcccttttctgtgcaggaggaataattgtccctcacagggttttggtgaggatgaatggtgttatggatataaagcaattttatataatgtatagaaaagcctgaaacttagtaggtgcttagtaaggatgcaccaggattccagagacacatgagatgtggcccctgtcttcaaggagtttcttattaccacatgtgtgtattcttttacagcctagaaagctctatgggccaggctcagtggctcatgcctgtagtcccagcactttgggaggcagaggcaggaggatcccttgagcccaggagttccagaccatcctgggcaacacagacctcatcttactaaaaataacatttaaaaaattgggcttggtgccgtggctcatgcctgtaatcccagcactttgggaggctgagggagcggggggcggatcacttaagatcattagttcaagaccagcttggccaacatggtgaaaccccatctccactaaaaatataaaaattagctgggtgtggaggcttgtgcctgtaatcccagctactcgggaggctgaggcaggagaatcgcttgaacccagaaggcggaggttgcagtgagccgagattgtgccactgcactccagcctgggcaacagaatgaaactccatctcaaaaaaaaaaaaaaaaattagccaggtgtggtggtgcgtgcctgtagtctcagctactcagctactcaaggggctgaggtgggaggattgcttgagcctgggacgtagaggctgcagtgagccatgatggcgccactgcactccaacctgggtgacagagcaagaccctgtctccagaagaaaaagaaaaaataaaataaaaaaagaaaaaaagaaagaaagctgtgcacagctttacgtcgtctgttattcagaagcctggtaggtcagtgcttggctaacagcacccgggctgtggcccagagaggaccaggttcaggttgcctgcggggggtggggaatctcaggtctctccactccttggcattgtcttatttacgacctctagaataggctgtgatctgccctggggcgtggccctgcccaggtgtggccctgtgccagacgtggactcggtgagaggtcggaaggggagtggccttgggacttcctttcagcagcctctggtttccagcaccacacctgggccgagctgaagcaggtaggtctgacttttcttttgatcccttagggagggtgtggagagacccaattcctctttttcttctccagggatacagccccgtgagtggtgggagggacaagtgggaggtccgaagtcggaagactctggctggttcttgaccggctctcttccccagcctcagcttcctcattcataacatagggatgtcggggttggggcggtggggggtgataatggtccctgcaactggagcctgcttcgtgccaggtagcttaatgccatggcaggtatttacagagaaggggtgttaagagatcagatgtacatgtgcctataggctttgagagcagggcgaacatgggagaggaaggggcccaagcataaagtgactttggggccaagggaggggccctttctgaagagagtccaaggggaaaagcatagccttgcatctcagcaccgtcttcccccacaccaccccaggccctccttggcctttgagtttacttggtccccaccctccccttgcttttgaagactgaactggagcttccaggcagcaaggcaaggagaaggtgtgtctgtgcagactggttctcagctgggaaaacaggaaggcaggccttctggatggggagtcgaggcagtgatactctttacccggcagatcccactgcctgggtgggatccacaggtcggaaaccacttctgcagtgagctcttttcctataggctcatatcatgcagaaggtaggagtgctgggaggcaactgataacaaggtgtccaaagtcccaggctgtgtatcagaagttccagttgttgggtgacctgatcgccctccagctgatgtcccctctgctgcactcctgccaggctctggagtcagaaggacccaggtccagtctcccctttgccttttactggccaggagtgcatgggtggccctttccttgttccctgtccatttcctttctcttatctgtaaaataaggaatgaggaggattcctgcttcagagtgagaattaaagggcccccaagaacgagacctggcatacagtaggtacatggtaagtagcagtcatagatttctgaaaagggatctttgagcttctgcaaaggcaattcttagcccccgtcctgtagaaagctctcttgtctcagtaggatccctcctactggatctgtcccaggaccagatgaaccaaccagctttagtatctcccagactctaggcaaacaaagccccttccaactgctaccttgtttctttgctgccttttcccacacacattttggaaagagttttctctgttcccatggtattacctctcattctttccctaattcactctaactggactcctctcttccccctccctccctccttcctaccttcctgtcaaaaatcagtgatagcttgtttccccatctgccttgactcagagctcacgcaccagcagggcccccttccctctggagagccagactctcctggggtcctcccacctcactgactgcttgctcgcagactcctttgcagattcctcctccccacgtgacttctaaatagctgagtgtgagggcaggcatggtggctcacacctgtaatcccagcattttgggaggccgaggcaggcggatcacttgaagtcaggagttcgagagcagcctgaccaacatggtgataccccatctctactaaaaatacaaaaattagctgggcatggtggcgcgttcctgtaatcccagctacttgggtggctgaggcacgagaatcgctagaacccgggagatggagattgcagtgagccgagattgtgccactgcactccagcctgggtgacagagcaagactgtctcaaaaaaaaaaaaaaaaaaagccgagtgtgaatgtctctgtcaacccatcttcttggatgatgtctgttctagttacagtggctgtgtaacaaactaccccgaaccttagtagcttaaagcaacaactggtttctatcatcttgtgattctatgggtcaggaattctggcagggctgggctgggtggtttgtctgctctatgtggcattgatggaggctgcttagtggaacttagtggtggatgggctgaactgggggctccatgatgccttcactggcacctcggtggggagtgctggaaggttgggtttagctgggactgtcatttggagcacccacgtgtggcctcttcaatatgacagtcttgggatagttagattttctacctggcagctggctccactagagcaagagttctaagaggcctggggggaagctgcaaggtgtgtcatgatctagtctcagagtcactgttgaaatgtcactaaaaatgactcagattcaagaggaggaggttagactctacctttgaatgggaggagtagcaaaaattggtggccttctttcatttaccacaacgtctcaaaatcctgtggatcttaaatacccatatatgttagtgtctccaggtgtagcctcttctccagtgagctccaggcctgagttccttgattcctctctttaaatgtttaataggatctcacaaattcttgtcccctacttatttctacactgatctccccaactcagtaaccagtaccaccatctgccagtcactcattctaagcttggatcctcctttcttatttatttattttgacttttttccttttttttttttttgagatgcagtctcactgtgtctcccaggctggagtgcaatggcgcgatctaggctcactgcaacctctgcctcccaggttcaagcgattctcctgcctcagcctccggagtagctgggattataggcacctaccaccacacccagctaatttttgtatttttagtagagacggggtttcaccatgttggccaggctggtcttggactccggacctcaggtgatccacccgcctcagcctcccaaagtgctgggattacaggcgtgagccactgtgcctggccttttttccctaatttttatcctgcctaccacctcccatcatctccacgaccaagtcccctagccgctcgcaaaccctccctctacactgcccgcaggtgtagctgccgcttccctcgaccaccctctccaactggcaccaccctgtcccttctcacacacgtggagtccttcagcaagacctgttgcttctacctcccaaatacatcctggctccacctctctgcccagccagccctctcccctgactgcagtggcccgctgagcagtctgcctgctgcttctctccatcctaaagttcacctccacacagcagcagagtgatcttacaacgcaggccagaccaccaccctcccctacagcctccagttcttcccctcacacttggagtaaaatccaagctccactgggacatacaagaccttaggggatggggcagagtctgctctctgcatttcttaggtccttctgtcccaacacgtccctgttcttcctctgacagccggtccctgcgcttccttggggtttttgcactgtctgttctcttgtccgcaaccctgcacagtcttgtgcaattgctccttctcatcattccttcagatcctagccaggaagcctctttgattacacagcctaaagaagctcctccctgtccaccaccttctttctgttacatcccgttttttctttctcatagcacttttccctcttcttgttcctcttttgtttattgtctgttcatgtgagaagacactatgtctgtttaaggttttcccagcacctttttttttttttttttttttttgagacggagttttgttcttgttgcccaggctggagtacaatggtgcgacctcggctcactgcaacctccacctcctgggttcaagcaattctcctgcctcagcctcccaagtagctgggattacaggaatgcaccatcacgcctggctaattttgtatctttagtagagacggggtttctccattttggtcagactggtctccagctcccaacctcaggtgatccactcacttcggcctctgaaagtgctgggattacaggcgtgagccaccatgcctctggcccccagcacctttatcttttggcagaggctggggggcccagtgtggactgaacttcatgggagtttttagatttattttttatttttattttattttttaaaagacagggtctcactctattgcctagcctggagtgcagtgatgtgatcatagctcatcgtaaccttgaactcctggctcaagtgatcctcccacctcagccttccgagtggctggggtgtggctaaaaactttttcttttaccagactgggcaacatggcaagaccccatctgtgtaaaaaataaaaaattaaaattagctgggcatggtggcacccgtctgtagtcccagcaacttgggatgctgaggtgggaggattacttgagcctgggaggtcaaggctgcagtgagccaagattaagccactgcattccagcctgggcaatagacagagcaagactctctcgaaaaaaaaaaaataattttttttttttttgtagagatgggatcttgctctcttgcccaagttggtctcaaacgcctggcttcaagcaatcctcctgcctcagcctcccaaagtgctgggattacaggcatgagccactgtgtctggcagtgggagtttttaaaaagatttatgttgattcccagctagaatcggccccttcctaaccttgtccacccctttggggtcttggttttacactttactaggcctctttctgtcctctaatccagccagcctttggatttgcagccagaggcctgacacccaggccacacgcagcctggccccctcactgtccctccgacggcctggttgtcatcctgagccactccttgttccctctgttttccccttcacaggactgggcctcatgctgcctgccaaatgccagtcttgggctgtctcctccctgccactgagtcattccttcccgaaatgcactcccttcaccccccaacccctcaccacagggtgaagccttcaacagccacagggtgcccatttggttacagcaggaattgttattgttgagtgtgtggacagatgaaataataaggctgttttcccataaacaactattaagctggagccaccccagcatgcatacaacttaaaaaagtgatagcaacagaaaagcttaaatgcaggttgatagaatgagtctttttcattttcatctgcttggttttaagtttatgtgttacaacctttcaagtggtcatctaggaccaggtgtctcttcaggtaagccatttgatcacatgttgaatggagcaggtacatgtggtacttaattggagacagctcccaggttccattgaacacatatttactgagcacttacaatgttctgggtctatgcaaatgcaaattttgtccattcctaacccagtggtctgctcctgtgtgcccagcatgccttgttctcagtgaacccgagctgctttctagtgactgttgccttctattccaataatccatttccctcatgaggtgtcttgagcctctcgagggcctacaaaatgcaaaggcttcccagcagttgtggagtctggttagaccatatgtgggcgtctgcgggaggcttcgtagagtgccacagactctgtcctattccacatcttgattcttggttgaaatgaaccacaaaccaatgaattctgtcttggtagagagaggatgtgttcaactggcagtgccaggagggaaagcagatgccattgtcatagcccagggctgaaaggctccatctgacccccactgctctgcaaaggccatctggccagtcacagcacttacccttgggacctgtttaggcccttcctcactagaatggttttctgggtctttctacaacaccttgccctttttattttttgagacagagtctcgctgtcacccaggctggactacagtggagtgatctcagctcactacaacctccacctcctgggttcaagcgattctcctgcctcagcctcccaaagtgctggctgggattacaggcatgagccaccgtgcctggcctttttttttttttgagacagagtctcgccctgttgcccaggttggatggagtacagcagcaagatcttggctcattgtgacctctacctcccaggttcaagcgactctcctgcctcagcctaccgagtagctgggattacaggcacccgccaccacacccagctaatttttttgtatttttagtaatgacagagtttcaccatgttggccagcctggtctcaaactcctggcctcaagtgatctgcctgcctcggcctcccaaagtgctgggattacaggcctgccttggctttttaacaacatgaaggcacttcctatgagtcagatcctgttctaagcactttacatgtataatctcattgaatcccaattatgatattctctctctcttttttttttttttttaaagagacagggtctcactctgtcacccaggctgggtaactatgatattcttattcccatttgacagatgtggatatggaggttcagaatggctcaagtaaaatggcttcgggttatctagccagacagtctgaagcccttgggccttgctgtcctctttgccagcccccatgccttcctgtttctttcttctctctttctcttcacccttctgattatttcaataaaccttcttgtaggctcaaattcctctgagacagtgtaggaaaatatggggatgggagtggaattggaacaggtctgatagggctactttgcagccagagagcttgaggctgaaggcagcatctggagtgtggatggtgccgcgtagagagttgctggcacacctgctgagctcagctgcctctgccagagactagattgtgctcagctctggacctcctaatgcccagatttggcagcttgggccttagaagcagcaccacaggttcctctgctaagccttgttctgagacctgctctgcaacacctgcagtgtaagggcactccttcagtgagtaaaatcacagctcctctcccacctctctgctccgctcaggaatgttttcttgaacactcctgggaaaatgaaaatgttgttatgttgtgcaaggggaagctgggtaaggtgggaagaagagagccagaggatagcaggcctgggcaggcaggagggccctgggaaccatctggggccttggggtagtgagggggatgctgagtggggaggtgctgctgggggagctgggagaaggggccccactttctggggaggaagaggacatcatccccagcaggaagggcccgcaggaccctggagcagccgctggggccttgaaggggcccactgggctgctggtttcctggggcaggaagtcctggctgcagccagaatttggccaggggagggcagctcaggcaggaggaaggtgcacagtgggggaggtctggagcctgtcctcccttcctgctcgcctctcttctgcttgctctgttccctgccagcctctgtttttctctcgctctgacctctgcattgttccttccctcctgtctttgacgcctttcctttctctctctctgactctggtttcttctcctttccctctgctctctctcattctctctctcttgctctcctgaaggggaattgtgatgcctgtagctgctgtgcccagctccagggtaaacagagttgcttgcaggatggtagggcccgggtccattgcctggccacctgttgccatggtgacccagaggcagcacaggcagcagccttggctgtctggcaggtagggcaggggtctgaggaggggaagaggccgggtctgtccttcacagccccagaatggcccaccccaccgtcagggcctgtggcatgggggtgactgcctgtgaacatgggttctgtactgggtgctgtcaaagcagctcccctgagggggggggtcacacggaaagggcgggtcattcatacttggggtcagactcagactgcctgtgttctaatcgcttctggccacttttgtggtctgctggaggtagagggtgggaggtggcaaatagccccaagggaggaagccacagggaggcagctagtgagtgggacatagggaagaacaggcagatttgctctttagcagaagggtctcccttggaagggagtgagccctctgcttctgggagcaaacaagctcatgctggacagccaccagaggcagtgtggcgggctgagatttctgcacctgagagaggcctgtctagctgaacctgaggtttcctcccactctgagagctgagaatttataaagtacagttttcagctccctgagagtttgcaatttcctcactgacagtggcccagtgggacagtgttctggaaagtgccttgaccctggaccatgctggaaaagggtactgacaccatcacggcctcctgcagaggacataagggtagacagggaggggagcttcttggaagtcctggctccaggtatgggtcctggcctagcatgtctggttaaggaagagccggtggatgtcacagatgcctgggatgcagcagcaactgtcctgcctgccagatgagagagaagcagttgtacaaagtggtcaagcagtcttagcttttgcggtaagcagacttgggttgatgtctcagctctgccctttcctggctgtgtgattttgtgtgcatatatgtgcaagttaccttttctgagactttgtttccccatctgtaaaatgggaataataacaacattcaggtattaaggctgtgtgatgattaaaagagataatgtgtaaaaatattcagtacaggctgggcacagtggctcacgcctgtaatcccagcactttgggaggccaaggcaggaggatcacttgaggctaggagttcgagatcaccctggccaacatggtgaaaccccatctctactaaaaatacaaaaagtatccaggcatggtggcacacacctgtaatcccagctacttgggaggcagaggcaggagaatagcttgaaccccggaggtggaggttgcagtgagccaagatcacaccgctgcattccagcctgggtgacagagtgaaactctctcaaaagaaataaaaaaatgtggctgggcggtgactcacacctgcaatcctagcactttgggaggccgaggcaggtggattacctgaggtcaggagtttgagaccagcctgatgaacatggtgaaaacccgtctctactaaatacaaaaaattagccgggcgtgatggcgcatgcctgtaatcccagctactcaggaggctgtggcaggagaatcgcttgaacccaggaggtggaggttgtggtgagccaagattgtgccattgcactccagcctgggcaacaagagcgaaactccatctcaaaaaaaaaaaaaaaaaatagttcattacagtgcttggccacattaattaaatatacaaggaagaatgattgttctcaatcttacctgccgcccaccactttcggttttataaactgaggaagctgagtccggagaggttgaaacacttgctcctgttaggttgttagttttgggcataaggcagggacagcgcccaaacaatacggaggagctgaaccccggcccacccagcctggcccctgtcctgcaggttcctgtccatctgcacacagggtcagactctgctcacactctgcagcccagctgcccctcggtgtagcagatctcctagggaacttcatgttcagcggctgtctccctatctagaccttggctctgtgagggcgcggctcaggcttgcccacgctccccactccctgcaggcctgactcagtctctcagtaagtgctggcataaaaggaaggcaggaccatggcaacttacaaagctgttcatgtgttccctcctttgcacctcacaacaatctacaaagtatttgggattcccattttacagatgaggaaaccggtctgtggggggtgctcacttgttgaatgaatgaatggagagaggggaagcaagttgcccagagacctccccatcatccccaccccgctccctgtactgagggtggggccgggattcaaatgcaatctacctgtctcaagaacccactgtccaccagcaaaccctctttccacatttctgtttcccaaagtgagaacaaacgctgctagagtctggttgtttaggaaagacaagtccccatccagcccagctgctgcatcctctccagcctccttgacaccgcttcctcacacgtgcacaaaactgcacagttagccaggtgcctttagcttctctcctttcatccacatgcagcaattcatggagctgggtgggagtgcttgtctttctttaaccaaggaggaaacagcttctcaataacttgcccaaagtctgcctaactaagccctttgactgaagaccttagacagagagccccctggggctcagtttctccacccatacaagcaagcaggtgtcttcaaagccctattcacctcgtggtgccgaggaaagggctgtgctcgagctctggctgggcaccttaggcaggacttgagatgtctctgagtgcgggatccctatgtacctcaccagtgatagcacctcacatatttgcttatgggtcaaatgagatgtgaatgggaaagcattcaggaaatgccctccctactcccccaggcccctggtggtcacctctgggacaggggcaattctcaagatgacccacagagggtaggtgtcagatttcagacaaggttatttttacccttgggggtggagggaggcaggtgacatttggactgacagttctagaatggggtgagggggcagggatgggagcagggcctctagcggagaaccttgtctgacctcaaggtccatattctccctgcctgtgtggggtgacactagggagaattcggaacgcactgaaaaaaatctcatgcatttggtccacagcgagccaggctctgtcccctctgggccctggagataccagaagtagaaagagtttctgcatagtagatcttcatggtctggtgtcaatcaaattctcccacaattaattgaaccttgtcacaatggagagcactgcagaagtgaggtacacgggtgcccggggtgctgagggataaggagcattacagagatggcggagcaggacaagtgttccaggcagagggagtggcacgggcaaaggcccagtgctgggagatggcaagctgcacatgaggacctgaaagaaagccagtgtgactgggtcacgccatggtgctatataggaccacaaggttcatgtctgttgtgtgtgcagtaatggagcaatgcaccaaaacagcaggaactgaggcagagaaagtttcataatcaaaaggcagccaaacaaggaggtgggagagaacctcaaatccacctccctggggagtttctcagactggggtttttaagggaatttgaaggagctgggggttgctgattggccgaggagtgaggggtggagtcatgggacagggagaggaagaaactacattcttgtgttgagttgtctctttggaaggaggctttagactgacaggtgttggtggacccactgaaatgcaggatttggggccgggtgcagtggctcacgcctataatcccagcactttgggaggctgaggtgggcagatggcttgaggtcaggagctccagaccagccttggcaacaaaaaattagctgggtggcacatgcctgtggtcccagcaactctggaggctgaggtgggaggatcactggagcctgggaggtggaggctgcagtgagctgaggtcacccccactgcactccagcctaggtgacagagcaagatctaaaaaaaaaaaaaaaaaaaaaagcaaagcagaattttgtaaatatctcaaaatagaaaccttgaggtttttttaatgttaaagatgttatctggaaaagttaggaccctgtggcaggggctgtgtgacttttaagcaataagcagctataagaaagtgggctatagggcaagccggttaatgcttagctatgcttttacttacagcttatgcttttgttaaaaacttagcaatttagcttgattaattttgtgaggatggcttcagtgtgagcgagactggaggtgtgggcgagactggaggtgtgggcaggggtggcccatgaagggcctcagagaccttgttaataaggagttcttcctataagccaaaccctttcaggattggaaagaatcttggagactctctggttaaatgccccatttgacagatgaggaaactaaggcccagacatctaataataaaactcacctttttataatcacttaccatgtgccagagatcaggctatacactctgctttctgctttcaccatatcttccccttaaaatatagctggcatttcacatcttatttaatttaaattagcagattgacttgatttttgccaaagatgttttctctcaataattaaaaaaaattaattattgaagtaaaattcacataatgtaaacttaaccattttaaagtgaccagttccatggtttttggcacattcacggtgttgtacaaccaccacctctgtctagctctgaaaatttccatcacactaaagtactacaatcccttactcattaggtagtttttccccattccctctgcccccagccccggcaaccaccaatcagctttttgtttctatagatttatccgctaatatggatacatacaatatgtgactttttgtttctggtatgtttcacttagtatatctttttgaaattcatctatgttttagcatgtatcagtacttcatttatgtttatgtctgaataaccattcatttgataaagatacatatacagatatacatatatatctatatacatacatatatattacaatttattcatttattaatggatatttgagctgtttctaccttttgcttgctgtgaatagtgctgctatgaacgtgtatgtgcatgtatttgtacttgttttagttcttttgggtatataactaggagtggaattgctgggtcatatggtatttctgtgtttaactttttgaagaactgctaaactgtttttcatggcgactcaaccattttacattcccaccagtaatgtacacaggtcccgtgaatttcctggcagcaggcccaggccagagacctcacatgactgtgaggctggagcaaagccgcttgtgcgctgccccatgcagctctggtcctgttcctccttccaagtttttcagtaccaaaaagccctgtgtactggcttttctcccattctacatgtccttggttccttaggatccctctcggggctgcatgagccaggcaccaggggtcatgatgcttccccctacccaggctgtgcagggagagctctcaccttcctttgacacttagaagtcctgtgtcaatagtgccagttctatgagtgaggctgtcacatatgcagactcctttctgacccccataccaaggaagatgccaaagtgacaaggggaacaaacacattggcctggctgtgcttgctgcccgttaagaatctggctcagcctcagcctggtgaccctaaacagcaatggcagggtctgggtcagcaagacacagctctctccatgcaatgttggaatgagtgtctccagtctcttattgctgatgggaaccttgtgaaaggacctgcatctcctggacaaaccaagacacctatggcagtgcaggccccaccccctgaaaagcatcacactacttgactgactgaccacgccagcactatggataaacctcaagccttttaggttaactcctgtctgccacagattctcaggaaaagagatcatctttctaaatgcagattcacaggcagatgacagtccatgacctgaataacctcttagtgaagattttcagattctgctccacattctgggatgcttaccagggcttcagatttaggaggagaaagtttattttattttattttatttttattatgacctctatccaggcctcctttccttgcatgcaaaatcagtgtgatagaaaggagaatgaacaacaagcatattgtggtattagtgaaagaagcacctaccatttggaagcccaaagaggaatgtttatttttttaatttttatttttacttgtaaaaataaaatatttaatttatgatcttgaaaaaaaaaagaattgctagggtaatacgtatgagaactgctagcataggacctgagacttagtaggcattcaataactgttcaccaaatgaatacatataggagatgcttcataaaaatattggttcaattctctacctttccaactcccaaatcttgaagaatgtcaagtgtgaacacacttagtagctaaaggaaaattaagatgtttgataggacattgggaccatcgtttgtcttctagaatgaagatatgatctgatattgtatgacaatcagaagcctgaggaacagcctcctggtatccttcctcccagccctggggctagctttgaggacgtatgctccctattttacccatgagtttgctgcccaccactactaccctttttttttcttgtctgctgggaacctcaaggcccatgcagctctctttggcagcatctggattcctaacaatcctctcctctcttatttggttccttaactttatttgtttgtattttggttcctagtgcacgtgcatcctgtgtgtgtcccgggtatgtgtgtaggctgcctcagagccttttttgggaagaaggcagggaataggccaaaagaggagctttggaatgttgacaggcaggaatactcctgccttgttggtggggaaagcaccaggaggctgcccttgggtttctctgagaggctgggggagagggaaggggctggggccacctttgtggggacagagcatggaatttagtcagctccctcatactgcttagagtgacctggttcagacaatggggcctttcatggggcctggcccacaactctggagtgggtgcaaggcctcttctccctgcccgcccctggggcccaccttccagtaccttgtgagaggcaggggcgggagagtgggaggaacaggggctttgcagttttgcaccctgggtttgaagccctgctccataatcactggctttttgaattctcacagaacctctcaaacaagctcgtaatcttgccctgcacagggttgctgtgagactctggagagctcatgggtagaaagcactgtggaaacagtccactttgaactatgtttgggtccctcccagctgtatttctgtagaaagcaccaactttataatgctaatagtaagcactcaatacatgttagccacagggtatatgtgtgccaggagcttcatatacttggtgttgtttaatttcctccctatgatgattcttggaagtgagtataataatcccatttttatagacaggaaaccgagacccatagaggtgtagcagcttgctcaaggttatcaacgttagttgtggaattggacttgaacccaagctaggctgacccccaaggcctgtgcacagcctgtgtcagggtgggttactccagaggtcacccaggcgtgctcttccccttcagggcaggtaggtctcctttgcaccaggcctgttgctccagttggggtctgcaggcactgtgatctcagctggcttatcactttagggcataccttctccagaagtcttccatcgtttctggggacttcttggcctggcccccaagcccctcttcctctgtctccacccatccaggtatgtagagcattttcccacctgctctcatttgccccagtgttcacatcacctgaaccctttgccctgacattcctgtcacctgaaccacagccgttctgtttctcctttttgctgttccttatggcctctctgtacctcagaccttcctcccactgtgagtctcagctctcagaccattagtcttttcctttctctcttccatgggcatttatttagccccaaatctgtgccaggcacgtgtccctgtcccgtggaagcatctgtctgatgggggtggcaactgtgaggacagtgactacccagcttggtcagtgccatgatggagatggtgaggctgcaggggcattctaactctccctggggaagagagatgcaggatgaggaagagctcacctagcagacaggcgcagataaacggattctaggtggaagtggcaccttcatgttgggggaagacagcgggagtgagagtggtgctctaaggaaacgtatatggtctggagctgagagtggctgctggggtgagtggcaggagctacggtggctggttcttgatcctgagagcagtggggagccatcgaagagtcctgagcaggggaagtgcctggtgaggcttgctctttagaaaggtctatgtgctcctaaggggcagagcaaagtcccatggtgggtggagttatgaggaccaggtctccccgaaaggaaggtagttgttgagttggatttgctttttggaaagatccctctggtgctgtgtggaggctggaaggagttagatcagaggcctgtttaaggtcggatcattgggacttggatactgggcagagggaggaaaccaaggtgaagccttgggcctgtttccagccccagtagcctgtgggcccagtagcctgtgggtctgttgtcaacttgcctagaaggagccgtggcccagcagggcttatattggcccccgcagctgggtggccctgggccagcttttccctctgtgccttagtcccccaggctgtgaacggattgggtgagggggtctctcctgccctgaccctgcaggtctgtgacatgactctggctcaggaggagggacacagagcccatggtgtggctagctggggcctagtctagcattatcaagtctggccaggtctgccagggcctggggccagcacttggcacagctgctgtctgagagggcacatctccgacctctgggtgtcctcctacccttgcagtggttcagcccccgccaccctggtagctctcttggctcggcctgcctggctgcccaggccctgactctatccagggcctctcctctccctatgactggccctgggaggagtggcccagctctggagccccattggccaaaacttgcctgggctgcacacacccctgcctcccagactggctgcctgcccaccttgggactaggaggcctggcctggcatgccctaatgtgggcagactgccttggagcccaaggaaggagtggagtctgaaaggctatgcctggggccacctgctgctctgtccctgctgcctgtgctccagcccacggcttctgcgcccctctctttgaggggagtggtggggatagcaactgcgaggcttgtctctcagtgtgcttcaggggccctgcttagaggagcacagtatttccattctgacagggttctagagcttcctccctgggaatctcagctgggtatgcaaatcccaggctgagttaggccctggactcctggaaccaggggtactttagggactggcaattctctgtcctacttggtgagtgacagatgtggcttgggaagggggagaccctgctcaggatcacacagcacttgagggacacaggtagaatttgaactcaagtccgtctctgtttgtccctccacaaacctttgacgatgtcctcctgtgtgccaggcccctctaggcccaatttgtctttgtattctctatctttgcccagggccccgtacagaggaagtgtttggtgaatgaacaaatgaacaaatgaaccagtgagcaaggcacaggtcctggctcccgtggcatagggtccaacaggaaggtagggactcctgattcacagaacaggaaacgggagtgcatgggaggaggggttgaccaggtgagaagcagagagaggaccagagcttaggtatcatgactgctggtccaggactgtgcccgtgttcccttgttggtgaaatgggtcaatagttcttgccctcgtcctcgtgagggctcagagaagtggcggacgtgcccaggctggtaaagcgggggtgctgtgtgtcggcgtccctgtgtgtgtgtccagactgcccagaaaccccaggcagtctgccccttttgttctgccccttttgttctgcccagttgccctctgcaagtgggcattgtctccccatttcctcagctctccctagggcttctttctggaatttcttcccaatacccctggctatgggaggggtttgggaagagtgtggacgaatggagtcctgcctaccacctccctctacccactcccacaccccgaaagccagccacccgtatccatgcaggcccccagcgcacaaccaagcgggaagtgccttggcagtggttaccatggcgatgggtcctgctgcttggacaacatcggccttccagctacctgtgagagcccgcaagccaggcagcctggcaccctgcaggcctccaccctggctgagagctcctgggatggctgtcttcctgcctccccttggtgcccagcctcctacccaggggctcttgggaataagccgtgtttctgggaacccataagccgttctgggtcagacaggcctggttcaaatcctggctgtaccacatgggggtcagtgactttgaacaagccacctcggagtgcttgaaattgaattagctatgggaggctcactggggggaattatctaaggagtatacaccaggtgcaagagctaccactgccagcatcctgcagccgtggcaggctcaccattggggcatgctgctctttgccactacagccaagcccaggtccctggactcctcatctcagccccaggaggccctgcaagcagtgtagtgtcgggggtaggagctcaggctgcagcagacctctggagtcacagctgagctttgtcacttacttgggctcctcatctgtaggataaggataataaggcatctgtctcataggtttgttgggaggataaaattggattagtacaaataaagtacttgtaaaattatgtgacacctaagtgccatataaacattagtggcgactgtcatcaccaccacacaattggcattggccatgagaatcggaacccatatgcctgtccctcctcatttttctcacacatgcaggtgtgcccagctcttgagctcatggtctgcttagggatggcaggctgctagcccctttcctcttcctcccttccaaaggactgatgggcacaccccacctcttctgcttggagagtaagacatgctggttccaagcagaaaccccagctctaattcattagttggagaattttctcagccagttttccagctggcagctgttgtacccagccctggatcagacagctggtctgtgactgcccacagccctcccagtcaatagatccaagtgctagacattagcgggccacagaggctgtcctgatggcctctgaagatggagggagcccaagaaaggagccctttggggatgaaatcagagcggcttcttgaaacactgtattaggaacagttccctgggcttgactgctatggagctctctaggcctccctgcatagagaggcgactctttccagaatgaacgtaaatctaaggcaacactttaaacagttggcccaggagctgaagcaaggaggactgacttctctgcatggttttgtctccactggcccactcgggtgcaaggccgtgttcatgtgcagttcttggccaaaaggaaactgggcagaagcagcaatcacagatatcctggggtccgagaccacgggctggagggtggtgaccactctcgggttggggtctggtgggaggtggccctaggtactctctctcccccagaccctaagttctcagggctggacagacctgggagaccctgcagcaagcagacctctctgtccccacctgtccccacctgtaccccagggcttggcctctgtgttctccaaccgcacatcccggaagtcagccttacgtgcggggaacgacagtgccatggcagacggcgagggataccggaaccccacggaggtgcagatgagccagctggtgctgccctgccacaccaaccaacgtggtgagctgagcgtcgggcagctgctcaagtggattgacaccacggcttgcctgtccggtaaggctgcgctccccatggttccctacctgccccacaggcccagagcaggggccgtgctttcagagatggtcaccgtccaccctaagtgccacacttgtttctcatcttggcctttgctcatgctggtccctttgtctgaaatgcccttcctgatgtctcaatgctcagcacagcccacttttctctcactcagaccccttcagccctgagtgttggtcccaggccctaagtccctgcctcaacacagtgcagccttccacatggctgcttcagattggcttggagatgctgttgagcaaagcccctgactgcctgccctgcagcgctccttcccttgagttgaggtgcgctggactgagcccatttcattccttttgttgcaccggtgttctccaacctacagcgctcacagcctggtagggtggggatgggggatagacaggtgacccgactgttccccagcactgtttcagaggccctgacccaggcctgggggcagggaagggatgcctgaggggctaaggcacctgagtggagtcctgagggtgagtgagaatgactcaggcagggaacaggtggttgaagggacgggggctccagaaggccgggaagcaggccagtgtggtgtgatcactcattcaacagctacttactgagtgtgtactatgtgccaggcactgttccaggactggggtacagcaatgaacaagacaggcaaaaatccttgtcctcaagtaatttacaatctagtgggagggagagacagtagacagacgaaaagcagatatacagaagatggtcggggtggtgcccacggtgaggggtgtaaggaatggtggcagcagggtgtggtgggagttgtggccttggcttgggcggctggagaagcctcctgaggaggtgccatctgagcagaggcctgtgatcgggggaggctgctaatgtctggctttcttctgctgacaccagcggagaggcacgctggctgcccctgtgtcacagcttccatggatgacatctattttgagcacaccattaggtaagtggcccctcctgcctcaaggtcctctgggctccctcccatcagcctggggcctgtcctcctgactccctgcctggtcagcgtctgtgctgcctagagcctgactcaactgactgaaaatgaggtgggggcagcctctggggaagtgtgaacccctctgcagtgtttctgggggctaggagttgacctgctgttctgtgcagtgggtgggtgggtgggtgttccctcagccagggtgtggccgagatagcatagtggggtgctgcgtgactttggggaagtcagtctctctctctgagcctcagttttctcatctgcagaatggatggggttagacttaatcattgagtgcctttttgagcttggacattctctttgggtccttggtcattgggctgtagggaggccccctagacaaggtgccttggcaaagtcggagccagaagcttgggccattcaacctctgctcacatccttccagggatgaggagctcgttacctcattactaaagtagacttttttttttttttctttttttttggagatggagtctccctctgtcacccaggctggagtacaatgacacgatcttggttcactgcaatctctgcctcctgagtttaagcaattcttgtgcctcagcctcacgagtagctgggattacaggtgcctgctacaaggcccggctaatttttttgtatttttagtagagacggggtttcgccatgttggccaggctggtctcgatctcctgatcttaggtgatccacctgccctcgcctcccaaagtgctgggattacgggtgtgagccaccacacctggccttttcttttcttttctttcttttaatggctgtacagaatagaagaatattcatcacacgcactgggctttgcctccccatagctttgcccatagatcctgcttctgggatccaaggagcaggctgagccctcagcccaggacaggctgcagggccacacacagagctcttgtctctgggcctgatcctaaactcaccagcactagctaggacatcaagtgccaagggcttattcaggactcactgggtgctcagtgtgtcaccattaaggaagaagattggccagtccctgtactcactcattcagtcatcagtcattccctcaccacacacttaatattagatgagcaccttttccagaccagaggccttgctgagactgggcatgcaaagtccactggagcacagcctcttccgcggacctcccagtcttcaggggaggcagatgtaggaacgtcattcaattcgcagtgagaagttctgtgcaataatgggctctgggccaggcatggtagctcacgcctgtaatctcagcactttggggggcctacgcgggtggatcacgaggtcaggagttcaagaccagcctggccaacatggtgaaaccctgtctctactgaaaatacaaaaaattagccgggcgtggtggggagcacctgtaatcccagctactcgggaggctgaggcagagaattgcttgaacccaggaggcagaggttgtggtgagctgaggtcgcaccactgcactccagcctgccaacctgggcaagagagcgagcctccatctcaaaaaagaaaaaggctctggtttgtaatccttttttttttttttttttttttttttgagacagagtcttgctctgtcacccaggctggagtgcaatgatgtgatgatcttggctcactgcaacctccacctcctgggttcaagtgattctcctgcctcagcctcttgagtagctgggattacaggtgcgtgacaccacacccagctaatttttgtatttttagtagagacggggtttcaccatgttggccaagctggtctcgaactcctggcctcaagtgatctgcctgccttggcctcccaaagtgctgggattacaggcgtgagccaccctgcccagctgctttgtaataccttttattttagaatagttttaaatttataaaaacattgtatctctaaagatagtacaaggccgggcgcagtggcttgtgtccaattccagaactttgggaggccaaggcaggcagattacttgagctcaggagtttgagactagctgggcaacatggcaaaaccctgtctctaccaaaaattagctaggcatggtgatatacgcctgtggtcccagctacttgggaggctgaggtgggaggatcacttgagcctgggaggtggaggttgcagtgagccaggattacaccactgcactccaacctgggtgacacagtgagatcccgtctcaggataaataaaaaaataaaaataaagatagtacagagagttcccatataccccacacccaggtgccccatgattaacatcttacatttgtagggtacctttgtcacaattagtgcaccaatactgatacattattttgatgcctttttaattacgttaacttatttgatcctcaaaacaatactatgtggtcatagctattagtatccttattttacagatgaggaaactgaggcacagagaaatgaagtaccttgttgaaggtggtacagctaatggaggacccaggatatactaccaggcaggcaatctgggcccagagcccttgctcttaaccaatgggctgtatttcctgtatgtctgggggtaggtgtcgtggcactgagggtagtcaaggggggacttcctggaggacgcatttgagctgccagtactgtcagctctgtgtatagtgatactttgaagccagtggagctgtgtctgggccagctccaggtccctgtagccaacacaagttcttttacttaggggagcaaggaatagagagggttaggggtacatgcatgatggctggacctgctgcagggctcagcagagtgaaggtgaatctgggcagaggaggctgtggttggaagggaaagccagagaggatgccgggaaggaggacaagctggggaggggcctggagcatggttggtggccagggaaggcctggacacacctgaggaaagattaagaagtttttttgtttgtttatttctgcttttgccacttaagaatatttccaaatgtatccctaagggctaataactctttttatatttatttatttatttattgagatgatctgtctcccaggccggagtgcagtggtgcaattttggctcactgcaacctctgcctcccaggttcaagcaattctcctgtctaaacctcccgagtaggtgggattacaggtgccggcaaccaagctgggctaatttttgtatttttattagagatggggtttcaccatattgatcaggctggtcttgaattcctgacctcaggtgatctgcttaccttggcctcccaaagtgatgggattacaggtgtgagccaccatgcctggccctttttttttttttttttttttagagaaggattctttttaaacacaacatcattaccacatctaaaaaattaacaataatttttcactaacgtcactagtcagtgttcaaatgcccaaactgtctcatgaatttgtttttattttgtttgctttgcagttatttattttttcaagatggagtcttgctctgttgcccaggctggggtgcagtggcaccatcatagctcactgcagccctgaacttatgggctcaagcgatccttccaccttagcctccctagtagctgggactacagacatgtggcaccatacctggctaattaaattttgtattattattttgtttttttgtagagatgaggtctcgctatgttgaccaggctggtctcaaattcctagcttcaagtgatcctcccacctctgccttctaaagcattaagataacaagcatgagccaccacacccagcctgcagttattttgttattcaagtcaggatgcaaataattgtaattggttgcttctctatagggaggccgaggtggacagatcatgagatcataagatccagaccatcctggctaacacggtgaaaccccgtctctactaaaaatacaaaaaattcgccgggcatggtggcaagcgcctgtagtcccagctactccggaggctaaggcaggagaatggcatgaacccaggaggcagagcttgcagtgagccgagatagtgccatagcactccagcctgggcaatagagcgagactctgtctcaaaaaaaaaaaaacaaaaaaacccaaaaactctgtagatacccaccaatcctccaccagctctctggcaccgtctctctctctcaaaatatatttgttgaggaaagctggccatgtgccctctagagtccttcatcacctgggtttgctatttgaatttctgtggtgcaattaacatgttcctctgtctcctgagagtaaattggtgtagggaaggtctcgatgggggtcagatttgttcatggggggtcgcttgtctgcgttgtgaagaacacctggaagggtgtccgggagctccggggccctgaggaggctgggcagtggccctggggaaggatccggtttgggccagagctgtggggacagagggcagtcaggaaggaggaggagcttagaaacccagatgggtgtctgcttggctttgggggaaggtagagagagaaggagggagaggaggaaaaatcacaaattcctctcagcaccacagaaaatagacttttatttttatctgggggaccacagaagttttttgccgtaatttttgatcatgaaaactttcaaacatatagaaaagttgaatagtacaatggtcaccaccactgagacccaataattaacatttttctaaatttgctgtatctatgtatggacaaataaataaatacatatactttttttcttgttaagagacaaagtctcactccgtcacccagcctgggatgcagtggtgcgatcttggctcacggcaacctccgcctcctgggttcaagcggttcttgtgactcagcctcccaagtagctggaattataggtgtgccctaccatgctcagcttatttatttatttattgtatttttagtagagtttcaccatgttggccaggctggtctcgaacatatgagctcaggtgatctgcctgccttggcctccctaaatgctgggattacagacataatatatacactttctctctctctctctgctaaacgatttgaaagtgagttgcagacatcgtgatgcttcatccgtcactatgtcagcatgaatctcctaaaaatgaccctcccctccgtgaccattagtattactaaaaaaatgaacaggaatcaacaaatgtctggcaaatgtgagcttgtggtatttattgagctccggctgtgggccaggcctggcgcttggctcagtcccattctctctcacttgaccctcagaaccacaggcagtactttacacagaaggaaatggactcagagaggcaaagtgactcacccaaggtcacacagctctgtagtgtgatggttaaggtggagcttgactggaacccaggcctgtgtggccattcccactgtgttcacggtggccccttgaccagcaggccccttggaatggacccttcctaggcttggccagaagactgtgtcatttgagaaagaagttggcatggcactctccatgttcatgagccaaggcccagagaagtgaaaggacctgctggagatcacacagcaattgaacagggccggcctttagcctcctgcccctcctccccacagtccatcagctgggcaccctctgccccctccattaggcacagcccaggctaggtggctcccctggggattcatatggatgtgggaatcattccaggaggacaggctgcagctgggaaaagaggggctggtgcagtcaacagagtcagtctagaagtctggctctgccactttttagcttggtgaccttgggcaaatgacttaacctctctgatgctcagtttctcctaaacctacctgccaagcttattctgaggttccaatggcagtgcacagtgcctggcacctagcaggcattctttaaacatttccttttctcatcttgccctttgtttatagcatcttgcccttaccaggcattcaatacatgtagaatgcattaattcagtcagctaccctttatgggagacccaccctgtgccatgtgctaggccttggagagtcaatggggagcaaaaccatgacccttaccctagtagagcttaagaactgtgggagacagaggtcactctgccaggagagtgccgcagggtgagcctctgcagggcctctgttggtgggtgggccactgcagggcagcgaggggtcccctgaggaggggaccattgagccgagagcaaaaagaagcacaggcattaattggacaacggggatcagggaacgggggagcagatgagtgcaatcatgctacttctctcagcctcagcttaaccatctgtaaagtggggtgctgacactatcttgctagctggctttgaggacttggtggtatcgcagatgtgaatatgccctgcaagccatgaagttatcctgccagctccccgcaagagaggctctgcaagtatctgaggcccctgttcctccctctggcccctctggaaggctcacctcctactttcctctccccagtgttggacaagtggtgaatatcaaggccaaggtgaaccgggccttcaactccagcatggaggtgtgtggggtgggcactgcttgggagtgggtgcgtgggtgggtcctctacctcctctctccattcttctccctgcagcccagggccactcacacttgcagggccctgattagagcagcagagttctgtaatggttggcagagcaaggggaatcccaaggatcttcctgtcccaaatcccagaacacagacaggaaaatcgaggcccaggaggggaagggacttgccccaggtcactgagctacatagattccagtgtgggacttgacttccaggcccctgagtctcacatccagcctcagcagccaggtttttgtgggaatggagggaaggcagcatgagcgcctgatcttggaggaggagctggggcagggagagtgctgggtttccagcccatgagcttgcctcccacagcccgtctcctcatctgcaaaagggaacatgattcctctgtggcagggttggaggactgctggtgatgcccagggttctgtgagctgtgggggagggctctatttcccacctatggacttcaggcccaggcaacttcaccagctgggccagtggttcctgagggagcactgaggctgggtgacatagccctgactatgcctctgggcaccccatgaatgctcaggtacccccaggtgcctgttcttgattttttattttatttttattattgttttgagatgaggtcttactctgtcacccaagctggagtgcagtggtgccatcatagctcactgtaacctcaaactcctgggctttagcaatattcctgcctcagcctcctgagtagctgggactacaggcatgtgccaccacacagctaatttttgtgtgtgtgtggtttttttttttttttttttttgcagagacaggggtctcactgtgttgccctggcttgttttgaactcctggcctcaagtgatcctcccgctgcagcctcccaaaattctagaattacaggccattgagcctggcctatcctttaaatttagccaacattctgcctgtatgaagccctgttgtagacatagtctcattttaatcctctcaacaatcccacaagggtaggtctgatcactcccactttgtagatgaggaaactgagacccagagaagggaagtgacttgcccaaggtttcccggggacccaagggcagagtcaaaccccccctcagatctctggcctcccagacctggtaggtggtgcagaaactctggaggcctggcctgggctgggacttgctgtctggtggagctgcggggcttctaactggtgagtgcaatgttgttcctcattccttcgcccttactgttcctctccaggtgggcatccaggtggcctcggaggacctgtgctctgagaagcagtggaatgtgtgcaaggccttggccaccttcgtggcccgccgagagatcaccaaggtaactgggtgcgcctggctgctggaacgctgctcagtgacctgggcacctgccatggcgagtctggctcaggggaatgaggttaggggttggcagaggggatggggagggacacagcaggaatccacagctccctgaggaaggcccacccctcattgcattggaatcccccagccccctctcccctcctttccccacctctccctgtgcttctccagcgaagattcttctggtctcaccattctggtctcaccattctgtcacctacagtgacaccccccatcctctgagcctttggccaaggaagggacctgggtgggagctggaggatgaatatgtatcaggtcatcgtggaggcaggaagatggggcaaagagggaggaagccttggaactgagcagcagcccacgcctgctgtgtgctagcctcgggcatggcatggtgctggggacaggcccttgtgctatttcaggagacttgccctgagtgtcccccaccctgtcccctggccgacaggtgaagctgaagcagatcacgccgcggacagaagaggagaagatggagcacagtgtggcggctgagcgccggcgcatgcgccttgtctatgcagacaccatcaaggacctcctggccaactgcgccattcagggcggtgagcagctgccagctgtgcatggggagggtagctggcgtcctgcatggcccctctgccccgggctcccactgggcagaggcaggaagggaggctccggggacttccacccactggtggccctgggcctctcctagccctcttggctccgaggtctcctccagggaaggggagtgtttgggcctctctaccagctcccaggaaccatgaagctgccgttaggtcatgtggaaatccctttgttggccacaaaacgcatttgggtctccagaagccaaggtgtttgggaagatagtattgagctataacttgaagactgtagaattttttaaaaagcatatatatatgtatgcatctataaaaagcatatataggccgggcgtggtggctcatgcttgtaatcccagcactttgggaggccgaggcgggtggatcacctgaggccaggagttcaagaccagcctggccaacatggtgaaaccccatctctactaaaaatacaaaattagctgggtgtagtggcgtgcacctgtaatcctagctactctgggggctgaagcaggagaatcgcttggacctgggaggcggagattgcagtgagccgagatcacaccattgcactccagcctaggcaaaaagagtgaaactccatttcaaaataaataaataagtatatagcatatataaaacatgtaaaaagcatatatatatgcttatgtgtatgtgtgtgtatatatgcgtacactcacacacacgtatatatattctcacccctcaaaagataaaataaaaagcaagactcctttctatcccagaatccaggtcgtctccccagaagcatctactattacccattttagggtatctttccagaagtattccctgtatatctaagcatagcatgtattatttagctcctgaaaaggggcattcagtacatactgttttgtatcttgcagtttccccttaaaaatatatcctgggggttgttctataccagtacagaaagatctactttggactgggtgggattttgacagatgggagataaggaagggtttctgacagagggcacagcctgggcaaaggcctagaagggagaccttggacttgtttacttatccccagaatgttcaaatttgagtcttccttgaaaccaaaaggaggcgatcttagaagaaaatctccccggagtggggagagagcaggcagaactcgccaagcccagaggaagcctcaagctatgccctgagttccatgtgccctggttctactgggcttggaggccggagctggggaggcccagctcttcctacagtcatcaaggcccctttgatccatccatccccttgcagccctcctaaatctcttctgtcctaacagcgctcccacctaagaatcagctcaagtgcctttgcctggcactgggccttctggctggccactcagcttcactgggtactgtctcttgacctgctgcagctcctgttaagccacaggccccattgccctgtgaataccctccccgtcctgtctccagaccttggctcaggccaccctcaacttcccctcctgtctgcccccaccctgtctgtggtctctctgagagcctgcaagccaagccaagggcaatgccagctctttgatggaccctccctgaagaagtctctccatgggagataggagacaaatgacaccaccttgggtttggtggggcatgccagcatctgctgccctgaagcccaggaccccatgcactgcctggcctctcctactaaggatattctaacactgttgctgccaaggataagggaatcaccagggcagaaggcagggaaaaaccatcctttttgagagcatatttactggagtcaagtactttgtgattattattttttttgagacagagtctcactctgttgcccaggctggagtatagtggcgtgatctcggctcactgcaacctctgcctcccaggttcaagtgattctcgtggctcagcctcctgagtagctgggattacaggcactcgccaccatgcccagctaacttttttgtattttagtagagacaaagtttcaccatgttggccaggctggtcttgaactcctggcctcaagggatctaccctccttggcctcccaaagtgctgagattacaggcatgagccattatgtctggccttgagtcaagcactttgtgacaataatcacatttcatcttcaaacagtcctatcgggtcggatttcatgcctgcctttacagatgaggcaaccgaggctcagagggattacttgatttgcccaaggccatacaggcagtctggagtggagctgaggctcagacctgctgtcttgtctcagagctggtgctgcatccactgcactggacaggctcatccctctcatccagggccaccctctgcctcatgtgcactctgtgctgagtaaataaaagaacctgagtggggtagagtggtgggggtcccagggctgcctgtggggaggggctgcccttgggaatgttctcacctccctgcttccctcccttatcccatccctggtcagatctggagagcagagactgtagccgcatggtgccggctgagaagacccgtgtggagagtgtggagctggtcctgcctccccacgccaatcaccagggcaacacctttgggggccagatcatggcctggatggagaatgtggccaccattgcagccaggtgagggcagggtgtgctgcctctgcctcccctcctttctcctcctcctccccttggctacctccctctggaggggaaaccccagcttggggttggcattcaaggcttcagaagcttggctgttctgaatcagagaaatgaatttttgtgaactgaccattccttgttctactaaaaaagctagcatcttttacatgggaaacaccaggtctcttggcctggcactagatcctccccttgatctggccctacctgcactccttctagtatctatgttcccttcacatcaagccttctagtatctatgttcgcttcacatcaaaccatttgctgttctctgttcccatcctccactttcccagcccctgcctttgctcctgatgtagcctcctgccgtgcttcccctactcttctttgtctgctaatatcctgcccacttcctccataaagccatctctgactgttcccttcttctaaggggtgaaaattgttttctctcctctaacatctgtttctgtccggggcttgttctaccctaaatatcagggtattttttatagttatggtaactgaccttcactaattgacactctcacacctccaagactttgctcttgctgttccctctaccaggagtgcctttcccaacccatgccctttccagccaggtggattcctccttattctttagagcctggcttaaatggcccctcctccagtttaacctgtgggagacagtgcataagcaatgctgttttgggcaggcctggctatgagtgcagtaagatcctggaggagcctgatggtcagggaaggctgcctgaaggaagagcacttcagctgggacttgaatgccaagtagctttgggtaaggggagggcttctggatagtgggaacagcagctaccaaggtgtaaaagttggaaggaaaatgggaaaggggtttacccaaagccctgctttcttctgtcccctcaaacttggcttctttccagccatgcatagacctcagtattctaaactatgaaatgggactttagttctgtgcctctgggcagaactgccactgggttgggtggcagtgggtgggtcagaatgtgtagttccaggctgcgtctggggatgggaccagggtagaaggctggcccaagctggcctagcatggtggctcacacctgtaatcccagcgctttgggaggctgaggccacttaggccagaagttcaagaccagcctgggaacaaggtaaaacctcatctctactaaaaatacaaaaattagccaggtgtggtggtgcgtgcctgtagtctcagctacttgggaggctgaggcaggagagtcacttgaacccgggaggcggaggttgcagtgagccgagattgcaccactgcattccagcctgggcaacagagtgaaaccctgtctcaaaaaaaaaaaaaaaaaagagaggccaggtgtggtggctcatgcctgtaatcccagcactttgggaggccgaggggggtggatcacctgaggtcaggagtttgcaaccatgctggccaacatggtgaaaccctgtctctactaaaaatacaaaaaattagctgggcatggtggcggacacctgtaatcccagctactcaggaggctgaggcaggagaattgcttgaacccaggaggcagaagttacagtgagccgagatcctgccattgcactccagcctgggcaacaagagtgaaactctgtctcaaaaaaaaaaaaaaaaaaaaaaaaaaaaaaaaaaaatatatatatatatatatatatatatatatatatatatatataaaaatctggcccaaactagtggctgaagcaccaggggcattccttctgtctccccacccctgcctcctcagccggctctgccgtgcccaccctacgctgaaggccattgaaatgttccacttccgaggcccgtcccaggtcggcgaccgtctggtgctcaaagccatcgtgaacaatgccttcaaacataggtgagggtctgggatgggtgcggccacgtccattcagggctgagggctcttcctgaccctagaaaggaccctacttcaaactgtccaggagccctttgccctgcagacagggtctaaatccctgcctggctgatgggttcctctgaaattcagctctgattttcccttcttgggagccttccctggctcccagtcctgcccacccctggctgggtcagggacccctcctctgggatcccccagcccctgtctcccgctgtctcagatcagtgtctctgtctccctccttggctcctggctccatgcctggaccgctgtagatgctcagatcacagggccacttcttgccagtgtttggttatttatcaaaccctttcccacacatttcctaaaataattagtccacagagtctttgcctttgcaatgaattctgaaacctactcccatgaaagctgactttaaataagtaaattttttgagaatttcagaggtcattatttaattattaaaagtgagggatcaggagccaggctgccggattcgagtttggctccacctcttactggctctgtgaccttagaagtaacttaacccctctgagtgtcagttctttcacctataaaatggggctcatcacaactacctcagagttatgaggattcaatgagccgttactagtagaacgccagagaaaatgtccggtaaaggtcagccattgtggctgctcttactattattgttgttatttgcagtctgacttgcacacgttctgccacggtgcaggggaaaagcccttttgtaggagctgtgaagcctggattttagtccagattccaggaatctggaatccttggaaaaatcattgcccagttctaggccttggtttccccatctatataatgtccacactctgcaatcatagaacttccaaagtgagggggaatggtggtggctgctattttataattaataaggatggtaagtggctgagcgcagtggctcacgcctgtaatcccagcactttgggaggccgaggcaggaagatcacttacggctcggagttcaagactatcctggccaacatggcgaaaccccgtctctattaaataaacaaaaaatgagccaggcatggtgcacacacctgtaatcccagctactcaggaggctgaggcacgagaatcccttgaatccaagaggcggaggttgcagtgagccaagattgtaccactgtactccagcctgggcgacagaatgagactgtctcaaaaaataaataaaggaataaagaaataaagacagtaagatacatgaatagcagcaactgagctgtttgaagcaaggctgccacagcacttgtaaatatgcacataatgaacattttctaattaggccgtccacctccacctcctggtttatgtccttacatccctttgcagtttttgatggcatatttatacctttgctttcttgttggttgcctcctcccctgactgttagcccatgaggcatagactggacaggtttattcactctcgcatcctcacagggccggacacacacaagaggtgctctgtaaacaatggtggagggagcggtcccaggtgtcctgtcactgggactctgatccacgttgctggaagaactgcaggagtgtatgtgagtgtgtgtgtgcatacatgtgtgtgtatgtgtgtgcatacatgtgtgtgtatgtgtgtgcatacgtgtgtgtgtgtgcatgcatgtgtgtgggcgcatgtgtgcatgtgtgtgtgtgagtgtgtgtgttggggaggaggcatggcccttgggaaggtctgtccaggttggaagccacactccctcccctcagcatggaggtgggcgtgtgcgtggaggcctatcgccaggaggctgagacccaccggcgccacatcaacagtgcctttatgacctttgtggtcctggacgcagatgaccagccccagttgctgccctggattcggccccagcccggcgtaagtgggaccagcgccctgccccaccagcagctcccctcccctccctctctgccctggcatggtggagactgccagccccctacagacctagaggcgtgaggggcccaccctacccccgtgctggggcacagccagctgagtgtcctggctgtgagccctgggatgccccttgtgcagggcgggcttgttctgcctgacagaactcggagtatgtgtgggtctggctcggagttgggggttaatgggctgtcatgagcctgcagggttggaagagtactggctttggagtcagatgtgggttggaacctcgcctctactacattcaagtgatgccccctcgagctttcagtctccatttgtaaaatgggtgtatctgcagtccctacctcacaggactgtggggcgatagatgcagtactgactccatgcctggctgcgccctgggagcggtcaggaggatggtgaaagcaacgcaaggggcacgggaagacagtcaggagcctggtgcaaggtcctctcttacaaaatgctccctgtgcctcctgtgggccaggccttggagaggccgctccctcccttgggggaggtcccctggccttcctgctggccttccagagggtagcgtgggctgtggagttgggtggagcctcgggactgggagctgggggtcacagccatagccgcttcccaggcattttccttgtacttggggctggaggacgttagatgtggcggtaaagagggtgggcttgaggcaggccattggggtgctgatcctggcctcggcccttacccctgtggccttggcaagccctcacccttccttgtctcaggttcctcctctgtagaatggatacagcaccagccccagcctcagagggttgttgtaaggatttggtgcaattccacatggaaagcccttgagaagagtggctggtgtgtagtgagtgctcagtaaatgtggactctcattaccattgtgagtggcctgtaaggatccccattttacagaggaggaaactgaggtctggccaggggaggtggtgttcccaggtcactcagagagtttgaggggagctggggctacagcttagtttcccactttgctggccaggatgttttgattccagctgccccagcgacacctgaactccacgttagggctgcaggaactccttgggccctgggggatggagagggggcaggacggagggtgggggtagctggttgcctatcccgacttcctccccaggatggtgagcggcggtaccgagaggccagtgccagaaagaagatccgcctggacaggtgagtaggggctgagtggtgggcagaatgtggattcggggctgttcacgctccgctgaccccagggcactcgcttttcttcagagctgcctgtgcgttgggccctgggccgggccctttacatcctctcgttttggtcttattacacagcggtcttctggcctgttgtacacacgaggacgctggggacagaggggttaggtggcttgcccagggacacacaaatatcatcagcagagtcagaatttgaagctggctgagtccagccgattttaaatcctgtgttcttgccattgattctgatgcccatttggcagatgaagaaacgttcagagaggagatgcagttgttcaagaggtaaagccactttgggaggccgaggcaggcagatcccctgagttcaggagtttgagactagcctggccaacatggcaaaaccccgtctctactaaaaatacaaaaattagctgggcgtggtggctctcgcctgtagtcccagtgcacctatagtcaggaggctgaggctgaggcaagagaatcgcttgaaccgggagttgcaggttgtagcaagccgagattgtgccattgcactccagcctgggcaacagagcaagactctgtctcaaaataaataaataaataaaaatgaagccaggtgtgtctgactctgctgtgaaagcatttatggactttagaggctgtaagcacagcagggatcacaagctgttgttagtaagaaagtgtgcatctatggcatttactgagcatttaccgtgtgccaagcactgttattgtgatgtccccatgaggcaggggtgactgctgatcccatttcacagatgaggacacagcagcaccagggtgaggtcactcagcaggggtatggggtgtgggaatcgagccttagacgccatacccttccttgctggctcgctcccacctctgagctttccctggtgtaggggccgagctggtgtgccctcagctgctgtgtcctgtgtgaccatccagcctccctacccagacaggagtctcccattctgccgggctcagcacagggcctagcacagagtaggcctgcagtagagtctgtggaaagtgctgaacttccaggggaccaaggttgtcatcttctctccttcccaggaagtacatcgtgtcctgtaagcagacagaggtgcccctctccgtcccctgggaccctagcaaccaggtaaggctctctgctccgagaggacagtcttcagacccaccgggcccccacccttccctgcttgtcagaacgggtttggaggaaggccggggagagcaggatatgaatgacacgcctcatgattgctaccattagcaaagagctggcctgcgtccctgtttggtaggtggaagcggagaccctgagaggcagagtagcttgtctagggtcacacagtgggtctagccaagcccaagcctggacctcccttctcaacgcccaggactctttccacagcacctgccgcaccacccacccaccgcccaacccattcctggcccaggttcctctctggcacacccttggccttggctcaggggccctgaaggaagggggtggggtagtggtagcacctgtgtactctttcaggtgtacctgagctacaataacgtctcctccttgaagatgcttgtggccaaggacaactgggtgctgtcctcggagatcagtcaggtagctgaccccacccacccaattttcctttctcatctgagccagaggtggctaatggcaagcaacaagaactctcccacaccacttatgtcaaaaaaagatctcttcaaagaattgggtgagatcaagaaaccagtccagttatggaaacgtacccacccctgcagggcctggagtcgagaacccctagattcttctctcctgcctgccccccttcctgttctcaaccactcaggtctgctgctgtctgaccaggcacttcctccctctctgttcttctgcagtgatcactgcagggatcggggcagccagcaggcacgcgcttacaggagacctaagctctgccagctgcctgttcccctagacaagccacttcctgcctgtgccactggggcttggatgggcacctggctgacaggaaccaccacatgttgccttagtcactgttgtcttaagccaccttcctgtccatttgtgctgaattcataattcgtggggatgcagctgagactcagagaggttgagctgcgtgttcacattcacacagcaagtcagctgtagccctgagcttccagtctcagcctccagcatccccatcagtccactccaccacccagcaaatgaggctgccctctatcccatgcaggtccgcctgtacactctggaggatgacaagttcctctccttccacatggagatggtggtgcatgtggatgcagcccaggccttcctgctgctctcggacctgcgtcagaggccagagtgggacaagcactaccggtgaggggccagggtgagggcagggcagtgtcccttctccggcctgatgagggagagagtgtctccttctgcgggtcatcctccatgatgctctgccctgctggggctgggggtgggttggagttccatgctgggtgggggttcagggtcatgggtattttgagcccttagggaagagactgagcacggaattagagctggaggcttgagttgaagtcctgcttctgtcccaaccagctgtgtgacattggataagtcaaagtcacttcctttctggcctcagtttctctcttcttaaaatggatgcttggatggcgggtcatggattcacactcagagatactgattttcaaaccatgtgctgtggagttctgtgttcccaaaggggcttccggaactgctgggggtggagttggaaggatgaagggtgatcgggacatagcatggccagtttgttgaacttaccaagtttgctgattttcctcacaaatatattatttttgaatataatgaatgattatgaatagaaatatgttattcctttacatacatttgttcctccaaatttattgattgttcacatgactatcttcttctcgaatttagtcaaggaagataaatatgttcttaggaaaatagcaaaatttgtgtttttcaagtccccttaaagtcattttctgttctgccatcaccggggctcgagggggttctttgataattgcttgttatgaggagcctacattctggagaatttccgtaaggaggttctgtgtgtttggaaattcagtccgctggtcacttggtgaattgtattttgacaaactggctttccccttcccaccccatctattttctccagagcaggcttgtagctctttatacatgggcttcctgctgaaggtgtctttgcaaaaagggccatgttgccttaaaaagccctggcccagctgactcaggcctgctggttgtccccttccagaaggcagagaggtgatttggtggtggatgtcgtgtagggggagggcggttgtgcatgtggtaggtgggcttcttggagggaggctggggtgggccttgaaggccagaccaaatcttgatacttgatgggatttgtgggggagtggcctgaggggaaagagagcccctagtttcttccccataccctgcctactgctgagtgcaggcaggggagtggggaggaggaggtgggtctggacatggccatgcctgcctctgtgtgggtgtccttgtgtgggtgcacgtgttggtatgaacctgtgtatgcccatgcatgtatgtgtcaggtgcctgggcctggggatacatctctgccacctgatagcctggacacaccccagccctgcttccttattagctctgtggccgtgggcaggttatcttcctcatctatgagataggaatactaaaagcgtctacagcatggggctgttatggagattaagtgacacatgtaaagcatttagaacagcacctggcactcagtgggcgctcagtaaatattaagaacaactgctaaatcatcacacatccttgtggtgtctgcacctgcgcagacatgtatagacacacgtgggtctctgtgtacactgatgtctgtccatgtgcctgtgcacatatgaccacatgtgtgcatgtatgtgcacatctttgttcccatgtctgtgtgtatgtgttcatttacttgcatgcatgtctacatgtgcctgtgtgtgcacacgcacatgtgtgtccatcttggctgggctttgctgccttcctgctggcccttgctgagcagtacagggggtgacatcccatcacagaagctgctcaggcactgcagtgtggcagggcccgggcagacccgctgcttgcatgggagctggaagcttcctggggcactgagatcccggcctccccacaggagcgtggagctagtgcagcaggtagacgaggacgacgccatctaccacgtcaccagccctgccctcggaggtcacacaaagccccaggacttcgtgatcctggcctcgaggcggaagccttgtgacaatgggtgtgtgcctatctgctgtggggtgggggacacaactggacagggtggtagggtggccgcttctccctcccagggaagggcatcagcctggagccagagctctgcttcccattggctgtggggccccaggcaccactagacttttctgggctgctgtggctttactatgggtaaaatgagggataggggcacacatttcccctcttgtcgcattccctagagcagggccacccttacccagggtggctcaggctgcctcgatgcaggccttgggcaggatatttctcacgtggccacctccttggcctcctccctctgacagccctgtgtgggctggagggcctaaacatctcttttgctggagagacagggacagaaaaaaaatcccaaagcccacgagtcttcccctgagcgttgaagtggagtggcttttccagaaagtccacagtgaagtcaggttggctcctggtgaattcagtgctaacccacaggtacctcctccctccagcctggccctgagccccgcattggggctttaagagtcgatgtgccttgcatccccctggtgaggaatctgtgctagagggggcagggtctcggccttggttgggcagaacaggcccccactttcttctgtggctgacccctgtccccttgctacccttccttcactcagggacccctatgtcatcgcgctgaggtcggtcacgctgcccacacaccgagagacgccagagtacagacgcggagagaccctctgctcaggcttctgcctctggcgcgagggggaccagctgaccaaggtgaggccggtccccccaaccacgcccccagcctggctccaccccaacaccacacgtgtattgagctcagcactgctgggctaggatagtctcagagctggccccccagcaggctcccccttccagcctgggggagcctgagagtgtcaggggctgaaaatgatctaatctgtgtacaggtaagtcagaggccactgcatggtcttggaaaaagctctgggtgctgaaggcagaaggcctgggttctgaactgaaattccatctcactcgtcattcacttggatagcccttctcatctaggaaggctttatatgactctgagggcccataaaacccagcagcgcagtccgtgttgatggaaaacatggggaggaggctgagggaaagcgagggtggggtactgcagcctcccccctcacagcttctattagggccctgcagcctgggtctggccttgagactcacccagcagagactcagccggtgtttgctgaattcatatgcttgaacccatgagcgcctcagaaccatccctgggctaatgtctaatgtgtctctatggccgagattcagagctgggccctggagatgcagcccctgccctccagggcctctggctggcggggaagatgcatgatgacaatgtggtgtgtggtgtgggaagccagggttgtcagtgcccgaggaagggttgggggagatcagctggaggaggtcatgctgggcaactgtgtaatctaagaccctggggagttgggttgaatattctgccctcccagaaggccagcaaggctgactcaccaccagcctcgtgcccactgggctcccaccccttcccaggaccctcccctagcttggtccccctgagcttggcttcccaccctgcaggtatcctactacaaccaggccaccccaggtgttctcaactatgtgaccaccaacgtggccggcctctcctctgagttctacaccaccttcaaggcttgtgagcagtttctcttggacaaccggaatgatctggcccccagcctccagaccctctagatgccctcagtggccacatcatgcccactcccactccatcctgtccccaaggactcacatacagtgcctggagaaagccaaagacctttatttcttcctgcctccccgtgggaagcctccgccctgaggtccgctggcccaccacccctgggtgctcagtttctaccaacatgagccagcaagtccttgtggtagccctggggtagcctgtagtagactcgggtcctgtccacagccctagctgccagcaatgctgtcctcacagaggcatagtcgcccccagctgggttgtgctccactgtgacggtggcccggggggaggatgccagcagcctgcctatggctccagctgtgctgtggcccagcagcatggcctgcatctggaaggacacaggttgccagagcccctggcacaactctagcatatctgtgagcagctgttccctgtagccactgcccagcacctcctcaggccagcctggtgccacagtcacgtgggggaagacctcagccacagctgtaagcagctctctgccagccacatggccggggaccgaaaaactcccgtgggagattttggccccaacccacacaggccaatgcaagaggccaaggctggagaggcgtgccagcaaggccagggatggccggagggctgcgggctccgctatttgcaaatggatgccccagtgtccgggatgtgtggccagctgctgcaggcaggactccagcgtcaggatgttgccacttggagtatgaacaatgggcacggggttttcagccacagttccctcgaggccagtgttcagcaggatcatgccttctgtgtctggaagaggcggcagaggcaacagtgtttaggatttgggttatcataaggtgttaagagtcccttgttaaaggggcagtgggagttatggggtcatcaaggaccttgcctctctggaatctgtcaacccagttttgggctccaggtggatgggttgctttataaatgtgcctggtgcatgagaaactcttgtttcagctcttggcctttacccatgactcagcctgggggctggtgccggccttgcctgcagcaatgtagctgaggactggtctgaaggccaggagccctgtgctcttgacatcactgtactccctctccctccccgcaaccctgccccaccttgcatccagggtatggtgtaaataaacctgtgttgccatggcaacag

SEQ ID NO: 1201 - DNA, 729084 bp, Homo sapiens
tttttttccccctttacgaacgctggcaattgacatcactacagacagcctggttagagaacaaactgcctcatcccaagtggaccccggcagctgggggaagccaggcaagatctgggaaggctgtgtgtgggtgttttttctacagatctcactcctcgccctttttttttttcctttggtgtgtgttttttgttttgttttgttttttaaaaaaattcttgctgtgttggaactagcgagtggtggagtctctgaagcctcatcagtcaccgggactgtcaggaatagtggtttaagaggaagctcggcctggggcactataccctgtcatccagttccctgcctcggagataaagattccagctacatgggcaaacgcctggatcagccacaaatgtacccccagtacacttactactatcctcattatctccaaaccaaggtatggcttgacccacggtctggcgatcagcgtggtatcgttctgcacttgggatgggaaacagacaggcgtgtgaattattagttaacccccacccccatcacttcttcctgcttctttgaaattagtgacataccaatggagttaatgaggcagaggaagacataagaagaaagcagcaaacccggaattgtagctttctctttaaggagagataatagtttcacttgagttcagtttctttgttgttatttggcagcataaatggtcctgatatcaggaacgtcttttgcagatgggcacggtttttagaaagcagatcacaacagtgattaccaggcacaagaatataatttcaggggcttttctggtgagctgttctttgattgtggctctaaaagggtttttcccactggataggacgtgcaacggtgggggtaactcaaacttttaatcgcagggtatagaatgaaagaagggtgtgagaaggtatagggctcctaccagagtctctgagagtttatttttatttttaatttgccttgcctattttattttatgttgaggatgatcagcatgctacagactgctttacaatagatgttctttacttttagaagatctatttttctgtgtagctgccatgaggaggcctgagtcttgaaaaggaatgaaatgtaactgatcataattggacttgaattggttaaatactttaggctttatgtgtgtgtgtcaaatgaccattaggggcccagaggcaagcccacgtaagtaagcagtgggcagtacctaccctgaactttatcctgcagttaagacatgaaagactctcaggtgtgaaatcactgctccgatttgtcaattaaattggacttgattagggggaaaacatgttagcggagtgaccacctcgagtgtacgggtgatattattttgtattgcattagcattagccagactccaccgtctccttaataaataaatatgccgagagtgaacaaggcgtgcctgaatgatctatgctgtcaccaggactcggtgatgtgattagggttaggtaattcatgctgtagttatctgtcatttattttgtctcgtccagcaacgcctatttgtaaaccagactgggaagcagactttcagtattatacaaaagattattgctttgtttttttctttttcaattgctttgtaatccaccctgcccctccaaggtcgactcacactgctatttgcctttgtgagcatttagtttgtgctgctgatgcttaaatagactagccctcctgctcggtgccttaagttttaactctttgggggtgttaggttgagaatgctgcctgccattcctcaaggaaatggcagagcaaggacaagttaaaaggggaaaatttacagtcatttctcatgcctcaacaaaacaaaaacaataaactcaaaggttgcatgaaaaatatcagacattccatcccttttactcatttggctacatttttccaagtgtttcaaaaattacactttgtttcgggtccttgttttctactatggtatatattcagaaaagaaactttagattgaaatgaataacataattgtttttctgtttgagacttcttttaacctattactaacaggaaatagtgaatgttatgcacattttttcaaagacacaggctgctggatgagctatactagtagaaagtgtgtgcgagagagagaaagatggggggtaaagagagagagtggagtagtgagggaaaagagaggagcctgaaaaatagggagattgtagatatctgttttggagttctatgtagtttagtgttgtatagacaggcggcatctggatcttgttactctcaagctagccaacaccttgaacttctggaacatttttaaagaagttagatccattaggcgtcctatgttgatatttggataatcagatcaggatagtagggaatataagatcagctattttgcctatcatggtagttcacattgattattatgttgtaaaatgttgacaatgctttgaagttgtcctgtattgttatggtggctctgaaatgacagacattaatagcattcctggaagctgaagatgagaaaatgtgccctgttttgaaacttgcatagagaggaaatgagatgaagagtcaatgtgcaatcatattttaaaatgtgggtactggggattttctgacagggttaatactatacaatgaagtaccatcatgtttcagtgtaacaggaaaacaactgggttatttccacatcactttttgttccttctacacttatacctcaaaatataatttataatcattttaaatgaagtacatgctgcttatatttatttggtaagcctgggtggaattcataaaatccactctttgtagccttggcttggagttataatccaatttgaaattcatagctatttaaaatgatgctgatatgtcaataatacttatgtttgatgaaaatagagtctacggtaggtaaaaatcgtattctggtgataacatatcttaaatttttctctaaattgaggtaggttttcttcctgccaatccacaagggctatttactatcattagttttttggggaaaatcttcatgggattttaaaggattgaaatgtttattactacattatttcagaaaatgcacacatgctgaactctctttttctacttgtgtaatgataaatacctttgctattttttaatgataaaacaaaatgaaaatgagatttaagaaataaatgcagatgtttccattccctggaatacatagtaaagttttagaagaacttgcgacacttccctgccttctctgctcctattattttccattgcattggaatgaatctctcaactttgtttctttaaaagtaaatgtttatgctccttcaaataatttttcaaatccttaaaatgttatatattagaaaaatatacatgtaagttaagatgaaaacccagtggctgactcatatctataatgtgtaacaatgttgtcatcctgtgctccctctttcacacctcacgtctttaaaaagttgtcatttgtcaattttctttttgatgaatttttctttttttttttttttttttttaccaaaagaagcaatttcaaggaggaacattacttcgcttaaggaataatgaagaaatcttagtgatatgttgtaatatttaaataagaaacaaccggatgaaaaaatagtttatcaaggcaaatttgctgtttggaagggacacccagaataatcagcaagttttagagaaaaagggctcaaaaaatagttcattagcttaatgacaaaatacaaaatgtttgattagttgtaatccaacattttttaagtattttatcaccctttccaaaaaaaaaacaacctgttgctgttgacttatgagatcccagctgaatttcattctgaatttttgaggtacttgccggggtggggtgggggtgggggtggtggtggggagtaggtgggggtggatggggggttcttgaaaaaaaattagtcaagctaggtaagctaaaaagaagaaaacctggttacagcccggtgaattgatttttttccagccgagaaatagatatttctctcacatatatttggaaaactttagtcatcttcataaaacttaaaaagttacctaagcacacacagcaagtttctcctttcttccttttccacacccttaccagttcactatgtttctaccaatccagtgcccagttgccaatgatgttgctctcacatgaatttactgcattcccttctggttccccagaaggtcttgaagaaagaggttcagactagtggacccaaacagaatttcttggctggtgatactcagattgtgttcagagcctggtatgaagaaggggccaggtgtaagaagtagttaatcaactgcacgttgatttcaggctgaatattcaaccatctgcagccacccgtctctaaaagtctagctgaagcacaattgattgtgccatagaatgagcaaacgcttgaaaacacaagtaggtgaaggaagagaggcttccacggagcaaaggatattcttaaagatgtgaatgtacagatccttcaaaagcaaaacaaaacaaccctgtaacaccctccttacacatgaaaatgtagaaaatcttgcagagggagggaatgagtttagaatttccttagtacttcctgcctcagatttgcattgatatccagttggtaacttgccagttgttttaaaacagccttgaaaactccaaagttctgttttcctttgaaagcctgaaacatacaaaactagttttctaaaatcttccagcgatagaatttttaggtacaactccaaatattttctttcgcttcggggggtaatataatagcatgaaactatgatagcatgaaactatgataaatcctgtttgtctcactttagactgtatagaatttttaattggtttcaaataagaggaaaatagaaggaaggggccatccttgtttcttagttttgtttttttttcttaactcccccaagccttcattatcagtgggattgaacacaatcccagtgcatgttttgctattttttttccatgatatagacattgtttttgcaacactgagtttggtgcctacttaaaaggagtagaaacgtaaaaagttcatggtattttcttttctccagaatggattcaaacttaaggaaaatatcatgtatatttaacagcatctttctaaagcattttcctttcactttctttcaatttggaaaaaaaatagcacaaaattatagcacaaaattatttccatgaagtaataaaatgtatctgagggctgggggtagggataatttgcagggagggacacaatatagaagggaggatgcaagttcattctaggtctttctggcttcaggaattctggaaagcttcatttttgcactagtatgattttacacaacctttttgacattatcagtcttttggcagagagagttcagtcacaattatgcccatgtcaaattctaaaatcaaaccaaaacaacaaaaaaagtattttcttttaaaataaaacttttttaatgtcaaacattttattcagagtaaatggttgatgtttattcaaaattggcttcaagtactacattgaaattgttttgtaacagtctcataagccacagctgtatgtgattaaatagtgtaatatcaaaagcatgtgagaatagacgtttttatgctatagctattgcacagcaagagtgcagatggaactgaagggagaccaaaagcgaaaatgtattcatgtggtgtaatacgtgtgttgaggatatgtgttgctattttttgcagtagtgggaaaatgttgaactattttggatgtgcttagaaaatatcctctcggaaaacggaaacagacatataataccatttttaaaatgtggagtggatcatgccatttaattagaaaacacataggtgctgaatagatctgaaaccaattcaagtggaagaatgaaaattattcccattgagtacacattcaaaaagcaaaagtgactttctcatttctgttttgaaattataaatttttttttactactttaatttatggaactattgtaagaaaaccttcatcccattgatacctaaagaaaagtattaggcaataagaatcagcaacttacagatggcaaaataggtggcagtatattgctttttaaagatatttggaaatatgatgctcttcagtgttgtataaatattgctcttttcttaccagtgttaaaaattacaaagatacacaaggacatacaacttttgcttccatttctgtaacagagatgttatcgtaaagaggtgtctagttttaatgaggtgatttaatacagtgtttttgaaataatatttgttaataaaaattaataacctctagcttcctagagataataaatctataggattaatcatactaatcatcactaccattcatatgtgattgttttcagggccttgagaaagcttatagaattggctatttttagatttcagattttagacagaagtaattttaaaaagaaaaagagagtggcagactgagatgagttaaattttgcttggttttgtttttatttttttttattttaagttgatattggcagataatctggtcttattaaaaatgttttgttttatccatgtaggtttattactcagggagtatgtattatgtggaatcacgaataaaattttaataattcaaaaccaattcctaataaatatcaaatttcaaaagtaaggataataaaagaaagataatagatcctatcattttgtgggggaattctctgatttgtatgtcaatgcattggtttctaggttgggttccttcactaggatcccttccattgtgagatagctgagcctgctttagtatcttagtggtatcttcaggtgacctcggttttgtgtcattcatgagtttttcttttgttcccagatgctttccacagggcagatcaaatgctgctttactggctctctggtgatttgaaaaatttaactgtcttcatcctttcacacatctaaatccagtgcactgagagaaacacgtccatcacttgggagtgggtggatagaagttcccaggagtggaacaaaatgacagccattctttaatcatgaccttttccagctttattgtggtggttacaatttttcttctgagtgggtaaaattaaggtgtatccaaaaacttaattgtgatagtatgatgctttacttttcctcatttaacttcctctctacaggtggtgcagagctaaatggttatgcatgtttggctaaaccagttgagttaatgaaggagactagaattgccacattaaaatactgacaactttagtttcatgaatgattataaggagtcagtgtaactataacaattaatgaaatattatttcgactgaatccaaaacctacaaatccgcaaaacctacaatctctgaatctcagaatagtagcctagaaaacgtgggaactgaatactgtggttacctcagctatactgtagtattgtaggagggaaataactccccaagggcatataaacaagaacattatcttttctactttttcttttgagattcccttcttgtttttcaaaaagcccctgttagctgaattaatgaaagcaaatgacatatgctattttaaattattatttaagctttgaaaaatcatacattattttcatataacttagtccataagttcctattatgcttgcttctctgagtatatttggagtataaaacaaggaagataatcctttgggaaagttggtttctgttcatatcagtctgtgtgttcatttattcatttgtgaaatgggtgaaataaccctgacctcaacaatatattatagtggcctctgctatggaaggtatgaagttactgaactgttaagagaagggtggtccatacataagtagcaatgttatcatttctgaagcccaactgcatatttttatttactttattacagactcagctctgaggtgggtagcctgtctttaacacagaaaagagtttaggaactcctcaaatgtgtaaaggccatttctatttgctgaagcatagctcttcaccacttaatcattgaaaattatgttgtagaatatttagtgatgggggaatgtttataatacatcaaatggttaaaacagttaactatgttcctaatattataaaagcataaagaatccaaatatagacatataaaaaggcttaaagaaaatatatcaaattctcaaggaaaataaaaagtaaatggaacccggaattttgtttcatgaatgataaatacaaaagtgagactcgactacatgccttattagtcaagggaaccctaatagtgccctttcctgttgtgtggaaagtaaggtataataggagaaaagtaaatctaacaatattttaagttttaggagctgacatttaaatttgttttagacttaactttcctatcattatattgtgaggttaagaaattggcatatattacattcaatatgctagatgcaaatgatcttctggtcatcccactcttagctgataattttcaagctgaatatagatcatgcatagaatttaatatggatttttttagagacagcttattgttttttaatcctgtgtactactacttagtcattttccctgactgatgacaatttaatgaaaagtgaaataaaaaacaatactaactatctggttttctggaactggttaaaatatattgaaagtttttcttatgtatgtgagtcatatttgaggctattgtcgatgtctgtaaattctcatgttgcttcttttaacacttgtcaatcatataaatggtattctgacacccaatatataacttaaaattaaataacttagaattcaagcaaatatattttttaactagttttgagtaggtgaagtatttgaagtatttaagagacttggaatgattttggtgacattatttgctaataattaatctcatctccatctttatgtaaaatttcagattgttttccgggatactcaacagataaatatgtgacagacctatggcctttaatttcttcttgaaagatgagaaaacaacatttcattttctttgacttggtgggaactacccttggagggtggtgacagttcatggattaaccctggtatcctgtccattaccaatgtacaccaattctgactgcatctttagaaataagaatattgcatttttagtctaaggtaggtagggaatcctggaaaggataaaattctgatgtccttttctcaatgtatttcaaaaaaattaaccactgcttttaaactttattatttacctgtttaggacaatttggcttcatgttagcaatggaagtttctctttctgactcgtgtttaactttgttgttgagctggaaaaacacaagaaaaggccagtgggaatagatgaaagaacatgcaggaatttctcttcaagttttgctatttcctgtaacaatagacgctttttgaggcctccattccacatccaaagacacatattaaagtgcactaacattcaacaccaaatttaattatttcacaataatatgttgaaaaagcttttataattttgctcctgaaactctgtgtccaagtaaatttaactgatatgtatctgtgaatttggagacatcttgcatacatgaatattcttgcgaagtgaaaaaaacctaatctacaaatctttttcaggtacaaagagattattagaagactaagtggaacaatgaataaagttgacaatgtattatgttttttagatatgcatataaatgttaattgatttgggttttgcagtttttcttttcagagtttggagttaatgcatttgtttccttgcaccagtgtttttgtaggtctttaagatggtcagagcatctaaaaagctggccatatctttcactattgtggccttttggcactcaaaatatctctgtattttagtaatcccaaatttccggggagggacatgtggtagaacagcacagtgtattggaaaatgtcattaacattctttggctaaaatatttcaaaagcagacacattggattgacctttggcactgagagcaactgggagttccagatctgggtgccaggttcacagaattttttattgcgtaattggtgaaattgtttactagagacagagcttaaatgtaacaggtgtttccctagggcaccctcttaggggagtaggcaagaggcaaatcaatggcacaatacttattctatggcataatttttctcaattcttctgtctcaaaatagggtcataggttttttatatgtattaaaactgacatttcttccttttccccagttcccacggttatttacctaggataataacatctcttggtgtctagaagtctctctcagccctagagaatctacgtgccttttaaagaacacatgtctctacaggtatgcacactgcagctagacccactatcactctcacaagtggttgggcaacctgaagatactgctactccagccataagccaagtgtgatggtttccttcattttcattcttatcccagtgttacaggaaaatcaagatcccaagcctagacatagccatcttctccaatcttattcaggaaataattttttctctctgtagccccatatatatcctcagacctgaaaattcacaccatcccccaatgctggagggcgaattctctcataatcaccctatgttttgattctctatctaattactcaatttttcttcccagccctctagacagatctcactgaatttcatcagcagatgcaatgaatcagctttgattgtctctcttacacataaaacaacaacacacacgcacacatacattcctgaaaaccttaacgattattttaatggttcagattttctctgaggctttacaaccacagagaaatatggaggtgcaaagtggtcctaagaagacacattcctgttctttccagttataatttatttaattttattttactttgctgctagttggtagcacaaaggggtgagtcttaccaaaatagaaataactactatttttttactttctttcacaaatattgtggtaccttctcatgatctgagatacattgacagtatattacgcaagttagctatctactctcttttttatgtcattcttgatagcatcttttggaaatcttattgattaattctaattcatcccaaataatttcataatagtcgtttaaactgtgaagagtctgatgaacctcaaagcttttagtgatgaggctgtcaatagcagcctagtaaaaaaagaaaaaaagatgacagttctacaacctcaaccggttatttataagaaacaggaagaaagataaaataaagagaagaaagagaaaatgaactaaagagaaagattaagggtatcagggctcaatgtacttttgaacatttctggaatttgacaacttgttttcctttccaaaggcaatagataagagctgtttagcaaggaaaaggtcatttacaaacagaagaaacatgtttggggaaaatacgtcaatgtaaattcataatttgatgtggaggggtcctgtagttgagacttttggtctcttaggaagaaaattaatggttatgtagacaattagtgctttattttgtttttgcacttgttgcagcattcagtaatagccagcatttgcttttgttgttttgacttactcatcactagttctcaagggagaacctgtataaaagccttcttgatgcttttgattggaaagagggatgtttttcagaaagagtcattggaatcaagttttaaagtgtatttttgattttctgtatctaacatattcatatacgatctgtatgtgctcacaaatataaccaggagcaatgttgttgttgttctgtgtggaaagaatctcattctgagaaggaaaaagcaacattagttgtgaacccagcaaagccgtattgccatgagaaccacacagtaccaactgcttattaaacaagagtgaagtttgaggccactaatgtgcctgaggacccaaggagcaggtcagttgagggtatgggtgcagtcatgcttacttactctgggctaacataagcctttgttagaggggaggagcctggtaaaaagagtgtctagatttcaacatggcccataaaaggctagctgctattgttattattcgtggtccatcttttctgccaaattcattgtatgcatttctccatccttgttttatttaggatggctgtctgatgcaaccttgctttaacattgtgtcttctccatctccctgtctttcccagattgtccttcctagggctaatattttttttttctttgttgtagcttctactcctgtagccctttcttgctcgccctttcttcttctattctcaagttttctgctatggatttgccttctttgtctctctgccctctgatccttaaattctgcttccttctttttgttctctcagctttcagtcttttctttttttttttaattattgctttttatatgtttctctcttttttttacaaggtacagtgggattgggttttaatttatctttttttgcttagttgtaaatttatttttggcttttcaaacataactgtactcttccagatcatatttgtgtcagagttagtctgtaaacagtctgagaactgggaccacagttttgatctctgaatgccctgcaatgtatagtatggtgtatgatgcagattaaggtcataagaaaaggttttcagaaggtattagtctatcttgttttgtgtgtcttgtacattggtccattgctgaaggcagtgcttttttgaaccagagttgcttaatgtcatcttcacctctgtgatgctttatgtcaaaagacatcttttttacatgtccacatggatacaatctcttggggtcctatctttttcacattaagcacatgggtcacttggctagtaccctgaggctgttggcttgagttgggttacattcctaactaatgggaaaaaccataaaacacaagatgagttaagtcagaaactaatagaaaaaaagaaaaaaaaaacatagtactgcattataagttgctggcaagaaagtcaatacacgtgccaactcagtgaggggcagaagtggatttcaaagacaaactaagtagctaggatttggaactgggggatgaaagtaagcaaatatgtcaggattaaatggtagtggtggtggtctggagaagactggagaggcaattcctcagcaattgccaagaatatcagcccttatatgtggcttccttttatgggttggcagaaagttggacatatcaggaaactaacttagcttgaagaactaggagatggtctgagttttcggtccatctttttgtcaattttgtttattcaaaatccagggtcttgactacaatagttcttataataatattgaactgttaaccaattttggactatagtccaggagtaaccagccatgccatatacctatccaaagcaatacccagatgggttttttaactcagaattttgaaaagacttcaagtatcaggtaaaaatgacaaaatacccattttagaaagaaaacaaaacacaatttccctgtacaattacctacgtgggtataaagacatatctaaactaatgcaagataacgttagatgaaattctgatgtaaacttcaaagcttttctcactaaggaatatctgaaaacaataaccctgttgtggctaagagtacaaactgtgattttggtttggacttctcttggtttttccaagttgtgctgaatctcctatgtttgttctgcagtgttctcctctgtcatacttttttttattgcattgaggtccttattcccaattgcagaaaattatatatatatatatatatatacatatatatctatatatatacatatatatatacacacacatatatatatacatatatatatacacacacatatatatatatacacatatatatatgtttcatgaaattttagggaattttttaatttcaaagtaatgcatattttgcatatctagggaaataattcaagatacagcgggaaaatgttaataatctccctcaatacactacacaggtcttcaagagctctctgaaataactaatattaatagtaaggtgtgtgtcttttacagaattctatatgctcttgcaaatagcaatctgacatatgttatatgagatcaaattgaacaggttaactactttttcaatgacaaatgtaatttagatattcttaccaagtttttagatatttctggttttttattgtcatattaattgttcctactttatttgtaccacgttttatgcaagtgttgcccataggtggacatgcattttattgccatcattttgccaatatgaataattctaaaatatatattcagggtacttatataaatactaaaaattaaatctttcatcttctaattaagtttgcttcctttaaaacactgaaaattgccatgatgagtttcgtattacacaaggattaacatctctctttggcccaaaaattctgtgccctgcaaggttgtcctgcccctctgtgttttgatgacaggattgtactcttcctttggtaagaagatggacttcctgatggaagtacaagctgaaagggaaccctcacatttggcagaaacaggaatatcttccttcctttgtgacactatcacagatcccaacaagcgcttggggtcagcaattctaggatctcattacttgggggctgctcttttgtgaaaggtcagcttcctttgtctgccaccttatatacaaagtaaaaagggcagcagcagtcaaggacaatgttaagcagcccaactcttcctaataaatttcaaagcccactgaaatatttttgtgctagaacacatatttttttccaaaggctttggaaatcagaatttttatttttacattattatcttgggaatgtgtacaactgtatttcttaacaaccctcatctgttgaacttgtttggcgctgcttaatcagtgtcaagtaatgtcatggtttatcaattgagctggaaaaagtgactctgtaaatctaatggacctaggttaaatctattgttatttcctttttctagcctgtacttgatatgtttctcactttgaattcaaatgttaagatcagagcatgacaataaaaagaataatacaaaagttaacctatttaatatgtgatgctgggatgacacagaactatttgctacctaaaatatgtctagaagatgggagatcataaagtctcaacagtttcttctcctagaagaaaagttagaccaagaatgtgtatttctgatagtagttaatcctctttacatagtcatatttcacagaacttaatcacatctttccaagtttgatggccaaatctcacatgctttggaaactcagggagtttttccttcccaaggacctgaaaagatgacctttttttttttaaacactttagtcaaattagcatttttttttaactgctggaagactcaccattttttaacccacacttaaaaatcattaatatatattatacttaatatacatttagtgagagcagaaacattttaacaaagtctggaaaaggaatttagtaatcagaaacgaaaacagtgtggttaggtgaaaggactctgagtgtgctagtagagtaatagttgtgggaggtccaatttttgattctacaacttgctttaatacgatttccccagagtttctttactttttaatatttcagcttcttgtcacttcttcccattacaagaatatttagttatttggtaaaaatgtcttgaggatcaatattagactaatagtaatgtgtttcagtgttcggtgaagaatgccaatatattaacatattatgaaggtgataaaatataaataagaaccattaactcaaagagattgttattagtgataatggtaaggagagggcaattgaaaagcttggaattgacttgatacgtgaatataatggagcacaaatccttaagatggctccgatcaatgctattcattgaaacatttctttgcacttccattatgcttctccacatccatctctgcaatcagctggattgaaatcatatagagatttgctctcagtatttcttatacttcttacatgaattttctttattgttattttgttttggaaaggagtgcaagtctgtctcagcactctattcaaaactcaccatatagtctgagatgaatatattggaaagttgtctggttcttacattgctatatttcacaatacttgtactttcctcatttaaggttccaggataccttttgtcccctagagtaaataaattagaggggagaaaaggtgtcattttcttgcagccagcttacagagtgccagcccttgcctccctagagtgaaatctcatgtttaaaaatgctgtgagtgaggccagcactggctttgggtgtggtattgggttttaactagataattcttcagactattcactgggaaatgaaggaatggagttttgttttagtttttttcagcttagcattgagctttcaaatatcttcaaacttgctcacatttagcattgctaaactttaattttacccttttgttaatcttcctccaattaccatgattgcctttaccaagctcttcatgctcaaaacccaagggcaatctcaaaggtcttcaagctatgtgatccccaccccctgcatgtggtaggtgtttaataagtgtcaattgactgaatgattggtctacatgaaagtggctgttccacatcctgtactcgaataatactcactgagcaatatattttgggcacttaaccatttttgccttccttttggtatatcctattagctctcagaatggagaatcctccacttcatctttcttctgccctcagatcttacaacagtgctagtcagtatctattgaataaagagtgtatggtttaattccctaccctagatgtcctttaattgattttataatcttcaggaaacttaataaaacctctttgatacttacctttgcttcccttatagtttgctttcttcctttttaataattcaaaataatgtttcactttcaattataaagatactaaagctaagacaaaaatattaaggtaaaattctcctcaaggtgtttggcattttttttttccgggaaatatttggtttctttttgcttactcacatgtttactctcaatataagacgtttatctcaatacatctaccttctcccacccttttatgtacgtttggtctcatgacgttttgtgaaaaagggaaataagatttttcagtgtttgtgcaatgttcaattttaagatcttctagtccagtactgtatctactcattatgtatcctatagttactaatatttgagtttggtacttggaatattagaatgtgaaataaaatgctgtatcaatcaatacatgtttctggagctctccctattgccaccactgcttgggggtggtttggacaagacaggagttataacacgattcttgcccctcagaagttgataatttatttgagaaaacagggaggactcatgaacaaaggagggtaatcaaatgctaagtcatgcgacattgacttaaattgaggagaaagggcaaggactgttggagcaagtagacccttaaagggagaagacagtcttgggccaggtttgaggtgggcatatagttgggcatttggtatattgcttaagtaacagcaggaagggaaagtattcttgctagaataaaagtagaaacataatacaggcacgagattggaattgagaagggacaatataatgacaaaacagacttagatgaaacaatgcatcagagaggcacaaggttagaaagagcacagcaatgacagaaaggctttaagagggcagatgagaaaaagttaatagtggtttaattttggggtagggagtggttttgtaagtttcatttttaaggcataaccatgaatgaaaacaatgatagatttttaattctttattgttttaataaaatgcctacattttgactaaaataatatgattggccctccacatctgtgggctccaccaagcgtgatttctaccaactgcgggttccatcaagtgggggtagaaattatttgaaaaaaaattaaaaataacaaagcaatagtaaaaataatacaaataaaaatatagtatagcaactatttatatagcatttacactgttttaggtattataagtaacctagagataatttaaattatatgggaggatatgcataagttatatacaaacactacaccatgatatataaggaatcaaagcatctgcaaattttagtatgggggtgggggttcctggaatcaatcccccacagataatgagggacaactgtacttacaaatcttcatatagcagaaaacctactacaatgaaacataaaaagctaacaaatagtcttataaaagaaggcctgcagtatatatgacaaaagtttaatatcctagatataaaatttgcttgtacgactcaataggaaaaaaagggagaaaatattctaataataaaagacacaaaaaagcataaatgaagaaacagaaatagctaccaagcactcaaaaatatatgtcactaataatcaaagaaataataaccacgagggagatactatttttgcctacttggtttttaaagagttaaacatttcctaacaaccagagtagacggagatgttggaagacagtcactttcactcattgttcatccttaggggaatattactgaataggtgaattttggatctttatttgagagataatgtatcaaaagctttaaaaacatacatgcccggttatatagcaaaaccaattctagaaatttttgaaaagagattaaagtgtatatctacaaagatgcttattgtcgcactgcttttaacagagaagattataagcaatctaactgtccatcaataaaggaatagattaaatgaatgacgttttatctttacaaagaactactatgcagccatgaaatcaatgaatatggatataatgactgaggaaaataccatactgttagaatttaaaatgtgacaaagcagttttataatatgattccaaatctttctttgaaatctgtgtatgtgtgtacacatttatgtttgtatctgtatttatttgttcctataaaaaatataggaaaagttttgcgtgagttttggagttgcaggcattgttaaatgcttttgaatatgcattgattatcactgcaaaaattaatattgaaaattaagttgtttccaaaaaatgataagaaattaagaggaaaccaagcaaagaagtaaggattttgatgcaattcgtagaaggaagccattgcaagttggttagtagagagagaagtaacatatatagaaagtgctttgattgattgctagtattttacaaaaggcaatgaaacagaaagttaacatttaggaaatcaaggtaaccctgagtaagtatagatagggaagcacaaaacatgtgggaccagagaaaggccaaaaggtggtagatgatatgaagattggaaaaatggagtctgtgatgactctaaaaataaagacattaatccaggtttaaatatattaattatgtaacaatgaggtatccagatgaagatgtgctctagacaaacagaaaactgaagcatgatctaaatccaatgctaaaaaagagacttaagttttgtcaccatggaggcgacatttgaagttaataagtatgaatgagattaccaaaagtgaggatatcaagctacaattatagagagtgataatttatcagaaaagtctaacaagagagctttattcttcttctattctatctgtgctatgctctacttatggtttcagattgtcttcaacatcatgaggattgtattaaggaaataattcgtaactaacaagaatatttgagtgacaagtctcagaaagtttaggaaacttgtttagcagaaatttaacccctcttaacgtctaaaatgttattttccaggttttagtttgacgcttatgtgcagttggcccctgacatccacttcctgttttgctctaatgatcctttagtgtgggtctacccagttttgaggagtttttgtcagaaagaatgagacaattgggcgtattttctttgtttgcttgcttgaattacctttttgtttgtttctttgtgtttgcttttttgaatgaccgactgactgttttatctgggatttgtttctgaagttgtattttagggcatttgttctcaaactttagcatgcttaagaagcctctgaaagacttgttaaaactgatttatgtttctttcttctggaaattctgactcagtaggtttgggatggggcctgagaactagtttgcatgatctcctaagagatgctgatgttgtgggtctgcaaaccagaggtgaaattgcattgttggaagaaacatgattttgaagcccaattttattttcacgtaacgctttttcacacaaagacatatccatctctatcaccaagtacaatattaaattttttttaaaaagtttttttgaagacagtcttactctgttgcccaggctgtagtgcagtggtatggtcatggctcactgcagccttgagcttctgggttcaagtgatcttcctgcctcaacctcccgaatagctgggactacaggtgcatgccaccacattcatccaatttttaaaaattttctgtagagatgaattatcactatattgtccaagctggtccagacctcctgggctcaagtaaccctcccacctcggcctcccaaagtgctgggattacaggcgtgagctacagtgcctgacctgttgaaatttatcactggtggtactttctgattattgttgtatacaaaatagccatttacctagattttaatttgcccataatttaaataataaaaattgttgtttatgttttaccctccctggctctggtgacttcagactttcatcatgtgattggaaagaaaatttcagggagaacacagtggattgtccccacaatcttggaaaaaaaatatatatgtatagtttgtcttctgagagttaaaatgaattgattttatcaatagatgctgaaataatatttatccaggtatatgtaaatatctaacttaatcagtaattttaaaatatatctaaaggaagactacgccacagaaggtactgacagtaggacagatgtgtattgccttggcacagggagaagaaatttcaatcccagagtccaaactcccttgccaatagagagaagttctgtgctatgtggctgggatgcattatcacttgttaatctggtctgggggagaaaatgcttcttgcctgtctatttctttatctcttaattacattttatcagcaaacttcctatgcttttatttctacaaaatgtaaatctgttgatcataaagggatgttttatgttgtgtatcgacaaattagtctcctgggttataccttagtctcatatgaattaaggtgactctgcctccaggattctaatgatctcagtgtgtgctaaaaggtctatttcctaaggcctcagagctagagaacaacatgacagccaagtggtggacccctgaacagccaacagccacacctcaatggagactcatctacttttctgagcactttacctgctgtttatttgttcattcactaggaagcagagctatagaattttataaaactgaaaggagctttgaagtcatcagggccagccctttcattgtgaagttgaggtcacaaccttccattggtgtctgactcttatgaacctggtaattgaaataattcaaaggctaggttcactgctcagaaatatttcacagtgttgtgaggtgtttctcttttgtattatcttagtctgaagtgtggtgcttggcatcaggttcaggtgctaatgtagagtgagaatccattcaaccttaacctctaggccccttccttactttaatttgagagtcacatatctgcattataaaacctgcctattttgcttaccttttcaagtgaactttcattgaatttccctttttaacttttatagcctaggatggcacttcttgataaaaactgcaaagaataagtcctgttgagaggaatacattattaagaacatatcaagagaaaaatacatatcaaagcatcaaataagttaaatggattgtgtacttaccgcaataacagacacaaaacatgctttcaaatattcattaattaataaaggggaatagagaaactcttttcatagcatattagtccgttttcacactgttgatacagagataaccgacactgggaagaaaaagaggtttaattggacttacagtcccacgtggctggggaggcctcagaatcatggtgggaggtgaaaggcacttcttacatggcggtggcaagagaaaaatgaggaagatgcaaaagcggaaacccctgttaaaaccatcagctctcatgagacttattcactaccatgagaacagtatgggggaaactgcccccatgattcaaattatctcccaccaggtccctcccacaacatatgggaactgtaggagtacaattcaagatgagatttcagtggggacacagagccaaaccatatcacatagagaactcagtatttgtttgcttttgtatatagtctgttataatagaaaaaaagatcataaaaacatgattctaatcatgtgctgtcatttttgggtttcagtctttttctctaggagattagttacaaggactagggataacgtatgcaacttgcccagtggatggtactttgtacatattaaagtaatggtaattatatttatgctatatattctaagttaaactgatatttggaatgagtggtaaaactctgagcaaagatagatttaaaagcactaggagactatatctgtactcgccactttttaatgcttcctctgccttctttagattctcacagctggatcaattgataacacaatcatgctgacgaagtcctgtgcccatattgactgacgtaaggaaggctgttacagttttaatctcaccacatagaagatcccagaaataaattactcgtccatgtatgggaatgttgtaatctggtcacaagtaccagcaataccgcagcactctccacaagaacacccctaggaaaccatgttgcccttgagttttcatagaattgtagttctctcctagtccttactcattaactggttattccaccggatattaccacccactttgtgttatgtgctgtgtttcatagtggggtctggatcccctgcattgttcatagccatcttcctcctgaatgcaatctagtcccttgctgaacctttcctttttcactcctcaaattctcagatatggctcttcaccaacttgactgtgtgttcttgatttctctaccataacaatatatatcctcagtgactgcttcttgaaacaccaagtttgctcttaccaactatcttctctgcccctgcccagctctatgacctctcctcctcctcactctttcatattccagtcacgatggccttctttctgttgctccaatatgcccagacctttcaagccccaggaccttggcaagagctcttccctcttcgtcagtggccccctctcccagcccaatcttaacatagatgattcttgtttttcagaccccagcttaaatgactttgctgaccacctagtttaaaagaattccccaatctccattgttttaccatattttaatttcttgcaatgcaatttcctattgttactggatatttttctgtttattttcttacttgtttgctaattgccttcctattaaaatgtaaggtctacaagagcagatatctgatctattacattctttgttgtatcccaagagctgagaacaatggcttgttctcaacacaatggtaggtgctcaatacatactccttgagtgaataaccagctgcccctcaggtttatgcctagacctggttctgttctcccagttcctacgccaaattgtatgccagggtagtaatccctttgtctctgacaacaaaaatggatctacccaacttagatacgttgaccagcctcacccacacacatactgtagccagggtgacattgataattgatggttattatgcccaccacaattttgggattttcctagtgttccaggaggcaccttgagtttacctgagcatgaaatcaaaatagcttgcctattgttgatccttgaagttgtttccagatttccattttaccagaattgaactgatgatacttatgcacatgctctttaagcaaagtgattttccagaggaaattgcttagggaaagtttgtgctttattttaaaactacctgaaggaagttatcaaaatagtaaactgcatagattcagagtttgggtcccactgactcagctgtcacagaatagtcagaaggaagaatgaacatcaacagaccagggagcattcgttacttgttctaaaaacacatgaagaaacaatggcacatgtgtcttcacactcccatgcccatctgttgcttgacatatcttttcttttagacctttagaaaatctctgttctgaaaatcgcacagtatggatatttgattttgcatgtacggcatctagtgttccttgttttcataattgcataccaattttcatgttggaaaactaatctcccattggatatggttttggttcaattgcttatcaaagggtaaggcacctggacccaaggtggactcttgactcaatctaggaatagcagctgttcttttccaagaagatacatgtggatttatccatgttatctttagtatttcaaagagactattggcttcttcagcttagatcctcagaccttctcttgctccttctcagaagcttgcctcttcagattttcctttgctttagttaacctagttggcttttgttttattttgttttgttttgactaataagaatcaattagtgccacttgcaaccataaaaccttaattcacagaaagtaagtaatgttggacaataataagataaagaagtgatatttagtgttatggagaaatacagcagagcctcagatttttcctcccttccttctacatttctgccagaaccagaactatgtcatatccatatacataaggaagaaacactaattacttccaaagaatgtagagtgtccctatagaagagcctccctgcagaggctcccttcagttgatcaagctgaggctctatctgcttgactttgcttatgttctcccgtttgactggagtctttctcagttctttttgccctgtttctaccttccatgttctcctcatacactacctcctataactaagtcttctgatattaaaattaacctttttcctcttcttcactgagtcttattcattttgtggaccccatagcacataaccaaaagccttgcatcttgtttctatggcaaagccacatttaaatttattcgttagattaatgaaaaaacacacaattaaaagaaaacgcactgttttaaaattatattcactgcttaatttattgaccttgtttaaaattgctgctagttctatgcctactatttccatttcagtcttcaaactcaggcagctttaattctgtcctctcaatcattacttccctccactgaccaaatgtttccacctgcattggtgttctttccacagctggtcatagagctcatcaaagcattgtactttagctacagaaattgtaagttgagggttggaggaagatccaactttctccaatgtaaatatttctgcattgcttataagcaattacatttgtatgttagtcctattttaagtagctcacttacagctggtactgagcaatgagtaagcatgtggttctctatttataaagtagcccctaatctctcaccatgataggccagctatacatagtggtctgttttgagagaggggttttctagaggtcaggattatgtggctaaagagcagggaaacccaggaaaatgtaagtgattcaccacagtgtgctattggtgtttccttgggaccatgatgttgttcagtgcaaggtgaaagcctgagaagaacagatgagagacgctgtttagagtgacagacatgtagtaagtggctgcctttgattgtaggatttcaagaaaaaataaaagaaaaacatgttatttatgggttcgaataatattacaataatccaaaggtagttttattctagcagtgtggaaaataaaagcctttgtaaattaattgcttgtctatgatatgagaaagcacagagcaagcgctgttgaacataaatcaacttgatttataaacaatttgttattcatctaagatatttaatagtatatattaaattcattttgttatataaaaattaatgagtgaatgattggtaaatgcataaatgggtaaattacataaatcaagaaaattacccctcacacttttgcttttgagttaaatttatgaaaaatgcactagattcctcaccactaaaactttctatatattggaaacccaagttgttttttgttttaactagcattttgtaagcccattaagtagtataaatttctgttatttttaaatacttgtcagcagtatgttttgcaattggaatgaatacttagacaaataaatgttgagtttaacttctcatagagttacaaacttctcatagagagttcaggaagtgtttgaattcatggtggctttacttcattcacctgtatggttggggacaattccattctaaatacatttattcagcacctgccatatatcaggcactctgttaggttgaaagtgttggctcattggagaagacagagttatttttacattacatttccagagtatatcacagtgtttggtacatagaaagcacttagtcaacaatgaacgtataagggagctaaatcactaaatggttttaagaagagaaaataaatgcttactatgtgatgcagaatatggttagtgttatatttgatataggaacctgccagggctaaaaaaaaatttagagattatgtaagtccgaaatattggtgaaaatttcatggaggatgtgcgatttgatatgaattttaaataatttatagaattacatgtaaatgtctaaaggaatggtatggccaaaggtctggagttggaaatatatgtgcctgaaagaaatatagcatagtgattaaaaaaaaacaaaaaaaaacaaaaaaaaaaacgggaaagtaaaactgggaaagaaaattttgtcaaaaaaaaaaaaaaagaagaaagcttgattttggaagcttggaaaaccttgaatgccatggtaaggatgctgatatattttatctggaagatgatgagctctaatcttttttttaagtgcaggtgatattatctaacaatgatttcaagctgttaccctaacattggttaagacagtagagctaagtagagaacttggagacaagtcagaattgaatttatagaaataacacaggtaacagaacattaatatctggcttaggacagttctgttgaaagtgaaaaggaactgtggaggcagcattggcagaggttgaccagtactttgattcatgggcatgaaggatacagagctttcaaaagtgagtccaaacgcatcctgctggaatgacactgaaaatggggtatttccacctgaaaaaaagaggagatataggagaaagaacaggtttttggagacatgacggagagttaagttttgggcatgtgaatttggaagtgtgtgttagtctgtcagcaatctgtagctgcctagaagtctgctagaaatttatcttgaagtttaaaataaatatttagatttaataatattaagaaaacaataacaccaacaacaaaccctttgggcgtatttgtatcataatgtactgacacgttaaattcttacaataacttataaggtgggcactatgatgtattttgtcattttgctggtatttggcagtgatcatcacagcacaaacaagattaagagggaaattatagaaataaaagaattgaaagatagaatcctagggaatatgcagtggtggggggggcggtggtggcggtggtgagaatttgtcacagagatggaagaagcagaaatgagtattattatagcaaagggaatatgaaatttcatgccaaaaggaattgttagggatttcatatattggaaagagtttaaggtgtctgaagactgagggaaaaaatgcattgcatttaataatttgaggtcattgttgatcttcaggaaaatagtttcagctggagggcaggtgaagaagggggtgaaaactcagaagtgagaactagaggcattagtagtgcagccaacttttttaaaaaagtttgagatttaaaattagaaaaggggcagctactaatgtgggataacataattaagggaatgggtttgtgaaagagggaggcttgagcatatttgtgatctgagtcgaaggaggaggtggcagtgaagaataggagatgtgagaacgtgagtaaaaaaatgccattaaaggtaaatcctgggtcgagggggcagatattgaacagatcaagggcacaggtggagcaattggccttagaaaacctaatccataatcacttctttctttaagagaggaagaaagagatggtggataaggacaaagataaattttgtattgggatggagtagaaatagatcatgtctgaaaactttaatctcagtaaagtaggtcatcctctgtgaataagctgggggggcccggataaggtcatatctggagaggcaaagtcaaatttgtctttctagtaaaacttcaggctttatagttcaataattaaggattttgaaacacaagagactgttattaaatgcatgggaattacatgtatggtagaattggatcctttccactgaaacacttaaatacacttgaatctgagatttcaatcttctgtatttttttttttgaagttttgatttttagtgaaattctaaaaaccttggttaaggatgagaggcctatgaaccatatatgtgtgctaacattttaagatttgtttgtttattttatgggaagattttctcttcctgatgaacataaaaccaaagaaagtcacaggagtgaattccttcagccccaccctccaagttgttattaggctaacgctgaagggaaagatcactcaagatgcgctccttggggtaaattgatgtgatgaaaatttattgtcatgtggcacttcagggagcagcatctggcatatttgtccctgtttatggctctgacgttcatctgttattctatttttcttacatagattaactagtgttttatttccactgaatttttctgttattagataaaagtgaagcaaagctaagcaaaccaaaacaaaacataaaaccttttagtctgcacagtccaactcccagtgagtccaaatctatctctgatgttttatatcaatagtgccactgtgttatcactcctgagtgctgctgcttctgtggtccatgccataggcatttcttttcaaatcacatccttgattcagtaggttaatggggccagtgagcatggcactggttgataaacagagctaataagcaaagctagacattatcttttatgtgcaaacagattggaggtgggtttgtttgttaggttctcttattatctccggagagctctggcaggagaatatcattctccagttctctaatatacctcttctctgaattgaaattgagatctccgatcagcctaggtttgaaaaatctaataacggtttctgtacactgcttcacgctctatagccagccctcaaggagagaaagacataggtagaacagaaaattggtctgagtgcgaggtgcactgccagattggttgaagaataaacacttgatattctaagtttgtgtctcacactacaatatgcaagccaccaaaaaatgttggcattatgctaggagatatgtgaatatggcatgtgttcctggggtgccatataatttagattcaggtgtttggggaaagtttgaggtttactatttaattcacgtatttggagaaaatttgagatttacttttataggctattggaagccactatagagtaataggcgtaagagcattgcattgaaatctacatttagaaaggtttgcttgattttaacatataaacttgaatagcggaagagaagattagggggattggccattttagtgacctaggggtgaaggaataagggtatgaagaaataaaacatgtccatagcaatcattaaatcaatcagggccatccatcatgttgcagcatttggatagccagatgtatgcccttagagaggccttggtttccttatttggaaatgagaatgcttgagttggatcagagattcctaagtgtgttccacagtgtacttgtgctgtgaagcacactttgaaaaagaaagggctctataatcaagtcagtttcgtttcccatagtccatctgcatggtagagaggcctaacgctggttagtatactaagggatttgagaaggtctgaaggcaggacaactgtttaaatttcctgaacccaccctttcctaaactttgtgaacatatagtcttgtggagaataacacgtctagtgttaatctaatactggggttacattctaaattttaaggcaattatcagaaatgtaaaatccaacacagccagttatttttttctagcattctgtttcttttttgttgttgttgcatgtaagataatttatgaatgtgctttttgaagaatacgtgctctgtttttaaaaacttgaactgctctcaacctgacaagaggttcacttacatagggacacaagagaacaaagagtgatcaggggaaggcaaattcataattcagaacttgagtttactgtcttttataaatttattcatgaaatagtggtagaattagtaagtgaccacaaatttaaatcactaattaattctcattctttctgaactcttgcactctctcttctttttgcatttatatctgtgtatctttttctctccttgtctttgtgtatctatatgtctctgtctatgtctgtccctttgtcactctctctccttttctctctctgtcttcttttcccttccctctccttttttttttctctcacctaaagagtccatctgcaaatatagagatgaagtcccgtaaattaaatatgcatgtgccgtgactccctgtattaaccttttgtagaactgcgcttccctggaaactgtggactttagataatcccaagatcttttgcctttgatctgctctgctcactctcttctcctggcttttgtggattcagttctgcttttcaccttgaacttcactgcccctgcagtgccattcacgtgtaccccatcatttcaggacagaggcatggagaaggatgagagagtctgccttgtctcaagccctaagcaaataatctttgcatttctccatccctacttggaaggcatattcttaccatctgtggatcatataatgaatgacttttttgaaggaatgttcacatttcttatcttgcttgttatacacatcatttttcaaaccttggaacgatgagatggcatttcaagtaagggtggtcccacaaatcaaatgtagtgtgactttggtttcatttctttgttgaaacatctggtcttgtttaatgcacaacaagaaagaggtaggaaacatgtaaaagtccttgctgccctcagctctgattgctttctcttactgccattgtattatgaaactcactgcctcgagtagagaaaggaagttaattccacaataactacatttgccaagagtcacttgcatgtccatgggcatgaaggcactgtgtatattgcttttccaaattccagtctgggacttctgccttgaacaaggaaatttgaggcacaggtcactggagtctatggtgacatgatttatttgcaacagtaccatgttaaatgtcaccatattagggtggtgtggccacggctgccccttaagttttccagtcacaaaacagccctttttcccctcagaaatcctaaaactcccatataggaacaaaatcctacgccttatggtacacagacttcaggttgtcaatatttgttaaaaaggcatgatgcttactagaggacagcattggtctccagagctagccatgtgtgccaaacaggtgactggtttatagatggatagtatgcttaatataaatccaatcacttttacagttgctcttgaattccagcctcaagtcttggccttattccctcccagagtttagcagttgactttcggcaaaaggaaaattcgggatgagtggagagtagtcagcacaaattagatggattatcctttaacaaatacacagaaatctccttgctgttattgcttatcatcttctggttgcttgggcattggcaaattttctttcttggctttgtctactttgcagtactgtggtggtggaggtataggggtggtgatagtaatagaagtcataatgatgataggcaagattatatattcatcatactttatgcaactccctaatcttggtgtttaactcagtcttcatagcaaccttgtggtaaaaatcccatgatactgtatcctacaagtttagatgtaatgtagttggcagttggctccagaatccttgaacttatcagccagctagctaactttggtcatttcattaatctggcaataataccttctcatgtattatgggattgaatattttagattccatgaacaaaaacatgacagggctcactgtcctattagtatcctcattttacacattaggaaattgaagtctgacttacttaaaggtcactgctggaaggcagcaggcatgtagagtcagtgtggctccagaattcatgctttccatgactgtgatacaggctgaggtttataaagttatctatgggagggataaagctgttgcttaaaggttaagagaccatggctctgaccctggtttaattacaagtaccctgcatttcagcattacatcctgtttttatctcgggtgcacaggggtggagggaaccagatatggtgtgcacaaaacctactggggagctgaagccaagagctggtttgttaagtggccttgactttgatttaagtatttaaattgtgtcccaatttgggtcatatgaagtgaagcaaacctaacttcatgtatcaaacatgagtgatgtcttgtatcatgcttttctgaattagagttgctctttccttaagtgcctaaaaatgtcatgtgcctttgctcagtaaagtgatgccagtagctggcatgagatcagtaagaaatatgccaaaaatcactggagctttggggaacccaggattgggaaacattctaaatgactgtggccataaatatagagctccaaagtttagagcctgaagcttttatgcctaggagcatggcaatctctggtttcattatagtccttgctaaaatttaacttaaaaaagaaaacagataaattagacactattggcaccattgaaaaacaatctagcattatttatcaataaccttaacatgtttataagctttcatctaataacttcatatctggaatagtaagaaatatatacattcagagatgtttgtcgtagttttatttgtttcttcatcatttatttcatttaactacagaataatattctagttgaaaaaaacccaaaaatatgtaaagtaaaatgtaagattcgtattgcaaaagttcaaccacttttaacagtttggtatatacttcaaaacctcatcctcattatatttcttcctccccttctcatgtatacacacatacatacatgcattcatgtacacacatacatatatttgtgcacatgtatatacacatttagctacacatatatacaaaaatataatttccaagaaaactgtaaggctagggacattgttcagtaacttacttttttatcatattacgggcatttgcgtgtgtgagagagagcttgtggatctacataattgttttatcaactagatggtattctagagtcacgatgtactgttaaacattaaacttggtaaatactaagattgtttccaattttgataatacaatcatgctgcagtgaacacactagttgctatattttggtacatgtataggggcatgtccatgaatcaaattttaggagtagaattgtagagtcgaaaggacacttaaatttttatagatcaggctaaatgcatctctaccctaccactatcactgacacagctctactgattcactttcccacaaacaacatatgagagtccttcaggttttgttattgttctttttctagcttcttgagataaatgctgtatcttttatgttttatgatgaatttactttagactgtaaattttccttcaaatgctctgttggctacctcttattggttttgataggtattaccggggtgatattaagaatatctaagaaccagtaaaaaataaaaaaatatttcaggaaagaggccatcactgcctagtccagccataaacaactggtatggctgtcctggtatgaatgtgccagatatcagacatgtgactctcactggaattcacttcttctagcctatcacccaaccaaactctacaatatgatattttctaaatatgtcaaatatgcattgcttatatgactttgatctgactttttgtttgttttgtttcttctgggattgctattatcaatgaatctgttcattaaaattcttactcataattgaaagttcagcttaaatgatacctccctagcaaagataacactcttctatgaaaaattttgtcatttggtttgaacttcatatggtagttactattatcatcatcagggatgagtgaactttcttgtaaaggaccagatagtaaatattttctgcttgctatgtatacactttccactgtgctcactctgctctatgtaacatgaaagcaagcttagtgatacctaaacaaatgagtttaggtgggtctgtcctgattaaattataaattataattaaattattaaattaattatattacaaaaacagttgtccaggctccgggccatactttactaattttcatattttgagctatactatttaatagctattataaacttctctaatcttctattccggactatatacttcttggaaatgaggcttgtgtaagtggtgatgtggcttaacctttaattcctacgcactcaagagacatttgttggataagtgaaaaatgttaacaccgttgttattcacctgtagaaattttagtgattcttaatataaacaatgaatactggagatattgacataccagcataaaatttttctgaaactctaatttgatgcccaatttgtatgtagattattcccttgcttgtgtgctgggtttagtttattctttgagattcattcttttgtcaaaacgtttttagggataaaaggagtgtagtaaaaactcagtcaaatatttgaaaaagccttaagtcaaaatatgatagatctaaaaggaagcctattcatattgcgtactgtgacatttattcttgtttaggaagctttatgtgggttgttaatttgtttttggcttaggtaaaccaagctatgatagagttgagcaatgatatattcagaaaaccaacataactggtgaaagaatttttttatccttatattttttctatgtccagataggatattctttaggagacttacagtagcatattgagttttgtttggtatttctctctggttttcggtgttgcttgaacctaaaagctttaaataatctgtagatgaaaatctcacctattctatcattattgcgacaacagaaggaatgtgtaatgaattcacagccattcagaagccgcagaggcaaaacacatataagctgttattaattggatggaaaagacaagaattaataaacacccataatatacacacacagaaatacataaaaataaaggaaacgctctgtaaataattaattaatttaaaaattaaaaaatgtgaaagaaattgtgtatttacatagtgaagatttgagaagaaataattctacctattgatcataaaaggtcaaaaaatacagtaatgtcacatcatttaaactgtatagttcatcttccagtagtagcaggagtttgttttactcatctttagttttcttcttacaagactacactcgtttcacccactcatggaaagaacagcttgtcttatcaccctccagtggaaatgagttatgagccttttatctggagtttacaggacagctttaacctctttatagttgaacttcagtgatgaatgcaatcttattttatcttagttaatttttttcccaagaattccttttcctgttctgatttgtaggtacatacaagataataataggaaagatcaaattaccctatttgggatcatgttaaacacttttctattgtcctgcaagtcttcagtattaatttcctgtttctttttctgttcatatcaatctaattagaaaaagcaggcatttgtaacattcataatattctggtgtcttcaccgtatttcaaagaaaagcttgtattttatgcatcttaaaatatttttgtgggctaagttggtttacttcttcttaggtttataaactaggctgccaagaattttgcaaactagaaatgtagtgactgaggtaacttgggtgtcagttgcaagacaaaatgatcattcacaaagatgcagaagccctaacctgggttctgtgagcaatagcaggaagagtcagatgtactgcgtaagtcaaatggatggccttatttggtatctggctaatatatcactctggctaatatatcacccgcagaatgcaaggtccttactgttttaactcatcaaacacaagaggtccttcccatggaacatatcctcccctggcactgattagcaattatttccgaatgattacctttgaatgattggacagagtttatgatttgccaaaagtcacaaccaatgtaggtcatcatggattagcttctttcctttgacgtttaattaatttattcacacattcatcatgtatcttgtgccaactgtgggccaggtattgtgctatgtgctagggatgccaacttgaatgagacaagatctggaaccttgagagacttaagtaagaaatatgcaaatccatgattacattacaattttattagtgctataatggaagcatgactaggatactaggggggcataaagggatcaaaatcagattcagggaaaataccctagaggaaacaatatttatactgaattttgaagaacaagtgggatttcagttagagagcattgagacagcattgtagcatatatcaaagagatataaaacaggaccaggtatttaagtaatgacaaatacttcagcgtggcttcagcaatagaagctaagggatataagtggtagatgttgaagctaaggatccagccagagatcagatcacaaaagatgaagatgataaactaggaagtatagtttgggacaaagtgacataaggaaaggattcacctttctcatttaatagcattccagcaccatgccaattccgtgtcacacaaccacaaagctcttcccttgcctcgttcagtgcatttctatggggtttgggatatgagcttaaaagtaaaggcaggactcatttctctaaatggaattcacataccaactgctaagagaatctattcttctttaacttatttcagttgtatctcttctgttaagctggggacctactcagcctgccaccttcttgtgagcaacttcccctttatctgtactggtttgactgtatagaaaaagatgcagaaatgccgtaagggaggcataagcgaaaataagaaaaagccagcaactactgtgggccaggcactgtgctggatcatttacacggtacctcatttaatcctcaccatgtctatagatattattctcatctccattttacagataagtaaaataagtgtcttgcttaaaattgcacagtaaatatgaaatttggatttttaactttagttgatctgtttctagaaaaccattatttgcatattctaatacttcctagtctgggcagtattctcccagatctaagtccaaagtacttagaaaagtaattaaatctgatacctagacttgtttctattatattcaaattgttcatgtcagcacatgtcaaagctcttaaggacataggaagcaccctttccccttaaaacattgccttcttgaactttctgtgctaatattctggcagacacatggtagaaagaatctgttttgagattctggagccgggttttaaacctggtgctgaccataacaatgtttgagatcagactcgagtcagttaagctctcagggatttagtctctgccatgtaaaaggaggcaactgacttacctcatcaagtccttttcctctaagtacctagatttttgttttcacaggtgagacattaaatgggttatttagatcacctttgcacaaattgctagctttgttactgatggataacaagaagttaatttcactctcagagtagactacggtcagctgcaaatatgaaggaacggaggttctacaaaataggagaactttctctgagacctctgaaaggttcaggctgcctgtttttattgtaactcttaaatatcaaactccttttaaatgctctaaaggaatttcatgaaaaatgttttctccaaaggtgaataaaggagccattgactgagtaaaaaaataaatacatgaataaagaataaaagctggatcatcttccttcctggaaacattctatggcatattaatggagaaattcatactatcacagagaaaaatttacaaacatgacatatgtaacttagagatgtttaatcccgagaaaaacagtcaaagagaattttattcacttacagaggaatatttttaaaggaaggatttgctagcagattgaatttctattttatgttagttatttattagcaaactcataactttgctattcaggcagcttggagtcataagagatgtattataaaaaagctattatttttagttattaagaatttgaataaataactgtggcccttttttgaagtggagggctattaagaggtacagaaatgcagataaaaatactccttaatagaaaggtcagttaaatataatgtgtcatatttaaaagaataaactttgaagtcagagaggacaaaatatgagccatggctccagtactctgtttttaagatttgtgaatgtaaaaaaaaaaaaagtttggggaaaatctttaaactttattcctgtgtcatgcaaaacagcgagttttgaggaatacattgagttaagatatcatatacttagccaatgaacgtaccaaatgacccatacatcacctgctcagttcatagggcaggaaccttaagatagaatctcatagaactctttctttcacttataacctgaataacctatacataattaccttgctttaagtgttttattgtactagacatgggttttccaaacttttatgatatattagtccctttcattgaaatatgtaatcccagcaacttccttagaaatgaaaaaaactaatcattttgacattattacctggtgaaaaataaaatacgacacatttttactgttttccatttaacaaatgttgtgctctattcagttacttcaaagttaagtttgtaagcaacttataaaatatctgaaaatagaacaataatttgaacccacaaagatatcagattgcaatgcatattatgtggctaaattctataattttcctgagttgtttctaaaggatgagataagaaagaaactcatgttgtgagctttctccacttgttatattttgcttacatgaagactcaaatatgtacatacgtagtttttcctcttgcaattccctgtgaaatactagggtcattttaatgttctgtgtaagatgaacaccaattttattctcaatagcagtgttccatatacttcttgcattttaacaagagctccttcatcaatccaaataataaattacaagaccaaaaatgaaagcaatttgtacatctgtgaaggtcaaagccaccaagctggctggagatattcagctgagggcggtaactactgaagtcctgagttatgggcacactcgtcctctctgagtgctgtgcatgctcactcagtaaaaactaagcggctctaaatggtttccttttaagaagaaaaagcatgtttagtgtgttatttaattcaatgatttttcaaaattagatattataatggatcccaatcatgcccttaataatgagactgtacaagaatacgtgataaaattgtagaaaaagaaataacaatggttttgccaggcactgagcttagggctatatacagttttctaaaggatgctccatctatgaagggctcttcctctcttttatttttttttcatttccgtccttcccatttgttttctttcttcattttcttcttttctaccgtctggcttatttgagtcaaccaacatttactgtatccccatgaaaagccagacatcataggaggaactacggatacgagaaattaaggagttcataatctagtaaaaatgttgtctgtgttttttttgtgtttgtttttaatttatccggagtttgtgtttatttacctatccatacatgaatttataatcactttggatgccttaaaatacaataatattctggggcctatatcacctaatgtaatcctccacatgctgtagacatgattaaaatcctcatcctctaacattcaaatagatctggtgaaaataaagtgtacattttatgagttaaaaatcataaaatcttagtcctgctagtcttgattacagttcttttaaagtacctagtccagatcaagtcagttgccatgctaattagttttcacatacgaaaaaaaaaaatggccatactccagacactggtctttctatttcaggaaagatggcatataagaaaacctcactatatgcaaaggatttgtggatggttccttggagttaattttcatgggctttagaaggtatttaaacctcaagacaaggagagggtttataaatgattgacagaagctctttagctactcaagtccaagagggtagcacctcttagccgttcaatgaatagtatggagaattcgaagggctgcttagaactctagggcagcctattttttgaagattatgcttttgacctttcttgctagaagtcatccatccatctaataagtgttatttaagggcatacagtgtgccaagaacgcaacttggcatcaccatggagaccataaaattctagtctcatcctctcatccatcacaaccaagtagaagttggtgctgttaatgtcaagagcaaatcaagaagtcaagaaagactgaagctcagacacattgtcactggtgtaatctccacctttgaaggtgctgctctgatatcaaattttatgtacagagacaaacacatacacagttgacaaagtaacagacataaattatttttatgttttatatgttattttttgaagtaacatcaggtatgtactttagcttattttttcacacaaagttgatttttttgggtaataacaatagaatttatactagttgcagaattatctacaaccaccatagtaaagaaacaaagccgtaaactaggtcgtattattactgttatcttttgaatttttggacagagctgatttaataatttggcaaacttgtaactagggtaactagaaaatgctgaaatttaaatctatgttatttatattattttgatctttatatggcctaaaaatgcaggtttaactccagcacacatagtaaaattaacagtagaaagaaacaaacatcagaagccatatgtaatatgtctgtggtgctcttgacacccctctgtcttctcttctgaaatgtgtattccttctgatattggacacatacagttacacacacacatacacacacacacacacacacacacacacacacacaccccttggactgaattctagatgcaattttaaaaatcaataatttagtatctcttcatataattcacaccccttcttatttcccccatgatttttatttaagcttgtacgcaatttttggcatgaactaagctttttaagactttatgccactgtagggatttttggaaaacactgataaagccaataaaataacacaccgattcagatattacccttgttcaaacagggctctcaaatgggtcctattttcttggatttgcccactctgaaaaaaaaaaaaaaattcactgcaagctaaattactttctttaacatacctagattttttttattttgtttttatttttaactctggactttattaaaaggacaaaggaattcactggagtgggaataacacagattttactgtgcaatgaacttaaatgcacttctataaagtaagtcatgaacactgacttcaacctttcattttcctcaggaaggacccagttagaaccagcagtcactgtggctgagggaagaggcacagtattctggtctggtctaggttcttctttcctttttcagtttcttttttggttcctttctgtttgtactgctcttgtgagcttcttattgttcaagcctcatagctatttatggattatgcacagtttgggctaatatgattaacatttgcctcaagagccaggtcttctcatgtaattggttctctttcaaaacacgtggcctccgcctggatgactggcttgctacgtaacctggaacggccatgtcctgggtctttctgtgctgcatgtttggccgtggaatttatttcttctgtcctgctggagtgggtaggattgtttgaacaggaagagtcacttccttgttatgctctcccagcattgtagagctccaagatgtttcccctgtgcccttccattaagcccttacaatctcctgcactaaagtttaatcacttccctcctaatatcctaaagaagacaagagctttctctcctaattctttccttctctcctttttctttttctctttccttctttctctttgcttacctagtattctttccagcctgcctgcctatctgccttttcttctctccttcctctcctcttcctttactctcattattccctttgttttccttttccccactgttatttttttttctaatttcatgtcatttctgttatgaaaactagatcccagttaatggagctttatcgtatttgcacacagatgaaagaatacatgcatataataatgaattgctgcattctttgtaacaagagaatattggaaacaacttgaatgtccattaataggggacaaattgaataaactatggcatgtctgtaaaacagaactctctgtaactgtagaaaagaatcaggaaacactctatgtattaagttgtaagtatctccaaaatattttgtgaagtgaaaaaaagacatagtgcagaacatttgtattttatatttcgtttgtgaaaaaaggcggtggtgggaaataagattatattttacattttattgctcttagtaaacaccaaaaaatttgtgtaggaaactattcctgggtgtcaaggatagatgggctgaggaatagtagaaagggagattttatcgttataccgttttgtatttattaactttcaaaagtgtgttaatatattatccatccaaaaagtgaaatataataatgtaaacctgggaagccaatgtaagattcagttgaaagaaaactatcccattaaatgcatatatatatatatgtgtgtgtgtgtatgtatgtatatacatgtgtgtatatatgtgtgtatgtatatatatacatgtgtgtatgtatatatatacgtgtgtgtatatatatgtgtgtatatatgtatgtatatatatacacatacacacacacacacacacatacacacacatatgtataaatttgacatgactggtatagttatccaaactcacaggtgttcttctagaatattagctatctatggcttaaattatgtaaaattgtcattttttactaaaaaaccatttcaaatattggcaatttcatactattggcctaatctttccttgtcttaagttgaggcatcaaaaatctatcatcaggttgcctgggctattactctctttaacttcattcttctcctgtgctatagaaacttttggagtcatatttcattaatttccccaggtcacctggataggactatgaagtgtggcaatcctgaatcacctttccatccttgctttattaactttacacttgactgtagattaaactgtcataatctaccactgagattatggtgtttttttcctaagaagtcattctgaatctcaggctttccttgcaggtctaatgtcttcattgccaccaaatttatctttctacaatgcagtttgactcctgtttctttttactaagtgcatcccatgtcttctcactggctacataatatatatggactaaactccttggaaagcatgcaattcatcctcattcttacctccacccactgatctttccataaactctctaaacctgttctttccccaaattatgatccccaataagtctccatggctttgctaattactttctgtttattaaaatgagcttctccaccttctatgtcttgcaagcctcttattaccatttaaaggttttacacaaataagtgttctctctgtagttctgattcccaactatccacaattaatctcttgcttatttatgtttccatggtcctatgtaattacccctattataaatctagtcattaggacctattccagatatttgtttatgtggctacctaccttcctcactaccttctgagtgattggcagcacagatgaaggtcttggttatccttgtattccctcgtactgagctcagtgtttggtatagagttttgtgattagtaaatattggtttattgagtaatgcttcagtcttactactggcatcctttttttttttttttcgagacagagtctcgctgtgtcgccaggctggagtgcagtggcgcaatctcacctcactgcaacctccacctcctgggttccagcgattctcctgcctcagtctcacaagtagctgggactacagacgtgcaccaccacgcccagctaattttttgtatttttagcagagacggggtttcaccgtgttggccaggatggtctcgatctcctgacctcatgatctgcccgcactggcctcccaaagtgctgggattacaggcgtgagccaccacacccggcctagaatccttttgtatatggaaggaagtattttaaaaatcctttttaaaaaaggtaggagactaatgttaaggaaggttttgggagtggggaaagaaatgcctttacattaaggacatgaaaattgaaagtacaaagcagtctctaatttgttcattatttgccataaggacatgatttagttttgaatgtattccaccaggttctctttatctcctttgcttcatattagtgtttattttgatgatgattaaggcaatatgctactaagaattgtgctgtctttttgtaaattatgcctgaaaaaatcgtgattgttcctgttgctttgaagtcttatgtttatatttaattgtaaaagttaaggctacctctatgtgatagacagagtgttctccaaaaaatgcccgcaaatttggagtggaggataaatgacagttttctcttcctacttctcccttcctccttttcctcctccttctgttacttaatattatcactattatcattattttcttctaatctggaaatataatagcttaatagcctagtctagctgagttggacttgtgtatttgttgaaaatattaagttataactttggagtaaatactcatcataaaatgagaatgatttgatggtgtgtgttcttgtgtattgcacagacacattactgagtggcacatagagttgcagtgagttttactgtaagggagtattttagccatcatgtcttccaaggatcgcatgccctgtttcctaggtcctaataaaagcttgtatttatatgtaactcactattgccatttcagttcatcaagattaacaccaaggagctattatcgatcacgtcagagtgaggcaggtagaatgctagaattttttgaggatgaaataaagtgatcttagtctctggcatcttagttgttgggtgccttcctttttcttttatcagtaaatgattgttatctatgaccaaagaaagaagagaaattcgcattatttagcattttgcccacttaggtggcacttactctgatttagtctattataacatcattatgtcttgctaatggcaccatgcagttcacttccttcaactgtttgcagagtgcctctccatttaaacaacgtggcacgtttaaatagtttactagtactataacattcttggcttattgtacattagattttaaaatttagaaaattttctattgagcacaagaatatataatggtgagcatgactttaaatactgaaatgaaaagtctgtgagaacaattatctgtttcgttatgtgttagaagtggtagatatgttttctgtaaatgtgaataaactgaaatgaaattttaaagcttgtggaatgaaacgacaaaaaggacattggtattacacagtttctttcaattccaccatccctaccacccacccaacccttcatcccagaattagtgttggtctgttgctttccacggttccatgaaatagttagatgatttaataagaactttggaatatgtcctcttttccctcaacctccaggtaaatttattggtagttaatgttgctagtcttttcatggcctagaaaattgttctctcttttcttcacttagttaacttttatttttccttctaatgagagctcaggtcttccttcctatgcaaggcttccctgacctccattgggttagatctctcataaaggtgctcagagcactgcttacttggcaaaccttcaaattcacatttgtttacgtgtttatttttattagtcttccttccctattaatccaaaagccctataaagctgagggcagtcttcaactccctattggattattaattccaagtataatgttttgcacatactagtcactgagtaaatatttttgaaacatgaaagagtgttcagatgtgaaaacactcatttttggctatagaatataatttggggtatctccatcaaatgcatacctagttatgattttattaattttctgcaatttaaatcagtattgtttctttactccgaaatgtaaattaaggttcagtgtttaatgccactataccgggaaaatatatgtttttggcttttaattccataacatgtattttttgcccctgaacttcaattaaatgttctccagttggttttttgtgttggggtggggcagggggtttgtaaggtaacccttttggttttagagcataactgcatccatacttttataacccatttacaagtgttgtaagtatatgaaccttaaaatgtatatacaattcttcaaagctcatgtgtaattaaaatctggaagggcaggtggttgagaggttctagtaatttattgtgttactctaagataagaatcaaaaatttaaaaatcacaggagagtctatagttagcgtgtatccaattgatatacaataaaagccacaggaagcatttattaaaagactcataatgaaaccaaaagaaataatccattaggagttaactcgcagaatatcatatagaaaactgaataagctttagagaaatgtcttattctttgactcttctttgggcagaaggtactacagaatattaactagacagattttcatgattgcctattcaaagaaaatgaagtattttgatgtgccatgcattgagtcaagcttaatgcatatttaagcacagttctagcatctgagtggtaaactggtcttttactcctaatggaatttttgttcctgacatggaaaaaatcatgtgaaaaatttttatagattatatatattatatgtatattttataaatcatgtgaaaaattttaatatatattaactatataatacatattaatataactatataattaatatatatattaatataactatagaattaatatatatattaatataacttttgttatattcacaagatactttaaaatcttattcatttctccaacttctagaacaatttttcctgggcaactattcaaatctttgtgaaatatacatcttactctatgacatcactagggactatagccagaatagaccaggcattcagagctctatgtctgtaccacatagacatcagacagtgtttggacaaaacagatctaacacttgcaactattgctaatttttgacccctaaatacctaagtttgaatataccactgtgtgggattgcggtctctatttctccacactacaaaaatctgccttcctggattcccatggtcctgttttcagagtgggtgtttgtttgtaggtgctagcagtatgtttgtaattccagttaggtttgtcactcaatagcttctgcattcagccatctctgtactggatacactttggaagaagtaatagttaataagtaatattttaaactaaactactttatctaatttatgaaatcatttgggctggaagagccctacagtgaaatacatagctcatccccttttctggaatagcgggatagcttattattgtctataaaaaatccattctgggtgggtatctattctcagccttcattatctacagtgatagcaattccacagcctcccttggcagccctccctattgctgaactagccttgcttattaatcctgtaataataccttatgttctctaaatattgaagcagtgcttaagtttcccctgctaactcattcctccctgctcaccctgtgaaatgcttctagagggggaataattatataagcacacagcaccaaatgatgtgttgtgcagccttgtcctaaggcattctgcaaagggcttgttaggatggacgttgtcagtccatagaaaattaagctattaaatctgcagcacccggatggtgattgaattgcttgtgccactggaataaagttgctttgcagacatatgaatttcacagctagtagtgtccttcccttcctgcatgctctaattgtatttttatattaatgcactgatttaggggctatgttggcatatttgtgctggtgctgggacaagagcattggctggacatttcctagagggtgcagtccacaaattttcccagaaaccgaattgattatgctgatgggataagcctgtcctctcccattttcaaccagtctgtgcgctgcctggtgttggcactcttacccatatctctctgaatacctttttactatttctgcactcccttcatctgcttctgggtgtttgacttgtgcaggctagcactagtgactttcttcagaggactgccttaggacagctggagacctgaggtacctgggagttccacgtcctccctggtgtttatgagagcccagctccctttccttaagttaagacgaactccaatatgtaacttacagcctgtagtttcccagtaggaccaaactaaagctatcctttgttgaatttcacttgaaaaagtactcttgcttgccttatttcccttctctgtcttgtttccccatgatttccttcccaattatccggggagcacttctttaataaattttacccacaaatcctcatctcagaccttgcttccaggaaaccagacttgagacatcattcctttttctgtgatccatgtagaatgttatagtcagacttctcagcctcgcgtggctgaccagatttctatgactgtttttctctcatggtacacacatttgattctgtccatggaaatcacaaggtttttttccagattcacaggggcttgtccataatggtgatttgagttttctgaaataacaaaacttactcaaacccaggatagctcctttttttttttttttttttttttttccgtttgcttttctcaagtgcaacatctctcctgtgctgtttctgaaactggcttgttcatctattagagcacaggccacatactatgtccaattatagaatttgtctctcaaactggactgtgaactctttgggggagtatctggtcatcagaatccctgacaagcaactcacatggtgtcttccactccacagctcctccgtagttggttgctgccttctactgatgaaaggactcaagtatacctaggtttgtgataacagtctttgtgactgcttcattttgattagcctcttctgtttcagtttattcagcccagctctgaaaacactgactgatttatctcttttaaatttaatacattttctatccccaatccagtgaatatcggaatatcaggataatcaagaacaaatggcaagttaggaagtgatgcatttggagacaaaacaacaagaaacagtcatgaacattctcttgcctccttttgttttttttcctaaggtctttattcacaaatgaaatgttattgttttttcagttctctctctcttgctctcactctgtgtcatcctcaaatatgttagaaatattaactgagaaacatgctttatctaagaaatgagtatcttttcaagaatgaatgctgacctgaatataatgtggaattaccctgggcaccaaagacagcttgcctgggcatgattgttccggaagctattactgaaatttggaacagcaccctcaatgtggtgtcaatgcctccttcagttctgaagttttgaaataaatactcgaaacatccagttatacaccctctttccaagagtgtttgcacatatttggtgctcctcaagtttttcaaattaatgttgatgaaataaaagagtgatcagatgaatctggcactatatttcttgcaaggacaagaagctatttttcagaatcttgccccaaatatataattgataacattggaaaataaataaggaaattttacttctgttgcatgttcctccaatcattagtagactgactttgaaatgagaattcaaagtataattaaataatggcattattctgggatgacttcataccattgttgtagactagcatatgattttactagttattattttctcagctagtctattaaatatagaaaaatttcagtaacagaaaatattgaaaaattttagaaacaggaaaatctaaccttttacctagtaaccatgtactttttttcattaggattcctcttaaatttgtatatgtgtgtatataatctgtatgtatagtaatatttgcatatgttacttttatatcagagagaaattaagggaaaaggttctggcaaactctaaaactatatttagtccatctttgaatcaattgtgtatttctttcatggcataatcctacctggtagattatttcctttattcccagaggtgaactagtcagtgatcatttgcatccagtgccctctcaagggtttatgcccaattagaaagcagtagcactataatgtagcatcagcacgtataacattcagtgctgagacggtggcttaacaattcatggggcttgataaaaagtataatttaaaaaaaattccactgcattaacccattcttctttaactctaagaccagactgagggaaaagtaaaacagaacaaaactgctttcaacctacagggcagtttaaattttaaatttatagtgaagctacaattaaggtgatttagtatagtccctattctcagttaacaacttccctttggaactagggtgggtaagtcttgaaatattcaataaagagcgatccatgtgactaagttgagtcgctgtgtctccgttgcagcagtgcaatgaagcctccatctggaatgaattcagcatctttaacaagtaagaacagggatgcaaagttgtctttgttttcttagtaggattaggctatgatttttgatatgacagacagttctttataggataccctgaaaatcctatttagtatttgtttatgcaaagaaatttcttgttcagtggagcaagagtcaagaaaatatagtaagacagaatggttaagtgctcagtacttccataattagagagatctagacttgcttgtatctagcgttatgaccataggcaaagctgtacaattcatacaatttctatgttttattttccacatctgtacagcgggactatactagagagttgatgtgagagtgaaaatttaaaaattatgtctaaagggcttattagcttagtacccaacaactagcaaatgtttcttaaaaatggtgcctgtgaacaataacagtaaagtcatagttgttgcattagccttttgcttttattatacatcattactatttaagcttttcacagttccgtttgcaatacacatataacttagtcctgtaagttcattccaagattgagagttaagatgtctttacaaatatgaaaaaaatgaagaggttagtttgcttaaattacttgctattcctaattttgatcaagtgttttcttaatattttgcattatttagtagctaatttttcccatcctaaaagtatgtttgtaaatactctcgtgtctctatatttttaagaaacagtgttctgtttttatattaagcttaatagtttaatttttttttgcagctgtgaggcagcagatgataaatcaaaaactaatattttcaactatctcaaaagataaaagtctgacacactaaatatggactaaatgaggcttatggatgatttattctaattagatataaggtaaataaatgctcctgcagttgtgaattttattaaagtcaggacatgtcgttgttcaggctttcctgcattgcgctttaaagaatcatttgaaaatattttgggtctgctgttgctgagacaatatggcttggcagtgtattggtaacttaataagctcaccacatttgtcatgcagaaactgttctttatatgcaaagctgtcagacagattgagtgtataattcttcttcgcatgaaataatatgataaaactccagtatcaaattgaatgctgtactagcgtttggaatctttcatgcataggttggaattgttttacaatggaagcattgtttgatgacaaatactctttttgtaacattcatcagttatgttttaatagcaggcattttcctcctgactataggtctgccttttttgctgttaacatactggaaaatgaagcctgcttctcagttatgtttgacattttttttttaatggttaactgctacaattagactgcactgtcagtgttgtagatgtttttgttcttcctacaaaagactatcctattggattttgccagttttatgatagagcaaacattatttactccttcctggttttgattcaatctccaatgataatgcgtactgatacaatattttaagtctcacttcatcacagaagagaattgcctggtatgtgcccatataatgcctgttggtgcaagcagtgagataataaattagcagaaattatgcatatagtccacgtggcacattctagaaggttaagcatttattttggtccgtggcagatatgctcaaagaactcccctgccatgtcaatttcaagggtctaaaagggaaagaaattgctacaaatacatacacagcaaatgtgcttaaagcagctctttgccaagcaagttcctgttacagagtggcctggtgccaaagctcttctaagcactctactgctacttaatgtatttggtatgtgggagaaactcgtaactctgggactgcccagtgtacggcgtctgtcacgtctgaagtgtgagcattccaaaggctcacagccacccagctcagaactcagcggggaagacaggaacaggggtcagcctgaatagaaagagactaaaagatacatttgtgaaatttgtgaagatatctttttctctcttccctccttcctttttcctcccttcctcttaattcctcacttcctgcctccctccctctttttcattttgttttttattctgttttgtttttgaggggtactctgttctaaatgtattcaaatgattataaaatattcatggcaattcttaggactgggcctggcgtaccttaatttttcaactgatcagcctttccggtttttcttaacaaaggaaaaccagatcttttgcatcccataacttcgtagcaaagcctccatctggaatgaattcggcatctttaacaaatatgtgttctctattcaaaaactatctaaaaatagttctcaaacaagtaagaaaaaatattttgacattttcttcatgttttgggtggtaagcacagtttgaaacaggctttctgttaattttcataggcttaggagtggatgtacttttgtgtgcatgtacaacatattttgctcaaggatgctttctgatccaaactataccatggcagttgtgtttttttgcaaggcacaattcttaacatgagtcagcttttccatcaaactcaattacaagtattcaaagtaaaatgctcaatcaagatctactgacacatgccaatattgattttgcttacgtaattttagatgaaaaaaaaaaccataatcaacctgtgagacggtgtttgtggcctcaaccccaaagatactgatggcaatgactttattgcggaacgaaaggattactttataggaaagctgggcccctgtaagaacagtatcacttcctataatttattaatcagctaccatgtcttaggcatcatgaaatgaaatatacatatgtgaatattcttatacagagatatatcttgtcatttaatcctaaaaagatattattagtcattctataatgaaaaaactgaagcttgcaaagttgagcaaattgtcaaaggtaaattggttaaacattccaacccaggcctgacactgcctgctttgccatcatgttttccttttggaaagacaaaaaagacaatatgttgatttttgggggtcaaattcatatttaaacaattacaaataaaattaagtcaaattccatgtaccttctcctatttcctagacttctaatactctttggtcttttaaagtatacagttttagcaaatctgaaacggttttttaaaatgctctaattataatttcattgtaacatgcttaaaattctaaaattaactctagagtatttatatacatataatatggttaattattcttaacccccacagcttatcccttttgttattttttaaagatgatttcactttaaagttggtgctcatttatggaaatatttgtaaactaatgaatacattgctatcactggagtaatttctagcacccaacataatgtccttgggatatttgatacaaaatgttaaaaaattatccctattgatcaaaattatttttctatatgttaccatataggtactaaaatagtacctatatggccctagtaatctgtaagatttaggaatatatggctggatgcagtggctcaagcctataatcccagcactttgggatccaggggtgggaggattgcttgaggccaggagttggcgactagcctagacaacataatgagaccccatctctacaaaaaattaaaaaattagctggtcatggtggcatgagccttttagttctagctacttgggtggctgaggctgaggcaagaggattgcttgagaccaggaggttgagggaactgtgggctatgatcatgctgctgcaacccaggctgggtgacagagtgagaacctgtgtctaattttaaaaaaagactcaggaataggaatacactagggaaggttatgttttagatgttctaatgtgatatgaagctgcacagaatcaaagactaatgtaataatacaaccatctgataaagcacaaataaaaaacaaccttacaatactacttgtctctacaaacactgtgtttccagtaaaacagttaggggacatgtttgataagcctgatctttctaaattacatttgtggtgcaaaatgatttctggtaattataatttaggaaaaagcaggtcacttggaaaacaactctgttgactaccttataaccttggctagaatggtataaatggaagggactcatctattttgacctctccatttttgagatgggaaaattgaggctcaacagtatcaagtgacagaaagcctcaagacctaaggccagttaaagatgtagggatctgggaacaaaatatgcatgccatgatctgtgctgtttcttctgtgttgtgattgggtctctttaagctttttttaaaaacgaagctccacatctattttgtctttgatttgcattcattttcatatgccagttataaagtatcaattctagcatcttaaatatcacaaatgaggcttagaatgtatttaatacttcatctatgagttatataaaagcaaataaaatgtgtcataatttacagattggtgtcaactgaagcacaaaaaaagagtaattggtttgccttcagcccaacaatatggtctttgtaaactacagaatagaatctctcctgtaaaggtttagaatagtagttctcaaagtgtggtccctggacaagaagttttagctccatctgggaacttgtaagaaatgcaaattctcagatttctgctcagacttactgaatcagaaacacagtgggtggagtccagcaatctgtatgtgaaaagctcttcagataattttgataaatgctaatgtgtgagttactggtctactggtctagattatgctgtctaggatttctcctctcctctcctcctcctctcctctcctctcctcctcctctcctctcctctcctctcttctcccttccttcctcatccttattccataaataatttgttattattattattatataaataatttattacttttgcatgagtaatgtctcttaagaaccaccgtatcagctattactccagacttctgatacggtttagaacaaattttgtcaccatgttatggttgagtggaacagcatcatcaattttgatatgattcttggcaggtgttttccttgctaatttcaaatgattgcttcacctgttagtctctgccactcttgctactaattgtcatctttgctagcagacctcactcagaggtcagccactgtaagccaggagactccaggatcctctaactcttgttggcctctcacccccacctgtggtatcccctgacagggctgtggaaaggatgagttagtagaggaagcctgacttctctagggcccatgccgtaattcttctggagataagtagggaagcctcattcttcaagctctaggccccaatcctgttttcaccgacactaaattcacttcattatccttgtctgcctgaagacagaccaagacaaatggcatttacaaatgaaaatcttgggggcgggagcattaaagtgtgcctaataagaaatcagttgttctctcagtgtttcgtgtgctggtctgagcaccaggaagtggctgcaggtcctcgcagatgtggaatttctgaactgaatttctgatattttgttgtccaaaaatagtcggacagtactatttgcagtcattaatcatgattattaagcaaaggatcaggagagctttacagctgttatttaactcctaatgacactgcagagtgattagatctcaggtagactttaacttttttttttttttaagaagaaagaatgatgtggtcagaacagtcatccctttttagtgaggggaatagcggtattaaataagcagttgcctcacaagtacaattcctggagttctggcaagaactgctatctaaaataatatgttattcacaagtctcagaagttatgttaccctttaatagagtaaaaaatttgaatgcattagtggaagatttcaaggataatagaaatgccttgaaaagagacgaactattgccttaaagtcacaagatggcacagagtatgttgtctgactatgcatcagtgtagggtgagcagcacattttgttgcctgcaggtaggaggaaaatgagagaagtagcatcctttgcacctaaggagatggctgccaagggaaaacgttgtgcaaaaacaccaagttggggccagacacaaacattgccttgcatttttgctgaggacaggtctctactgatagatatcttctattaaagcacaatcctagatcaaagtaatgtcaagcacatataggaagatattttgatagagtttgtctgtcttctcccaggactggctacataatttgtggagcctagttcaaaatgataatatgaggcttctggttaaaacaacaacaacaaaaataagtatttcagaggtggtagcaaagaattaaactaagaatggtgtccctctaagtgaagagctctgtgtaccagtttcatgcccatgaagctggccttgtcttcctttagcacatttactttttctgttttttatttggccaatggacaccgccattggggtgttatcttatgacagaatgcaattttgcaaagtctaattttaaaattgtgtattaaaagttttccctggacttaatgaaggactttgaataccctctctagttgccaaataaattgagtttaatgaatctcaaaatcatatgtgttcatcatattctttatagcgtcagttccaagtttgtactagagagatttgacaaaatgccacatcttttcttctgttcaaaagtcaaatatccttagaagagaggaataccttttgcctgaatctattatagcacaagcaaagctggttttactgtaaaatcccctaaaaccaattctactttttaggagatgtcaaatatcttggttttctctatgtgcttcgctttttcagtttgacaagataattagatcatagtatttcagtgacatagcagaaatggtagcaaataaagtacattttatattttctatccctccttcctattatatatatcatttttaaaaagtttaagttaaatccttttttaatagataaaatgctatctgtaatgctttttaaattaatttaaacttagtttaataatttttaatatatttgtctgttttattagttttcaacatgtgaaatatcattatcataagcgccataccactcttgcagtgattaaggagagccagccactagcaataatcctttttcttgttaaaggaaaattaatccatgtaaatatgaaaaatccctgtatttgtagaaataaaaatccatatataaaaattcatatatacataaaatgctgttatacgtatgcagatataaataaatgaaatcttaagtaatgaaactgacaagtggtaattgcatacaaaattatgaaatacagaagaatcaaaatgttttgtatattctctcatttaattattaacaactctgtgaagttggctttatcactactttgtcagaaaaagagattcagggaaatttcattatgttgcccattgtcactcactggaggatttgaacacttatttgtattaattctaaaatccgtggtctttccataccactctgccatctcaagcataatattttaaatcttataagtatttttattttatcatctatttgtatttctacttttttatattaagtaatataataaatattcaatttgaccagcaaggttattaaagctcaaggaggtaaagtgaattgtctgagcttgctcatttctctgggagcccatcagaggctggaacattgcactgatgacccccagctctgtggtcttgtccctagacctccacttggcttctcttcctcttactgctcttaactaacagcatgcatttgtctttagtggtttataatcctttataagaatttctgcctatttaacatatatgaaattattatttttcacctcccaccatctaaaataataattaccctcaaacaaggaagacaaactaaagtcattttttattctgaaaatgtagaactgaactcttcattttcagtatgatgccaaacactactaactggatttcatttaattggattaaaactgacgggacacatattctctcgaatgtgcaacctcacccctcttgcttgatcttcataaaacatcatgtatttagtcagattgcatccctggagatacagttggagtagctggtgactctagagaagtctgaaagtaagaatacgattcttgatgtgataaggagatatatttttgaagtaacaacatggaataaatcaagaatagtctgtgctgaattttgagttatttccagaagtggaggcttcaggtgtgaacagaaaatggaaacctggttttcttaccaattgatttactagatcatccgaggagatttgagacctagttctttctgctactcacagatgtatggaagagctgcccagtcataaaaccaattttgaggccaatttcaagtggacagataatggtaaatctttaattagtttgattatatttttagccagttgcctttctggatttggaatatgctaaaaattaatttacctgtgccttacccattgtgtctattattggcacctcccatttctatttgaataaggtattgaaagtttagaatcattgaaaaaagtatttttatagtatctttaagaatcacagtacaataaatagctaatttaaagcttggatcgtgaaaacacaatggataacatatagtataacgtagctatatgccgaggatattatcaagtgggtagggatttatttccatagttataaaaaatataattgccttgaaacttatgttttacttctacttcgatcaattatatagtcaggtaagtatatgttaaaacctatacgtagtggttgaattacacagtttttcacacattatacaaatagttcatttgtttgagaaagagttgaggaagatcctccagccccttctcactataaaattatatgattctaagtttataagatacaaaaaagccaaataaatggaaattaatggaaaaattgatttactggcttgtgtgagagtagagactgaaattctacttagatgcatgttatgtattatgtttaagctattttaaaagtagggctattaggaaagaattttagtgcaactggtttcttatatagttgctattcagtaggatacttttgaaatggtgaaaagtttgtatctgtatacataaaactcaattcagtaatatgtttgtatccatattgttgatctaatgtagtagtataaaaacaacctaaggaagagcttccatgcgtacacagaggttatgagttgtggtctgagcgaaatatcttttgggattggcttataacaagtgagtatttgcataaataatgccgtttggggagttttttaaaagaaatttcttaagatatagccagttacctaagaaaatattgtgttttctatttatctagttgtaccgacactgataatgttgagaaatctacattaattgacaaagaagaacaatgcaatttgacatattaactactttagtctgagtgaattatttttggatctttcaaaataaacttgctacttgaaaaaaaaatttacatatctgtctaattaatagactatagtttcccttaaatagacggctaatattttacccttatttatgaacagtttttattttgtatgtagtatcaaatcacagaaaaaaaaatgttcctaacttcaaaaatggaagacaacatgcctctcaattggaatacgacttaggtcttggctggaatgttggtgaactgaaggcactgaggaaaaccagttcaacctcattgtccactagaaaacagttcctttacagaatgaagaattaaatatggtggcataaatttaactttcctgctgcttttgatcctaaggtcacaactagtaagtagcagagacagaatttgaactaagaccgttctctgcattccctattttgctatgctatgtagcagattgggctgcacactggtagtttgcctccattatccttgcccttcactacaataatggactgcaaacataaataacagtgttttcattttacagatacagaaatggggagtgagtacagtacaagtacttgcctaagggcatacaataatgggtggtgaagctgccatttggacttagatctctttcctaagtctctattattgcctatattgaccccagacagaagaaattacatttttctcccttttctcctccctccctcctttccttctttccttccttccttacgtctgtccttcctttcattaaagcaaagaaactaagctccctcatatttgtaaggaaagccttttcatatcacttttattcatccattatttgtaaaggcatgttgtcgaccaggtgctgtgctaggcatcatggagtgctaaacagttgtgaacactgtcacagtaccatgtggtctgtagaattttatcacacaatagcaatggcttacttcctgaaaagtagaacagacactccaaaaaacgtagtatttctcttaacaaaacaagggcaaattgaaattgtccttggttctgcttcagttcagcagttttgaatcttcttttgggaactgctggtagagagcaagttcccaatcatggctactatttttagcttcataagactcttgtgtctataaatgatattcccttttttgaggataatgtcttaaatgcagtccaaaatcaattagctattatgtgcaaccaggctacccttagaaaggtgactatccttttttgtatatatttaccagtatttgccacccagaccacaaggcaagggattgaggtagtcactggtatttttctgggagtagcttaagcttataattttcatgtacatatttccctttctctctttccaaaaaggattatttaaatttttcaacatttaagcatagaggaaataaataaaataggttatcttgtcattttctccataaggaacttcttcagaaaagacagtgtgtagacagtcccagtggctgtcccctttaactcaagcccaggacctacagatttctctgtagctcaacaaaatgtctttccacaaagggctggaggattcttaattatcagttgttgaatttcagtcatcctgataacaccatttagccaactgtgatggcagcgatatttgtcttgttaaagaccctgaagttaaattactgctgtactattttccttcaagcctgacttgttagttatggtggaagtgagctattgactggggtcctcccattcatctatacttcctttattattttaaatgatctctagagctaaggggcagcaatttgcattatttattcaatgaattctacctgatagtcttgtctataatttcccttgtgaagagaacagaaagactaagaatgaataaattgtctcttgaaaactcatggctttatctgcttctgtcacagaaatgctatagatttcagttttcttgactgagaaatatttaataacaagaagctctacattctagcagtttaaaaggaggaggatttttttttcccccactctttgtctctcactgtttcttcctctcagctatactttacctaaaaccttaattttttcccccattgcttttatggggattcctctgaaagacataaaatgcctctctccatgagaagccctgtcataggagacagctctttccatctgtatattttacttgccttgcatgtaattttctcatccaaatggaaagctcaccatgctctaatgaaacttactagagactcccagaaaattcatgtaaccaggtttatgtgtgggtctgatgttttaagggacagactgacaattcatggccagaggaggccattaaggaaacaggtttgattgaagtcccgacacagatgttgacagcataattaaaatgattaattggagtaagagaagtgtttcaaactaattagaaaaatggtttggttatacccccagactgtacaaatggccagaggagccaatttttttatatagagaagggaaaagtgaagatgtatgttaaaacaatgtcattcttcttttatcaagaggatactgcaaagtttaaaactatgattattgttatgttggttttcctgtgagtctttaggtctattatcccagccccttttgccaggtggctgactgggcataggcgtgcagccacgttcaagaaacaaagggaatacttgcatagaactggagttggcccatattgacataagacagttctcaatcacaataactatttacttgcatattgcttctccagagagaatacaagtaccccaaattaccatcagatggcttagcacatagtagggcctcaatattttgtgtgtttgctgaggcaaccaaagccatatttttaagtatgcctaaataataggactgagaaatttttcttccagttatgctttcattttcttgattatttctgttttattgtgaatcctagtaaaggcaattcattctttttttttttttttttttttttttgagatggagtcttgctttgtcgcccaggctggaatgtagtggcgcgatctcagctcactgcaacctccgcctcccgggttcaagtgattctcctgcctcagcctctcgagtagctgggattacaggtgccgaccaccatgcccagctaatttttgtatttttagtagagatggggtttcaacaggttgaccggactggtctcgaactcctgacctcaggtgatccactcaccttggcctgggattacaggcgtgagccaccgcgcctggccagcaattcattcttatatcttcagaaaacctgaactatcatggaccaatcggttttagagattattaatgagcattagcaggggcatgtttcagaactctttgcagacacaatttagttaaaacatttcttagtttctataaaagcaaatgtatgctattgtggtgttgaagctctttgtacacaaagtaaacattacgtgaaagaactcctttggcctgcaaacataacatttaaatggctattgaccatatgtttctaactaaaagcactatgaaaaacaagttcttgccagatttcaggtttttttctagttgtgctctgtgaagcctggtggtaggttttcagttaatgcctttggctacatgaacaaggagtttcaccaagaatgttgggaattcctttggtgaccaaaaggaaatatgaagactctggaggctgatgagagagacaaataatggggaagtcataaacatcatgccaattcctgtcatttatttcattttctttttaaaataagatctgaaattgtttaaaagaatttttgaaaagcatcaagttaactttctagcacttttaagtttcatgtaaatcagtattcttcaagtgccacataaatatgtgtaggtaagtgtgctatttctaggtctataatatttaaagatatttaataaataggtttcattcgttgcatgcaggatgctgactaaaattgatagaggaaaggtctaggggtttgtttattttaatttaatacaatgaaatacacttgtaatcctattaaattatagtctattttgtatattcttgataattgaagttattatctatgggtgtgtgcattcgcgatggggggaaaatggtctattgggaagaatggcattttgacaaatcacaggaaatagtcaattatgtggattccacgcagtttccaaggttatgacaaagattttacccctgaaattcatgaaccatagtctggagggagtttggatggaattacaattcaagtggtttgttttgggaggagtatagggtggggacagaattaaatgttcagtttatttctccccacaaaactcgccgtggcagcacccttaagagggagagaatgcaaacttgttttctttaacacaaaatttctagcagtatgaaatactgaaacattccggatgataagggccttaaagcttaggtttatgatcataacaataacctattcacattaatatactcaataaagttggctatatacatgaagtgctaatgaagtaaacaacaaatgagttttccaggatgctgcatacttgaaatttactgagtgtagggtctctttatcaataaagttggaaatttatttttttccatcgttttcctcttgtttcaagtctcttcactgccttgtcatttaagtaaatgacaagtaaacaacacatgagttttccgggatgctgcatacttgaaatttactaagtgtagggtctctttatcaataaagttggaaatttatttttttcctcagtattcttgttttcgtcttgtttcaagtctcctgactgcattgtcatttaagctgttaaggctgaaaataattccccaaaggggacattgaactaaaatatttcaggcaaatttatctctaaaacttttaatctagtcaggaaatattaataatcgatgcaggtggggttgtgcataaaagaaatgctataaaatgctacattgttcatcgagcatatagtcagacaaaacactgcatttactgtctccagaaaatgaaagttaatttatgtatttcatcaacagactttattatagtgccacatatttgtggtagacttaaggccgtgagaaattttcactcttgacttctctctgttaaaaaaaaaaaaaaaatcaaatcaaaacactctttatgtttaaaaatggttacaatacagtaataaaaatgtggcttactctttgcttttcactaataagttgagtagcaattggcaaaaaccaaaaatcgtaaactccctgagctccaatttcctccttaattaaatgaggtcacagagaccaggatccactttaagtagcaaattgaggctcaattccgaaattagaatgtgcagctcccattcaataatccatctttaataaaaatgtagattaacattgtgtcccatcctccagcccaagtctgcagtagaagggacttgagagtaagatgcttggtgcttctttttctttcctctcttgcagttcacctcattcttcaactgctggttctcatttctaaccctgctagtgtcaaagtgagagggtaggggaggacaggtgaggaaggtagggaagttcgtacttgactttcttgagatggctttgtatattcttaccaggtctctctctttcttgagatctttcttaggctcctttgaggcctttactgtggatgtttgaaagcacatctgtgacattgatgatagatttttctccagctctctgctccctttgcaccccgtggagatctactcctaaaattctctctgcaggaatctcattagcctccagtggttttcctggacaggagacaaaaaagctacagtcgtactctctctattcctctgtaacccacatcttgtccagggacattgatccctggctccaacaaagtctgagaatgcaggtcaatcccaatacagctgcacctttctactttgtgcccaaagcagttcatcagttgcttactttgtcctctatgtttcctgtatagggaccaatcacagttcactttgccgtattaactcagagcaacatattaagctcttgaggggtccctctgaagctcctctgtcttaacttgagaagcaagcacagaataactttctccaaacagatctttaacacaagtccttcttcctggtttcattggtttgcactaatttttaatcctcaatgtagattttaggccatttagctctctgtcaccctactctgacattttgcaaatggtattgtatcgtgtgtctaacaactcagctgtctgctgtctgttttatcttggtgcctcagttaaagaatccaatgtaacatgctgttgcaaatgagttaaattccgatagccttcagaactaattttttgtttctctttgtgaatccatcccatgaatctcgatttattcataaaaatatagttgttcaggccgggtgaggtgactcacgcttgtaatcccagcattttgggaggccaaggtgggcagatcacctgaggttgggagttcgagaccagcctgaccaaaatggagaaaaccccatctctactaaaaatacaaaattagctgggcatggtggcacatgcctgtaatcccagctactcgggcggctgaggcaagagaattgcttgaacctgggaggcggaggttgcagtgaaccgaggtctcaccattgcactccagcctgggcaacaagagtaaaaactccatctgaaaaaaaaaaaaaaaatctagttgttcattttgaacatttttgaaagttagggattttttaaaaaactgtcattataaaattatggctaagaattaagggatgactgttcctgctagttagcatggttcataattggttgttttttgtttgtttgcaaattgaatgatcaattgagttaggtttggttctttcattttagagattgccaatatatgtaaaatttgtctagacagggattgatgtccacagaacagaaaatcatataggtaattatataaagtaaactaatttcagttagtttacttcatgtaaaataagtgaaaacaattcaatcttaaaaggtcttcatgtgacgaaattgccctaagcatctcatgtatgtataaggcactatagtagacagtacaggggccacagagatggagagaactaagctccctctctcctgggacaaagcttatgctctgctctgaaagtgtctgtcttgagtgagccttaatcagcatcgcgaatatggagtatcttagtttcttttgaatggtaatcgattgtttaggggaatagttttaaatttactaaataatgtgtttttcttttaatgttaaggaatataaaaaaggacccccaaaatgtttcataatctactgcacagataagccttttgccataaaaggtaaaagaaaaacaaagtaaaaacaaaaaactataatgtgcatggtaaaaaaaaaaaattaatactatggaaagctataaaaggaaaagtggacatcttctgtgccattttctccttccaaatctaccattaacaattctgcctgcttttctagaaaatattatgtgtatatatatatatttgcacatatataaagttattatagatatgcctataccaacttgcttacttgatttcttccctcctttcctcagttgttcattttgctttttctcttaaagcactacctcattctttttaatagcaacgttgtatttgctgtagttaattagtccactcttatggaggctttcattggtaatacaaataatgacgtgatgaacattttcctgcaaatttccttatgaacctctaggatcgtcttcttaggattaatttctctaagagttgctgtattacatcaaagaaatcctgagttttctgttattgtaatagaaattgctaaactgcccataagaaattatccatgcatttacacttcacccagtacagttttctgtgtttcctcataattgctctaacattacaatcactgtatttacaaatgtttgccaatctgaactgtgaaaaacacaatctcttaattttactatatatctacttcattacaaaggaggataaaatatttgtatgtttctcctggaagcctacccttccttacagatttttcactttgtattgtcttttactgacttttttgagttttttttagattaaggaaaatacatatgtatttgataaggcattgcatagattttccccaattagttttctgcattttgattttgcttatgatatttttgccatatagaagtttaaaatatatgtataataatatctcatatgtttttcttttgtgctttctaggttttgatgtctacttaaacacctttcccaccaaagcttatgaataaatgcaaccattctttcttctagattttttttgtatttatttttatattttagtgtaagcgatggaatacacatgtacgtgctcatacattgcatacacacacacacgtacctgtgtataatttcagtccaatcaactggacctagagtcccaacactaattattgtaattattgaataacttctccgtgtataccgatttgaaatttggttgcgtcattatggatttaattctcatatgttttggttatatttctgaattcttctattttttacatttgctatagatctatctcttctccaaaaaagagtattaaaaattatgatttcataattatttttaagactattctcccttcttgattcttaattttcaaaaattttctgcaactgcgtctttttttgagacaaatattttgttcgtttttgcaaacatacactaatttatggataattcatttgggcctacattttacttataagttaattttgaacaattttggcttctttatacattcaggtcccccttttatagtgcatgatatatctatttattcactaaaatattttatggtatgtggttgaattttaaatttcttcacttaagtgatataaatttatgttagatttatacccagtattttatatttatttttaactgatacatgatacatatttataaggtacatgtgatattttgttacatgcagtagagtgtataaagatcaaatcaaggtatttgaggtatccatcactttgggtatttatcattgctatgtgttgggaacaattcaagttttctagctaggttgaaatatacaatacattgttgttaaacatagtcactctattctgctgttggataatcactcttatgccttttgtctaactgtatgtttgtacccatcaacctacctctctttatccctcttgcacccataaacacttcccaccctgtagtttctatcattctactctcactctttatgagatcaacttttttagctcccacatgtgactgagaatatgcaatatttgtctttctctgccaggcctattttacttaacatagtgacctccagttccatccatgtcactgtaaatgacatacattcattctttttttttttatggctgtacagtatttcattgtgtatatagtattttatgtttttgcttgctattgaaaattggttcatgccttcattatacttaatacgtttaaatggcaattttatatattgctttcttatagaataatcttagtgttcctaatatatttttaatttgatattcttgggttttgttaggtgtaatcacatcacctaagattggtgataaatatgtctgattctggcttcccatttctgcaactctttttctttctcttatctgattgcattatctagtacctccagagcagtatcaaattatggcacatttttattatgttcttcattataatgagaacaattcttatttccccattaaatgtgatggtggcatttgactttgtgtgtattggtacaaataaaccagatatttttattatcaggagttttttattattaatattagacgagctctgtgtgccattttgcgttaaaggagtatagatttatagaaacatttatttcttaaatagctataagctactttctttgcttgattgaagctgggcatttttgctgttcttttgcttataattaggtctgtaggaaggaagattttgtaatcatgcttcattttgccatctgaaaggaaaagtctggtgggaatattttaattattcatcatggaatctctgtatagcaaatcaaatagagttatgtattttttacttgatgattttgctaatgtggttctaatactcacaacttaagcaaccaaaaacaaccaataatattttaaaacaacataattaattattgcttgaaagtttctaccaaggggcatatggacttctatgagatccaattataaaccaggaaaaagagagatcaacacttgtattttaacacatatgcagtttcttattagcaaaatttcactgataaacatatgctaagttattatagatgtgagccaaaagttctttagaagtaggtatattctgcatttgaactctacagcatttgaaatcacattggctgacacgaattagtattagatctggaaactttgccagtaattcttctagtctccaggaaaagtgaaagcctttcattttggttttctttttggtttgttggttttgctttcatttctgatttttgtttggtggtaggtgcttttatgaaatacttttttaaattacccttactatttattgattaattgttggtaattattaattatctacctttcttagtgtttttcttcaaactctgcaattaggaatacccacatattggaacatttgctactctatctcattccacatgtgtgtgtatggtgtatatatgtgtttacatatttgtgtatattaatttccacaagtattttatgcccataaatattcatgccataatagacttttgttcatttatgatgcaaaaattaactctgaagcaaactgtattcttgcttctcatggtcacatactttctctctctgtctctaagctttgttaacctagtggtaaattctgtggtacccatttgcatgcatacatacgtgtgtgtgtgtgtttatgtgtgtatagatatagacatagatatagatattcttgactatttgtatccatggtgcacgtgtgcacgtgcgcacacacacagacacacacacacacaagtatgtatacatggaatagcaagtctctaggggctttgctgaagttaaaccaagaatttcaatatatgatactactactaaacagtatcaggccctgcgaacatgacacattcattgccaacatcaggacacctaatagagtggatactgaccaagggggtgtattcttgcccagatgatacttatttaggcaatgccagtgttggctaatttcacttttccttcatggcctctgtctctctgttacttatgtagcactcattctgtgtcagactgtgttctaagaacttcaactatattaaccttacttaactgttaaaaagacttctgagatagataccatttatccatttcattttcaggtgggaaattgaggcataaggcatttgggcaatgtgttcaatgacaattaaacagctagaaagtgcctggttagctaggatgtaagccaggcattttggttcctgagcccacactcttatacactgtaatactatctcattcatcctgctgtaattattcatttaattacatgagctcctgccagactgcatgttctatgaataaggggccatgtcaatcttgcctgtctttctatcttgtgtcatcataatgcctggtaggtaatagggaatacataactggttttcacttttaattgaattaaagtaaaagtttgtctctataagatcccttttcatatatcttcctgataaaaaacctgtttaataagctgaaaagatgaggtttcattaagaagaggtgatacagaaaaacaacaccatatttttctaacttatgcctcatctggcttactgcttagttcccatttgtcatcagtgcacttaaaaaattattttgaaaaattgccatttttaatatctttggaacttcctaacacattacctattttttaaccaaacgaggtgattccttatgggaaaatatatacagcaagaaaaaaaaaaggaaaaaatgttgatgatacctgtttaattgggaaatatgtttgcatatttattatatctcggaaagaaatgtatgacttattataacagcatttagtcttccaaaatatcagtgactccacagtatatgccttcatttccaaaatgaggggaaaagcattgagtgtatagtacttcctttttttcccccacaaagaaaaaatcatagtggaaattacattgaagaataatctgcacaaaacaaaaaagcacaaatcttatgtttctggttcagtgacttttgataaaggtaacccataattactaacccaatcaagatacagaaccattctgtacctctggaaagttcccatagtctccctcccagtgaatcttccctagtcaccccttggtaaccattgataggatatctatcgcaataacttaattctgcccattcaagaacctcattttaaaccttacaaaaccagaagttattgaaagagatgtgattgtaaccatctttgtttttgtaaggaccacgagttaactacacgtagatatatcatccagagaaaagtcctgataaaagtataatcagtgcaagttgaattcacaggtaaggtttactgtagacgtggaagggtgtttcaaaattactcttgagaaacaggtctcaggctaacagtttctctcacctctgttgcattgtctctttcttttgaataactactgtgtgctgtggtttcacaaacctctcagtaaagtagtgatgggaaaatacttttgttctatgttttgttgacctagtggtaaattctgttacccagctgtcaagcaattagattataataatgaatattttcttaaggcaatttattgggccaaagaaccctgtgaataaatagtagtatcttttattttcagagagcctagttaacatccctccacttgctaaaactagccagaatgtgatattagtgactttcattctattaaataagcattcatgattatcctaaacattcttgccaaatgtgcatatgaaaatagcatagccactgtaattgttaagtcagtcaatttttctcaaggactgtgttgctttaaaaagttagtagtgtttacacattcatgtgattggtctgaagtttacatgctaaataatatttactgtgaaagatgtgtgtgtttgtcagtggatgtgtgcatatattcagatacctaatatgaccaatgtgacaagggaccccatttttttctgccataaattaagggttaatgatagcatttattgcattgagctgctgagaggaccaaatgagataatgcattcagaaatgttgagtgttatttggtttggaaattgataaaaagggcaggtcttacatcgagtgcagctttacaacatattatccatgcatgattacatataaacaaaaatgtttagtttagaaagggaaaaatagtgggtacaatcacagttttattttatttttatatatatattttttattatcctttaagttctagggtacatgtgcacaacgtgcaggtttgttacatatgtatacatgtgacatgttggtgtgctgcacccattaactcgtcatttacattaggtatatctcctaatgctatccctcccccagcccccaaccccacaacaggccccggtgtgtgatgttccccttccggtgttcaagtgttctcattgttcaattcccacctatgagtgagaacacgcggtgtttggttttttgtccttgtgatagtttgctgagaatgatgatttccagcttcatccatgtccctacaaaggacatgaactcatccttttttatagcagcaaagtattccatggtgtatatgtgccacattttcttaatccagtctatcattggtggacatttgggttggttccaagtcttggcgattgtgagtagtgccgcaataaacatacatgtgcatgtgtttttatagcagcatgatttatattcctttgggtatatacccagtaatgggatggctgggtcaaatggtatttctagttctagatccctgaggaattgccacactgacttccacaatggttgaactagtttacagtcccaccaacagtgtaaaagtgttcccatttctccacatcctttccagtacctgttgtttcctgactttttaatgatcaccattctaattgatgtgagatgatatctcattgtggttttgatttgcatttctctgatggccagtgatgatgagcattttttcatgtgtctgttggctgcataaatgtcttcttttgagaagtgtctgttcatatccttcacccactttttgatggggttgtttgttttttttcttgtaaatttgtttgagttatttgtggattctggatattaaccctttgtcagatgagtagattacaaaaattttctcctattctctaggttgcctgttcactctgatggtagtttcttttgctgtgcagaagctctttacgtagatcccatttgtgaattttggcttttgttgctattgcttttggtgttttagacgtgaagtccttgcccctgcctacgtcctgaatggtattgcctaggttttcctctagagattttatggttttaggtctaagatttaagtctttaatccatcttgaattaatttttgtataagatgtaaggaagggatccagtttcatctttctacttatggctagccagttttcccagcaccatttgttaaataggaaatcctttacccatttcttgattttgtcaggtttgttaaagatcagatagttgtagatgtgtggtattatttctaagggctctgttctgttccattggtctgtatctctgttttggtaccagtaccatgctgttttggttactgtaacctcgtagtatagtttgaagtgaggtagtgtgatgcctccagctttgttcttttggcttaggattgacttggcaatgcaggctctttgttggttccatatgaactttaaagtagttttttccaattctgtgaagaaagtcattggtagcttgatggggatggcattgaatctataaattaccttgggcagtatggccattttcatgatattgattcttcctatccatgaacatggaatgttcttccatttttttgtgtcctcttttatttggttgagcagtggtttgtagttctccttgaagaggtccttcacatcccttgtaagttggaatcctaggtattttattctctttgaagcaattgtgaatgggagttcactcatgatttggttctctgtttgtctgctattggtgtgtaagaatgcttgtgatttttgcacattgattttgtatcctgagactttgctgaagttgcttatcagcttaaggagattttgggctgagatgatggggttttctagatatacaatcatgtcatctgcaaagagggacaatttgacttcctcttttcctaattgaatgccctttctttctttctcctgcctaattgccctggccagaacttccaacactatgttgaataggagtggagagagagggcatccctgtcttgtgccagttttcaaagggaatgcttccagtttttgcccattcagtatgatattggctgcgggtttgtcataaatagctcttattattttgagatacatcccatcaatacctaatttattgagaggttttagcatgaagggctgttgaattttgtcaaaggccttttctgcatctgctgagacaatcatgtggtttttgtcattggttctgtttatatgctggattacgtttattgattttcgtatgttgaaccagccttgcatcccagggatgaagcccacttgatcatggtggataagtttttgatgtgttgctggattcggtttgccagtattttattgaggatttttgcatcaatgttcatcaggggtattggtctaaaattctctttttttgttgtgtcgctgccaggctttggtatcaggatgatgctggcctcataaagtgagttagggaggattccctctttttctactgattggaatagtttcagaaggaatggttccagctccttcttgtacctctggtagaattcatctgtgaatccatctggtcctggactttttttgcttggtaagctactaattattgcctcaatttcagagcctgttattggtctattcagagattcaacttcttcctggtttagtcttgggagggtgtatgtgtccaggaatttatccatttcttctagattttctagtttatttgcgtagaggtgtttatagtattctctgatggtagtttgtatttctatgggatcagtggtgatatcccctctatcattttttcttgcatctatttgattcttctctcttttcttctttattagtcttgctagcagtctgtcaattttgttgatcttttcaaaaaaccagctcctggattcattgatttttggaagggttttttttgtctctgtttccttcagttctgctctgatcttagttattccttgccttctgcaagcttctgaatgtgtttgctcttgtttctctagttcttttcattgtgatgttagggtgtcaattttagatcttttctgctttctcttgtgggcatttagtgctataaatttccctctacacactgctttaaatgtgtcccagagattctggtacattgtgtctttgttctcgttggtttcaaagaatatctttatttctgccttcatttcgttatgtacccagtagtcattcaggagcaggttgttcagtttccatgtagttgagtggttttgagtgagtttcttaatcctgagttctaatttgattgcactgtggtctgagagacagtttgttgtgctttctgttcttttacatttgctgaggaatgctttacttccaactatgtggtcaattttgcaatagctgtggtgtcgtgctgagaagaatgtatattctgttgatttggggtgaagagttctgtagatgtctattaggtctgcttggtgcagagctgagttcaattcctggatatccttgttaattttctgtctcattgatctgtctaatgttgacagtggagtgttaaagtctgccattattattgtgtgggagtctaagtctctttgttggtctctaaggacttgctttatgaatctgggtgctcctgtattaggtgtatatatatttaggatagttagctcttcttgttgaattgatccctttaccattatgtaatggccttctttgtctcttttgatctttgtttgtttaaagtgtgtttcatcagagactaggattgcaacccctgcctttttttggtttccatttgcttagtggatcttcccccatccctttattttgagcctatgtgtgtctctgcatgtgagatgggtttcctgaatacagcacactgatgggtcttgactctttatccaggttgacagtctgtgtcttttaattggagcacttagcccatttccatttaaggttaatattgttatgtgtgaatttgatcctgtcattatgatgttagctggttattttgctcgttacttgaagcagtttcttcctagcatcaatagtctttacaatttagcatgtttttgcagtggctggtgcgctttgttcctttccatgtttagtgcttccttcaggagctcttgtagggcaggcctggtggtgacaaaatctctcagcatttgcttgtctgtaaaggattttatttctccttcacttatgaagcttagtttggctggatatgaaattctgggttgaaaattcttttatttaagaatgttgaatattgacccccactctcttctggcttgtagagtttctgctgagagatccattgttagtctgatgggcttcactttttgggtaacccaacctttctctctgtctgcccttaacattttttccttcatttcaactttggcgaatctgacaattatgtgtcttggagttggtcttcttgaggagtatctttgtggcattctctgtatctcctgaatttgaatgttggcctgccttgctaggttggggaagttctcctggataatatcttgcagagtgttttccaacttggttccattctccccgtcactttcaggtacaccaatcagatgtagatttggtcttttcacatagtcccatatttcttggaggctttgcttatttctttttattcttttttctctaaacttctcttctctcttcatttcattcatttgatcttccatcactgataccctttcttccagttgattgaatcggctactgaagcttgtgcattcatcacttagttctcgtgccatggttttcagctccatcaggtcctttaaggacttctctgcattggttattctagttagccattagtcgaatcttttttcaaggtttttaacttctttgcaatgggtttgaacttccttctttagctcagagaagtttgattgtctgaagccttcttctctcaacttgtcaaagtcattctccgtccagctttgttccattgctggtgaggagctgcattcctttggaggaggagaggcgctctgatttttagaattttcagtttttctgttctgttttttccccatctttgtggttttatctacctttggtctttgatgatggtgacgtacacatggggttttggtgtggatgtcctttctgtttgttagttttccttttaacagtcaggaccctcagctgcaggtctgttggagtttcctggaggtccactccagaccctgtttgcctgggtatcagcagtggaagctgcagaacagcgaatattgctgaacagcaaatgttgctgtctgatcatttctctggaggttttgtctcagaggagtacccggccttgtgaggtgtcagtctgcccctactgggggctgcctcccagataggctgctcgggggtcaggaacccacttgaggaggcagtctgcccattgtcagatctcacactccgtgctgggagaactactactctcttcaaagctcagttggaaatgtggaaatcacccatcttctgcgtcactcacactgggagctgtagactggagctgatcctattctaccatcttggatggagtacccacaattttaacctaaatgatttcttccaaaattccatagtttactttttagattgagccatatatggtgtactgcacaagtggattaagatattttaaggtatttttaggagtaattttgactatacttgagctaattaacgctgacgtcgaatctattccctggcaaaagtaaactccattgtattcctgttctttagtccttttggtagaaacccatttgggatattattccaacatatattatctatctatctatgatcttgctttgtacaaatacataaatagatgattcccttgcttttgatattttgggttgagtagaaattttgcccctctcatctgtccataaggttggcctcatctgtgtgcaagtctgaccattatatctgacaatggcttgagtgtctgcttttttagttttgtgctcacctcaaggcctttttagttgaacttggcctctctccatgctttggcctaaatctgagggttgccttattacaatccttcaggagacttagtgtgttattcagaaagttggatacaatgtgtttattttacgatgcatttgggcagaaatatgcctgggaagaattgaaactagattgttccttatttttgtttgtctactttgtgactcagtgcctttactacaaataatcatgacgagatcagcaagatctggttactatctaatatgatacctacagagactctctaatccaaggctttatgaaacatcaaaatgtgaaaaggatgatgaaggcttcactaagtagtgaaaatatttatacattaccacaaagtcaattgacactcaaattaaaacaactatttgccgggcgtggtggctcacattgtaatcccagtacttgggaaggccaaagcgggtggatcacctgagatcaggagtttgagaccagcctggccgatatggcgaaaccccatctgtactaaaaacataaaaaattagccgagtgttgtggcatgcacttgtagtcccagctactcaggtggctgaggcatgagaattacttgaacccaggaggcggaggttgtggtgagctgaaattgcgccactgccctctagcatgggtgccagagtgagactctgtctcaaaaacaattaaaaaaaaaaaaaaaacctgttttttagcaacagttaaaaacagcaaatattttaaaaaattgataaaaatttttttttgctatcaaataggatagaaatttaaaacatattatttaatgtggcaaagatgagcagaaacagttactttcatatactattaagtataacttagaaaaacttttgtgttaccacttgggaatattcatcagatttttaaattcatgtttcttagggccaatatttctacttctaggaagtggaatgatataggtacaggaatgtttattgcaggcatattggaaccattacatgtccaaagtgagggggaggggcgattaaatatagaacagatgcgtatatggcattaaaaattctcaaatatatcattaatcgaaaacaattctgcaaaacaatgcatatagagtgatatgttatataaaaattgatttgtgagtatatatttataaacatttacaattgcataaaaacattagcagagaataagggggattcagggaagggtgataaaggggagaagaacaaacatcaacagaggacctaattgtggcagaccgtgactatattttataacttagcagagcttccaggggttttatcataaacacagtatgtcttatctaggtattcttatgcttccacagcaaagtatgaataagtatttaagaagacaacctaaatatattaattgaagcttgctggctaaagttggcttcttttctgaggaatatatatgaaggtaactagcagcaaaacatcatagatagtatcagtcttgggccttcttcacatactttacattttcccatctataaaaagatgctttggaaacagccatgagagtccttcggagtagcccaatctcggcagccttattagatgcatagatgtgtgtctcctggtgagagtctcatgctgtgaaagtcattagaataataaattaaacttctttgtacacaggctttttaagcttcaggtgcatatccttttatgccttttccattttcttatagcttgaagtattgagatttttattgtcgaccaattgcttcctccacagttttgccagcataatgagttcgtggagtcactgatgcctaaaataatttgtggagtttggtttgaaatagctccacgtagtcctcctttttcccagttcctaagagctaactaaaaagataagacctagttaatgaaaataaacttctcaagggtcaaaatggaatatcgtataaaattatttttgatattttatattaggatgtgactacaggttccactaatgttaatatcaagattattcaatagtacctatttatatgtgtggaaattattgcataaaatttcaattttcacatagattttggaagaggccttggctgcaccaaatggaaattttataaatggaataatatttgtgggaaagccttcagaaagcaataacataaatttaacattaagctgtgccttttaaaagtaatatcaaagcaaattaggagatatatatatatattctttaaaaaattttttagatattgccattcaatttaagaaattcagtggaaaaaaacatttttccatcattcataatgttagcatggattattttctctcttcgtatcaaagaagtaaaggaaaacaatacaacattacttcttacaatggtgattgacatctggatcttctaggctaaaatttgaaaaaaaaatattatttcaaactacaatgaacatgaaacaaaaagacagtattctttgcgttaagtctctttgtattcgttccctccggcccatactctaagaaaagatcacctttgctctcttaggtatctctgttagtccttaatttctcctatggatgcaatgtccattgccctggccgccttcaaatcattctccttcacttctgccgttaggtacatgcaaatgtctactgtatttcctctgttactgaatggaaaaagaaatcaccttaatttagcttccaatttttctagttccctaaattttattttgaaacttcttgaaccttacattttcattgactttcttccagtttttgaacactgcctccttaacatttgtgagctgtggcaggttctcaccagtttactgtactgagtactctctgggaacctcatatttgaattaagtgattttactcatttgctcttattattttgactgaaggaaaaaagtcacatagtataattttagcagagaggatgtgaagtaagagttgaaccaactttaagctttaaaaatattccacactgttgtatgcatataaatttgagacagataaagaaatccttctttgtaaaaatgtaactaaagtcaggtttatttttttcatataaagtgcctaaaataatttgtgaaatttgaattgcaaataggatatatcataatttaaaaatatgattactttgttaagtgatagttgtattatcagtgccatgcagacattacccaaacacatagatctagattgatcaatttgagaactataacatgaacttagaatcctaaggaacaatgcctccaaatatgtgtttctgaatcctttttttgtttgtttgttttttaaacagggtcttgctttgttgtctagactagagcacagtggtgtatcaaagttaactgcagcttcaaattattgggctcagtctttccacctcagctcctgagtagctggtactacagctatgagccaccaggctgagctaatttttaatttttttttttgtaaagacatggtctcaccatgttgccaagctgatctgggatcaagcgatctgcccgtctctgcctctcaaagtactggtattataggcatgagccaccacacctggcgatatccaactgttttaagaactagagggaatgcggtatctctggggccaagagttccctgtacagcccgaatagcaaatcaactactttaacacaaataaaattagattaatcttcctgcatcattttattcctctttctatagcggggctgtgtcactttttgatgacttttttgccatttttaaaaaatctatagcttgacatgaaaataaaagtcagtctctaatagaaaagcattttggtccttgatcaagtaatcaaaacaattataaaggctgatcagcaacctagatgtctaataatggggaaaatattatatagaacacaaaatgatctttggtaacacatggaagaactaaaaaggtaaaagactacaaatttgtatataacatctagtgaaaattgtgtaaacattatttctgagttgaatatacagtatttatggagagaattgaatgtgcttaaaattttgatatgtttttccattttatgaaaaaactgggaaatgtgaattaaagaaaaattaacattcatttcatcattaattgtaatagaaaaatgattttacctaattcaaataatatgtaagtattcagttattttacatatctatgtatatctatgctaaaacatatattcaaaaatgtttttaataacctgaaaaacagttgggatatattaagaaagcaacatacaatgtgagtgtctacgtgtgtgagtgagagagacagagactgaggcaagaaataacatttaatatgatgttgaaaggaaatgtgccaatataaaagcattggtataatcacagatgtttttaatacaactctccatattccaaattggctgttaacatatattgatatttataatcagaaacacataataaatagtatgttgtttacaaataaagcataatactcaaagaatgtactatttttaaaataatgttggtacttgcttataggaatataattgctttttgtttattgctgactttctgtagtttctattttttcctataaagaacatgtatcactcttagaagaaaatataaagttgatttttaaaaagaggcaaataatattcccctatgcttaatcaaatattttgatgaagttagaaaaataagacagtaatgcactttctctacaactcgattattactaatcaggaaggacaatagtacattttattttattatgctttcttcctctgttctaagccaatagataaaaacaaaattaagaaggatatgttcaaacatccctaagaaaaaaaatcaagatttcaacttggatagaaataagggaaacattgctacatctttcttttatacatacagaccagtttgcacacacaactcactgaaactgtaactagctcttcacatcctgcattagtagtcagataattgtaaaatgtgtctttgtatatagatatgggatacttatgtggccatcaatttagttgactttctatcaaaattgagaagttttatcctgaaatagcttaccaatggaagttagaagtgggtctgacattgcattatttggtggaaaaaaccatcaaggtctgtgcagtaaagctgatgcagctctgtgaactagcaaatcctattagtacttagcctgatcacctgggaagatgaaattgtccttactgagatgtggaaggctgaaagtgaaacaggttgatctatatttattggagtattgctgggtagaaaatttgtcatcacgttatccccaatgcctagtatctaggtatctagtggcacttaataggtattcggtaaatatttgttgaatgaattcctgaattctaaaaggcttcaatctgagctatttttcacatcactactgaaaaatgagagttcacaaggagctgttaaaaaaaaaaaggtcttcactttcagtttaaatagaatgaagaaaaatgagatttttttagattttttgagtttgtgacagtctcaatttgtattagtctttttttaaaaatctcacaaatatttatagagaaaaaggaatgcttatatactgttgctgggaatgtagattagttcaatcattgtggaaaacagtgtggtgattcctcaaatacctgaaaagagaaataccattcgacccagcaatcccattactgagtatatacccaaacgaatataaatcggtctacatacatgcatatgttcattgcagcactattcacaatagcaaagacatagaatcaacctaaatgtccatcagtggtagactggataaagaatatgtggtacatatacatcatggagtactgtgcaggcataaaaaaagaacaagatcatgtcctttgcaggaacatggatagagctgaagccattatcctcagcaaactaaagcaggaacaacaagccaaataccatatgttctcacttataactgggagctaaatgatgagaacacatagacacatagaggggaacagccggcaccggggcctacttgagagtggagggtcagaggagggagaggatcaggaagaataactaatgggtactagacttaacacctgggtgatgaaataatcttacaaccaacccccatgacacaagtttacctatataatgaatctgcacatgtatgcctgaaataaaataaattttaaaaatctcacaaatgtttatattaggttggtgcaaaagcaattgtgttttttgccattactttcaatggcaaaaaccgcatttacttttgcaccaacctaatagtcatttaaaggaaacttcttaagccagtgtccccacctcagattctcagatcatcactccttaacacacacacacacacacacacacacacacacacacacacacacactttgagtgagggtgaggaggagagagggaacaatgaagaaaaagttctgctaattaagggaactgctgaagtttcagctagtcttggtgatggttgaaataacatcaaggaaagagggaatataggaaagacaggtgggaaaatgattcagagtctagagctaagggacaaaaagagacagaaaatatggggaactaatgtggaatagattattgatcctagaaataaatgtagctaaaattctttccagtaaagaggtcccaaattggtgataggtgggacttttaaaggcagccatttttatcacactctccaattctaccccgatttacagtgataagttttcttagtaaagaagcagctttgtctgaaacttcaattccaaacctccgagactttggcttaattaatctgaagatacaatgcagacaccagcttttctttcagaggttattttaagtttaaaattatgtcttcctaacaaatagcccaaagaaatgacttcgtggttttcctttcgtacattcagggatgatggacagcccggcctcatgacaggtgttccaggaggtctttttaattgacttgtctatagatgtaaagaatttgaacaaccaagttgtctcgtattttctctatcactttcctgagggacttttcttaagagaacaagtgaactatgatgtcattatgtcatttattggttttagttggactttgttgagcctatgaacctgtttgagatatagtcataatatcttgcagctcatgtctgaaaatttatgtgaacacttcacagaaagttctgttcaggttgtacatccattttcatgttagataacttgttttgggagttctgcctcttagtaaatttattgcttttgataatgtgtggaacttttaatttctatattttagttctttttagactcaactatgcacaccctttagatttagtatttggcttttaaggcatatttagaccagaccctttctattggttaattgtggtataaacctggctcatccacttgtgagactcttagattccaagtgtctaataaatcaccagaggaggaataattaaaagcttctttcagttctagtattaaatcaacaaggttgcctggaccgtgcttctagatgtgctgtaatttatactattagtgtggattgctttggttttctaaaaataataaatgacccagtgaatagcatttggccagaggcatacaagaaacaatccatagtatatagatttgttcaatggcatttaaaagaccttgattagaattcagtctgggctggagtgatgagaatgctgtttactgatgtctgtttgaagtctccctacatggcagaggctagagggattcacaaatagtaacatttcttaactccaatggctggatccagctgtctggaagagctgacattttaaaagagaggtacaaaaatgtctgaatgtcatgattgctaatgtcattttcatgattttatttttaagcgatctttgtttgctccgtgctctagcaatgagctgggttagaattcccaaaacgctgtgttaaaaattccttgtgaaaatgcagtggttttgttcatggagtgggaagtgtcttctctgacaaagctgttcactcatacctgtggtttctgccacccaacctaagaatcatttcaacatacttaatgttttaagattggtaacacagggatagaggagaggcagggagaaggcaggtacaagccaataagtttgaatagttcatctttgaaacagaaacagacatttgattggttttgccagtgagcctgggaaattcctagtgttgaaaaagcaaaaacatgtacttgatggtccagacaagtttatgaaccagaatgggatttaaatatctagctgtaaaattatgttggaaacacacagacacacacatgctttactgagtgagaaaacatgtaggaagtgcttgcaaggaactaagggacaccatgcaccaataaccatattaaaacatgatagtgatagtgtttgttgtttatataagcatatgtgtgaatatgtatgagtgtatatgagaacatgtatgtgtctgtgtttgtatgggtgttattttaaaggaaggtatgacatggcacatgtaacataagtaattttgttttattggttccaaggaagcctttacatttgatctaagtttctcaagaaaggtccagagtaaagatagatatgatactctggaggagagaggaattaaaaccagcaaacctgactaacccagagcttaaagaactaggcgatgtttcaatcagtttcatttacaagaagttttttttaaattatttttccatatcctcgtcacctttaaaagattcctctattcatttatttcttcatttattaatcatttgaacatttttaagtaacaagcatgtatcaacattctgtttgatgggagagattcaaagataacttctagatcacagaacaacaagcatagccaaaaggcacctggtaagtagggggaagaggaagacaccgtagaagtgcacataagcttccaatgattgccgttagaatgcaagttcaaaggtgtgaaacagttaagtaagaaaccctgtctctactaaactacaaaagaaatgatctggatgtggggacgtgcacctgtagtcccagctactcaggaggctgaggcaggagaattgtttgaacccgggtcgtggaggctgcagtgagtgagatcacgccactgcactccagcctgggtgacagagcaagactctgtctcaaaaaaaaagaaaaaagtttaccaaagcattgattttattttatttaaaaaagaactttaataattccgggttctatttgttttataatgagataagctaaagtgtcattagtttccccttctgataaacaggatgttacctagtaaataataaaacagaaatatttcagaaatttaggttggaaactattgaaaaaaaaaataatggttttgttgggaggcaaagtcccaatgtctctttgagccaataagcaaccaaataattcaacttgattttttaaattgcactgtttttatgtattggtttttttgttcctctctctcaattttactgttattcctctaataataaatgtctcggggagacaaagcacatctttcttgtgtgatgggaaaagggaaactactaattgaaatatgtactctgcctaaaattagcattgcataaaatggaaaaaggacaaaaagatttgtcttcaagtttacttgtctataaaatgggaatgataatagaacctgcctaatagcattattgtgatgtttcagtgagagagaaaaaaaaaaacaaaaaagaaaaaacgccttgaaaccattagagtggcgcctggaatatagtaagtgctcatttatgttatccctattttatgcttatatattattaaacctaaatataaatttttaaaacgagcaggaaaaattctaaaactgggcacacataactttctctgggtttttaataccacaaagcaggtgcttgaaattactttctgaattattgtatgatgtttctcatattacagttactgtctggaggccacatgcatgtggtggtgatgtcatggtctctttctgtgttaatcttgaattccttctgtccatttgcttccagaacccactgatcatgggcaatccagtgagttctcagcactgttactcagggtagaagcagcttctgaaactgagaaaaaagaaaaaagatactatttggtcatgccaaggataatcctccccctaaaagaaattttggcttcccaataataccagctgggtgttctccctaacttctggatgcacatatgtaaggaataattgtgattcagcaaaagaaagtgaatggaaatggaacaaattgaaacaattaaccaaaagatgcagaagggaaacaagagtcagacttgacccctagaccttgtgggaaggaaacccttggtgttggtttgaaaaatgataatgatcagtttctgtttccagactgttatcagtggttaaggtccttatgatttgtgctagagactgggaaagaatgctaacatgaaaccaagcaaacaagtagcaagtaattgagccttgagggatccctttggaaagcatcttgtcatttagaatgatgcatttttgatattcttctagctggtttctgagtgcctgtttgcaggaaatgaaattctaggctttgcagtttgaaaagggttgtataggggtgggtagtgttctcagaagtaatcaaagcttttttagtattaaagatgactgtggaatgtttagagctagaggcataatgatgcaaatcaaatggcgtattagtatcctgcctagtaaatgtggaagccttaaaaattctgctggtggatgggtggtcagcattagagcattagacacaaggcactggggcaaagaaacccagaaggctgtgcacttttgctgggaaagagagtttactgtgagggctgagtgggacagcaatgggcttgcagagaaggggaaatgtatcagcctggggactataaccatttgacttttctccatctgcatgtaacaaccaatccaaaacggcagagatcagcaagaagaagagactaacattgtgaagatggatcattcacaacctagataaatagccttttagaaaatgttgagttgattttataaggagaatatatcagtaaagatgtagaagttactggtttgctacaggtagctcagaccagcttgtgagagatgagtttttgatttcccaggaatttttcaagctggttttgaaacagagccaatattaaaagttacatcatagaaacttggatagaaacttacacagatagtatgtaacttagtgatggcttgaaagcaatttgcatttagtagaaactgtactttgggtacccatacaaacattctgtttttcactttcagtacagtagtcaataaattacctaagatattcaagactttattatcagataggctttgtgttagatgattttgcccaactgtagtctaatgtaagtgttctgagcatgtttaagttaggctaggctaagctatgatgtttggtaggctagatgtatgaaatgcattttcaactcgtgatattttcaatttaaaatggattcattgggatgtaacctaataaaaacttgagcagcaactgtatttgaataaattacagtatacagaaaaggcaatactcaaaactcatcacgtcataataactgtactatgttttaccattatctatgctttggcagctatttacatgtattgtgtctgtatgatgacaactatataatgaggtgctactgcacatttctttccaaacctgcattctataatgtgatgttggtggcttgaaattggctttccgctacagtaaccaaaacagcatggtactagtacaagaacagaaacatagaccaatggcacagaatagagaactcagaactgagtctgcacacctacaaccatctgatctttgacaaacctgacaaaaaagaagcaatagggaaaggatttcttatttaataaagggttgggaaaactggctggctatatatagaaaattgaaactggaccccttctttataccatataggaaatcaactcaagtcagattaaagacttaaatgtagaactccaagctgtaaaaatcctagaagaaaatctaggcaataacattcaggccataggcacaggcaagtatttcatgatgaagacaccaaaagcaattgtgacaaaagcaaaaattgacaaatgggatctaattaaagagcttctgcacagcaaaagaaactatcatcagagtgaacagacaacctacggaatgggagaaaatttttgcagtctatccatctgacaaagctctgttatccagcatctacaaggaacttaaacaaatttccaagaagaaaacaaataaccccattaaaaagtgaacaaatgacatgaacagacacttatcaaaagaagacatacatgcagccaacaaacatatgaaaaatgctcagtattactaatcattagagaaatgcaaatcaaaagcagtgtgataccatctcacagcaaccagaatggttattattaaaaagtcaataaaacaacagattctggcaaggttatggagaaaagggaacacttttacatgttggtgaaagtgtaaattagttcaaccattgtggaagacaatgtgggaattcctcaaaaacctagagagagaaataccatttgacctagcaatcccatttggtatatatccaaaggaatagaaatcattctattataaagatacatgcacgtgcgtgctcattgtagcactactcacaatagcaaagacatggaatcaacctaaatgcccatcaatgatggattaaataaagaaaatgtggtacatatacaatatggaatactatgaaaaggaatgagatcatgtcctttgcagggacatgaatggaactggaggccattatccctagcaagctaatgcagaaacagaaaaccaagtgccatgtgttctcacttataagtgggagctaaatgatgagaacacatgaacacatgatgggggaacaacacacactgggtcttgtcagagggtggggggtgggaggagggagagcatcaggaagaatagctaatggatagtggccttaatacctaagtgatgggatcatttctgcagcaaaccactctggagcacgtttaacaatgtaacacacctgcacatcctgtgcatatatccctcaacttaaaagttggaaataaaaaaataaaaatgaattggctttccatttacccctttgattgcccttacccctatccatatgtaaagcagcagcagggtggtgattctgaatgtttcacgggagcagttaaaaagacacaatgtgggccgggtgcggtggttcacgcctgtaatcccagcactttgggagactgaggcgggtggatcacctgaggtcaggagttcgagaccagcctgaccaacatggtgaaacttcgtctctactaaaaaatacaaaaaaacgaccaggcgcagtggctcatgcctgtaatcccagcactttgggaggccgaggtgagcggatcacgaggtcaggagatggagaccatcctggctaatatggtgaaaccccatctctactaaaaatacaaaaaattacctggcgtggtggcgggcgcctgtagtcccagctactcaggaggctgaggcaggagaattgttgaacccgggaggcggaggttgcagtgagccgagatcgtgccactgcactccagcctggtgacagagcgagactacgtctcaaacaacaacaaaaacaacaacaaaatacaaaaaaattagccggacgtggtggcggatgcctgtaatcccagctactcaggaggctgagacaggaaaatcacttgagtctgggaggcggaggttgaagtgagccaagatcatgccattgcactatagcctcggtgacaagagcaaaactctgtctcagaaaaaaaaaaaagaaaagcaaagaaagaaaaggcacaatatgtaatgctatttgctaaagtcagcctctttatgggtcttttgttgacttcttctttagtggctccacttcttagaagttaatgagcaattcctgctatagcagcagagcctctaccaaagcagggggacttcagggaaccactggttgtcagatgtgctgggcgtgaacatgagcgtgaacagaggaaaagtgtctgatttaactggtctcgggtgaggcctgcatgttgggatgtttagaggttccccaatgataactaataagaagccaaggttgaaaaccacatctaggccaaactgcgattaatttttgccttccacctccttatcaatgtcctctttcccttatgaccccgctgcctacctgactcagttgcgtccactttctctgtgaatcttcctttacctccacgttggctgccagcttcaagattgcatgcccctctgagcagtttatctctaaccaagagaggtattcctttccaagagttccattaaaagtccaaaggagaagttaattggcctgactttggaccatgtgtgcccacctctcaaccaatcactgttatcagggcagtcatccctttgtccagccatgctcctgtatcagagaagcactgccatgacagatattgggcaaactgatatatgacccccaatactgggtttggtgctcattcttgttaatgcatgtgttaagggtttcattctaatcatctgcaaaaaagtgattgttgtctttaaaatgttaccaaaactagtcttttagcaagaatcttactagaataaaatggctcttgctacctgtatttttaatcagcctatgtatattgatcccattcctgatattatcaccttaatatataacagccccaattcctcttattgagcattggttgctagggaaagcaaaaagttaagagaaaactactgagattttctctctaatttgcctctgtctgcctctaactagcttagagatcttggacaagtcctttaacagttctctgtcagctgcttggactgtgaaatagagataaaagtacctgtctatttcaggccgggcacggtggctcacgcctgtaatcccagcactttgggaggcccaggagggtggatcacgaggtcaggagattgagaccatcctggctaatgcagtgaaaccccgtttctactaaaaatacaaaaaattagccgggggtggtggtgggcacctgtagtcccagctacctgggaggctgaggcaggagaatggcatgaaacccggaggcggagcttgcagtgagccgagatcgcgccacggcattgcagcctgagtgacagagtgagactccgtctcaaaaaaataaaacattaaaaaaaaaaacaaaaaacaactgtctatttcatagaggtattgtgaggattaaatgagataatgttgatgaagtaattttgaaaagcatatcaatgtgcagctgtaaagttttattcatatttaccagccaggcaagtagtattagctgttataagtaaaggtaaacatccaagtgcatatgttcagatgattatttttaatatacattttctcctgatatatattcttctagttgcagatctgattgggttgtatattctgtctttgctaaaacagaattgtatcgaaaatcttaaaacgatttttttccagtgatcattcctaatcattaagtgtgatgtcaaaattaaaacaaaaaaatatataaaaccaaaatgcattcatatgggaatatacttaatttattttccaaataagctcaatggtatttgggagactatctctcatttgatttctataacctttgaaacaagtctgctgacttaactttctcagcctccagagcattatctctgtcttgtctgcagagagattttcctttgaggtcaatctctggatcttccatggtaaaactccttttgccattttctgtgctttcctcttgagtttcctgagcactgaacacacatatatatgtacatacaggaatgcagggacataggccctcacatacagtgcaagtcacattttataagggtaatttgttaaatggtatttctctaattcttaaaagcagtgactcaatgtattattctaacctctttcacctaagagttctgatatgtagctgtaatccaataaatctccaatgcatgattgaattagagaattttttaagttgataagaagttagagtaactagaaaaaaaatgggtcttttattttagattaatagagaaatttgcctctgtattaatccattttcatgctgctgataaagacatacctaagactggacaatttacagaaggagttttattggacttacagttccacatggctggggaggcatcacaatcatggcaaaaggtgaaaggcacgtctcacatggcggcagtgcagggaaactcctctttttaaaactatcagatgtcatgagacttactcactatcatgagagcagcacgggaaagacctgtctccatgattcagttgcctcccaccaggtccctcccacaacaagtgggaattcaagatgagattttggtggggacacagcgaagctatgtcaacctcattgactgaacgtatttgctaaatatactatataccaggtatcaagctggttatgagatttatcagcgaagacgacaggtgctgccttgatccacattgaagtagacaaacaacacattaataaatcatttcagtctgtgatcagagctctaaaggaaataagcaaggggtgggaatagaaaataatgaggaagacttaatttagtcagtatagtcaggaaggacactcttaaaaaatggcctttcaactgaaacctgaagaaatagaatgaatttgctttgcagaaacctagagggaggacatttctgacagggggaaagagcaaaaaagtatgaggatttgcaagaagagaaaaggggaaggaaaatttgtggcttttatgaagcttaaaataaatagtgggtactctattattcaaggtctttcagccaggttaaagaatataaagaatagtgagaatctagtaggtatttagtaggggaatctcacacacacacacacacacacacacgtacatctataataagctaacatgttataaaaagtacaggacatttcttaaaaatatcctgtaatttttataacattagcttattataaatatggttattggcatggcaaggaatgccagtattttctactatcttttatatgctgctgtacatattttgatgtataccagttgcaaagccagccatgtaagttaaagtggcataattgtaaaaaatctaaaatgtaatgcttataatgtgcttggtattgttctaattgtggtaagttgcattgcatgttttaactaattttaattatcacaacaagcctgtgaggtaagtattgttttgttaccatttcatagataacgaaactgagtcatagagggattaggtaaattgccatgtcacacacatttgtaagcaagggatggagccaggaatagggcaggtcagtgaggctcaaatcccatagtcaaaatcagtggtattcaaagtgtagtccacagattgatgccaatttgtgaattatttgtcactagtctatgataaatacagaaactggaagtaaatgtgtgatgattggccttgtcctattgaaaaacctatagaccactttgagtgtagtgtggaattgcatgggacatgaactacatatgagtcaggaactgtaggaacacatttccattcatgatggattggagataagtggtgcttcacctcagataattcaaaagtaatgctctaaactacatgctgtgccaccgtagatgaaataaggtgttaaatcttctctcctgtgtctctcgatactccatatgatacatcatgtgcaaaaagtgccatttgtaatttgccttgtggaaattcattttatttttttcttacctcttgcacctgtgaggaagtgagtatgagagaaagatccagaaaggggagaggtcatatgaccccctgctctccactggcattgacaagtagtagattgggttccatagtatgatagtcactttcctgcaatcattcttcaacacctctggaaattgtgagcctgtaagagaagcaaggaagtgtaagtgctgaatacttatcaacatcctacctggtcaagtggtccagaaagcttgagcatagtgttaaatggaccaatggtatgtgctaccttttttctctactaaggtaataatgtactcttctagctgtaacctaccagcctacagaaatggggttggttttgaggtttggatagatccctgtactgttattatcctgaagtaggggtgggggatgctgaagagagcttcacagtgccatctttgtatgtaaaaatggcacaattatcctcaagtgaagaaataatgtagaaagagctgaagtagtgctttttctaccactttgcagaaaattagtgtcagcagcacattattcagaaatctttatcttttaatctactatgctaactcttatcatatctgcccctgccctattgctttaactagagaggtttattttgttcccttagctaatgactctatctgggtcagacatcacatatgtggcacctgggtggaagtgctgagttcatttttgtctttttgttattgttattaacatcacctcatgtgtttggcattctgtgttggctgtcgaaccagattcctcttcctttcctgaaagaaaacagggcctagcataggaacagcttctatctttctttccttccctgtatatctctttctttccttccctgtctatctctttcttttttccttaactggggaatcaggaaacttctgatgaaaaatcagtatcatagtgttgagtaaatattgtgagtagacaggcatttccttgcagttttgaatagaatcatacccctaataaagacattctgaaggcttataattctcacaaagtccagatgtttctacaaacaaggcaaacatggaggtaaaatgtggaatttttgaaagacgtttagttcccatgttgtcttagtcaaaaacaatgaaaatttcatttccagttaaccatcaactaccttcagtagaagactaacatcttccttgggcagtttgcttcatggatagtaaatggaggcagagagcagttattctgcagcacacaatgccatgaatgctcccacatatgtaataatgtatatgtaaaagcatggatttgtgcagtattgatttcttcctcaacgcttactacttcctgcctctttggtgttgcaaggttttgtctgttgctttagtatttaaattgcctcacttaagaaatgtgcccattatgtgtgggggagaggaagggttccatgaaaacgaatgctctgaagtatttgaaattcttctatgagcaccgaagcactgcaactcacactgctgtgttcaccaaaatcctggaagcaacacgctgttttgacttgaagaagcaataccaaaattatgaagtcatctaacatctttccaattttaacacagactctaaatatgtggcaattcagtattttatttttcgtttatatcccctttctatactaccaccgtttaaactaacaaagttgttctttacagttttaatatagaatccagagatgagacatcctggatttgttattttttctcctatttctttttataaccctatttaagcaaattaacaacatctgggttgattaatgaacaagccacacatactcataggctcatctgtatgtacatattatgaatgacgcctctgatcaggaaatcaaacaagcaaatgagaaaacctgttcacttgttcaatgggtcaggtgtaactgtcaaagagcatgacttggggaaatatacccttcatctgtgctctggcttttcaggccccacaagcagcctctagggcaacaaggtcatagatgatgtattctgttaaaataacaatgccttttattttaaggacactacttatactgggaaggtgatcttttccaagatagcaattaccaatgtgaatccataaataagttaaaaaattatgttttttgatcataagaattgacacttgagtggaaatattcctctgattagactagcttggtttctctcgtcacttgtctatgtaggaagaattacaatgcagagctgtcctttttgattttgcctctgatattgaatgcaaatattttggctatcagtctttcctaatgctacttaccccttgaagatggggagaaaagctgaagaaagctatttctgtaatcttaatatttcttccatgacacttgtaaattgatttgccaagaagggtaaaaaaaatcaatgcagatggctagttaagtttattgtggttcagactcaaactgttgtatgtggatgtacacttgggagccaaggaatagggatatattgttagtgtaaaatatccagttccatactaacttatgaactcttttaggtcattcatcttattcaacttcattccctggcacctcacttagtacctggcaatgtgttgtagtagctaagaaaatgtgcgatctggactctgactatccaggttcaaatttttgctcttctacttactaacaatatgatcctggatcgtaagttttcagtgaccgtaagttttcagtgtctttagctgtaaaatgtgggcaatactattatttaactcatagaattattataaagattgaaaaggcaaagtgtgaagtactcagcccatagtgagcaaccagtatatgttaactatacgataagtatttctttactcaccaaattttgaaataaaccattacctgaggtggttggtaatggtgaaattataatggaagagagctgggcacagtggctcatgcctgtaatcccagcactttgggaggccaagccaggtagattgttttagcccaggagttcaagaccagctggggcaacatggtgaaacagcatatctacaaaaaatacaaaaattagccaggcatggtgagatgtgcccatagtctcaactaatagggaggctgaggtgggaagatctcttgaacccgggaggttgaggctgctgtgagccgtgatcgcaccactatactccagcctgggcatcagagtgagactctgtctcaggaaaaaacaaacaaacaaacaaataaaacaattatagtggaagagaatctgaacatgaagatggaattctaaccttgcttaagaagtaaacatatacaccaataataataataataataagaagaagaagaagaagaagaagaagaagaatccagaaagactccagacataggaaataacatctgacatgatttgaaaaagagtagtgaagtgaaatagaggcccacagctcctcttttctggtataaaactttttattgaaactacctgtgtcgtaaaacagggagagaagttttgctaccgataatgataatttgatgccttaactgtattaatatagcaagtgtgactcaaggatgtctggagtctaaatataaaggtctgagaagagacatgactgtttcagaggtttagagtggtaaagccaataagtggtttccggccttcccaggccactccgcataaagcatcctcactccctgagggcctctgacattcctcagtgttgtgagcggggaagagagaaatgctttttggttggctcagattaccttgttctggttaaatgaaaaagtattaacatacgtttcttgtcaccacaattccagctgtccaagtcagtgctttcggagcagagatgtatgatcttataactcctgaggttaaaaaagaaatgtgttgccgaacaaacctcctcatctttgacaccctgtttcctgcctgttgtgtgtgacaggaaggtaaaaaggtaaagactaaacagtagatactcttcagtgagtggttagtccagcattacctgatggtgtttagtatttgccattctgaaagatgatcagaaagcaaaccccttaaagagaaaaattaaccagtttgttttggcaggctattctggagcacatgctaaagtgaccacagttgtttttaatgcccagcagaccttcgcaactaatcctattaccgcaggactcccaggactgtctggttagcactccccacagatttgtccactcccatttctgaccccacaaccaatcccttcccttgggccctctggaactcggtcatacagaaaatctcctttatcctcaaattttcctgaattttttggtttcactgttttactcaaattcaaacttggataccccagaagacactacttcctctaagccacctcaaactgggggagcataactgctggtgccagtgggccttctttattgtagtttcagatcattctcattccatcttctgtgcaacccccctctatgagtctcgtgggtctttggactatgtgactcactacctctccttacttgattcactgtatcccatactgaccttgccatattcttggaaatttttgcaccgtggcctctccattctttggcttcttctcctccattgattttattcatattttgcctcagccacacatgcaaaggacatatcctagactctctcattaccaattactaaaaacccttcataattcctatctcaggcatcttacttttgggtcgtttgttcctattttagcagctcaacactttgagcattctgataccaacactttctttaaatctcattatgaactatggcatctattattttttctttgttgctcattttcctcatgtcccagcatctctttatactctgcttagatttcgtgaaaagccattatttcatgaaaaactgttccaaactaccaatgtctgtatccttataccgttgcttatataaactcgcttgtccctctctcttctttctttaaatgactctggtaaaatcctaattatggtatatccaattgacttttgttttacctgcatgtacacacctgaacagagctggagaaaaacactctatcctgcttaacagtctcattttaacagcatgaccactcgcttaccttaagtgggttctcggtgctgccacgcaacctattatatttttctagtctatttattctcccattccataatgatgactattttgtacattttctctcctttctgcctttcaatatttattccagctgttaactttactatttcattaaaaacagagaatcaatggaaagagaacttcaaaatgatcccactataacacctcccaacccttccatactaccaacatgtatatccttatactcttctttctttcatgttactgtggatgaatcatgagggtccttcgtagcaaagatcatctcttctacttgtgcactggatcacatacctcttctgtatacaaagcagcaattgttgctctcctgaaacatcagttatgtttttccttttcaactgaattatttctaccagcatacagacatgctgcaatgcttcccatcttaagagaaaaaaagctcttggctccatttcattttcagtgactgcctaatctccaccccattttaaagcaaactcagtaaacgagaagtctctactcactgtttccacttcctttcttcctgttctctcctaaagccacttcaatcatgttttcatctccactactcgagcaaaatgatttttgtcaacgtcatcaaagatctttatgttgccagatccaatggaccattcccatttttcattttactttaaaatcttggtaacatttgatacccttgatcaactcttctttcttaaaacttggattgtgagacagtcttctcttgtgtccctcattgcttaccggttaccccttctcaatctcgccagcttgatttcccttatttcaattctaggggattctggcgcttagtccttggatctctggatatctttatcttcactcatttctttaaggagcatatataaatttgcttctttaaatatcacctatatcatgatgatcctcaaatttgtatcactatggttgacttctcacctgaactccaggttataaaaaactaaaaactgcattttcactttggatgttaaataggaattccaaagttaacatgttcaaaacaagtcattattttccccaaacctgctttactttcagtcttcacaatcacaaagaaaaaacaactccatccttctcactgatttagctaaaactttgattgtccccttttttctcacctgtcacatagaatttttcagcaaatatcaatggctctacttgactgtttttcacatttccgtctctgtaatcctggtccagacctacataattgcctgcctatggtatggcaatacatttttaacagctaaacctgcttatatccctgcctccccacaatctgttctccaccgtgcagccagagtaaacgttttaaaatgtatagatggccgggcgcggtggctcacacctgtaatcccagcactttgggaggccaaggtgggcggatcatgaggtcaggagatccagaccatcctgggtaacacggtgaaaccccgtccctactaaaaaatacaaaataaataaataaataaataaaatatatataaattcatgccatgcttttctgctacaaaccttccaaaagttttggatctcattcaaagtaaaagaagaagcttttgtaaatatccacacaaccttgcttctcttctgtgttaccttcttctctcctaatttactgcattctaacagtgctggcctcttacctatttcttaggctaagagaacccaaacatttttcctaccactcccaccctcatttatctgtttggtttatttattcaggtctctgatgaaatgtcactccatcagaaataacttccccaaccaaactgtctacacacacacagacacacacacacacacacacacacacatgtgtgtgtatgtatatatgtgtatattaaaaaatacatgtgtatcaccactccctttacccctagcttttcatatacctttacctgctttatttatctccatattctaaaatcactcaggatagagaaataagcggtttgcttgttgtctgactctctgtaatagaatgtcagcttcagaaaagtataaacttctgtgtgttttattcattgccagatttttagcacctagaagagtccgtgatatatagatgcaccataaatatttgttgcatgaataactcactgaataaaggtgtatgagcttagatttgactgtttatctttttttatcactgcactataaaacccaagtttggtttccaggaaggccacgttaaagaaacactgtaattagagagttagataatttggcattgaggaaacaccactttgccccccactgccaatctgtgcactggcaaaattttttttcttttttgaggcagagtcttgctctgtcgcacaggctggagtgcagtggcgcgatctcggctcactgccagctctgcctcacgccattctccgcctcagcctcccgagtagctgggactacaggcaaccgccactatgcccagctaattttagtatttttagtagagacagggtttcaccatgttagccaggatggtctcaatctcctgacctcgtgatccgcccgccttggcctcccaaagtgctgggattacaggcgtgagtcactgcgcctggcccaaaatttttctgttgcaatgagatactactattttcttacagaaagagcttgcagacctgatgtctccctcccatttatgtagacacatcatcaggcagtttgcctcagtattgatttgagaatttgagaggaatcatctcttgattttttaaaatttaaaagttttatttaattgaatccttttggagaattatcctaccttaggaaaaatagtgaagacataacagcagaatcagtttggtgctccctctagacaagcaaaaaataaaagtgtatggaagatctgactctcactgtcttctcttcccctctgattgcccaggtatatctcttagccatgggttctcatttttcttctttgccattagtttggcttttttattttctctgttaacacattccacccttgagattgctgtaacagtgatctcaacctctgataaggtaagtttataaacttaatgaggaaaaaatggggaaaaaggtcactcttctgctgcagaagtgcgcttggcttctcttggtttgctgcctattcactggcattaagtacctgaacaaatgttttatcacagacagggaactgttgagggatgttcacaatgcattgaacatccttaggcataatttttatgtgaactgggcatccttaaatacattctgactccatgatcagattaccagaaagtgcaggtcccactcactatcttgattcagcatctcccatctggccaaagttgaattttacattgagttggatggtgataaatatgcttagcaaaagtatattcgttgtttctgaagttctctgtgctgataaacactggctgggactagggaagtgggccccaaataaaacaatagcaataatccccagactgcttgagtagtggcagtctttattcttgttcactaaatggaagttgtagtttagttttatttctctcataaggctctgctgtttgaggactcagctttggggccgttgagtgcttattagtggtagctccagaattgcttcatagaggtagaaatagggaatggggcgggggctcctggtgggtggaaaaaagggtaagggactgctactgaaagtggtcactatactttatttagattttatatttgtttgtgatggctttagtagggattgataggcagtgcatgtgctgatggagataaaagaggctctaaaagacccctcctacaaaaccccttgataccactcctgtgaaaaacatcaagttttgatttttgtttgcatggctgttatcaaattccattttgaatgagtaacaaagctatgggagactttttaaactcttttgaaaattgaagattgtaggaatccccctttccccatctcttctgcctatgtagacatcttggggatttccaaattcaagataaaatgttattgttctaaaataaatagatttggaaaatgtggttttgacactgtatttaccaaaaaaagttctattgctacatatttaaagagatattttattattttaaaaagctgcatagtcaaataagctgggaaggccctgactatcaatgcatttcattaaatctaagatgcttttgattataatatagactgttttaatgtactcctaagaaaaatatactgccaattagactctgcttctactgtaagaagcatctccatatcaaagtttatttaaaaaaaaaatgaaaagacatgcctttgaatttatgaaatataatatatacaacctttctgaagagccccatggttgattagtgtatcttaggttctgagaaacactgcagtaaaaatatctgttaagatttctttaaactagcatttcccaaaccacctgattagccatttgagtttctatcacaccactctgtctcataacatttgttagaatttctttggctctttcactgccaagttgccttaatgtgaggaggcattgaaaattgggattcacccgtaactcactgccatgcccaaggaaggcattgctgctggaggcgtagtggacattaacactgctttgcaagaggagctgaagaccaccctcatccatgacggctaccatggggaatttgtaaagtagtcacagtcttagacaaaagccacgcccatctctgtgtttacattcaactgtaatgagctttgtatgtcaagttggtggaggccctttgtgctgaacagcaaatcaacctaattaagactgatgacaccaagagactaggaatcgatagtggcagaaaccccaaaaaaatggttagttgcagttgtgtagtagttaaggtctatggcaaagaatctccggccaaccatgtcattaaagagtgcttcaaatgccagaaatgaacaaataaaatgttggctcaaaaaatttgaaaataacatggaatattatccaatacaagcatggcaaaggcaggctatctattgaaatatttgaagaaattctgagaaagaaaagaaatgaaagacaaacttgaaaaaaaacagatggagcaagccaggtagaacaactgttaagaatccagaaaaacaaaaatcaaagaaactattctaaacaagctatcaaatttgtgtgacaaactgtgacttcatggagaagagttcaattagaaaaacggtggaaaggagattaagactttgattggtgagagtttatgaagactgacacaatttaaaaagctattatagttattaatacactcttagctataagctgagagtattcctagcatgctatttaaatctgacatcaggcaacaaccaaaattatatttgtgtaagtcatatgggaagggttagggagggagacaagtggctcacccttgggaaaagatgttcatatcaactttgcagtctctactttcttatctgtaaagtagggatgagcaaaattgaacaagatatttagttttacaaaaatagtcacccatattatataaaaatatgattatttttgtaaaactcaatacagaaatggaaaccgatgacatgcaacccattgacaattaaatgagttgtatgagattgatttttaacataatagaggaattatagccatgataaataaagttaaattaagaaaacgtagaggcctggcatggtggctcacgcctgtaatcccagcactttgggaggtcgaggagggtggatcacttgaggtcaggagttcaagaccaacttgggcaacatggtgaaaccccatctctgctaaaaatacaaaactgagccaggcatggtggcacaagcctgtagtcccagctactcgggaggctgaggcatgagaatcacttgaacccgggaggtggaggctgcagtgagccgagattgtgccactgcactccagcctgggcaacagagggagtccctgtctaaaaaagaaaaagaaaacgtagagaaaaataaaaggtaagatctattgccaaatatatataaaacatatacaaaccaaatgaatatgtgtatgatactacctgaaataatcttattttttggttacttgtttattccatctcatccacctggaaaatatcactcatgagagtagactttctttttttcatcactttatcccagctcttatggttagttcctggaatataggagtcattcagtaaatatttgtaaaatagttgcaaagtaaattaatacattaatgaaatataatttaaccccaccatttagtacttattataatttgatactgtgtcctccttaaagcttttaaacctttgcttagtagataatatttttctctggaattttttaaaattgcaaataacaaaatattttaaactgcaaaccatgattctacagtggagagaatgttaaacacacagacatacacacagacacacaaacacacataaaaattgccttaatatgattggtcacagttatacatctatgatggcaaggatgacagaagagaatccactgctatgttgggtcaggtgaaaagagatcatgccagtcacttcactgcagttgccctttgccacattataagatggcatagtgtctacagaaaaaaaaaaacaagaaaaaaaggaagacttatcttctccctgttacaatttttcacctaaatgtcagggtcagattcaccctgctgaattttttttcctcctttctgtgaaagagccactatttccacagattgctttaacaatgagtaaacttttgctggtttatgtgtgaaaactacactgcaaagtaccttataatgtgcttaactattagcagaacataaccttttctatgacttgtaatataatatactgtgtggacttatgacagatatagcccatctctattataaggtccattctgtgacccagaaactattttggattctgagagtttaaaaaatgcatgggactacctgccaggaactcatggtccaggatatgataccaatatgaaaataaatacagcataatgtattaaagaaaaggaatgaggcttttgaaatttttataaatacagtacagtgttgaagaattaaagaattctggcagcgatggcttaagaggtgtatattccaaattgtatgcacacacacacacaattaattaattttgttattcaatggaaaatcatcagaaggagaaaatgaggactagtggatgatgaactacccagatgccacttaatagtatcatatttaacaaaaccaggcttatgacataggacaaaaactctactgattctattaaaatataagtcaggttatgtgactcctgtgccccaaactatcgggggaaacagcccccagtatttcaacgtaggttcttttctatttttccctaagtgtcgaccctaagtgttgagaagagaaagagtacaaagagagaaattttacagctgggcctccgggggtgacatcatgtattggcaggttccgtgatgccccctgagccacaaaaccagcaagtttttattagggatttcgaaaggggaggtgggtacgagcagggagtaagtcacaaagatcacatgcttgaaagggcaataaaagatcacaagggcagagatgcagagcaagatcacaaggctagagcgaaattagaattactgatgaggttccatgtcccactgggcatgcattgtcattgataaacatcttaacaggaaacagggttcgagagcagacaactggtctgactagaatttgccaggctggaatttcctaatcctagcaagcctgagatcactgcaggagaacagggtgtatttcatcccttatcttcaactgcataagacagacactctcagagcagccatttagagactgccccctgggaatgcattcctttcccagggttatttcttgctgggaaaataattcagcaatatttctcctattcgctttctgcaagaagagaaatatgactctgttctgccccaccccgcaggcagtcagactttatggttatctcccttgttccctgaaaatcgctgttatcctgttccttttcagggtgcccagatttcatattgttcaaacacaaatgttttacaaacaatttatatggataatgcaatcatcacagggtcctgaggagacatacatcctcagcttacgaagatgacaggattaagagattaaagacaggcataggaagttataagagtattgattgagaaagtgataaatgtccatgaaatcttcagaatttatattcagagattgcagtaaagacaggtgtaagaaattataaaagtattaatttggggaactaataaacgtccatgaaatcttcacaatttatgttctttgccgcagcttcagccggtacctcctttcttggtccctgacttcccacaacaccaaaccatttaaaaattctcctaagtcctcacagtggcctctaaggccctctgtgatctttccaggcacccccctgtctttgattgcctctcctgttacttttctggttcagactgcttcagccacagtggcctctttgccggacctcagatttggcctttcttcaactcttttccactccgcattccacctgttgggaacactctttcctcacatagccacacctccttccagactttgttcaaaagttcaatcgagtctgctctggccaccccacttaaatttacaaactgcctctctggcccctttcagcaatgccacctcccaatctcccagtattactctgtttagttttatgtatgctgggttgggggggttaatctgtaaagaagaataattcatgatctgttcaaatcctcattaccactttctaatctgaatgtgaaaagcatcaggagccagttatcaaagtatccctctcctctccattgctagtcattttctaccacaagttttttctagccaccattggaactaacctacagcaaacttctggaattaggtattagcttgtcaactgacaatacccacaaggatgtgcatctgaaatttgtgtgtgagtgtgttttatgtatgtatttgtaaaacggcatgtagggtatggggaaaacactgggtcagtggtcataagaaatacttagggtcaaatccccatctgtaaaatgggggtaattcctgttctacctaatgcacagaattcccattagataaaaatgagttagtgtatgccaaaatgctcttaatgctggagagtgctatgatgcttctccatcattgtcattagagctacatttaagcaaatgcttacatttgataacaccttatatctttataaaatgttccactttcaaaagcaataagcaagtaaccattgttttcaagtgaatcattgtcttaattttctcaaaaatattgttggcattcttgtaatggttaaattaaaaacaaagacatgttttaaacattaaagatattaatgttaaaatttagattcagagaaggtcagtgacttatctgtgatcaaattgctactaagtaataaagggtgttgagtgtgttttctgctccaacttggcttcccacataaataatgaaacatataatagggtaaatatggatggaggctggaattattggaaatcaaaatacagaaatatcaatggacaaatctagggaagagagtttgatgaggagcaagatatttgcatagttttgaggcatctcttcataaattgctttttagttgcaagctgaaaaattgtaactatacaatggaaacattagataacaatttgatcaggtgatgaacatcaacaatgaggcgcaggtggatatcatgtgcctatggatagaggcgcagctggatatcatgtgcctatggatatgattctctgagaaggacataacataacttatgtatgttccagccacgaatcatgcataatctgaatttgatcacaaggaaacattagataaattcaaaataaagagcattcttcaataaaacaagcctatatttttaaaaaatgtcaatatcacaaaagacaaaaaccaaagacatgttccaggttaagggggacaaaagtgacataacaattaaatgcactgtaactggatgctgtatggcaagatggaaaatgctattattattatggggttaaatggcaaaattggagtactaattctagattattgtatcaatgttagatttactgatattgataactgtactatagtctaatacgtgaatatccttattcctggaaaactcatactgaagttattagggataaagaaccatgatttaccaatttcactcttggacggttcaggaaaaaaatgtttttagatagttagatggacaaataaatctagatctagacagagcagtacattttattaaagtaaatagggcaaaatatagtaggtgaatctagggaaaagatatattcttgcattttctttgtactatttatgcaacctttctctgtttgaaatcatttcccaaaaaaatacttttaaatataatgaggcacagcagttgaggcttctgtttatttgactcatctgaaagagtttattttctttagtaaatacctaacttacaatcaggcagggacgttttctcttgggaaggtaagatgtttcgtgcataaaagtagcaatacagaggtgtttgatatgacaatattttactgcattttcattttttattatttattattaatgaaatgcagttgcctttgtagcctgctgagtgtttaataatgaaattgtgcatcattcattttcaaatgtctgtgcctcgtatgtgttaggaacatgaattcaatatgaacttcaaatcatttcgtaaagggagaactgcagatagagttaaccaactgatgctctttaaatgcatgtttatatacacaatttccaggatgacatggcagattaggagtttgtgtgttatatgtaaagtacctattcattgagcttctggatatatggttttagatatctacttaagtcctcataatatagcatggtttaggaacatgtttcctgtagtctatgattgaatttattcagtttcaaaaactgattatattcttccttaaagttccaaggttctttatgtaaattcacatcaattagttcttaatttatgatggtccgatcccccaaattggccttggttttaaacgcttactgtgttgaatggttctcccaacttttaccattgtactcagcatgttcaatataatacctatccttggctagtttggaatgaggaagtgagactaactttaaccctaaagagaggaacagacccctaagacagccatgtcccaaaactcttccccctcacatgtccttcttctcccatcctttcctattatcctcttcttcttcaacttgctcttcacccctcccccttacagctcttctgttctaaactcctttccattttattttgagatgagatctttctgtgtcactcaggctggattcgaactcctgggctcaagcaatccacctgcctcagcctcccgagcagctggaactatagatgcatgtcactgtgcctggctacatttctctattttagccacaagtgagctgcagacaggtgattccatagccatagggtctcgatctcccatcagtgacagaataaataaaagatgcttccatgatgagcaagtattcaaactatgataaggaaggatatgaaagagattacttctaaatctccttatggcctttgggaaattatagacatagctactctcagtgctgttagtgaatttgcagaatctagaacccagattccttctttacaacttagtggctatatgagcatcataaatcaacctctttgagtcacagactcctcatccatcaaatagaggtaatgatgagatgaattcagaggacacttgagaggtgtgaaatactgtctaagatgctatttatattgtcattgtggccagcagtgttatttctttaatttcacttttagggtagtttacctcttcaacaccaagacagtctttacagaacctttttgactagggagcaggatggatacaatttgtgtgaaggagcttatgtacaagagaggcaaattcctctccctttttctctctggtcatcaggaaggtctcaaggacaagtgtctcctcaactgcacatcctagaatcatgtgccagctattggagtaaataaaataatcttttaactgataaacagatcttggtttggcaaaagtcagatttttctgtgtgtgatttgaaaactcttctgaattagagatgaaaagatctttctcaggtcttccctttggcagagttccagctagaacacgtggtcattgaccaccataactgttggtgaccaggatgtctagaaatgctgtcaagatggctatgcagtgaaatagtgttcttagtgcttacaagatccttgtcatgtgctgcaggtgccaagtgatgcaaaaaatgtttacatgccatgaataaaactaaaagtgcgaacctcaaccagtctatttttatagtggatctacacacaagaggacacttacaaaggagataatgtaatttagctctgggaactcagctttaagaggacgattggttttgtttttatgtgtttttgcttttttagaattttctgctgtacatctgggaaatgcttattgtgagtgtgaatcacttagtagctctcctcagcgtttccattttgatattcccaggctgccagtgctaagcagtgtttctggctgaagctttgaaaaatcattttttcctatcaagccttttctctactttagccctgcctcatttccctttcttgcctctaaaagttttaacttcctttcgtaaattgcagggcataatgacttcaaacaaataaagtccaagtctcaaacagctatggccccacatgtgtgtgtgtgtgtatatatatataagcaaatatgcatacatccacacatctatatatgttttcaaaccactggcttatatcagtaatagtttggtggcaaagttcctgaatttcaaggtggatttcaaaactccatttcttccatttgttggcttaggtacaatgtaattgagcattgtgattaacaaatacagattcttggctataagcaagagcaaatctatctattaagagcttgaaaaaattgaggtttatttgccttttagaaaagaaggctgagacaaatactctaggaatgaattgctactgaaaagttgcaaacatccatggcacttcggctttggcctcatggtctcaaaatagctgccgaacttccagcatcatggcctgattacatcaatgtcctgaattttgcccatgttaaaggcttcagtaaagccaaaggggaacaaaagccaaatatatttgcccactgaatctattaccttgattagaaaagtaatattttttttaacccaataatatctgcttagccaatattcaattatgccttgttggctagaagtgtcataaagccactcctagctaaagcactgataggcaggtagagaagtaaaatgaaggacaatggctaaatcagctaaaactaattgtatttgtcacagatcccaagagaattatagaaaactacatttttttgttttgctttattttagaatggtcaagagataaaaactgtagggatcaaattctatacatgtgccaggttgctgaattcaggtttcaaggatatggagcaaaagtatggtaaaggtgttgtagatgcagaagcagaaagattggcacacccaagcagaatatttggctagagcagtaataaattttttaaatgtctactttccagcccttctggggaaaaaagcttgataaacctattgataaaattaaatgatatctgtatttcattctgagatgaagagttaaattcaaggcatatttatgggccacttactgagttcacaagcactgtgctgacaccacagacattctgacacatgctacaatatgatgaaccttgaggacgttatgctaagtgaaataggccaggcacaaaaggacaattactgtacaattccacttacgtgagatggctagagtagtcaaattcatagagacaaaaagtagaagagcagttagttaccagaggctggaaggagggagaaatgggtataatttaatgagtaaagagttgcgactcaggaggactaaaagttctggagatggatggtggtagtgattgtgcaactatgtggatgtacttaatgccactgaattattcatgtattaatggctgacatggtagattttgtttattctaccacaataaaaaacaaagacaagcagaacaaaagcgaggtagctgcaatcaattgggaaaaggacctacttattcttaaaccaggtggcatagtgaataggtgaaaatggaagttggaaatgaccgtggggatcaacaggttgaaaggatcatatttggttagccaaatggatcttgatagatgttttcaagttttacaggtgaaatgattggggcgatgatgagaaatatcaggaactccatgacacttctaagggagaataagtccactgctttgcctgagtatgtaggatagactgtaaacaggagatttttggactggagagttgagtttggagaataaaagaatattgaggtaaaaatgtaattcattgcaaagttggaaaccatggaaggttttaggataagatcttgatataatcaatattgctgtgaacttaattagtgaagcagtgcaaataatgtgtgggagggagagcacgatacaataacagctcttgattttaactgctggtgtcatatgggataagatgaaacaaaattcaatatcgattgaggcttcaatccagttcgctaggagttgtcccattttctcccaacaggcatacctattaaaaagaaagagtttccagaattttccctcatttattgtcaaaatagctcacattaatattatttaaaatttggtgttttatgttggtacaaaatatgtttcagtaagatatcatcacatcattaatacagtgaagttataaactgttatgtttacctccacaaaaaaaacttgaaatctaactaggctgtcccgcgtttacagtctctgcatttacagcctaacatttctcagaaggatgaagagttttaggacaatatatacctcttcatcatgagaagatatttaatgccttcactggtgcagggctacaggaagggatgttgcttctgctgactactgctttcttaaacttagggcatgttttaagaggaaaagttatagctagactaggttggcttttcatttaaacagtgctagtcgctttggtgtcataaaggagcatgggcatatagaatgacataggtgggaacttctgaatgaagatgggggaatggaatttgccttcttttcaaatactgctgataagtaaaaccaaacttaatttaattttatttaaactttgtgacacagggaagttccctttgcagaaaaactttagtgcttaggtttgtatcattttcagtgttcagacagctgctacgattctttactatcttgtagtcatggctatgatgattaattttttaaaacttgaaaagggggaattgcctcaaattagagaaagacagctttgaacaagttgcccaagagtaaagcattttacacatcaagaatgttagtgaagctgccgatactgtaatttagataacagcaaagataccaagctggtgtgtgttagttgttgagacatgtgggtgattgccattttcagtgttctttattttatgccacagtgttgactttttacattgacggtgatgaaaaaaagcccttggtaatatattgaagactaggcttgtggatatatgcctgaaaaattagtaaatgctgtggccttcaaattgtaagaggctcctatgtaggaaacattattctaatgaagaaaaagcttatctggagtatctttaaccaggaattcaaggtagtactgaagactccaacaaaaccatgatattaagccaaatgcacaaacagctcaattgcccactttagaaatcagtccatatattttaagggattgtgtcttatttgtttttgtattccctgcagattttgtgtgcaataaacatttcttgaatgaacagattaagcagtgatgtaggtttttacaacaccagaaatcaaaaatgtgagtaaaattatctagtagttatgaaatgtactttgacttcctttattttctaataatgatggcaatgagttagctgtatcaatctttacagagatatcttagaaatatttccccatttgtttaagacatattcttgattagaagtataactggtcaaagagctgatgattttgaagacctcttctgtgtagttggtcttgactccaaaatgtagcatttgattgatatagaactagtattaaattttatgtttttcaaggggaggaatgatgttctgtacaatgtttgcattctgtggcacagaactttacatcatataatactgaagctggattgataaagaagaattcaaattgagggctaggatgataaactggagtttatggacacaaaataactcagcagttctaaacagtaggagacaaaaagcacaatgatcatatacaatagttatcttctgtttatactttacttactgagcacttaacttgtacaaggtcctgtagcaactgaaaaaaaaaagtataagacgatcatagaatgatttaaggtaaaagagtacatgggatgtggggctgagctgctggttataaatgaatcagacaagatctgttctcaagccaaataaaagagtaacaaagttaaaaaacaaacataaaaaagtattcatcttctaatttcctatagttcattaagaattgaatatatattgaatatattttcttatcttagcaggaaaattcttgaccacacctaagctaagattcaggtggagaagtcaaaaggaaaaaaactgtatgtaatatagatggacgtatttcttggtttcatttaaggtgcttgtttagatcaaacatgagaagcaccttatgtcactttaagttgagatgtggctgtaggatgcaatattgtggagtgtacaaaccagatttggctctaggaagagttagagccacttgcatagctaactttgccatctttctatcaaccagggaagatgagctggggaaaagccaatctagaacatgtaagaacagcacctccaactttaggcccaatcataaggcagatcagactggaagaagcaatgggatttctaaaaggacattccagggctgttgaactgtcggaatcactggaaagatgatagtgaagtagatggaacaataaattgcaattaaagttggagaaaaaaaacaataattattccttcttttcttttctgtcattattaaaaagtgattgcagacttgagattaaagatttctattaataaaaaagaaattccttgcttctgcttctaatctttgaaaataataaaggagccaacatatttttaaaagtgtaaaaatccatccccaacacagacaatgctatgtagttctgaaactgcccagtgatttctttcttctcccatatgaaacttttgataatagaaatatgaatgactttatgttttgatatcaacattcttctcgagtggattatgtggtatcatcatagattggatgagaacatgaatattctgtacagacaccagtatcctgggcccaaaagggctgatgtccagcagtgctcctcagactatcgaagatgaaaattgaattttcattttcaacctcttgcaggctaaaatgaaatcagacacttggatgacattatgatatcaaaccagcataaaagtttttaagtccttattctcagtttctataattgatcttactgcagactggtcacagttttgagtgggaccaatccgtgaatcacactgagatcactgatttagggttctggctctgctatttgtttttgggacagtggtttacccttcttttccccatttataaaatgaagtgagaacatattacatgattgctgaaatccaatgattctgtttgtattttgatgctattttctttttgctggttaagagacatatgttataggtacagcttactatctaaatgctctttgttaggtccaacttatataaatgagtgaagagcatgttttagctgagagtttataggctatatttctgtaggattttcccttaattgcaacactattttcagagtagtgagctcttttgtttccatcagctactttgaagaaaaatattacttcctgggtagctctggactctccagtgaaaccccttactgccatgccctaggtaggataatcatgatgagttagcaggttggtcttgagtgataaatcttcaatttgccttattaacagagatatgagtgttgggttacaaataggtcagttctgaagatggcaaagtacctgcaaactgaatacattggtttcctcttctctcccaatacctctggtgaaaaagtacataccgaaaatatagcaacaaatatgtgactataaaaattgacaaataatatagtcttgcataggaatttaactgtggaaagattataaagccagactgctctttaaccctttctgaattataatgaatggtaataaaactaggcatggaagaaaacatttatctagagttaaaaaccacaataaccatggataaatgattgtgcttagtcacttcttgcctagggtttatgttttagaatgtgttttacttctaggacccaaacccaagttttcatagattttaaaaagttcttctcaaaagagagttagatattaatgggaaagtcaggtgttgttcatgaataagttatctggaaacttttatgttctctctgagaatccaagagaatcaaaactttctctgagaagacagatcctgcatatcgtttaaccatgtttacgcttttgaatgctaacttccaggctttgtctataatcctgtgcctttgttaaaaaaattcacagacaatttatttgccaggtcatacttttaagaattctttattttgtgtgcctctgagaagagaaaatgtttttccaccactacttctgaattcataaatattcttgcctgtatattattgtttttgtggcaaatcagggtacattattttcatagtggatatccttgattgttggcatactgtaatgccatttgccacatacgtggctgtaatgtggctttggtaaggtgggaaggagagaatatgtactaatcaggtgaatgggtcacacacacacacttacgaacttgcttaactgcatcttgctccctcagtctgtaaattttatggctattgttaagctacctgcttcatttctcacctaaaacatgggggaaaattcagccattttatctatacttgcagttattctaaggtgagcttagtgacctagggattgatttagaaaatgtatttggttgttttggttgtatgatttgccactatctgggaaaggtggagaggctatgcaacttttgaatgtatttgctatctcttaagaggtgtattggattggatagattgaaacagtacttgaatgtcctcacaaaaattccaactgaacccacacatgatttttcccctgctgcatatcctaattgttacattttaaagaactaacataatttctggagtgtcttccagagagatgcaaataaacacccagactatgtttaacaaaccttaaagttatactgtcagtcattgtgatgtttgcctagaggcaaattaaattaggtatcttcggtgcaattctgaaggagacattcattcagcatcgagatctgctcttgatgtgttaaatggttgtggctcacagttgtgctgtctccaaattcattctgttgagactgaccttaagataatgtaaaaaagcaattagttttaaacagtaggagtgccaacagtgtgaaagaaacaaattacacggtgggatgatatttttagtgatttttaaggagattattaaaaatgaaatctgtactaaaagctatgactgtagcttttagtcacaaaaactgacacagagcaattcatttatttcaaactgctacaactccctgaatgacaatccaagcccctttctatgtctggctgaaaggtggtctggctcattaaaccacatcacaactcccctgaataatcaagccaaacagtttttacacatgatttgttaagttctactcctttgccttgtcattcaatatttgagcaaatatttatagcacacatatcatgagccaagactgggcttgatgttgaaactgttttttgtaaccctaagctaaaccctgaactgtgttaaaaaatacaagtttatatgcacatacacatacacaaacatatatttatagtttaatactttttttcattaaactaattttttagtttttgttgactactttcagttagaaatcccaaaatattattttactcctttgaaattgttaagtagtaaaacaatagttaaaataggcagaatttttaaatttgaaaatcaaatttgttgtctgcatcacagtcacttacctatatccaggtttctttggccaaggaagaaatgaccttaactttgtgagttagattactatttttaagctcatattcatgaaacttagatgcatgctgatctccttatagatgggtctccaggttgaagttctgacttgatgcagaagctatgcaatacattttgtagaatcaatgtacattccaatgcagttcagtgataaacttaaaaacaagaacaatacaaatgataacaatgaccaacaatcactgcacacttgctcactgccagggactgttctaaagtggtttaacatctgctcagttcactggattatcacaactgcctaagaaggttgatactggccttattctcagttttcagacatggaaactgaggcacagagaagttaaataacttctcccaaagtcacctgactagcgactgaggtgtatgtacacgaccttggcagtcagtttcagagtccccatttcttaccgctgcattctgtggctgaacattaagggtgatctttcttatcaatctactcatgataatttggttaaaatatacatagtcaaaaatcttagtcaaggcagctacattatgcttataatttgatttaaatatgcatattatataataaatgcaatgtgattaaattatgtagagtcaaataatcttaatatagaaagctgttttcagggcccaaccatttagccaggtacttaaatgtttctatatctttctccctcttccctctaacagatgattgagttaggcttgagcattacacttgcttctgtggctgaaatgccacatatttctgccctgttagcacagtcttattttacagtcaatgcaaatgattatccccaaagcttgtctgaataaatcaatatcatgaagttatgctgttgtaatatttttgtgcataaatattctaacttgactaataatagaattcacactattaatgaaaataacattagtaaataaatattaatatccttaagagacattatggaactcagaggagagcagtcctaatttactcaattttcaaagtcattagaaattaggaaaattggctgggcacggtgactcacgcctgtaatcccagcactttgggaggccgaggtgggcagatcacgaggtcaggagatcgagaccatcctggctaacacggtgaaaccccgtctctactaaaaatacaaaaaattagctgggtgtggtggcgggtgcctgtagccccagctacttgggaggctgaggcaggagaatggtgtgaacccgggaggcggagcttgcagtgagccgagattgcgccactgcactccagcctggatgacagagcgagactccatctcaaaaaaaaaaaaaaaaaaaaaggaagtaggaaaattatgtaaataaaatgtttctgtttaatgtacattggaatcacagatctcttttgacttaagtttttgattaagcacttaatctgtctgtgcctcaatttcctcatctgtaaaatatttggaacagtgtatgacataccataagcactataaaagtgatggtttaggaaaaaaaatctctaagggtcaagaaaatgtatgacctattctttgtacttaattgttacagaatagacatttgataatggtctttaaattaccctgtacttttaggggggttatatgtcataggcacagacttctgactctctaatgtcattatgatacactttttttatatatatattttctttctaaatcataaaatgagtttacagcagcagaccccagcttttctgagaagtacctacactgttatattgtgtaatcgctgtaccaactaatatttttcgtcagaatatgtacaatacagagttgaagaatctgtatcaaaatgatcagctgtgatgagcctgagctagagggctttttcacaaagcatgttttgttctctggtgaacttatattagaccatggctgccaacttaaaattcctttcttttaaggatgcaatgttgcataattagtctgctattgcagtcaggatgcttgcacactttattttactcctggtatagaatgcaatagactatcagagttgaaaggaacctctgagaccatctaattcaacttgctcgtaatatagatgagaaaacagcctctgtcagttttaatgtcgcacagcaagttagctgtccattagaatctcagaaataagtttcattttagaaaatctcagttattttctgtataacaaatagaaatagataaaaaaaagtagctaaaaacaataactattttttctaatgattcttttcattgacagagcaggcctctgctccacgtggtaccaattggggttactccagtcactgaagagtttggctgggacacctcagttgcggcacctcagtacttctctacctggactcttttttcatatattatctcattctccagagtctctccatgtggcctccctctctagaaggatattctgggcctgaaatgacatatgtttcagccctaacacaacacagtcttcattgcagtaagtacaaattattgtccccaaagcttgtctgagtaaatcgacatcaggaaattatgttgttgggattatttccttacagcatagtggatgggttccaaaaggctgagtagttgggttctaaactacttagttattctcttgggagcatcccaggataataagctccaatgtgtgggagtgcttatctaaccactgctttatcatactcgtgactatcttttggttgcagcaaatctatggctaaactcagagctaatgtgagagtatactggactggggtatgaattatggaagatgtggttcacttgaagcatcaatgtgcctgcctatcaaaatggcagataatttatgtggtcaaggtcaaggagcaagttgcagtatgtaacacataatgtaatgctacttaaattaattgatttttttttcattacttcagtatactgtgcactgttatgggtctgttattggattgcagaaaagttgaaactttctagaatttgatgagccctgggaatgttcacattggttttggcagccaccgtttctttctttcaggtaatgagattgtactagagtcaggcagctctcaacatttcaacattcaaatgtttgaccataagaccagaaaagatccaacatatttaataaaaagtgaaggcatggaaatactattttggatatgtttcactaataaaaagagcaagacttcagtattagccttctattggaatgtaaattattctgacttgaacccacactgaactgcctgcagcctgtaacttagaaggaaaaaacaaagtgccaccactgaactgctggccttctaacaaatatcacctattagcattcacaatgaaggcaagcatgaatcagcatgaaagtataccctatataaggtttcttttagcttctctcaagtcttgacacacacctgtgtcactgacagctagtatgcaaattgcctaaaagctccattaggctagtctaggcaaggaagcccatctgttcgttccgtgacactttccctcctagatcctcatgtgggaatatgtccttgagacatgcagatggatgaatttgcgccagtgtctggtaccaccaaccttaggggaagttgtcacttctacttgctttattgcctctaatatttgatgtcctcttccttcagatgccaaagaataaaattttaaatctaaaacttcaaagggtggtgaaggtttttaaattctgaatagaaagtacatattactttttaagcacaagaaaatggaacatgatgagccctctgtttaaaaattatggtattcactgggtgtttttcaaagctgtgtgtgtggtctggtgttgacaggagagaacatacaatttcaaattagctagtgcttgtcagctgttgctgatagctgttggaaggttttgggaaagacaggggcacggtgatattttggcaagcttgcctattaaggacatttgctggaaatgacttcatgattcctatccctttcttcttaaaaaaaaaaaaaaagcaacacaactacatgtaagcaattggaaaaggaaattcaaccacttttttctggtggttttttgagtagactcaagtctcttgcccatctcagattgaaatccccagagaaaagttagaagtggcaacaacataatcagaaaagcagctatcctttgatatctgatatccattcatcataaacaggcttctttcattttgttaatctggcctagcagaaagatctactcatatttcattctcaacgaaggtaaggtggcataaaagtaatggtaatctcacctcctgggtaaagaaaacattacaaatcagaaaatcgtttttagaagcatacaataacttgtaatctggaaccagaaagatagatatttcctcttttgacaaatcctcattctatagcaaacaatgtataaagacatctgacatgtttaagacaggacagaaatgatgcttttgatcattttggcactaaaatgattcatgattttatcagattagcgcctgttttccatttttcaggaaatggtccaaaagacatactgtttttattgacaggacttccaaactagttattatttgctaataatgttgtgttaaaaatctgagcagagtgtcttgccagagagagagagagtgaaacttttatgcccaacggtgtttggatgagcaagataattacacccttgtccatagcagatgctctgttcttcgctttggcagtttccctgttcagtgtgcaaataattttctctactaaagttggtagctatttgctacaaatatattgcttttccagcaaagaatggatcttttccatcaccactcacaaatagcaactgaattgactggagtttttattgtttcaaacacatacacaaaactgatgtgaagcagaaagaaactcatatgaatgccccatgtctgtcaaaggatgtgaataaaataagttatttaccaaaatagttgaaaaactacattgtaacaatgatttgaacttatttaaattaagacttttgaagaagtcaatgttgatagtcaaatatttttaaaattcaaatgtgcatttagttagtttataatagaaaagacacttatttacatatattgcaaacatcttatgagctctcttagcccctctatttctgtaacaggcaaaattcactttgtacatatatagtgagaccaaaaataaggagctcatattcctcacagttttgacagtcatgtatgactatgcttgaaatgggtgggtgtattctccctggccagtgatgaacgaatacatttccataagccactatgcttgctttttgggtagcccagatgctgtggttttgtctgtaagcagtatgcttgcaggtgttttggcagagaactgcagaaggagaagggtggagaaaatacatttattatagttcccttttttgttcttaccacagccccagaagcataaaggcaagtagaaccactcctcaagttgccatgttttcatagatacataaggcaacatatacttatctaataaaactaataatataattgggggttaggttgatgaattacccctgagtctcccaagaagaatcattgttgactagacttttatggtaaaattcaccttccagccaaagattaattaagtgccaactgaaagattttgttccaagtatgtatatgtaagtgctgagaatcagaagtgtggctggctgcgtggcctgtcctcaactcttcagcattccaggggtagaaatatctactgaaggacaaaatgtttatcaccagcagggacatgagaaaaaaatgtctcctagaaccttaagcagggaggagataaatctgtctatgataaaggtttctcagaggaggtgaaatttgaatcctgccttcaggatgaataggcttggctactggggaaccaggaggaaggcattttatatagaacagcagcaggaatcaggaggcagtagactgctcattttcaaatggctttttcagagcatgctcaaatactactattaggttagacggcactgaaaagagaagatggccctgtttggacattaatattatttctcttctcacataagaaaaagagaggcagcagaaagccaggcgcggtggctcacacctgtaatcccagcactttgggagcccaaggcaggcagatcactaggtcaggaattcgagaccagcctggccaacatggtgaaaccctgtctctattaaaaatacaaaaaattagctggatgtggtggtgtgcacctgtaatcccagttactcaggaggctgaggcaggagaatcgcttgaaaccagatgcagaggttgcagtgagctgagatcgtgccactgcactccggcctgggcaaagagagtgaaactccatctcattcatacatacatacatacatacatacatacatacatacatacatacatacatacacagagttgcagcagaaaagctaggagaaatgcagtataattttgttaggaataccagataatgatgtgtatgtatatactaataagaatttaataactcaaatatttggaaacataattctagttttatttaatagttacactggtgttacaagagaatatcaaacatggtaggataaacaatggtacagtaggattctaggtacatccagggttaagtaagattagaaataactttcattcacataagacataggaggtcatttttcccttggatcctcagtgctggatttccatttccgtttctaggtgaagagaactgaattgtgtaagggccattcacagaacttaatcactgcttaaaatgttgtatcaaagttataaataactgagtagatcctgtatgaaattgggaacttccttttccataagataataaatgcctgcatcagggacatggtccttattctctttttgttccttttacttaaacttctcccttactggctgctattctatcctcccttctctaattacacatagacacatctatgcttccaccctctttctcctttcagaatgtgcttaaacacacttagtaaaaacagtccattttgggatatcattttctccttgcgcgggagtcttttaaggttttaggatgaagcattattgacaggtaacttgtgtcctttctaatcactgttgaatcatccctgcagtttctgtgtttattcttatgcctgatcacattcgataacaaagcttgtgcaaaatcaaaaacaaaaaggtcttgaactgcaatcaaataaaggggagctacctggttaacaaattttacaaaacatttattggaaaatatatctatcccatgagataggacacagtcaaaggaccacccactttctccattaacatgtggatagctgtctgcttcttactgcactttcattctctaaaaataaccaccaaggtcttttagtgaaaataagtaagttggaaccaaaaacaaaggcacaacattcttctccaaataagttgctcagaaatgctttttcgtgaaacatagtttctagcatcttccattttcttgctatttatccatgcttggaattacttcattcattagttctgacaacggattgtatttgtatcattgcttgacaaatgtgttacatgtttcagtcttaaaatattccactctgagctcagtgctgcatacttgggagataatgttaaatcagcctcgcgacacactgctgtcatcatgccaaataactcagggaaaaatgataagggtataaagagatcaataaggcaagaaaatctgtgctttcaaaagtaaggcaaaatatgagaaagactatcagtcaagcatcggggcataaataaagcaagaatatgccacgtttagggcaccgtgatgctacagtgagcaattatcccatgagtagtaaatttctcttacgtttgcctaacacctttattgtaggtcattctaaaatgtagccatgagattcaccggcacattgatcagcctagcattgctcttttttctcccataatagaataaaatgaggatatggctgataaatgctgagaaggacaattcccagaccatttagatgtgagtggccacactggagtgttctccctgtgtaagaaagatttatataacgcacattttttaaaatatgaattatgcaaatacatttctgcccattgagatgatattactcaacagggccctcgtaagtgcccagttctgttggatgtttagacagaaaacaagcaaactgtagataccggcaatttggaaattaaatcttttattgagtaataggtactcaggcgtgcatcaggaagcaatcgtttttctttttcagcaaagagcattaaattattataaatttgcaacaataaatggaatagcttgcaggcacaagacagtaaatttatgaacatttgaaaatagaaatttatttttgtgtgctaatggtcagggagactgtgaaactggcccagagcccttgaatgtcagtctcaggaaggtgatctatagacagtgaagagaatttcaggattgcttttattaacatggggatgaagtgtgaaaattaatttttgttgggggaagataaagcttaaggctgcatgtgggatagattagagtacttggagcttgggaacaggaaatacaatttggagacagttaccttaatccatatgtgaagtgaagtgctctgaatagaaatagtagaacggatggaaaaggcagatgtgggagacactgagaatgcagcataggcaggacttggggcctggctaagactcagtcatgacaatgaaattttttttttaaatgatgtatccagatgttaaattatcagtatactgtatatctgtggaaaatgattgctgagttcaagtgaatattcaaggcataatgtaggatgaaattttcatgccatgatataacacttggaagtacccttcagcatgtagagccatcaggaaaagtgtccaaaaaaggacatgaaggggcatgggctaaaacacattgtagacagaaagaacaagtggaaacgcataggaaaagcatggcctctgactcattcctgtggactatttagaattaaacatctgttgctttcaactttcttggtgctctccctatttaccttaagtcatttagctctatcacacgagatacttacatctgaaaatggaagatcacctcttgatatgacagagagatagaattttcagaacacctcttggtgtgtgggagaggtggagagatggaggtgtggctggaaatgtgagatagtgcaggtttgcctagaagctgacaaaatttaggctttagggtccctccttttccccaacctcttctataatcttatatctaatcctgtataatcattttgtattcttctcaaaaatggtcaatggccatccaaagtgtataaaatttagatcccacaagatccacattctttccttaactggcaatgtgtttccatggttacatggatttggaaaatttgtaaaagaaatgcattttaatcacaactggtccttgtctcttttcacactagtttccctatttgcattttttttttccttgcagtggtggcaggtattttggaatttagctaagggtaagttgggtaagagatgcatttattttgaattcaataggatccatctttgtgttattgctagctgttttgtggtctgaatggtttccaagaatactcatactcctcactgtaccagtgtcttgggcattgtggcaggaacgtgctgggccaactcaaggttctattgtgataggaatgtggtctctggtgcccaacactggaaggatgtgggaagtagaagaaaaaatctgaagccagaagcgaactctgtgcaaaattcatccacattgttatgcccaaatttactatcctaaccttcctaccattcttaccttataacaagttataagctattaccatttatgagttgtgaagctgaagaaaacatttctgaactatcactagaaaaaaaagtgcctatcagctgttagaggacaggcagaattatctgtctctagataattctccctggagaaaatagtatgaaattactctcatataaagagacaatcaaaaggtttgcagcaaaaaaggagaggggattatttctgaagtgtgtcagggaattaatattattttctacattttttattttcatgttgttcttcagctttttaatattagtgatatgttgaaatttcgtttttattctaaacaaatattcattttttaagtaattttatatttataaattttattctttttttaatgggtctccaacattgtataaacttaaggcacaacaagacctgagtttgtccttgggttcaggggacaccttaattttcataatcaagtatgtaaacttaacctctggctcatccatgcagtccacgtagagttaaatatctgttgctttcaacttttatggtgttctccgtttttaccttcagttagctctccctaatattatcttaattctctaattattataatttgggaatatcctatgggtttatattaagtggaatatattggtatcccttagtatgctgtaccctaattccagttaaaaagaatgtccccctttctgcatagcatagtatttgagaaatatatttaaacagacttttaaaactgtttcaaaacagagatatgtggttcaaaacaaaacaacagtggaatatacaccaaagtcgggaatatctgaacatggaatattattccatttagagaagtttgagaatttaaactagtttcatttcagaaaagtattttcagaagtgacacaatccggtgaaataaagtatataatcagaagtgtataatctactgacaaggaaaggaattgtctatcgtttatcaatactctattatattttggtaaaacaaatgtaaacattatttttactccatctcataatggaacacataagatgtgttcttgactaacaggaagaccaaccattggaatttaagcttgtataataggcaaaattataatgtcagtgattatttttctagttttcccctttgggtcttcaataaaaaataatctatatcattaggcagggatgagatattgattggtcactaaaactagcacatcagctacaaacataactttcactttcttcccattcataaacaagtcattatttgacctgctgggatgtgataagaagttcaaagtaaatggaacacactaggtcatgccattctcagtcttctaatcaagataaaataagtgcagaatatacttcttttttgttattatctgtgtcattgcgcaaaattgtaaattgggtccaggatagaaactggtggccaaaattagaggtgtgtctatttgtctctctgaaattgctaacatatgacactaattgactttgtcagaatcctcagtgctaaatgaaattaatgaccagtggaatccaaataaataaaaggaaatgtgcctttgcgtatagcatagccagattcaggatgaatagacagtcaatgttgcagaatattataatactccaaaaagtggttcttggccaatggtgggtgtgctagaatctcactcttctgcatgactaaactgggaggatttcggcattaaaaaaagagctctgtctctgtgatgtagtgtatactttgagaatctttgctttcctctgctgaaataaggacataactctagagggtgcctattttcattgggtgaaaaatattcctttgctaaaaaaagtctttcatatgagtctactgatggatcttaattcatttgagtaaaagccaccatgctaatagcaaaagtcctatgttgttagtccttctctcattttatttttatctgtattattactaaagcagttttctcccattactgcaaaccacaaggaaaagcaatcaaattgattacatttattgtcttcgagaactccagttataaaactagaccattccatcattctattcattgtgatacttaaaactgtcactctgggtagtaaaatgtgttttcctttattataaagaatacagtttacagtaaaataactggacattctcacaagaattagcattggatgcaggtgccattttttcctgtactctatgcttgatcaaaaggccaagaagcaatctcctatactcttaatacaggtaagtatagaccatatttcagtattccaagtttatctatttatcttttctttgctttctatgctgtgctgtgtgctgagaactctgtattaaccccacctgtataaactgttctactttcattatcttaggacttcaaggagtaattgtcactggatatattttaatctttaaaatattttctcataacagcatttattgtaatattatcattgaatttatctgctgaattctaattatctgttctattttacacatgttatagtgtaggttaaatttttatcaattacctgagaattagaaatctctggtctttgttacattatcataaattttctctaattagatctcttcttcaagtcgaaattctggatggaaattcttaataccagtagtgttaggaagttgacctatagataaaaatattttctctacttacaaaactatcattatagtaatatagtacatagtaacatggtaatataatgagctgtaattctaggctgcttcactggtttgtaaacttagatcaattatccattattcgccaaagtgttgggttccatatgatgttggctatagggagaaggggagagcgatgcatatgtaagtttgtgtgtaaattaatatataaatcttgcttattaaaattttgaacttcacaagctattattaagacccatttcctgaatttaaggaatacttacaccactaccaacatgattttaagaaggcagtttgtatcattactattgtagttcatgctatgctttttgctttggcgatggatgctgtctcaatttagcttcttaccgttggtgtctctgttttcattctgcttaagatgtagtcaattttatggcattaatggtctgccctctgagagcttacagtagaccctgagcatttgtaaagcaagaaatgatgttagtaaagatactttaattgcggggagttctctgttggctggtgaataaggacgttctctttgagttccacctttctttgagaaattttcatgtttcctgtacttttcctctattatatcatggaaacttactaaatcagcctgtgcattccgcccacatattccctcatggtgccttccggtcctagcagctgagccagggccatcaataaatcttcttcttttcccccaagatattcctagttgcttctttactattcattcttgtaattccattcatctgtgtgtatcatttaggatgctgggcagttgcatcgcatttcacctaaggtcacatcctgatgggatttggtgggatcctagagctggctaggaccacttgtgagagctgattgttaaattctccgaaatgacgtgactcagttgttagactgcttaaaggtaaaaatcagtggtgtacttaggtttgtttttttttgttttgttttgttttgtttttatcaacatagctataaatcagggcttttcccttgttttttttttctcgcagagtttcagaatacttgcacaccactaattgtgaatagttttctgttttgattccccacttcttgcaatctgccttttagtgcatagagcaagcactgaggcttctttaagggaagcaaataaatgatcactcctagaacactctatgttatagtgattgtactttagaaaaggctattatcggccaggcacggtggctcacgcctgtaatcccagcactttgggaggccgaggcgggtggatcatgaggtcaggagattgagaccatcctggctaacacggtgaaaccccgtctctactaaaaatgaaaaaaaaaaaaaaaattaactgggcgtggtggcgggcgcctgtagtcccaactactcgagaggccgaggcaggagaatggcatgaacctggaaggcggagcttgcagtgagctaagatcgcgccactgcactccagcctgggcaacagagcgagagtctgtccctaaagaaaaaaaaaaagaaaacagaaaaggccgttatcactatttgccaagttttacatcgtattcttcaaccaaagcaaaaacaaaacaaaagcatcctctgaataatggagatgtgtagaaagtactctggaatgtataaatgtattactatcccattcttatgctgtggactatttgcttcagctaccctagagcatctatcttatgacttgttagaaattcgggagataattaaactgaaaaaaacaatttaagccattgtttacccacaaaatgttcttgcaggggaacaattttttaaaaatctaattatttttagtgttaggagccatgaaattagtatagtttatttcttgtatataaaactccttttaattaagtgcatggatatttagtagttggtgtgttatttaacgtataagttttttccactgacagttaaatatgtcttattttaattagtacttttacaacttttagatatttctcagaatctgtgtattctaagaatgacttcccttataaaaatttatatttgtcttaaaaaattcttctgagagtcttgtcatcagcttatctgagagcattctaactactatcagtagctactattagtagctcctctcagtagctagaataataccaactaaacctaatgtcccattaaagaaggacattctttgacttataatctagagaatttcattctgacaagcatcaatggactttttactttgtatcatgagattttaaatcacacaagccagagttggctagatcagtcaacaaaccaatatacctgttaaccaaaagaacgttactgttcatgaaaacaatccatattataaaaatgctttaggatttatgtgataataatagctagcatatatagaatgctgtgtgccaggttttattctcagtgctttacacacaatcactcacttgaaatggttaacagtgttctgaggtagctattatttcaattttttgagatgaggagatggagacaaaagaggtggcatagaggtaaagcaagatttgagcctgcgttgtgtgtctgcaggatctatgtccttagacactatacaatgacaataatgttcctttcttcttcctgagcctatgaagagtataccaatcaagggcaaatgccctttaactgccagtctctgaagctcaattacttctttaaaaaaggacaatagcaatttggagaagaaaaagcagaactgtcttattactagggatagttccttctcttatgtagaatatcaccagcccaaaaaaaaaaaaaaaatctccagtaataatcacacaaaaaagaaaagatgcatctggaattggatgtgcctatattctttcgagaaattctctaaggtttgaggtgcattgacttaaaatatactgaaaatgggagtcctcatagaggtttataattaagagcaatagaagtttgtgtaaatattttataagtttcttattataaaaattataataaatttgataatgtaaattgcctaatattcattttatcatgaggtatttttttcttaaacttgaacattaatttattctcatagttaccacctcacagccccaaacataataaattttgaaaatgtatttatagaaaattatctgtgcaagtgctcatttcaatctttacaatgaagcaattactttgcatgtattaattcctgtcacatttttgatctgtgctctaacattgtcttcttgaggaaattattatgttttatagttcaaatttcttagatttaggacttcaaaggcctaggttctgttcacatttaattttgctacatcaataaaatatgaatgaattggctaataaagcaacaaaactattttatgtcatggaatataggttatcgtttatgaaattgctgaattgccctggtaattcactgtaagaaaaccttctcctttttttgccttggtcctgtttggacagaaataaaattggtagcatgtgtgttacatggaggatggcagggttgcgggggtggtttctcttttgggatggcaggtaaagtagattaaatggtattgaaaatgctgagggccccaggcaggcagcttgtctgccaaagagagacacatttactctgtacctacagctaatcttaatttctatcttttcttggtatttagcaattttacaatttagatgaaagtttggttattggttaaaaagagaaaatacaccttttcccctcaaattatatttttacttcctacaaatcttttaataatgtgcatgtttggtcaggggaggtatcagttgaaagagaggttttatatgccaaaatataaacctacttcttgagtgtgggaggaagcttgaatatggtttctactaaaaggagattaattacattttaagaaattcctgtaactagtagcatagcatagaaactgtgaccattatttcatcagcacatagtatgggagattatatgttgtagctataagaatgatatatattagcattgtccagtagaactttctgtgatgatgagaatgttctgtgtctacctgtcagatacagcagtcagtacccacgtatgtttttcagcatttgaaatgtaactagcgcaactgaagaaatacatttttaaatttaagttaattttaattaattacctgtgaatttaaatagctgcatgctgctaatgactgtcagattggactgtacatatttatatttaaacctggagttaacggaggtgaagactgcttagcttcaggtcctgggtatgatgctgagcagctgaacaaccttgaaaagtcgtttaacctccctaagtctcagtattctcttcttcaacatagagataataatagttcttacctctaagagttctgagatcaggaaataaatcaatgagcataaagctcttagaattgtgcctggaatataatgtatgctcaataaactttagccattgctattcttattttataatcttttgtagatattgatgaagtagaaactgaaaaagtatggaaatgaaatagctctaaagtaataaaaggaaaatgtcctgaatgggtataattttaggtgatccttgaggaatatgtgggatttggataaatagaaagtaattacagggtgaccatacaccctgatttgcttcagacaatctcaattattccttgtgtcctggtttaattactaacatccccctcttttgctctcaaattttcccggtttgtaagataaatattaagtcactgtagaattagatataggagtacagcccaggcgtttcagatgcagggaagataacatattaaggtatagatgcagatgtgactatggtgtggtttgaatggtgagtactgggaagtagaaggaaacagggatacgtgtaggctggacacattatggagttgggatgagaactggtataaggaaattagattggattgtatatgctatttgcactattgttgaattgctcctgtgtcaacatagattcactttcagaaaagcaaagttcccatttaattggacaaaaatatttggtgtatcaaaaaaacctgatactattttgtgttctgattgtatttccattactgacagtaattttcgttatacgtaattgggaacaaagtgtgttatttctatcatccctttgctacaagtaaccaaatcagtaatatgattggttaatatggaaactagtcaattaaaatggaaaatgcctcattattatctgaagccatgactttcacaactggaggaaactttgcaagagttcatttagttgcaataaagtattatcactgaatattttatgttgctctttaagctacatccattgtagcttatcactgcatattttatgtagctctttaagctacatccattggtcttcattctacttaggagggtgtacattttaaaaaagctaggggaggccaagcgcggtgtctcatgcctgtaatcccagcactttgggaggccgaggtgggcggatcacaaggtcaggagatcgagaccatcctggctaacacagtgaaacactgtctccactaaaaaataccaaaaaaaaaaaaccccccaaaaaaaacaaaaaaaaaaaaacaggcgtggtgtcacccgcctgtagtcccagctagttgggaggctgagtcaggagaatcgcttgaacccaggaggcagaggttgcagtgagccgagattgtgccattgcactccagcctgggcgacagagtgagattccgtctcaaaaaaagctaggggaattttaattgttggcaatattactaattgtaattttagggaaatagagtattagactgtaggaaaaaccccgtctctactaaaaatacaaaaaaaaaaattagccgggtgtggtggactgcacctataatcccagctactccggaggctgagacaggggaattgcttgaaccaaggtggtggaggttgcagtgagccaagatcatgtcactgcactccagcctgggtgacagagcaagactctgtctcacaaaataaaaaaataaataaaaaatagagattatggggaaaaactgaactaaaatattaggcaaatatatctttcttattaagtgtaagaatgttactctaagcataattgttgtacatttctgaagacctctttatctctgattgcatttgacattgacatggttggctagcccagaaatctccataaagagtttctggtgacctgttctgggttttccctcattgcctacttattctagctcatcgtgaaagcaggcatttgggttgatctctgaggtattccttggacaaacacagcagatattccattatggtcactttcagtatttctggagaatgctctgattctaacaattattgttcatattgtagctaacactgtaatctccagctggggaacacatcatggctcattattccacaaggaaccaatcattatcaatattggagtcctagcattttgggttattttcaaggtatacacttgactttttaaactaattccataagcactgcaatgtctgaagtatatgttaattttgtttgtttgtatttaaagagataaaaaattagtcaaattaaaagaagaattgggcaaagaccagatgtcactgccatttgaaaaactgataatctttataaaactccattgatgtcatttatagcaccactttttgctagcttataaatttattaatcaaatttgtttataggtgcttgaactgaacaataactagtttatttgtgtttccaagtaccatgaattttaaaatgtcatttaatatctaagcctctgaatagaattcaatgactttaaattaaacctatttgtaaatagcacagagcaatgtgtgattatgcaatctgctgaggttttcaaaaactaacatttagagcaaaagtgaatctcattctaacagaattttaataaaaactcagtagtgatttgtaaatgctttgaaaccaattagccatcccatccacaatgattgtttcatcacagcttagttcttaatgaaaatggcaaaccacggttctaatgacataatttcatttcaagaatagtggctttcatgtttaaaaaataattggctctttagcacccccttcaaggtgaattactccaactagaactgagaaggcaacgctcatattgtgggtctgccttgtgatgatgataatgacaatggtaatgatgagaaaacaaagaattactgaatattggctctgtgccaggccctgtgctaaacatttgacacataatttatacattttagcttcacaacactccaatgaagtgaaataatcataattcctctttcactcatgacaagaggtttaagtgcctagttagtggtggagctggattcatagtgggtaatctggagctcttaagcaccatgttaccactgttgacagcagctattacctaggccagttgatagagaatattcaaatgattgcctttcatgaggagttttgtcttttattgcttatttccatatctagctttgggtaggaaaagagaagtaggacagattttcaccaaactgttacaaaagacataattgaaacaattgtttactatgcttgtattctagataatggagaggcaattgcctagcataaaattgcaaagccataatgtatgtggttcatgaaaccatggctgtaattgcatggcttgccttagatattaatttagctgcatttgttattacttgcacagagagtattcatattcaccctcatttaaggctattatagacacactagtgactaccacagttcttatcgtgtccactctctcacgttgtgttcacactagaggagaggtctgaagaataaaggttatgtggaaattacactatcaaggagatgaatccaacagcctgcagcagtgttatccagcgagcaatggattacatgtgtacgtgcaagctaaataatgtatgatttaagacaataaggtagtatgtattcatttttggatagtaaaagagatggcatgtcagtcccttgggagattttatccagggctttacccttgagtggataaaaagagtacaaattctattgcataggaggtgaataaaaacaaactggggagaccatcagcagaacagactgctgtgtgatggagtccagagctactccaaaaccaccagaccaactgcctcaggatcctgccagcaaccagatgccggcaatagaactgactgcagtttggcatcagggctctgtgatttccagccaaggggaattgcatgcaaaaaatatttaaaattctctttgtaaagaattatgttttcaatcagaaggagaagtatgtttcagacttagtctgctgcaaatgaaatgtggcatactgacatcttggttacagatggtggaactgcgtatgttggagggggtgaatgccatgcgaagttgaactttggtttggtggtaaggttttgtttacggtttttttaggccattgagttagtatcattctgtgaggggtactgtactggcctttcaagaagatggtctggatctacttaaaatagtgattctcaactggaagagatttcccaaccctacagggggacatttggcagtatctggagatatttttggttgtcacaactttgggagagggcagtgcaactagcatctagtagggagaggacaggaatgctataaactatgctaccatgcacaggacagctccctaaaacagagaattatcttgtccaaaatgtgagtggtgccaaagtatggaactaaggtttaaaattatctggctcatatatattcactacaaccccgcctgcagacaagtgttcatcaaatatagtttgatagtgtataaaaaaattgttaaataatttgctttactctattgatgtgtgagcaacatttattgaatgtcccaaatgctttctgttaaaaaaaaaaaaaaagaagaaaacacaactaacctttctccaaacctacatacccaaaccacagattttacaaatgtaggaggacccagttgattcacttttcaaacttgaaaaatgaggtatatgaacaaagcacactaaatgaatcagctgtttaggaagatctacaagccagttcattttcctgttattaaataacaaaccatgaatcttgacaaatgaacccacttgtttgacagtatttgaaaaactcataacatgcttggttctgatggtcacttcccctttgaaattacattttaagatggacttcatttaaattctgatagagaaaaagagccttttaaccttcattttgactgtctgctgtttatcatcatcattctttccctcctgctgatacttagatgctccagagcttttgccagagcatcatcctccagtgtttacttcaaggaagtgtttatgtttattggtgtccatataattaagagctaaagttctgcagtgttgtgggagactgcgtggcttctggagtcagagtccctggcctcaagttgggctccagctgtgtgaccttgagaaggtcatttaccctttttgtgcctcagtttcctcatttgtaaaatgagaagaatattatttgcctcattgtgctgttgtgaagatagcatataaaatgcttagcaagcacaaacggatgctacctataattattaggattactattttaggaatagcatgtttcacaatggatgccaattcatcttatttcatttcctaaagaggacattggcactgatcctctgagatagcatccctaatgtgtggctgaagggctttagaccctattccataatccctaacagaaccttccagcaaagctacaatgactaaacatctaagaaaaatctgcatactaaccaagcatatgcagctgcaagagaaatcctctatctctcttcttcaatcagagtgtcatccaaaatccccttctgaatgtgccatttccaccgcttctaagctgacactgcaaattcatagcaaccccttgccctgttatagcacagtgttacagtgttcagtaaccccagaccgtaagtactctctcctcctaaataggatttataaagtgtgactttgagcaatgtagcaaagtcaattttatctgcaggaaaatatttttctttactaacattttaaaatcccttcctcagtgctccaaaatgatttaaaagctaatcaatgataaaatcccaaatccctctaaagacaaagaattgagaaaggaagcagagccactttaatcagtaaaggggctgctgtgacccattaacccctagagattattgacacttcttttatttatttatttatttatttatttattttttaagattctgtagtttggtcatatgtctttggcagcaagaacatacaaaatcgcttttgcttttcacaaattaattcatttaggcctgtgcatttgtcaggcattccgggaactttctgccaacattttgttgattaaaggatgtgtatttggaatatgggtggagaggaaggaatttataattcttaaaaccaaagaatgatttataatgctgaccgctacctgaatcaatcagtgcatcatcaacagataaatgaaatactaaagataaggaagagttcctacactgggtgttaaaatctgtggattgattggttcaataacaccgagaaaatcgaccgctttcagcagaatttctagaatttacgaacaaggatatgacaaagaaaaccgcctttttgtattttgttcagaaagcttctgaaatacattctttcttcacaagtctggtgcttccactcctaattataaattacatatctcacttcagtgcacacaagttcctgatcctcatcccaacttcggttggcttttgactattttgttaatttttttccctgtgaatttgttgggccttttggaggacacgtttattgctttaggcatcatgcaatttactaaatggtgttctggttatggaaatgcttacaaagagccctaggggggaaaagaattaagtaaacacatattgatcatcctgtagctggtgctttcttatttgattagtcaaggactcagtctgaactggtccttctaatctgtgatacataaagctggagacatttttctggctccctggtggttttaaaggctaaacaaagtctcatttttgaaaaagcctgaatgcagaatggaattcaaagaatttggagagaggggaggtgaaagtggtagcaaacagctttaaaaaggccctgggaattttaagagagtaaggcatataagggaagtaaagagaaatctcatctgacccattatgagatacaccaggaagccacctcggcaagcatgtactgaacacctactgtgtgcaggacttgtaaaagaggtagagcttaagttttgtgaggattccaagaagctaaacagaatactttatgtcaggaaataagtcatagtttttgatgctagctaagaaacttgagctttctgtagatattaaatttcaaaaggcaatgaatatattctatttaatccaaataccaggaaaagaaggttttatcctgtataattcattttaaaattcattttaaaattctatgtgaaaaatgttgatactaaagcaatactaaagaatagttgagaaaaatgtttctttctttctttttccttttcttttttttttttgacagagtctcactctgtcgcctggctggagtacagtggcgcaatctcggctcactgcaacctctgactctcgggttcaagtgattcttctgcctcagcctcctgagtagctgggattataggcacataccaccatgcccagctaatttttgtatttttagtagagatggggtttcactatgttggccaggatggtcttgatctcccgaccttgtgatccgccctcctcagcctcccaaactgctgggactacaggcgtgagccaccgcgcccagccaaaaaacgtttatttcaaagaagaaatctggaggctctgggttttgctcctgtcatgtctattctttcacttgtgcatttctcaactgttggtcaatgtgtgtttgcgttgcacaattttctttctttgttatttttactttttattttttctgagactgggtcttgctctgttgcccaggctagagtgcagtggcgccatcatggctcactgcagcctcagcctctagggttcaagtgaacctcccacctcggcctcctggatagcagagaccacaggcacatggtaccacacccagctaatttttgtgtattttttatagagatggggttttgccatgttgtccagactggtctcgagctcctgggctcaagcagtccacccatctcagcctcccaaagtgctaggattacaggcgtgaaccatagtgcccagtctggacaattttcttattcccaacctaccctgccttcccaaaaataaggggcataaaaggtgaaacatgatagaaagcttgaagctcgctgcatatgagatggtacagtctctggctgagggaaacaatgggaattcagagaaaaggaggtttccaggaggctgtttgagattttggtggctgactgtattctgagatttagaattaagaagcagataaagctaacaccaagttttctagcatggagactggcagaacaacagcaacattgaaagatatggggtaattgtattgggtggctggtgtggggaattgggaatgagagaataggtgcaatgggttgcatgtgatatactgaatctaaagcacattgtcttatagacagtgggaaatagggactgaccaaatttaaaatcctggaaggtgtaaaacagattactattgcaagaaatgaagctgggtactgctaaaacttggccttctttctctaaatgctaagtgctgtctttattccattttttattatatatatagtaacctaaatatttctcaagcacctactgtatatcaggcactaggctacatacatgacatactcatgtatggtttgacacattccctgctctcaggaaacacagattactgttagaggcaggcattaaataagccaaaaataattaaataagacccaatacactgaaagctgtgaaggaaaataccagagtgttgtaggatgatacttaatttgaaatcagaaggatggattagagccagccgagtagagtggggctgagaatgggaagggtgaaaagttgggagtaccacagtgtctggtctaagaagtgattggagaaaaagtctgataaaaaatcatgtggagctttcaggactttgtaataagtttggtgggaagccactgcaggattctacatacaaagtttagctgtctgtgattaaggccacagtcagttctatttccaggacatctcattatttacccagacccactaggcctgtcaatttggtcagcagcagaagttttgggatgaaaagacatactattttcatgttgaatatgtttcttgaggtttttttttttagaatgaaactgtagagacacaaagtacatttttttccctcagattatattattccttacctttatgccatggcacaaaatgtattatagtttgacctcatctgaatacttacttgctaatgtgccaaaaatgtgctgtttgacaaagacatacctcccaaatctgataaaatagctaaagactcttcatcttcagatgagaacccagcccaaagtttccccactggaatcttgatgaatgtgcttattttgtttttgggtagcatttggggtcacaactgagaaaatctgggacagttatataggttgatattactacaagacagatacaaaccatgaatattcatattattgttatttttgctaatattgtacacttattaatttctaggaaccattttgtttgcattaactcaactttttgaaaaaatcttctaacttaagagagtaccgttattatctccttcgtattaatgagaatgctgcttctcagagaggttaaggcaccacttaaaggtcacatagccagtaagaggcacagcagggactcaaccctagacagtcagtgttagttgagaacttttgaagatatgcctgtataaaaaaagaagcataattagtaaatatatatctatgaattctggtatgtataattttaaaaaccctcacattgtttattgcaattttctgggagtcattttatcattttaattttgccatataataatgtaatgaattaaaacagcggttctcccagggggagattcctaccagcaccagggagcatttggcaatgtctgggaatattttttggtgatcacatctggggaatgggcattactagaatctgggagatagaggctaaggatgctactaaacatcctacagtgaacaaggacagtgcccacaacaaataattatcctgtccagatggtttatagtgcctaggttgggatcctggattagagtaatttaaagaggatcttgaaggtaaggaaagaatggtagctccatcttgcaaacaaggaacattcaatgtaaagaaacgattttgggaatatgagaaagagctaagatggtttcattcattcagtcattcatagaatcactatttataggaatgatttctttgtatcaggaattatgctgaacagtaatgttgaggaaaacaataggagggagtttctttggagaaaaggagggaacaaggtaatagagggaaaccaaagatgcttgggtattaaaggtaagctagggtcagagtttattgccaaaagtgactgttttattttattagggaagaagatatgctactttaccaatctaaggagagtcactatagtcagagacaagttcaaatgccatatgctactgccaggagcacctgataactgttttttgtcccttttatggctgacttatgctgatctgaatggagggccagggcgggggacgatattcttgaatgcaacagagagtagtgatataaatgtgtgtgtgtatgtacgtgtgtgtattggagaagacgcatagcttacattgatttcaagttgtgctgctggcctgtgaataggtgctggcttttgtttttccagtaacagctttttctgtttccagcagtcctatgcaccagctccccaccccatggctcctcccagccccagcacaaacagcagcagcaacaacagcagcaacaacagcagcggggaacagttgagtaaaaccaacctgtacattcgaggcctcccaccaggcaccactgaccaggacctaatcaagctgtgccaaccgtaagtgtccttctgctgcccgtgctgtttctcactcccatacttgccttggtgggcaggatgtgttatttcagtcaatgtactcatccactggtgtctcagtgaggaagactcttctttacaaacaggacttaaatttgagattcaatgctagtttattttggggagtggaattggtttactttttgttgttgagtggaagttcttgagcacatatacatggaaatgctggctgattcatagatatatgacctgcaagatgaagatcaagtaatagagttacactctcaaaccatgtggccagtggagtcattgatgagtctcatgaaataaacgattttcttgagaagtattagtgaaaggaatctcaaaaactcagaagcggtggatttcaggattacctcttgtgttacaaagcttttctggccagtgcttggtaaatgtccgttcagccaggaccatgtatttggagaagcataagactaatcctctagtttctttgaaaacatctgctgcctagtccagtgaagctatctcccaccaaggccaaggaccacactcactaagtagttttatatttgcttggaagcttggaaatgattaaatcctcttcaaaaatgttttcatgaatctactatctaccaacacttatgtcattaattctcttatttctgtgcaaataaaaacatatttaagttcaccttcccataaaattaataatgaattaagaatcatagacctggccgggcacagtggctcacgcctgtagatcccagcactttgggaggctgaggcaggcggatcacaaggtcaggagatcgagacctgactaacacggtctggctaacacggtgaaaccccatcctggctaacacggtgaaaccccatctctactgaaaatacaaaaaaattagacgggcatggtggcgggcgcctgtagtccgagctactcaggaggctgaggcaggagaatggcgtgaaccaggaggcggagtttgcagtgagccgagatcacgccactgcactccagcttgggcaacagagcgagactccgtctcaaaaaaaaaaaagaagacgaatcgtagacctgtattttttggttagtatctgattattttcaaaataatattagaacatatatttgtcatttgattgtgacttagctgtgtatttttaaattttaaaaaactattactcaattgttatttttctcttttgcaatgctttttaaaaagccatgaggatatttattttgtaaatgttctgacctctaaaatattgaaagaggaaaacaaagcagaaaatatttatttgcctttgtcctagattttaagattgggaatacatatcaacacaacagaaagtggcagataaaccaaaatacaaatacataactgtctaattgtttgacaaaacagtaggtacattagggttggagtcccctgttgctactgagtgccttgatttgtgaaaaaggcaaggcggaaccttgaaagataaatatatatatttttaaatttgttcaaaaaatgttaaatgtgccaaagctcagacatacaaatatacgttagattttggcccatagaatattgaggttgagaatcagaagataaataactcaactttttcttttgttgtttaaaaaatctaaactctattttgaaaagcaaggtctttgaaaatgtgaaacattgtagactttatgatagaaggttcaggtgaagtaaaaagaaaaatagctattgttcttaatttatatttgaaactcatttatttttaagggtagctattagggaaaggttctttcttactggtctttaccacttgtagagcctgttgacacacagatgtctgggcccaaggaattatgattcactaggtctggggtagagcccaagaatatgtatttcaaacaggatctttagtgttgttgatcttttgtgaagcacttctctcaacagtcttgaagaacaccaactatttctattgtataaagtttcactaattgatgagggtagttgagatggaattttgagtgttaaaacctgttcaaccactgtgtaatcttgaggcatatcacttcctccctctaagcctcagtttcctctttcttaaaagactgggttggtttttattatttctgtgtttacttgtagtatcagcagtgtgctggagctggctctgactaacacacttgagccaattgttacatattcaagaattttgttagcaatctgttacagacttggtagcatgaaattggcccttgtgggagtatttataacacaggaatcagcacatcctgcaaatcagagctttttaaaattttattttattgaaaagctgctgtatgaacacaccactgatgtagcatcatactatgaattgctgtgtcaatatccatttctgcatagaattgccagaattttgtaaatggaaattattacttaaaagcctatattgccatttttaactcagagatgtggtaacacagaaacattgttgagggaataagttttgttaatgttttttatgtgcatttgataaagaatattaagtgaacagaggataatagttacttgttcatattaatatttgtcagctaataagatctggcccatttattgttattgtaaaagtgtttgtgggttctcctgttacagcagtgatctagaactgggatttattgcttagattatttttcctagagaatcttaaagaactgatgtgattgggcaacataatgtagtggaaataactgtgcactaagagatctgtctttcaatcttggctatgctatcaactgagtctttggccttagagtaatgactttttgcctcttaacgttggtttcccccatatacaaaataatggatttgaactcaacaatcttttatgttttcttcattctaaaattttgatatttgattgaagacctcattatttatctgccagacttactcaagattaccttttgtatctttctccaatcccctcgtgcagtgttggcaggggcacagtcagaatttattcagcttcatgggtatgacctgatggctgaaaaaacctttggtaagagaccaatgcaggtcatttgtaaaaccttgcttgtttctctctctctctctctctctctctctctctctcgtagtgttggcctctcacagtgcttgttaccattttacattaacagtcttctaaagattaaaatcactttccattcctgtacctcatctcacactttaaaataatttcactcacacaacagataattttagtagatttaaatgaacttgccatcaagattcattttccatatttatttctatgaaattataagcacttttagagttaatattccttataggaaatgcaatatttgctaatatccattgtaataaaataatagaaaacagatacacaaaacagcatattgtctttttttaaaaaggcatagacatattggattttctggtattagtatattatatccatgttaatgctaatgaacggtaagaaaattgtattaaagaaaaagaaattgcattatttctaaatatataatctgagagcaaattcttattgaggaattctattcacattcatcatcaaaacttctatgttcagatcacaagtaaaatcaaagaaaagaagataagactgaagaacaataaatataaagaatgattttactctatggaaaaatctagttgtacctatgttttggatgaatacattatactgtgcgtagcgtagaaaatagtatagttaaaaaccttgtaatgtctttttcttgagacaccttaaggaactttattttgttctcaatcaagaaatatttacagattatatcctgcatgcctgtggtgaggagtcagtggtgagtaaatttagataaaggagaaatattatattctactagggaaaatgggcatcaattaaatatatgatctgataaaaaattgcaactgtaagtgcaaaagagagaggagcatgatactaacagattttttagcacaagattagacctagttagggcgattagcaaaggtatctctgaggaagtgacaattgagctaagattagaaggataaatagatttaactaatctagaaaaaagtggaagagcagccaggtaaaggaaacattgtgtgcagagccaagggctggagggggcatgccaaggacaaagggctaagaaaaagccacgtgactatagcagagagaaagaggtaaagtgtggggcaaaatgagctagaaaacacgaaaggacaagatgattcctttggagatgatgttagaagcttgatttatcttaagaacaatggaggaaatcattgaattgtcataaacaggaagttcgcatagctatatttttgtttcaaataggtaactccagctgcagagtacggagaagtgatcctctgagatcaaggaacaattagagtaggaatagttgaaaagctgaaagaagaatgctttttgttcagagaagagggtgtgagaagtaatattagtggtggtagaaaaattatgtgtggtgaaagattttgtcatatgcattcttttttccgttaaaaagcagggacatgggaacaattaaccaaatgaacttcaaaagaaacagcaaagtagcacagaatagaacccaaatgagttgatttttagttaatctctttttatttatttatttatttttattattattatactttaagttttagggtacatgtgcacaatgtgcaggttagttacacatgcatacatgtgccatgctggtgtgctgcacccattaactcgtcatttagcattaggtatatctcctaatgctatccctcccccctttttcttacccagtcttgaacgggtcatcaatatactgttaaacaattaaatggctgtaatattaaaagcactaaaggcaatgtaataaaaactaggaatccaactgattatacagatttactcatggatggatgatcagttgaagactactgacagaacacttggatcatatatatcctttatgcttatctcaggaagaccagacggaagtcggagaagatagatttggtttaagaaagagagagagagcattgtaacttttttgagccagataaaatatttgtagtgtaatgattttttacatataagttatattttgtccttccaagaaattggtaacttctattttatgattctgaatatgccctggaaacacatttaaattgttcctaaaaaataaaatcaaacgtgcatcataatgggtagcatttacaatggaaaaaaatcattattgtatttatattttccacatctacaacatattttatctaaccattttgtggcttataaatttgatttaatacaatgttctcaggaagccccagccaattgcccccactttcctgtgattgactgctatggagttaattaaaatattgtgaaggaacagagtgcattgtttttctattataaagtaaacatgccgctgctaaggccacttgaaacagaatgcaggaaaatagagggaaactcttgggtaggtacatacatatttccagtccttaccagaagagcaggaaagtcaactgccctgcccccacacttttctccgtaaatgttttctttgctcaagtcatgacaccctagcatttccccctttaaaatgaaactctgaatgtcactttaacatttaaaaagagaggggaaacacccacaatgaaaagccagaggaacgaaatagaagtgtttgcgctggagagccgaagggtctgcccaagctaatctcccggacttttacacaaccctgttggatgtctcattatagtgcgtgctgaacgctgaatagtaagagccagactcaagtgccatccaggctccgagcgcagagtccattatacatggtgtcagacagttttgacaaatgcaccgacacaatcaaaccttttatcagtttaaaagtaaccttgtcacaataatctgtcagactgttcagatacaactaaaggaaaacaagtcatcatgcactccagggtaaacaagtaaataagaaaaatgtgactggaaatttttagagttctttcttactgtgtcattgaagatttaaaagtttcctctaataagaccctaggaaatttattagtagctgtcttctgcaagtcagactcaaattacgcagctgcttttgagatgtcataaatctatgtggtggcaggtgtgagcaggaagtgaatactggaatctttaaaccctgcctttgtgtattttaaatgagagagtgctttaaagacccaaaacacgatgttggaattccttgattcagcagagatttgacaatgggttacgtatattcattcagatttgggcaaaattatgtttgccaagcatctgctgtaaactagacatagtatttgattagtactaaataattgtcattaataataggttgttatatttatatatttacattaacacagttattgtatattacatgcctcatactctactaagtttttaaattatttaatgttcaaaacttccctatgaagtgggaataatactttctttaaactgatactcaaaagggttaagaaacttgttcaaatttatgcagccaccatagccaccaggattcaaaatctggatctgacttcaaagccgatattcgtaatcactgaaacattcatataatgagaataagggtggcataaatcataggttctcagttccatgactactcgtgagaatcccttagggaccttcagaaaataggtttggacctcaagtgttctgatttaaccagtatgggtcaacctggattttgggattttttaaagcctgctcagataattctagtatgtagcaaagattgagaacttttagacttaatgatgctcacacaaatcggaaaacataatttaatcccctgttttagctctcttactctgactttcataggctctagcaatttcatgggacctaccactgtgctttcaattatccagaagtattaaaaatgaatattattgtgaaaatttggggatgaatttgattttctgataacaaactgacattttagattaggcacatggataataaagccctggaatatgcctctagaagtgttttcaaggatgtccttggaagaatcttactttcctgctttatataatttccaaaagtcaaacatttattcaacattctactttttaataatgtttgcatttaattgatgattaagcaagaaactcttcctattttgactcatatgattaaatttctatatatacttacatttttttgccgactatagtttagtgaacaaaagtccagtgagtcttaaaaaataatttacatctcctagtgttttgggggcatcctagaaattattgtcccactgattcattgatcactcatttattattgtttttattactttgaagaattttctgctgaatgtttacatatctcatgatcaatttaaaaatatacttaaattcctgatagccgatgatatttttccatatctatctttggaacagagaagagaaaaataaaaataaaaaaatcattgagaggaccaattgacttagtttacgatcttgatggtagcacaaaaaagatggagatgtaaaaagatgtgatcaactctttctggatgtgctgagtaaacatctggagctcagagaggtggaattctaggcagatctcatgctgaatgcctgaaaatttgagggacttgagttttaagggcgggactctggcaagttcagatggcatcctggttttctatttgtccagtgattttttaattgataaatacagctgaccctttttagtccttattttaattaagctctctgttacttgaccctgttgacccctcctttcttctcctatggatggtaaattccttttgcctggatttcctcttaccttttggagattattctttctactttctcttcttctacctgtctcttgaatattttggagttttctggagattggacccctcttttcactctataaactgtctgctctttattacacaaacaacatcagctattctaatgactaataattctatattgtccaccatcaactatttgtttagttctggatccatatctcattattccctagacaattccagttttgtaacccaagagctatcaaattcattgtccaaagagggttattcttggacttatcccttctttaagggatcccactattctctatgtgaatagtggtccaaataaaaaatcttggggtaactcttttccccagtctagaatcaatttccaagacctcaactgtttgatatttatgatacccaatagctcgtctgcttcagtactgccatggtctttttactcatttattcaaacgtacttattgattgtcatctgtgtaccaagcactgcagatatcttaaggattggtaagtttttccatataatttgcattctaatggataaaaatgatatatgaataaataattaaaaaacattagaatatgtaaatgtcatgaaaagcaggttgtaagtaatgactaggaggttactctagactatgtgttctctttaatgtgagacttcatttgcaggaaggagtcaggcagataatattcagaaataatgcattacagacatatgtaagaatttggccaaagcttgaagaaagaaatgagcttgttgtatacaaggaacgtaagaaaggttatgtattcttctgcaaagaatagattttagaggagtacaagagaagaagcaagaagacgagcaaggaggcttttgtggaagtacaggaaggaggtggtgatggcttggaataagatcacaatggtagaggaggttaagtgggatgaatttggaatatattttggagatagttttgatagcatttactcatgaatggcatatgacaaaagggttaagagaaagagaaattagggataacgccttaactcttagcttgagcatcttgagggatgactccttaactcttagctggagcgaatatggagccatttcagaaaatgaaaaggattgtggaaagtgcaactttgggtggacagaaatcaagagctcttcttagtcttgttatttttgagactgtattatacatctaaaatgagctttgcattgggagtttaatatctgattctagttttcaaagtgaaaaagtaaaggatataaaatgggagccataagcattataaatggcttttaaatccatattgatgagacaatagtgtggtatctaatatgtactacagactgttctaagtattttgcacgtgagtacttcatattacatatgttaactcatttagatgtcatgccaattcccattttataggtgaaaaaccaatgacatgaagaagttaagtgactttcccaaggtcacacagctggtaattagcaaatccaggctttaaattaataagttttgtttaagagccccatctcttaaccatgatccatacatagggagtgtgtataacaataaaagaaaatgttcacacaacttgaattctgaggttctaagagaatgagaaaccaagaaagaagtttataaaggaacaatcagtatggtaaaggacaaccaggagtgcaggagtgtgctataccacagcagctgaaagaagaaagtatttaaagaaaacagaatgatgaaatgtgttgaatacttgctgagaagtcaagaaatatagggagagagaagttacatttgggtttggcaacatcgaggtcattggaaaacttgagcaggaaagtctttgtagacaagtacaagctaaaagccatttgaagtggtcctttcttcatcactcaacaattctttcaagcggaaatatatgccttttttttttttttttttttttttgctccatctataccaaaatagtcatctttcctaacattcctcccttgatcttctggtttcctctatcatctccatctatctctgtctctgtcactatctcaatttctatcttgttccatttcagtaactcctctttctttcttttcctgtctgtttccttccctccctactccctaccaatctgtactgtatccttaaccgaaaacttttgaggacaatagatttattcaattcatttttttacccctagtacctagtacacttccagatttttaagtggtaactgataaatatttaatgacagaatgaagcccaaattcatcagtaatataaaaatgattttattggacttacatcataaaacttgttctaaggtagagtttgagtttatattgggagatacaggaaacagcattttatcttagatgctacatccaatgttgtgccactgaggtgaaagaaggaaggttctgaatatgaagctcttttattgtgtagatcccaaggagagttttgaagggaagcctcaggataacttgaatcaaaagaaacaaataaggatcaatactttgcttactcactcaatattgctgctgagacaaaaaaaaaaaactgtttatttttgcctgagccgtcaggtttcagctgtcaaacagatcacagtgttccaccaaatctgctaattctatgtctaatttaagtaagttggactcgttgaatggtgtttgctgaattttgttttttcacagatttctctttgcaatctttgacttttaggggcacacaataagaaactgttggtgaaaaaacacacagagcatatctgtgtatttggcataataaaaatgaaagctttttatctgaaaattggcagtagtatggtatatacacattgtttaatcatatgattgagaataaggtacagttaaaaattatccttaaaaagaaaattttaaaaaacaaatttttgttttatttcttatctgttgtcatattcgttatatctctaacacagtagtatctcttgagaaacaagcactttgttttacacggtaaatatgtccacagattttttgaaaatagattttttgttttagttttttaagccaacattattgaggagtaaaattaagtgcactcatcataagcataggatttgatgagttttgaaaatgcatgtacctatgtagccacgacaacaatcaagatataaaacatttctatcatccgcagagattttttaaaatataatcatattctaagaagtccacaatttaaaatcatcctacttaagaaaacaaagagacggcataataccatcacaagagtagcacagaattttgagtccattgtgggttctaattgaccacttactcattgtgaaatcttaattaagtcattgagactttctgggcttaatagttccaggtacatgttaagccctcaataattgttcattattgttactcacttatgcaatcaaaaacatttattgtaattcatatttttatatagcaggaatagttaaataaaattcacctgtaattttaagagtcttgtattcaaaaagcacatattttgatttttatattcctatcttatttgtatattaactgagattatacgtatttagtaaccatagatccttatattatcttgtagtattgtgtatcatcaccactatacatagtacactggtatattttacaatatgaatattcatggtatcagaataaatacatacaatttaggttgcagttaaaagactaaaattaaaatacagcataaaacaaatttaaaaacacagttatagtgcataaacatgtcataatagtatgctttgatagtaaaagggaagtttttgaaccaaaaggataccaagcatttcagttcttcaatataataaagcagtttaaaacatggtaatcatagtcaacatgtgtctatcagtgatattctgatatcacttggattttatccctgaatctatagattgaatttgactttagggtgaatcagttcttattaactaggtgtgttttttacatagcatatatttaaggagtgtttcttcaatgcttccattaagcagtcttttttttttttttttttttttttggagacagagtatcactcttgttgcccaggctggagttcgtggtgccatcttggctcactgcacctccgcctcccacgttcaagccattctcttgcctcagtctcctgagtagctgggattgcaggcatctgccaccacacctggctaatttttgtattttttgtaaagacggggtttcaccatgttggccaggctggtctcgaactcctgacctcaggtaatctgcccacctcagccccccaaagtgctgggattacagttgtgagccgctgcacccagccagcagtcttttaaagaaaattttgtttattaaaaatattcatttaagtaattacagtaaatttagaatcaggaagatagatgcttaaataatatcaattattgaaatattcaattataaatagataaattcagatgcatgttaaacttagtttaggttgacttgtttctcagaaaatatagagagcttgatatttctattctctgtcacatcattatgagggccattttggcaccagaatgcctgagttcagctctcaaacctatcaatttttagctgtgtctctttagacaagttatgcaacttctctgttccaaagtttctctttctacgaagtggatatagtaatgctacctccatttcttgaatagtaaagatagttaaatgagttaatacacaaaaagcacttaaatgaagcctggcatggagtgagtacccagtaagtattaggattatgagaacttacccaatataaactgaagttaatttgctcccaatttgaaaattgtgtgtaaaactgatggccattttgttcaaatgattttttacgctgtactgaaactctctattcaaatatacttctaatgtcctttcgagctcctgtgtctggtcattctttaattctagaccttgtgtatataaacagaatggcctttattatttgggccacagaccttcgtttttgatcattgcagccttccacacatgagttttcagagtcaccaagcctaacattattcgtttacctgcaaaactgagccttgctgattcttgcacaggaatctcgggaaatcaaccaaatttaagataaagaatggacttgtttcactgattcatgtttcaacatcatgggacaaacaagagacataatctatgggtgacctgcatgtctcaacacagaacagtggtgcaattgcacagtgaactctctgatcgctacaaccacctgcgtgttttattgcatattaggtgtcctaaggacactttcatgacaacaaaccagaaaaaggccataagcagttcaagtatgaacttgaaatgaggttatcagagtatgactgtaaaaggctctccccatttcagaatttaagagaggagtcatcctgaactgataatgaatgacacctctgaggaagggaaaggaggcgtatttccagggaatgctttttatgtcacagtcattttgtttgagcagaaagggatttgctgtcggtctttaaataaacagttctttgttctctgcctctgtgtgcgactcttctttctctaactctaaagcaaaaggctaggatttattaggatacaactttacgctaaatctgtggaagaataatgcatttgtattcactccatgtttgaattgcagcgaaaaggacaattatagtcagagttgacattttagtgagtgctttgtacctggtattgttagaagcacttacaggtagagtggtctactctttctggtttgctcaggacagtctcagttttaccatgtaagtcctacatcctgggaaactcttaagtagcaggcaaactaggcctcccgttacaagtattatttcatttaattatcaacccctccaattcccaatgaggtaaccttatattcttttgcaactaacagaactgaggcactaagaggttaaacaatttctgaagttttaatacttactgacatttactgcaagtgactgaatgagaactcaaacccagacattacagcttactctgtttctccctacctgggagtaactattgtaataaacacttaagttgttgaactagaccttactcactagaactctggacttgggtacttcagtcttggtggatgtaaggagagaagaaaaattatttccacatcatttgtggatgacaccaaaccataatgctaacttgtctcaaaaatgcttgtcagtggctacaaaggattgtctttccgaaccactaattaatctgtaaccaattaagtacagaattctaacaatacaacatacctataatttgcaggttgtgtagtaccttgcgtagcagctacttaagaaatagtgttatgtctagtttggggaaaaaaactcttcagcaaaaatgtgttttgtttgtgttatatcctttcttactttcaaaaaaagagcaagaaaatctactcagacaagtcacgataaaatatctgcaaatataaaaccacatttcaaatggaacttactatttattatttaccaatgtgatataaatgcccattgatgcagtttaaatctttctatcacttactgcctatgtaaacaaccaaatgttcttactatagtagtataataattctcagactttgggatttagaaaaccaataaaataacaaaataagaagaggaggtcagcatagtgttaccactttttaattctattaagcaatgttaattaaacaaaacacttactattatttactggccctcagattgactttaaatttaccatcactggcacacttctcttaaaagttcgttttaacgctaaaagagccatcattttagtgtcatggttgaaagttaaatcgtatcccaacatacttcaaaaataggagttatgttacaaaaaataatttggcccacacagttgtattacatgcacttgtttttttggtatttatatgttagtttgtgacactaaattcagtgcaacattacatgggggtcagttttccaacttgctccagagcttcctatttttaccacagtagatgtagaattccatttcacatctgcatgttgacagaaatggagcagcatatttcatgttatttcaattgagagttttctgggaaaactgagagaagcagaggaaccacagcccccaagctagtgccaagaaggaaacaaactacagcgggcctaatgtctgtctaacatggccaaggggagaatggattcttggcttaggagtggttatgcccactacatccagagtgtacaactgccagcatggagggaatgaatttgaaagacatccattgggtcagggaaaatgtgagcaaggattgaccactggtatagtggctgggaatgagtagagctgaaaagtcccttcccaggtcagccaccaaagggctccatggtctggcaagtccttttacctgcctaagtttcagttgccccaatgtttttatggccttccaaactcctttcattactcaacacaaaactgtttgatttccaattctcttaagatccctcctttatgctaatgaacagtgcacactaaagtattaatcagttttattgaattagtagatttgtcttttcaagcacaccattaagttttacctggattttagtcacagtggtttcacctaaattcaaaatcctatgttgcctctttgcacagtcctgcttggcattgatgctaattgctaaaacattgaaattaccgcaaggatattattcatcttttgtttttgaatgccttattcataggggtaacttttaaacctgatgaaaggtatgtatcctaagcctaaaccagggtggtaaatggaaaacaaacaaacaaaaaatagcagattatgaaggaataagggaagcatatacttaatgtgtcaaaaatagtgaggcagatttgaaatctgtggttagtttttcaaagcaagtactatgcccagtacccaccagcacgtaacagtctacctcaacacacagatacacacacacacacacacacacacacacaccccccacacacacacatggtgtctatatgcttgtcaacactttcatatttgggagctgtaatttcctcaaaggtaggcacggtattgtcttcatcgactcccccacatttagttcaatgcttaccacataccaagtgcccactaacactttgtgtcaacaaatgttaactgttggaattaatttccagatcctgcgaatgtttctgacatcttatactcttatcaatttcactcctaggacagagggaaagaaatgcattccacagaaccaacactttacagaaaactcaatttgtgttagtacatgtttgtatattaaaattataggatgaaacttttttataacctcaaaatgctgaaccaaatagttgaaagggtgtaggtgatggtgaagatgaagaagccaaagattattatgggacattgtcttaggtacttgcaagaattagtgctaactcccccctttctaggctttttaaaataaagatagtaaaggtaaaatttggggacatcaggaaatggtccacagaaaaaagaccactcaaccagcatcttagtgtctccctaatatataattaagcaaaattcaatattacctacaatatcctcagctttcccttctacttatgaggattttgtggtttttgtttttttcagatatttaagtagatcaggatcctttactttttgagagggcaggcatggcaggttttgcacaaaaccactggggaaggaaggatgctgtcactttttttcatcttggatcagaactgattggcagtgtgcttattcatttatgcctacagtgcttcatttgagatgggctaatggacaggtacctggatattctttgctagccagcttagatagtaaatatgcaactgtttttcaagaaagtttccaagcataccacgttcatgttgttgcagcatatcctgtgtgaatcgtgtgaacaaatcatggtgtaacccaccttaaattcaataacacaatttgctaatcccctttgtttcccctgaaaagaggaggaaaaatcaaagttgcatagtgagtgttatgagggatattttgcatgaacaaacacaaattaggccatggactttcagagcagttgttttctggatctagatgtgtccattatgcttgaaggatgtcaagttatacatttaggcatgacgtcagataacagggattttcctgtgtaagaagctcgtagtctctggctgtgatatgtacaatatatggctccctctcaataggaaatgtccctcccagttgattctcagcttatttaactctctgttgtacctcctattttcaacaatcctcagggtgtgtggacgagttttaaacagagcatagatatacagtcttgccatctggatcaatggaagcaaaaatgagaaaacccatggcttattacctgcctcctttttttggaggctttgacctggttctatttaagagcattctcatatattttactctgtgatctagaatcaacaaatttctgcaaaatctataccaaaagcaaggtttcttgaaataattgggaaaaaaagagagatttaggatttcaaatgtcaataattacattattctgacacctagaatgcccgtaagccaacttcaagtgttgtttggtatattttgcgaaaagaattgaaaccagtccaggaaagctggagataagaaagagtttcagctgttgagccacaggaatcagttattattaatgtcccatcaaattatttgacatttatttgcttgattttatgtaggggacctaggttatagtttatgaaaacaggtaaaaacttgcaataaaatggaaagaaacatacattgtcactatccttcctgagtagctcaaaccaggaattttataataaacagaataagttaaggtaaagctgggtcctcaacaagggttctaagaggtcactaaaattgcatgcaaaattttgaaagtatgcttgaatatacatttttcagggtcaagtttacatagcctgaaaatgttttaaaaattggtgtaaattttaatgcattctggacgtatagaacctaatacttgtaatcttgctattaatatgttgatacattggagaaaatctacatattcacagagtttacactgaaagctctttgaatccccgctgcttcccttgcttgctaagacagaagcctcagggacaagggcagctgcttccaggatgtgaaatttagctaatctcaaatgtttgactttgaactcatttggaagatatgttttagtatgtagcatttgcttttcagccattttctctggaatgcttttactccacttaggtaaagaaaactgggacttagggcttccacaggaagtagataccactggattggattttagacaaggaagtgttctgtgtctctggtttggcacagcctggtgaaaattgttgaactgcagcatttcagacctggtgccagcctaatggctacatgccaagattactatttggcgacaagcagccagacaagcagctggttattgcagcgaatccgagcagtgtgcctgaggccatgtctctgttgccagatcccccaacccagttagtaaccaaacccttgaggctttctctgggtttgttctcttccagcctcatggtgggctttggcctggcaagggtcgtctccagcaggttgtcctgcatgcgtcctgagctgtggtgtctggctggaattaggatgcttatagaccacgtaaagttaagagatttcttggcagctgtggctgacactgtgggggcactggccagagcatgcttgcactagaggctggctggaagagggcagaatcaatatgagctgctggcattccacgctagccaggggtgatgaagtgacagcctgctggcatctccctttggccctgctggcatctattttgcactgttctttgtgaaaagtgctaagactgagggacctggtgagcaaacttgtcagaggaaatgaactggaggaggtgagggaagagaaactggcccacaagatagagccacaaccagtgactgtaatgatagtagcaataggtgatcacagtcttaagtaaattttctctgtatttccaaagtggaaaaaaaatttcttccctaggcatttcaactccctttttctgccagaacttctggaccttgagaatagtttgatgttaagcttttggaagggagaaagtatagctttccaggaggccccagctccctgtaggtattcccctcctgggatctggcaccatctgtaagtttgctgcagctgctgatgaatttaaactgagttagcaggagttgggcacagcatatttagaaagcactcatccctcttcttttgttggggtgggagtgaggagaagggactctggcaagattagtttccctctgttcactcacagacaccgtaatactgtttgcagcactgtgtcctccatgttgattcctgggtaattctcaacatctttgaaaggatctggtaatttctcccagggaaagttgaagtatactacaatggtggatctattaaaaatattggcatggaagaacaagagctctattgtctctaatccgcgtcaccacccaggacaagcaccaacaggacgctttctatgaatcgtgtcttttattccacatatgtaatcactttctggaactaagtttatgactagaatatccagcacttaacataaatgaagtaagtagaatgagagtatagtttcaatggtattctgccatggtaaaaattttctgttgccttttctttgattcgatacagtgataactcttttacttatttgaacatttatccaagaaaccttaatgttgtagcccaacatataaaacaaccctcagggctatctaggtcacagacaaagcagagtcacatacatagtttcaggaaaaattctattagtagtttaatgaatacttcatttccaaataattttataatattagatctgagtgttttttaaaatgtagctatgcatttcaacgtcaaaatagcacattggtatttggcatttttgttcatgaagtcatagttgaataatttgtgtttgagcctctatttactccatctccctccctatctatctgttgaacactcactcatacctaagaaactcacatgcatttcataatgcactctacattttgtctccaatttttgcaggatcgttcgccacaacatacatgtatgttcccgtttcactttgcctatatctcgatcatcacagttttcaccctgtgttctagttctttaatacattttcatctcttctgttagcctgaggattctgaaagcaggaattgtcttatcctttattgtatacattatgattttagggaaattaaattgtatagtaaataaaaattaacaccatttacagcaagtacatttaaagtttgaaatacagaggtagagtcgattcttgttattcacagaatgtttttctatgaagtcaccgcaaacactggattatcaaatattgaaccagagctcctgtggaaagtgtagggtaagattcccacaagcctctgatcacaactttctcatcaaccagttaatgtgtaactgttttgcatgtttctgtttaaagacacctacttaatagatattgttaattcattgacatttgtcaatcaaatcaaaattaagtttataatttacaaactcaaggccaaagcactgtaactgatacctgaacaaagcttatctaatacacatactttctcaggaaggtgcatcctagcttcctggcacttaggaacacactagagagcactttaccactacacgtggggaccattttaaacagcaaaatcacacacacgcacaaaaaaaaaaaaatcacaaaaatgtgaaaaacatggcagtaaatagatcccaaaaaggatacttgtttacgataagagagctgaaacaagaaggcagaccatcaccttgttctatctcagataagaatgtgcatatcaggctgtcaaatttttcaccacactgtacatgtcgtcaagtgacctcaaaactgctgtgagtactgatttggggattacaaataaatgttagcaagtaggcaaatttgcaaatacagaatcagtgaataatgaggatcaactctattatgtatcgctaatatttaatatgatagtcaccattttatttaatccaaattaagtgtgtcatggaaataggcttagtttctgtggagtattttataaatagtaattaaaaaattttatttgaagtagagtttactttaaaattatgtgatatccaaagtatcctttatttatcttgagtgtttaattcagaagagtgagaaaattttaaaacatgtgttttccactctccctgtaatttgctctaatacagaagttaataccatattatactaaaaataaagtatagaatgcataaaggcacatcacgagcacaaatatctgcacaatggattcacagcagcagcgatgagcttggctcagaatagaatatggatacgcatcttagtgatgataattcactccggagaacaatcctctgcaatttatccaatccactgtgtgccactggatatattatgtacaactttttattcatactatgtgggattatgaacaatatcaggattcattaagatgcctaggaaagtaaagaccattttcacagtaatagtattttttataataggaaaaaatggatattgtatttctaagatattattcaaaaatatttgcctacatgagtacttgtgggaactaaaaaaattaaactctcatctttaagtaagtgtgttcaatgtaaaaatcaagtgtttgcatgtgagggtgatataagaaatacatggtagggcataagtcctgacaatacacaggtgaagaaaggcatagcataggaattttaaaagtatataactaacttttacacaaggaggctggacataaagtactgtgataaagattgaatcagaatgagaagatatggataggatcttttgaaatggttcttgtaggacaggttgtattatgatggttatggtgagccacaggaaaaaagcacacccatgggacagcacagccatgctcagagtcacacttcatcccaggtagaatagtgtatgtgagcctgtggcatgagttgacacagtcaggtttgactcactcaaatcagtaatctggcagacatcttctacacctcccttcttctccacctccatagtcaaccagttgccacgtcctaacatgtctatcttctagatgtctctcgagtttgttcatccctttctcctcatccttcctttgactacctccacctaggtctctgcagtctcttactccaaaagcctcttgactattctccttgtctctaataaaggcccatcaatctgttcttcacactgcagttagaaccaacttctcatgttgtcaaccatataattttaccggtaagcccagaaccctttaaagattctcacatggcctgaagcagtggctcacacctgtaatcccagcactttgggaggccgaggcaggtggatggcttgatgtcaggagttcgagactagcctggtcaacatagtgaaaccttgtctctactaaatatacaaaaatcagctgggcgtagtggtgcatgcttgtagtccctgctactcaggaagctgaggcatgagaatcatttgaacccaggaggcgaaggttgcagtgagctgagatcttgcccctgcactccaccctgggtgacagagtgagatcagtaacaacaaaaaagattcttacagttcttgcatgttataaagacaattaaatacaggttgcttccccatttccttctccaaccttagctcttaccatttctcaatttgcactttttttttttttttttgacattaagccctcacctcaaataactatgattgccaggttgtcttttgcctacaggcttttataactgctgtttcctttgcttagagctttttatcttccccaccactctcctatctaagtaacttccacttacctgttcagatattaatctacatgccaattcctttaagaagctcttcctgactcagaaatttgatcagatagccttctgaatctttcacatagcaccttgtccttagtccctatagaattaattcacagttcattatgattatatatttaaattattgactcccttccaaccagactgtaagtttcttgcagatgaagagtatgtcttatttattactgagtactttccagtataaattgaaataacacagtgactggcaaatgggctagtgaagatttctgatggaaagagagtgctacacatagatatatagccagagatgcacagtatttatctgtatattatatgttaatactcagatggttcgtaatgactcatggtttattctttaaattagatagtaattataatcatctctgggtatccagagggaattggttctaagatcacccccttggataacaaaattttaagatactccagtcccttatataaaattgcacagtattggcatataacctaaacacatcctcctgtatgctttaaataatctctagattacttgtaatacctaataagatgtaaatgctattcaacagttgttatgctgggtttttaaaacttcaagttattgttgtattgttattttttattgttttgggtttattccaaatattttcaatctatggttgattaaatacagggatgggatacagagggccaactgtacagaaaaaagacctattataaatcttgataggactaatggaagagcatttaaattgtttttctcaacatatacattgaatttgcaagttacttatgcctttgttgagtggtcagatgtaagcaggatgaatattaccaccacactgtcagctaagcatattatcttacactacttcttacaaacatttagtgttatatcttcttttattcaatttatctaatatttttctctacaattaatgcattttcctattacatcatgatgtgagagaaactggatagagaaatcaaatgaaacagcaatcaggagatcttgttcttactctcttaccttgggaaggttaatctgactgtctgctgaagaagctgctgggatgagtgtatcagaacttgcaagtcatttgttcctctggacaactgtgttattaccaccctattatgtgcaaggcactttccaagattcattgataaacatacatcatattttcttaattatcattaagaagtgattgataagttttcttcgtttgaaatttcactccctcccctgtggttttacagtttaatagcatacgatttcatgataaactattagaggtaagggttctcttcatcagtagtctcatcatgtagagcttgactagcatttaagaacttgatttctgttctctttttgtccctttgtcagctgaataatttcataagcatataacaatcatctaaaatataaagaatggcattatttattatccacctgtttaacattccataaggacaaattatactcttcttaaactgtcttctgcttcctaggtatgggtatttatcatcatgagaaatattcattcattcagtctttcactcatttagaaaacttgctaatcatcagctcgtttaagcctctgtcataggtgctgaaacaaaaagtgattagagtaaaggcccagcccatgaggaccctagaggtgagtgggggaaccaagggaaggacataatcacaagagtgtgctaactgcaaaatgcatgatttcgaacttaaaacaattttgccttagatgcacttctgtaatataggccctttgggtaagtacagtagagaatttagagccgcaatttgctaacatgaagcaagaacttagaactgagggaaccatagaatcctagagttagagtgtgcattgaaacatccagttcaaacaatttgctaaagcttgagtttactcaagtgccaaatggtccactagcttggcttgaatacttctaataagacacactccccacctcctttcatgtgggtcttgatcaactcttgttgtttatgaattattttcttgtaatgaatcaaaatacatcttgccacacagaacaaagttaattcttcttcagcataacagccttgcaaatataacaaggtaattgttagtgactttgagccctttctccaggctaaataaaatcgatacaccattggtagaaatatgttcaccatcccaaagtcttttctgaatatacacaatagtacagagtttttcaaagtgccagttgcaatcagtgggtagtgatttcagtgcagtggatgagatttagaactgaataaaataaaatacaaaatgtttgtgtgttttccacatagtaagcatagatattgtttcatgaaatattaatttgtttcagatatgtgttcatggtggtgtttctgtgtaaactgactcccaaagtaaaatgtattttttaatgtgggtcacaagagataatataaagtaaaataaaatgccactgatgtatctggggtgaggtctatgaattgcatttttaataagcccccaagttctgatgatgatgatctatagagtccactctgagcactgttgcactaagtgacaacatgaagagcttacataagagctgagctgagtaaggacaaaggtgtcaacctacataacaaattttattaatgcttagtaagtgtattagtaatgcttaatttcttttgtatttttaagtgaaactaaatacttgtagaaattgtaataatgtgcttcgcagccctctttggagacaatggagatgtgggaacagtgctagagagggaggctgggttagagatacaaacactaggactctcagagaacagtgtctgattctcaggagttattaatttaggtttgctgacctcagagagagtatgacccatcttagttttctaatatatcttccctaaactgcccttaattcatctggcggacaatgtatactgaatggtttgctttgttttatgatctcaccattggtttcatctaactgctccagtccaaagttgattttccttaacagaaaatgtcaatgcaaaatagttcacaaattttactcactatttgtcattttccaacttgattttctcatttccttgttaatgatttaccataacatttcattttctcctcttcttcctttcttgtgcgcttcattttatcttagaatcatccaagggctgcttttgggaacaccttcagtgtgcaatatgcttacagttttgagggatttccccagcttctaaagttggctttcctttcaaagatgtatgcttggccttatgcctatgcttctttcctcactgttttctcttctccattcctgaaattcagaaccttgctcacccttacctttgcaagtcttcacaactctctatgccatagttcctctctccaggactcttctgttgttcagacaacaaaaacaaagtgccaattttggtttcacacaattccaaaaactgtttacaaactgttaacaattgcagaaagaagctttgatacacacaaattgaaatggcctgcatcttggtaatattacaacaccgtataggactgagctcttgaaatgtgtccaagagtaggaagtggtttttcgtttgtgagatatttgtgaacttttaatattttggagtatagcaagaggaagtctaaacttatgagtttatacctgccacttatgagcttgtaaattttgggtaagatacttaattttctgagtctctacttctttctctctctctttttttttgaaacggagtctcactctgtcacctaggctggactgcagtggtgcgatctcggctcactgcaagctcctcctcccaggttcatgccattctcctgcctcagcctcccaagtagctgggactacaggcacccgccaccatgcccggctaatttttttttttttttttttttttttttttgtatttttagtacagatgaggtttcaccgtgttagccaggatggtctcgatctcctgacctcatgatccgcccgtctcagcttcccaaagtgctggattacaggcgtgagccaccgcgcccggctctacttctttctctttaaaatggggtgataatacatgatgagattgagtggtttaaatacatgataaaatgtgaagaattatactcatggaaggttctgtgctaattaccaatgttcgattcctgaattacaggttcatttgttaagttaaatctaatttctctacagaccctttgtcaatgtcgttatcatcaacttcaggctgcatgcccccttttaggagaggctgtcttcagtctgtgctatgtattgatttaatcttgctgtgaattccaaatatttaatgataaatcactggctgctttcttgcatgtacattatcatatgttgcctcctaattcaatgatgtatcatattctcatttacttctgttgtccatgtatttattaagtattctgagcagtctaggctaaattgttggcagttgcctggctgtggacttggagctgatccttctcagttttcttgactgtttcttaaatatcagttctgggataatgctacccactctctctgtgtttcccagtgttactcagaccttagaatggatataatacttactttacccctgtttctcttttttaatttaacaataacaataaagctatatttgatgtatgacaaatgtatattcatagattgctaccacagctgagttgttgagaatgataactctataacccagagggatggagtttgtaaattagagctctttaattattggttttgacttaagagacaaatgacacaatgacttaagaaaatgaagtggcaattataaattaaacctatctttcagatagcttcagttttttagagatgatcttcagtcattcaacaagttggtattaaatgtatatgactagtgttttgttaagtgttaaaaacatagagggaaactatagatataatgctattgttaggaatttttaaatctcatgaagggaaaggcacatgaactactaaaatctgtggaagaaaagtacacagtatattttaaagagatctgatttaagctggagaggagggggacctcatggtcaggcttccatgacaaggtgatatttagacaatatgtgtctccagagcttctattcagcacaatcacatatttgttaacatttaacctatttttaggtaaatttgagggcattgttggtgctcagatgaacaaccaatgagtacttgtacctatatcaatgtagctttagattagcaaataaaaaaattgcaattttgcatttcacagccctaccctaatgggaaataccattcaaacatttggtttaactatgtatgaatctagcttttgagaaggttgaggtaaatatgttgaaatccagagctacatgtgtggtttttgaatcattcttcagagacaaggtatgttccttcccaggcatagaatctcgccattgctccctttccagccaatcccagttctgtcagcaacgattactcatggtccttcggttacaaaaaatacagggccacttgtcaagatatcagaatactaggattatgtatttctggttagttgaaaaaaaaaaaaaaaaagcagtatggaagcagaaatgccttaaagagagagggctctatagcactactctgggtcctggcagctggaacccttagcattagtccaaggtaacatcagtggagtggacatcctcattacttaaaaatacactacagtcgacactccctgtttcttccttctttaccccctaacctaaccccacactacatactacattaaactatcttgtggaaataggtaaacacaataagaaaatagagtgttatcctgttgccttttctattcctggataactagatgctgccctgccttccattgtacatatgaagatacaattcagaattgacagccacctaagcctgtcaaatacattgtttagtgaaacgtggaccaatgaaaaattttctacacaatgcataattgaggtctttgagaccttcaagatctttagtgatcttgttttttctcgggcacctgcaacccttaacttgtgtacaaattgaccacaatttaatgaaaaatcagcctgaccactacccagggctctaggggtttctaaaatataaagaaatataagaagattagaaaaaccatgcgtaagtctgtggttgcagccagtaagactgggaggtaggaggcaaggcccttcatggtcttgagaaatgataggtggttggtttgtaaaccaccttctaaggaagctgaatagccgactgcagggtgtttagtttggttcaagattgtcaaaagagccatttgcttaatacagcagaggatagactgaggctcactctccttcttttttccctagtacctcaagcctttcctttaaaatatcaaatttgagtttgaagggaaccagattattagttgactagggctttcaaatgcattgttaaaccatagttactcacaagtaaactagaaataatctaaagccaggactttgtcttgaaatcttttttaaaaaatttctgtggcatttggtataccttataggtatcaaagaaatatttggcagaggattgaactctctatgactgtcaggggatacaggtgattgatgaacatcacaggttgaatgttattcatcattcaggaaaaaaatacactgagatcaagcgctactttctctgggaggcctttcagacttgtcctcctctgttcacccccaccttattcctagcttccagcatagatgtatccatgactgcctttgttccctcgtgatgtcttatctcatgtatttcaatcatggccactctgtatcaataacagaatattggactgatttattttcatgtctgtgaacctgaattcacctataagcattttagggacagaactcacatctgattcatctcagtattacaaggacaatgattggaacagagaaggtaccagatatgtagtttaaaatacgtaaatgaagagtaaataataaacatgataacaataaagacattaatttatctagtgcaatctcatttctctgaaggaatgtacagtatccacaatgaacgatgatgataacacaagggcctttgaagatagaaagtggaaaatgtgaatctggatgctttttaatttttttcctgtgttctaaaaagccacagaagaagtcatgtgaataaaagacataaatgttagtgaatggatttatcatttttaactgtgccagcttcttggtgtaatgcttgagcattagtagttaggcaatacattttaatgagtgtttctaacttacaagtgcatatttagaggtgagaacactgtagcacttaaataattaataataaatagttaatatgttcctccagagtaatatgttcctccttctattatctctggcctattggacggtcttcatttatcttttaaagaaggctttagggtttgggacccaaacagatgggaatgtgcccttatttttttttttttttctgtaaatctagtgagcccctgagctgaggggtctttcagaacgcgtactttgtatttgtaggctctggtatctatatactgaaaaatactttcagttgcaatactttatgtaatgtcctaaaaaatgtgttttcaaagacagaaatcactgctatttagatggtttatttttctagagcaaatagttcatagtattgactttctaaagctatgtttctgtaagtgttcttttagtcatgcaaattctaaagtcatttgaaggggatcttacagatgtgctttgttattttattttcttaaattccatcctaaattgggtctgagcatattatggtggaatggactaggagtgaaagattggtcgttctggtttgccctgggccatccaaacagctgtgtaagcagcaggtcctggaaatactgggctcacgatttttggatatgattcagtgatcagcatgactccactgcaggacctcactcactgcttgtagctgtttctctgtggtcattctggaagtcaaaattcaatatgaatgccttgtgagaaatgcttttaatgaactataaaaatcagcagtctgaagagaaggtcatttctgatacagtgattatagtcatttctgcacaccaatgccaattaaagactatagatatgtaacaagcaggagacacacactattgcaacggcagctgaattatgacaactgacaaagcacatacctggaagttggtgatttcgctatgaaaagcagggttcagcctcctgtgtttcacactcgtctttcaagtgccctcacagtgaactctccaaaatgctttaattttaaaaaatcattttgaattcatggacctagtgattgtttatatatttttttagctccttcagaagattaaatatttaagatttttttttagatcatggattcgtgcagcttttgaattcttttgaaataaaattgctcttaatgagacatctgaaaacatgaacaaacactgaagaaacagagttctccagaataatgatgctattgttaagtgattgaatagttgggagattaatatcatggtgtactggcatgttggttaattctagccataatttaactgtaaaacctacttaaggaagcaggaggctgaacggcatgtcaaacacaaggcacccacacatagagctcaacacaataacaaattaagcactgtttatgtacagacatagttggccttatgttttttttcttaatctgtgatttaggtaataattgcactataattttaactctctatgcagtttgaatgtctgcttaattgttttattaccattgtattcagtgatactaattgatggtgccagtgaaatttagctgtgtgtccctaagtctttatgcacataagactggcattgatttagtcttgatagcatatatcctgtttctgctagattactctaaaattgtttgaccaaaggctatggggaaattttggcccaagtgaaaatgtataatttaatttgtgaagagttttcatatactctaagcttggcttttcttttccttgaacattttgccaaattccctaaatgagaccaaagtgccttttgcttaaattttggcataccatgaaatgtctttctgtattagctatagattatgtgaacctgttgctgtacaaaatcatgcaaaagggaaagaaaacaagagtctcatgtaaagttcaaatgtaccatttagctacttcagttttagtaattgcagggttttactaacctgaaaagttatcttgactcttaacacaaaattaatttctccttgtacctaagttcaacaaaaatgcatggaatttcatgagtttgcgtttatgtgcttacatacatatgtgtgtcatgaagctgtgtttcagacagtgataataaaatatccttagtgatctaattaaaatgcagattctggttcagtatgtttgggatggtgctttataacctgcatttttaagaagctcaaggtgatgccaaagctgttgttccacagaccacactttgaataccaaatgtgaatttggtaaaatgttcaaggaaaagaaaagccaagcttagagtatatgaaaactcttcacaaattaaattatacattttcacttgggccaaaatttccccatagcctttggtcaaacaattttagagtaatctagtagaaataggatatgtgctatcaagactaaatcaatgccagtcttatgtgcataaagacttaggcacacagagctaaatttcactggcaccatgtattagtatcagtgaatacaatggaaatacaaagctaaatttccataatttggaaatattagctttccaaaaatatgtaaaaatatgatactattcacttgaataagtgagaatctattaagaacttttttcttggtagaggactaaataatgctttacctctttgcctgttggctacagtttaatctttcaaggaatgctattgacactttcagcaacttggtttctccccattactgtggtctcatctatataaatgtatatatgtgacaatgaaaatggcttcaggaccatgaaaaattccataaatttggttgcttttatacattttatggtttttaagtgaacttaggagtctaccggcactctacatgctgaaattgttgatgtgcttgaaacattccattcatcaaaaagaaacagtggaccagaagatctctatgtcctctggcttctgtggtggcagattccccagaaggcttgcggtttgatgggacttaagcttgtttagataactgcacacaatacccatatgtacctccagaaaggctcagctttaaatgcagccattacacttagaaaaacatcatgtggcattaacctaatctggaataagttaagtagcttaccctaagtacgtggtagaataccgtaactttgtaggactgggctttggggctttccagtacagaaagccttataatatgtaatctttgagaaataacttaagatggacacttaattgtatcttctaattttgtctctgtattaacaccgaaaacatggttttatttgtactgttaaatatttattgcttggattatttcatactctcctaactagtttatttcacataaaattggcttcctttttcttttttctttttgttttttttactgatgtttgcttgacagtctcatgaatttggttttctaagctagaaaaatcttcttcagacctaatgtaaataagctacctgaaattaacaaaaatcttatggagacagaaccatctaaagaaaaagtgtttgaaaatgaggatgctctctagataaagtcattttctagttgctatttttgtgtgtatattataaccaaacacacacacaaactcaagatgttcctccaaaagcatggtgaattatagagaaatggtgggacataatattacaaacatttgttctttctaaaaatcagaccacatattggaactagtttatgactcaataaggttacagttcagcattctcgtaaatagcagggaggcctatcttgaaatgcctaatttagatttgtccatcaagtttcattaatgcattatttattattctgtaaagcctagaaatcttacaaatagtgataacattttaactcatagtatgggaaatattaaagaattctgcatcattaaacattggtaaggctgtggagaaactattattctgttggtaagacaactactttgggaaatgtgttctgcatgcttcaatgatcccactcctgagcagataccctagtaaaacttctgcacatttttaccagtagatagatatgagaatgttaataacagcaatgtttataaggacaaaaataaagggaaggtgtttggataaacctaagtgaaaacagatgggagataggataaataagttgtgaattatttgtttaatgggactctataaaccattgaaaataacagaattgcagtctcttacaccatcatgattgaattcatgattaaaaatgttaagtaaaaaaaaagttgtagtaaaatatgtaagctatggctcatttaaatagacaactaacatgggaaaaactaaaccatatatatatatatacatacgtataagaaaacaataagaaagacaagggatattttgttgcagagggatattttattacagaacacagggaagcagataaaatgtctgtggggaaaagtggaagaaatgaggttggacagaggcaagcaagaaagttcacaactaagccatgtattctttaaattctgtcatgtgttaatttttaattttttacatcttttatatatttataaaaagcctttcacatatttaatactcatgtatatataaatatatacatacatatttaaataatttatatgaaattatataatatataacctatattatataaaattatataatatgtaattcaatgattaaaatatataaaagaataatatactgattatatttaatttaaacttcaataattaaatatactgaaatataataaattataacacaaataaacaaggtagtatttgtatataaataaactaaaatttaaagatatccatgactaaccccaacttttaccttttgcctgtaatgatgcggaaaatgcatgttttaagttttttgaatgtctgttttaaaattgcaatttgacagtaaatactttaaaatacccagcaattatctaacatgcaattgaaattctatagtttcaaagatcaaaagaagtcttcagaagtcaaagactcaaaagaagtcttcagaagacatgtcacttcttacatgtagtgaatgaattctttcattgtatcaacaactttaaatagctatatcagttattctctaacaagattaaatctagttgcttattgactccactgtagtgtttgtaggaagaagtctttctataagcacacatacatacaaacaccacagatttccatgctttctgatttttttttctagaaacatgtaatttacagaaggaggcaatataggctagctcaaaagatacttatggcaatactaattataaaataaccagtagacatgtacattggtaaaaatcagctgctgatacttgcattagtttgaagtttattggaatgcttatataccctggaatgaagatatacttgaaataaaaatgacagtaaaaatgaattaaatgaattgtcacttatatattcctgacattttttggtatttagtaacttatcacaatcaatcaataaacaaacacacaaataaatttaataactaataactactgattccctcataagtgtgtaaattataaaccacccagtgaatggcattagttactgcttacttaatgcctgcttgtttgtgtgtgtaacttgccctgataaaattttctaacagtactaatagatatttatattaaatacattgcttttggcactggtcaaacttaaaagtcacgtggacaggtatggaaagtgttaacgccagatacaaaataatttatgtaataagattaccactgtgtgaaacacacaaacaaaaaaatatatagaaaagaaaacaacatagcatatctgtgtgtgaaggagttataactaatttacatgtttctgtttttctgcattttccaactctgagtttatgggatatgttccctctatattggcaaaaataatcaacttatgtcagtactcaggtaagaagtaagctgaagacagttaagagaatttcatttttatgggcatgcaatgtagcttttcattcatttaatgttaaggaaagtagaagcaattatgttcctgtggcatgtgaaaagtacacacgacataaatatatcaacttttactttggcttccccacgattaaagttaagacaagcgaacaagaggccacctcttgagcagaatatatttcattttgttgttaggtgaattccatcatgtaatgcacatctgtaaccacaacctataatccaattgggaaaaatcgtgtagccttgaagggaacctacctggtaatagaatcaggcttatttataagaaataaatatgggcatacagcttatatactatgcatctcaaaactactatttttattgctgtaatgaattttatatcatgaggacttagtttttttttttttttttttggtaattactgtcctttgatatggctttcatattgtgtcttcttagacacaataaaatccaatatgttatctgataatttattctcatctctaatgtgtacttctgtttgcatattttttctttattcagcttgtgtcagatggttctaaatttaaaaagattttaggaactttaaacataacagttaaatttcctgggagaatgatgaatagaaagcatttcatacttctccatgtctatgtatctcatcctcactagaaaacattgttagcttctgccatcaatgctactactttccacacatttttattgaaaagtaacaagtagatagaaaattgtactaatcgtcagtgtatagtttgtattttcacaaactgaacacatccaagtaaccaccagccaaatcatgaaacagaacatgcccagcataggaaaaaccctttatgcctcttctaattttttttttttttttttgaaatggggtctcgctctgtcgaccaggctgctggagtgcaatggcgtgatcttggctcactgcaacctccacttccccggttcaagcgattcccgcctcagcttcctcagtagctaggattacaggcgcccgccatcacgcccagctaatttttgtatttttagtagagatggcattttaccatgttgatcagactggtcttgaactcctgacttcaagtgatctgcccaccttggcctcccacagtgctagtgtgtccggaattggtgggttcttggtctcactgacttcgaatgaagccgtggaccctcgctgtgagtgttacaactcttaaggcggcgcgtaccttctgatgttcggatgtgttcggagtttcttccttttggtgggttcgtggtctcactggctcaggagtgaagctgcagacctttgtggtgagtgttacagctcttaaggcggcgcgtctggagttgttcgttcctcccagtgggttcgtggtctcgctggcttcaggagtgaagctgcagaccttcgcggtgagtgttacagctcataaaggcagtgtggacccaaagagtgagcagcagcaagatttattgcaaagagcgaaagaacaaagctttcaaagtctggaaggggtcccaagcggttgccatggctggctgggacagtctgcttttattctcttatctggccccacccacatcctgctgattggtagagccgagtggtctgttttgacagggcgctgattggtgtgtttacaatccctgagctagacacaaaggttctccacgtccccatcagagtagctagatacagagtgtagattggtgcattcacaaaccttgagctaggcacagggtgctgattggtgtgtttacaaaccttgagctagatagagagtgccgattggtgtatttacaatcccttagctagacataaagtttctccaagtccccaccagagtagctagatacagagtgtcgattggtgcattcacaaaccctgagctagacacagggtgctgattggtgtgtttacaaaccttgagctagagacagagtgctgattggtgtatttacaatcccttagctagacataaaggttctccaagtccccaccagagtagctagatacagagtatcgattggtgcattcacaaacccttagctagacataaaggttctccaagttcccactagactcaggagcccagctggcttcacccagtggatcccgcacggaggccgcaggtggagctgcctgccagtcccgcgccgtgcgcctgcactcctcagcccttgggtggttgatgggactgggcgccgtggaaccaggggtggcgctcgttggggaggctcgggtgcacaggagcccacggaggaggggaggctcaggcatggcgggctgcaggtcccgagccctgcccctcggggaggcagctaaggcacggtgagaaatcgagtgcagcgccagtgggccggcactgctgggggacccagtacaccctccgcagctgctggcccaggtactaagccgctcattgcccggggccggcagggccggccagcccctccaagtgtggggcccaccaagcccacgcccacctggaagtccagctgtcccgcaagcgccgcgcgcagccccggttcccgctcgcgcctctccctccatacctctctgcaagctgagggagccagctctggccttggccagaccagaaaggggctcccacagtgcagtggtgggctgaagagctcctcaagcgccaccaaagtgggagtccaggcagaggagaggccgagagcgagcaagggctgcgagggctgccagcacgctgtcacctctcactaggattacaggcatgaactaccgcgcccagcgcctcttctaatttttcatctctgccaaggataaccacgatcctgacttctaatacattagtttacataaatgcaattgtagaccatacacttttgtttatctggtgtcttttgctccgcattgtttgaggattcacccacaattgttgcttgtagctccagtttgttattctcatagtggtatggtattccattgtttgaataaacctaatatatttatctgttctattattaataagcatttgggtagtttccagttttaggctgctgatgaatattcttatatttgtaaacagtttatgtttagtacaagggattactacaagaaaaaagaaacacagcttccctaataattttatctgatgtggatgtagcagaaaaaagattcaagtttaacttttcttttaagttgattgtttacataggattaacatcctcatttttgcctattttacaacttatgttgaacacctattttgtgctgtgttttgtgtgatgactgggtgacacagacaaggaaggcacaatttatgttttcaagtaactctcagaaataagtatgcgcttaccatatagtagggacagtgctacgaagaggcgtactggtctagaagaagcttttaattcagctaaaagaaagatggtgagtgaaatatttatagaggagaccattaaactaaaattagacaaagcaagttgtgagtagagaggcaggaggaaaggaagaaaattcttggctgttggaattgcaacatagcagggaacattttagatacttcccatgattgaatttggttgtatttaagggttcacactggggagtgatggaaatataaagaatagaaagagaatctgagcttagtggggaaaaactgatatagtataaataagatatataaagcattgtgaagggctaaagaattattaaaacacaagaagcttcttgcataattcactgagataatattgcaacccagctgagcaaagtgatacatatggtaatgaaaggtttattaaggtttattatggtataaatagtgtctgtaacggatgcttaaggcataattaaataccaaaattaagaggaataattagtcaagtacaatgcatttgtcagtaagtgattggctttaataagtttcttttcttttcttttttttttttttggagacagagtcttgctctgtcacccaggctggagtgcaatggcgtgatcttgtctcactgcaacctccacctcccagattcaagcaattctcctgcttcagcctctggagtagctgggactacaggtgcacaccaccaagcccagctaattttttgtagttttcgtagggatggggttttactgtgttgctcaggctggtcacgaacccttgagctcaggcaatccgtccagctcagcctcccaaagtgctgggattacaggcgtgaatcactgcgcccagccaatttctccttttcttatttacaccacaattaagagtggttggtcttatctttcctccaggaacattaccaaatcatgaaacatttaccgtatatctactagacataaatatcctttgcatcataaacgtataaagcacggggtatctcctaaaggattatgggatgtgataggtgcctaagtacaaagattcatagtcatagatatttcaagaaagtatgaaagcagtgctttggattgtgagagtacagaaatcaggtcatattgagagcattatgtggggccatgtgttggaagttagataaatatatttaagcttattaaaaaaaagagttgatctggtaaaaagatctataagacaacattacatccttcctggcatgcagagagtggctgaatttttcttgcatttttccttcagcccatgaccctcctaaatggcacaaacaaaaaggcatcctaggtgtgttctttgtcatgtaaaacatcccccactgactccctgtggaatgaaaggcatgcactcaggggagtgtgcacacctgcagtaatgagaaggattaaggcaaacaagtgaaccagaagtcactgatacttcacttgagacagcactacacaaacttcacagtctactctgtttcttgattatgctttatggaatctaattataacataagcctgaaatttctgaccaataggcaattaaaagattgtgcatgaccccatgaactattgtttttgagtatctactataagcctattattgagctagaagactttacatactcttttaggtcttctcacctacctcaccaccagtaaggtagttatatacattttacatagaatttttaaagttctctggattatacagaatctataaagccaataattttcacataggtagttgaactacaccatcgatttatgcgattatgaattatttagctaaagactggacaatgggctccctagtatagttccacaaggattgatcttttggagtgacaaataacagctttacctagcatgcatctcaaaatttaatacaaggagattaacgtattgacaaaatagctgtggtctctttcacttgggtacttcgtcttatacatttttagaaataagaaaaacagagttattttgaattaaagctggccttgattttatcttttctgctttttctatgtatgtaatttttaaaaaaaaataaaaatcaccttcatggaactagttatttctgcattatatggctttgtgtattttgccttttgtgggttctgaatctttaaatgaagcatgcattcttgtattacttaatcacagaaatgcaatttgagtgttacgaagctcagaaagattctacagacatctcaaaactgtcattcttttacagacaaacctccctgagaaatacatcattgagttatttgtattaggtacttattcatagtaatactcaaaactgcgtatctattaaaaagcttacagcagctgctacagtacacggaatttctcttttagcattttaactcattttttttcctttgagtgtccttgaagttttaaaaataatacaaatttcataaagtattttacagtcagtatttttaaactctgttttcgtttgacccttgagtgatattatagctcactctcttagtggatgaaatgaaggaaatgtgctcaatataatgtataaaaagcaatgtatctttatcagcagagtatgcactttgtcactttgcaaaataggaggcatatcactgtacctggacatacttgactcccatagccatcctaatcatcttgtttcatgttcaaggtgtaatatatggtatccactaatctattcactcatttaatgggcatgtattgatccctgtgtgtagggtcagggatataacaaacaaacaaacaaacaaacaaacaaaattatgctctgctcttgaagaactcatcctcattgttaggataagaaaagatacaatatagtacaatacaatacagtactaataaaatacagcattttatcactgatacaattaatgatccaattgccatctctaataataaagatatgcccaaaatcctattggatcataaccacaattaaaattagctacttggggatgagaaaaaaaaaatgagagatatgtcagttgagtagggatgaggagaatgaggttagtgatatagataatgtttattttttctttttctttttcttttttgagacagggtctcactctgtcacctaggctggagtgcagtcgtgcaatctcagttcactgcaacctctgcctcctgggctcaagtgatcctcccacctcaccctcctaagtagctgggaccacaggaatgcaccacgatgcctggttaagttttgtatttttttctgtagagatgggatttcaccatgttgcccaggctggtctgaaactcctgagctcatgccatccactgaccttggcctcccaaagtgctgggattacaggtgtgagccaccacacccagcgcaaagacaatttggaggaggttagaatgaaactaagtgacccatgccaggcttgggagctaccacctcattagcaacatataacttctttgaaaacctaatatgtggtttggaactgtgcttgcagatacagtgagaaccaattgtcagtctatttgggctactatagcaaaatgctacaaacctggtggcttatataatataaaaatttatatttcacagtgctggaggctgagaagttcaagatgaaggcagcagctggttcattgtctaatgagggccccattttctggttcctaaatggtgccttccagctttgtcctcacatgatggaagtgacaaggtagcttgctgggccctctttcgtaaggggactaatcacattcttgagagctccaccctcatgacctaatcacctcccaaaggccccatctcctaacaccatcatattagtgattgggtttcaacagatgaattttgggaaaatacaaacattcatactgtagcaccaagaatgtgctataaacagctgacttccactctactgaaatgtggctctgaaaatggttacatatgttgcagatttaatggagttttctcttaaaactgagactgtagatgatgtcaggattttcagaatcagatttgatgtcttctcaaatagcagatgtaaaatctgctgtgaagctatgttttccattacgtattcggttgatgttggatacacagttgtactagaatgtgctacatattgtgaagccataagctgcttcaaggaacaagtttctttagaaggaagttctaacaagcagtggtaaatatgcagctatgttatttccaaggaatgttggtaatttttctgcgttttaaaggactagtcatgtccaaaatttgcaaaccttacacatgtttttttgtggcatcttgactggccagaggacttaattttatctgagcttattcactatacataggggcagcatgaaatcaaagaaagagtaagattttgaagccaaatgtaattgaatttaaatataagcaatataacttaagtgctgcatgaacttagtcaagtaacttaatatacctaaatttaattatttcatgttaaataaatgaaaataatatcaactaattatgtaggcatgagaatttgcaataaatatgtatactgctctctgtcacatagcaggtgttcagttaatagcatatgtaatgtatatgtgtatgtgtatatatattatatatataatatacaatgtatatatacatgtaatccaatcattagtgggtgtttctgatatggaaaatgttatcaggtccataaaaattactgagaaatttaaagatgttcatggaggcttattatgcatcaagctctatactgatctgggcctctttaaaatgaaggtctcattgaagagaaaatctcatgggggaatcaacagacaacatataaaataataaatatataaataaagtactgggtgctttcatacaggctgtgagcacagcagctattcagatttgagagaaataattggtgatcaaataagtcaaaacatggaatttagttttgaaggacctgtattatttagcaagaaaaggggaaattagacaatagttccaagatcacaaacagattcttcaggctcagtcagcttggaaatttttttatttttcctttgcattgctttgtaaaatctctaagccaaccttaaaaaattgggaaatattgcctaaaaatcaaggtctttcaaaaaaatcagaaggcctggaaatgctgagattatatttgtttatggtaatactggttgagctgacaagcagatgtcacatcagttgaagcgtaagttctccaggtcctcatggtctctatccagtatccatttcaatacctgactagtttctgccctaaaaatactttcagagaaaagaaaaaggcgaagatggtgagttgaactttgttgtgtcatttgagatgatcattcagcatacaaggagaaatatctaataactctaactggagattcaggactgaggattgagggcgaaggcagatctggagaggaaattttgagagtgaaacacaaagaaatgggaattcaaagcatgataataaagaagatttgtaatacagttgttcttaaagtgtggtcctgggatcagctcatgcccagtctcagacaaactgaatcagaaactcgggggttgaggccccagatttataagaagccacccagatgttccaatgcacattacattttgagaattattactgtagtggatattgtagcaccaaaactcaactggactgaggattcagcttgtctacacacactttctggaacatgatggaagagaaggggtaagtgatggagataagggaaaaagtacaggcaagaaaaaaagaaccagatgaaggtaatgcatggatcccagggaaaggatatttcaagaggaagctatttaggaggtcaaatggtgccaagaagtcaatgctagtaactgaatatttttaccaattagaaagttactgttcacttttcaaagtattgttccaacagaagtcagtgtttaggaattaagcagaaactggataatacaaagaaagaagtagcttgagtagagcaatcattcaagaaaagtctggcagtaaatgaaaagagagacaccctatgataaccagtgtatggatggaaaggatttgcacatgtttaagggcaggcagaggggaaagagccctggcatttgggaaaaagcatgtacatttcagagaaatataggtgatagataggggaacaggtcacagacatcacagggatgaataccaattggggagaaaaggagaagcaggtcttcttttgagacaggagaatggcaggtggcactagagctgagaggcaacaagtgttggcagagcctggactctgtagctggtctgtctgagattggatcctgcttttgctacttcctagtcatgtgaccctgggaaagttacttaccctgtggctagctcagtgtcctcatttgtaaaatgtagttagacatagtgcctccctcatgggtttgttgcaatgactaacatgagttgaaaaatgtagagaacttagaaaaagggctagtgtctaggaagtgttataaaagtaggtgccagctaaatgaaacacagtggggtggagatgagaggctttgaaagggatacccatgaattcctgagagacctttaaaacctccaaaatctgaaagccacttacataagaacttgagaattgatactacatggttaggttctagaaggcaaatggttctggagatggggtactgttcaagatcaactatgcatgaacaaatgagaagttgatggcagtgagaaccaagaaatggtcaagatgtggtcaaccaggtataatggctttcttgggtgatggccaggaaaggagacaatagaaaacagggttgaatagaggtactgaagtagagcggtggatcctggtggaaagattaggagggacaagcatatgggaaggtagtggagacagcattcaagtggcctggagaacagtctgagcaagtaactaggtattggcagaaggagactgagtgagtgaagaagaaactgtgaattgacttggagtacaaattagaaagcataaatgctaaatcatgtgcttccttggggcctctagaagcattgaacggggacatactggctctatcaaatggtcattagatactagtgtctgagttattattttatgctatacagtaaatgtataggtaataagggagggtttaataagagaaaggaatcaattttaacatgtcacacattgtgctaggagttttaatacatactattttatttcatttttacagttgctatagaaaacagaacatagtaatcatacagatcaaggaacaggtgctgaggggttgagtaatttgccctaggtcatgtgggtgggagagttcagattcaagtctatattaattgattctaaacctcatcctctttctatattagttggccaaatattaaagaatgttaaatatgctgaaatgcattggaatcagttgtagaaggtactcagatgcatgtgaggtttctgactctattggtatggaaatccctttctcataaactttcgctaaggtgacaggttatatatatccccaaattacataacccaactatataacctaaagcataacccaagagttactaattctgagaaccagcaaataagtgattttcttttgattttagaacttgaaagtatgcatttttggtctgctatttttgtgccagatttacatctatttctaattaaagaacaaggaaaggcacaaaccagttactaatcattatctgcttgccatttttcctcacaagattttcactgtaattcagtcaaactactacttagcaactagttatttcaagtggcagaagagatttacataggcattgccaatgttttctttggactttgtttctagaaggtatctgaaagcaaatttcaaaacagctatacttgagttgtaagttgttactatattggctaaatgaggaatatcatcaggcaaaactctgaaaaagtacacagtctaccattttctttctttctttcttttttttttttttttttttttttgagacggagtgtcgctctgtcacccaggctggagtgcagtggcacgatctcggctcactgcaatctctgcctcccaggttcaagtgattctcctgcctcagcctcctgaatagctgggattacaggtgtgcaccaccacgcccggctattttttgtatttttagtatagacgacgtttcaccacgttggtcaggctggtctcgaactcctaacctcgtgatctacccacctcggtctcccaaagtactgggattacagacgtgagccgccgcccccagcctaccattttcaatttaaagtattatatgaaggaaaatttatttgaagttttaaaagtagttctccatatcgacagaaagttcccttagtcgagatcgagaccatcctggctaacacggtgaaaccctgtctctactaaaaaaaatacaaaaaaattagccgggcttgggggcgggcgcctgtagtcccagctactcgggaggctgaggcaggagaatggcgtgaaccctggaggcggagcttgcagtgagccgagatcgcgtcactgcactccagcctgggcgacagagcaacttcgtcttaacaaaaaaaaaaaaaaaagaaaaaagaaaaagaaagaaagttcccttagtctctggagtattgcaaataacaaaccacattctttgctgtttgtgtgttagtcttttggagcagtggttctcaaagcaccatcagcagtatcaaccttacctgggatcctgttagaaatgcaaactctccaggcccacctctttatctactgagtcagatttctgggggtggagtctagcaacctgtgttgataagcctcctaagaggttctgctgcccgttaaacatggagaaccacttactttgagtatatcaaactcgaaatgctgtttgtagccctaggttcctggtgaagctctttgtagcatgaaaatagaaatttgctaagtagtaatacactgacgtgaaaaaagactcatttttttaacaattgtttttctaatctctaagacatataaaaatcattcctcattgacaaaatattgccccttcttcaaacacttcctcttctaggaacttttctccaaatctcccagctagataatcttattttgtgttctttgtaaggtattagcccgaaatagtatgttaataaaagacgttttagtttgcacaatagacatgtaaagtttacttggtgtggatgcatgatcacagtttgattatctctccggggaaagaaacactgcccagattacaagaccaaggaccaggttctggattatttgttgtctgctctttgtaacactgtgagacttctaggcttctgttatcatacacaaatgttagatgagaaagagcttgaaggtcttaggtaagagcttggaagggacaagtgcaaaatcattgagcaaagcattttagaaaggtgtcttgtctgatgaatcctctcacctctgttctttttgcaaagctcaggaggccttggagagaagattattgtgttagtttgttagaactgccataacaaagtaccacagactgggtggcttcatgaaaatatattttctcacagttttgaagtgggaaatacaagatcaaggtattggcaccattgctgcttctaaagcctttctctttttcttgtaaatggctgccttctctctacgacttcatatggtctttttgtgcctgtctctgcttataaggacaacaatcatattggattcgggcctatcgtataaccttattttaccttaattacctctttaaaggctctgtctccaaatacagtcacattctgaggtagtgaggattacaattttaacatattaattttgaggggacaaaattcagtccataacaattatgcatgactttgatgacccatttgtagattgaacttgttaaaacttcagaatataaatgggttgtaaacttgtaggtgaaacgtggctgatgtattccatcagagagatagccctacaacattccaactgggtccctaaagctacagatatgctccattaccatcctcaaatgccaaagaatgaatgagccatctagaagtaggcaaacaaccacatttgctaaaaggctaatgtttcatccattaaataaatgtgatacctttttctagtctggtatcaatatagaaggcatgtgaaaaatgagttagctgagagttaattgactgcggagactctattttcagtctctgcctgtattttttgaattaatatacacagtgggtgattcagcaaaagggtttaaaaataaattctttattgaaggatcccaccaatttgatgtcttcataattcatgaagagtagacccataataactctattttctcttcagctttgaaaataaaagatgccattagtttaaattaggcttgtatgtggaataatcaagtgtatcaacaaatatagtttgactcagatgctgtttaagaataaatgccagaaaagaactggctatttctcttaaaaaattaaatatgaaaattgtattgacaagctagggtgaaagtgttttaaaaagttgatagacaatatatacatttataaaattatgaaaactcaaaaatgtaataagcaaatagttactgtagactagctactcttttaaagcatactctttagaatataaagaaaatagaatataagaaatatcattagagacctggctgtatttgaatataaagaaaatgtcattagagacctggctatatttgtagaatacatgagcactcaggatagttggtgaatatgtaggtatggggttgccaaaaagcatctttgcaatgctgtattagggagttcctactttggctagagaaggcccacatagaaagaactatagtgtaaaatatatttacttcatttatttatttcccttgaaaagttcaaacccccaaggaagtagactgtggatagtattttatctcctctagctgtaagaaatgaaaggatagataagtgaattggatttgtctgaaagcttctggagtcaggaggcacatgggacttgtgctcaggtgtctatttccaggcattattcagcaatttggtcacataattttctctaatattagatttctgcttccaatggtgggtggcatagttgaagaaagaactttatgaagacataaggtcttgatctaaaccctaagaagggaaagagtaagtaaatgaggttatatacctgaaggcatacttttttacttcagaaatttttattttccttcggagtgtataaaatcatgtacttttaatctgcagagtagttttcattctaatctactagtatactttgataaaagcataatttcataggtatattacattcgtgggtctcgtgtttatggtggttacgtctttaaaaaaaatctaaaccttatttatctacatcagttgttgactttgcagatcacagagaatacagagccagtcatgcagaaagtacctgtttgtcatcctgagagttcagacatgaactgtaaccagtggcccattaagtaccttctcttgttgtttaaagcatatcctagctttgcaaattaattgttaatgcagaatgttgtaacggagccatggaatgaaattcctgttactccagtcatagtagatgttgcgtcaagtactctgagttgtgttccattgttttgtgattctgtgctgtcggaaagtctggcctagagagtgtttagaaataaggaaatcaagaaatagtatggtttgcttttttggactctgtgtgtgattttccattgatagtaatattgtaataatttctgagaaataaaattctttttctttgtttataaaaaagttacttgtcaaaatactcacaaatgctttccataagaaaacatttaacattttttgctgtaaaagtgattacatatactacatttaatgcagtagaggacattcttgtaatattgatacagtaggacaatatgcatgccattgactattgttaacagtccagttgtgagatgaaatccactatgaaacacagtaatgtttaatttcatatttaagacagagctaaatttcagtttagaaggttcttatataaaaatttcaggaacacctttataaaccaattaagaaggatttttgtcttaagggtttatgtgcctggtgtaagatagttatacctgatctaatttttctttctttttctgatttttacttctcacatattgtattaatggtgcttggtgtggaaaaaaaagatgcagtgacattttcttctcttatcccttattttctactctaagatacatataattttgcaaatatttatttaccttaatagctcaaacctagctaacattacagctagttaatgggtatgattgtaggtacgatgaatcattgtctagtaaagagactgttcaaatatgattttattttactggttattttcccaacagagagactcttggggtgaaatagagctccaaaaagagtgttttgggggagatgggaaagggaggattgggagtttttaaagggaataatctcgtgtggtaataggcatgaggtaatagtcattttgataatatgaaacaaacaaaaaagcttcgaacaggtgagtatctgtacaactaggtagagtgagaacataatgaaatccctaacatttaaaactaacgatgtaaactgtaaatgtaattatcttttagcaaataactttacatgtcaattttctcagtggaattttttgacagtctaagtagtaatgtttgaagctttggggacagaatctttacccccttccacttctcatcattctcagagaatgccgagggctggagacatttttatatagctgatagcagggagagcatcattggaagaagagctaacattaataatacttactctgtgtcggccactgtcctcagcacgttaggtaaaccccattttaccttcacaaaaagcctataaagaagacaatattatcctcatcttatatacttacaaaaatatttatatcattacaaataattcaaatcattatttaaataaatgtatttatattattatagatgatcaaatgatgcaaaaagcacatattacttacttagccaaccaaatatacccaggctaaattaggatttgaaccatgatagtttggtgtctccgtatattcttttaactactatattacattgctcctggagcctaatatagtggattcccaaagacataaatgttgattgaactaggagatttgacatatttagcttctcatttttgcagatgaagaaactgtgtcttagtgaagttgggttaaactctgcagtgttacaacacaaggtgagagtcagagctggatgcaaaccctgttcagtctagcaccaaggtccatgctttcttccatgaatccacagagtgcgatttactgtgatcacaatcacatgtgatcctcttttggctgcctgtgacagcctgacaagtttatttttgaagctcaacccattgcttacatagggaagaacattcctaagttataaagaagaactggtgaaaggacatcatccaggtgtgaaatgggaatccagagcttgttttcttggtttatgcatgctcagttgtgtgtgccccgatgttcattagagtgttttaagtgtcttcaatgggttacaataacatgggtttttttctctctctctctttcaggtatggaaaaattgtatctacaaaggcaattcttgacaaaaacacaaatcagtgcaaaggtatgtgtaagggcatccgtaccctgaaatcttgcctatgctatctgattaatggttcttccattgtggaggtccaggtaccagctgcacaatgatcacaatgcatagtatggaaaacctctttaatgatgccaatgttttgataagttgtatttctagtaacattgctcattcatttttttcattaacaaacaaaatgaaaatcacaaatcagaacaagtatcaaattgcttcagcataaaactaaattacctcctaacaactttggggtgtctgatgtgaatgatatcatcagtgatgcaaattgatttcctatataaaaatgaggaactctggggaaaacttccccatgcaaaacacattttaatttctctgttctttaaagctttagcaacattggttgactatgaataaatttactgatgggcctattgtattaagcttcagctataagcatctcagggatttcagagttggtatcttattaagacaggcttttggttttcctggaaatacttctgaagtcattggactatatctgtggctcatgtttcttcatgtctgggagtcctatattcttttaaaatttgcattagattaattgtggaacctgtatggtctctcttgcatgactcagttcttactggaaaattggaatgcttcttgtaacatgctgtttgttgttcctttaatctaatctttgttgtaacactgaaatcaagaagtatagcacagccacgttcattctaaacactgcctctatttcatatacaaacataatgtgcacaagttttaggaaagaacactcagaaactcctgtatatgtatctcctcacctacttgcataatggtagtcagattcaattcagcaattaaaaaaataaaaacattccacgtcttctataaactcagaaatgaactacatattacaagacaaagaataatatgacatgatttcttccacctcatagattcaagtcctagttaaaaagacaccaagaaaaccaagaaactaattctaatatccttattaggattactatatcaccttaatatatgtgagggtgtaacagcggtatctaaaacagaattatcgacaaaccactgttagaggagaacatagagatttctttttgggaaatgaagtttataaagtcaaggtagaatgggtgagcttgggacaggtggatgttcaggagagagaatttcagaatgtaattgagtagacccacgtagctgtaaaaaaaaaaaaaaaaaaagtactgctgggcgcggtggctcacgcctataatcccagcactttgggaggctgaggagggtggatcatgaggtcaggactttgagaccagcctggccaacatggtgaaaccctgtctctactaaaaatacaaagattagctgggcacggttgtaggcacctgtaatcccagctacttgggaggctgtggcaggagaatcgtttgaacccaggaggcagaggttgcagtgagccgagattgcgtcattgcactccagcctgggctacagggcaagactccctctcaaaaaaaaaaaaaaaaaaaaaaagtaccagtgaggacagaaacaagaaaggggttaaaattgtgtaggtttttaaatgatatcctggatattttaaatttaaaatttaatttaaaattaaatttaatttaaaattaaaatttaaaattttgagcagacaaaatatgattctgcaggtgtttcgtaatgttatttcagcaaaggtgtgtgaaattgaaatataaagggagggagtggaaacaaaaaaaaatgtaggctttaaagccatagtacaatagagaaattagaaaaaaatcagcttaactattactattagggtaataggaaggggttcaccatgaaagtttttaaaggtagagttggctattgactctaacagtgaaagagaggaatgtatgaaacaaaccctacatacatgttgagtcttctgattgggaaagatgcctgtgcctcttggtgaggtaagaagtccagaagtagtagtagtaggttttggggagaaggtgttggacatgctgagttagagtctctggcatggcaaccatgtggaagatgtcaaagaggaaattgtaagaaagcccagggctacagatgctgactgaagtcaaaggaatagataagattaccaaagaataatgtgtagaaggggaaatggagtggagtgaattagggtgggcagttgagaacttggagaacatttgagaagaaagctgggccatggccaagggatgttctgtcactcttggcctgtgggaagcatgtggcatgttagaagcattagaatgcgaattatagtgcatctagacctgcccaacccatatacaaagtcttgggtcagacagttaataatattaatcaagcaccaatcagaagcacaaatactgcacaggtaagcaacacctggaaacctcaatagatagactcataaccggagcggtcaatatgaagggatacttccttatgcagagttttgctcaagcatgctgatatctgttgtcacagtacaactctgaagaccacgaaaatgtaaattgccaacatgcaaaaactgtacccttctataactgtgaaggtttgaagaaaaagggatgtaactaaaaatgggcggtcagggtctccataagcaaattatatagtgggagcgtgggtgcttatcaggacaaattatactatgggtatccttatccttacatcagctcctaaaatccctatccacgctattttgcaacagcttatttaattttctgtttctgtagagagattcctaaaatcagtggaaacagggcctgtgtgctatagaaaacttacctccaaagtgggatgtgtgaagggtgatacaagactgtttattggagaggctaaaagaaaatattagaatttacatctctctttgttttttatatcaactttttgtgaacattacatattaatataatcttacaaatacatagattttaaataaatatgaaaatgttgagtttgctgcttcaaaatacttttatctctagtgatatgaatactggtctcaccaataaatatggaagaagaaaaggagtaagagaaggaggtaaaaaaggaaggaagagagggaaggaggaaagacggggctgtggaacagcctaggaaaatcacttaaagaaaggcatctgtaagaaattggacagcggttaggccgggcgcagtggctcatgcctgtaatcccagcactttgggaggccaagatgggcggatcacaaggtcaggagatcgagaccatcctggctaaaaccgtgaaaccctgtctctactaaaactataaaaaattagccgggcgtggtggcgggtgcctgtagtcccagctacttgggaggctgaggcaggagaatggcgtgaacccaggaggcggagcttgcagtgagctgagatcgtgccactgcactccagcctgggtgacagagcaaggctcagtctcgaaaaaaaaaaaagaaattggacaccatttagaccgtttgccctgagggtaatacgaagaaggcaaagtgatcgtgtgtccattatatgcttataaaagcctcccattgccttgcttatcctcagcatgtagagtctctgcttagcagtggtgagtgaatcacaaccttcatcaagcacatcatgggggaggtgccctgtaagtcagcaaatcatgatcaaaaatatactactatccctttcatgtttttagaaaaatactattttaatgatatgccgatgtatattagagtattttcctttcaaaaaatagaccttgacatagatatgagaagatatgattagaaagacagcaattatagaaaattgtgtataattgttcatgatgaccaagggaataataggagaaagatatgaggtcatggaaaggttcaaggaactgataagaacgagtattgaaacaatcgtctaaatgtttattggaattgccaagaaatgaaacaggagttgtattagaaaaagtgactaatccagaaagtatctgcggagaaataatgggatgggaaatgatactagggatctgtagaccatgatgaaaatgaagactagttggttataaaatttgatgatgtgagattctaaatgggagattttaggtaggggagaaaccatactgagaaaggaggaaagtggactaccacttacaggtccagtgggaggaaggatatgggagaaaaaaaaagaaacaaaactcaaacttgagagggctacaaaggaagtagtgtcctcagggtaagttaggtagtgatgggaaacatgcaaattaaagcaatatgcagtgatagtttataacccctgaagtagcaaacattataacatgtaggccattcatgctgttcactctgaaactggttcatccattcttcattggtaccatgctaaatcggtacagcttttttaaagtcagtatggaaacagcaataaagagcatacagttgaaactagttagtctgttgagaatatttattcaaatatgttatctaaacatatgttttaaattatgtatctacgtacaactttgagcactctcgttttccttactaggaaaaaatataggaagcatccaaattctagcttatggagcatatacaactgttatgtagctgttaaaatggtagtcataaagactagattatgccaagcctagaaaaatgtttattatatgaagttaaatcaatataaagggatataaaataatgtgtacactgaacatggagctatgtaaatatttgagagtcaggatcagtgtggttatgactgtggtagatccaggctgcctgggttgaacgctgcctcttcgcttagtagctgtgtgacctgtggtaaattagtcaactgcactgtgccttctgcaaggtaagaacatcagcaaagtaataacagagcctcactcacagtgtgttgtgatgattaacaaagttaatacatggaaaatgtttgacgatatctcctgttacttttgtataaaatactggcaatatcaagcaagacaaaaatgtttgttttaacatggtgggcttatgggtgatatattattattattattatcttaacatttctccaaatctgttctgtttttttgggcaagaaaaaaatacagctcttggaaaaattaagctggttttaattatgtttatattttgattgttctttctatggaacctgagtaactcatgactgtatggttcttcgtttttgtaaaataattccagatgaaaatagtgaagaattaggagagaataacatgttttgctttttaaaataataggcagagattgagtacttcttgaccattgctttatttaggaaagaaattacaggatgtgtgaggtgcctttttcaaacaaaatcattaagagcatcaagactgtcgtcattagaggacacaaattggatttggtcttctctgtgacacttggttttgaatcctttgcaactttatctccaggcaaaggctatacaattaaatctaaacattatgaactgaaggatttgtttatttttatttttaaagacatgatagtaattcaattcttcattagctgttacacgtacagcatattgtgtgtaagttagtctttaccaaggtatgagaaagtccatgaacttgtctccttagagataaaaagaaaaggtataaaaattaacctaatgcattaaaccaacagaattgaatcctattttagcatttaaaagaaaagcttttatgctctcctgaatcccacccacaccctgtaagttagggacagtagtcaggcctaggtaagcttactcacttttttattccggaaggggttatcaggaactttcaacataacctctcgttttcaagattattctttcttgggtggtggctgcatcagctttcattccgtataatatgacaacatacaacaaagcagtcaccatcaagccaaaatgaccagaaattgctgaacaaagcgagtaacagctccagatggggagtaatgaaaaacagaccacagttctcattcagatattcaaacacaaggactaaataagagctattgtacaagacacagagatttgcactgcattttttgcttgtttggcttttgttttcccccatgtgttttccttctggatcagtgtatttgctaaattaaaaagtcagggaaaattaaatgaaagctattggaaacaaggtgtaaatcttaaaagaattcacttgtctatgccttcctgcttttgaaggttggtttcccttttctccctgcacccaccagccttaccaccatcatatttccgacaggctatatgtttagagtagagggaatgagtaatggatattccgtagaaagtttccatgcctattaaccataggatataagagtagatagagtgtgccaaacataccagctcacttctgagggtttgaaatactctcttttgcctttgttgtcacaggctggttaaattatatttatggagcttatgttacctttgacataacattgagcccttaaaatcaaaattggagacaagtatccaaaagttctgaaatcatccatgaaggatattcattcattcattcattattaaataaaatcataaattgttatttcttctataagagaaataattctgcatatgacacttattttatagagaggatttagagcccatctagattgtctcagagagtggtgtgactttgttactggactgaatccatttagcagttctaaactcacaatcatgttatacattttgaaagtatttctaggtgaataaatattaggccatacacttggatgactttggaattcatcaattttattttacttttcttgtttatgcactgatggaatatttatacatgtgagggaaatacatatttctttctttttttttttttttttttttgagacatagtcttcttctgtcacccaggctggagtgcagtggtgcgatcttggctcactgtaacctccacctccagcaattattctcctgcctcagcctcccgagtagctgggattacaggtgcgcgccaccatgccccattaatttttttttgtatttttattagagacaaggtttcaccatgtgggccaggctggttgaactcctgacctcaagtgatccacttgcctcggcctcccaaaatgctgggattacaggtgtgagccactgcgcccggtcagaaatacagatttctgtgttgaaccccctgaatctggaaggagggcaggatattatattttgttatatgtttaggtagagtaattacaggacatgaggtatcctttacctatggattagttttaacaagtgacactgacatgcatttgtggtgaaatgtttaagtggaactatttaactctggcggataacagacatttccagggctggtccacatggaaatcaagcaagtaaaggaagaaaccaacaccatggaaagcctcttttctagtacctttatttcttgaaagcagtggaaactaaaataaatgttctgtgaaatttatgagtgtgaggaattacattttgagaagaataatcacctccaccaggtgggctcacagtctattgagcaagaagctcatgagaagcaaaatggcttgaaaaacacatttattcaattttcatataatgggattaggtataccccgcccacatcaaaaaaaaaaaaaaaaaagaaaaaaagaaaagacaaaaaaaagttatattttaaattatatttctctttggaatatgaagtgtgtaatatttccctagcctttttttgtgaattttactctaatctactctagtattaagtttaccaccagtcataggtcatcaatatataaacttgaaggtttgctttatttgattttgatattggcttttgttttcatttcagaaaaggttagcatatgcaggaactttggaaccttcattagtgcatcaagtttactcagaattgtcctgtaggtacattttacgtagaatttttatcctgtgactcttttaagaaaataccaatttttcttgtcttacagccaagttcggaaagaatatccactttgatggtaaatggtctttatttgttgtctacaacccaaccagacaactacaactaaaggcaatacttctgccaaaaattagctttccaaacttattatttccaatatcaggatattaattatgttatgattatttagtgttaactttgagaagtccttgatataaatgtaaaacaaaataggtatttatgttttggaagtcatacagctacacgtttttcagcaggttttatagctatatatttactcagcatttgcttgtaatcacttaatatacatattagacaaaagtaaaattatccactaacatgaaatataacatcagcattgctgttttaagcatcaacttgtgttcaatagcctttagtattgtaacctacttccctaatgcttttgtacatgcagaacgtgcagaaatgattttattgggaaaacttttttttttttcttgttttttgagacagagtctcactctgtcacccaggctagagtctcggctcactgcaacctccgcctcccgggttcaagtgattctcctgccttagcctctcaggtagctgggactacaggcgcattctaccatgcctggctaattttttgtatttttagtagagacggggtttcactgtattagccaggatggtgttgatgtcctgacatcatgatccgcccgcctcaacctcccaaattgctgggattacaggcatgagccactgcgcctagcctgggaaaacatttttaaaataattgttgaggaatataaaacagcttaaaaataaaatgatagagttacattactttcacccgtaaaccgaatgttacttttactaatccatgttatctgactaaacagaaactgtcgtccaggtattctgtttgcttccttgctcctgtctttcacttccctattttaagaatttgactcatgtcgataaacataaaatgctctctcttcctacctctagtagtctatgtaaattattgcttccaaaagtcaccttctcaaaaagtcctccaagactctactcatcctatctaaacacctttacaaaaccacttcctttgggcaccatctgtgtgcaaagatctaaggataccccatctctcatctctcatgcttttatgattagtttgtgtccttcctctagattataaactccctgggacccaggtagttaggattattgccgaagtattgaggatgcaggacagttctgagtagtcacttagatcccagtgctttacctctgtctctgagaccctttgatgttatatcaatggaaagcacaagcttggccaggtatgtgttccataggcctgtacagacaggaagagtaccaaagacatacagatgcatatgtttctcagagttattctctaaaagtattcatttttttttttttttttttttttttttttttttttttgggagacagagtcttgctctgttgcccaggctggagtgcagtggtgcgatctcagttcaccgcaacctccgcctcccgggttcaaacgattctcctgcctcagcctcccaagtagctgggattacagtcatgcaccaccatgcccagctcatttttgtatttttagtagagacagggtttcaccatgttaacctggctggtctcgaactcctgacctcaggtgatccacctgcctcggcctcccaaagtgctgggattacaggcgtgaaccactgaggccggccaaaagtattcattcttaattcagagtacttattttgttaatgtggagttattctttttaatggtttaaagctatttttgttcattaatgattttattaatacatggcaaattgtatatactaatgtatatttaaaatgatatacaaaatataataatgtataatgcacaaatatgatatatgtgtgtattcagttcactaaaatttatgtaaacttgtaatactatgtaaataaccttttaaatataaaaaagacacagttcttcaaaaattttctaattgaagtctataccaagaaattctctaagttatgatcttagtttccttggacaaggcacataacatctctgaacatctgtttttcaactgtcaagtgaggttatctacacctgcaatacaaaggtattttcagaactacatggaaccatgtttgttatatgccgggcacatacatcaggcaaatgtttctatggccttggacttggataccttctaggaaccaacttgtttagagcttgtatgtaacttacataatttaatgccattctgagtacattttaactgtaagaaatgtgtgttttatgaattgacttgtgtttattgagattagcttcgttaatagcaaaaagtataagtacttaaaggatgtcttaaaggtatgaaagataccttttggtgttggctatatgatagcttcaagattttttagggcctataaacctggtgtgtttgagataaagcaaattccatcgcagtgacaggtgatggaattcattctagttgagttgtataggttctgggaaaaaaattttctttgttcactcctttgttatgctattcactctgtaatattgttttacaagtttaaaggaaaaaaatgcctaaagattcttgactccttagttttttaaactatggtaaaagcatctaacatttaaggcatggtcaatcatcatttgctttggtgctagccattgttcttattattagttaatcatattgattctaaatagctattctttttccttccctttagtaaagaaaagagaactctggggtatgaaagagaaaaactcatgtacatagctgaaaaacaaaacaaaacaaaacaagctacaaaaacctaaatagagtttgaaaggtgaatgtaccacttgatatgcttcttcaaaggactataagtgagctcagatgcctgcttatctataaaatattggcaatataagtactttaatatgatcattttagaaacaggtataattttctccttgagttgtggaataagagaaaattacaaagttttcatttaatttctacttctcttaagaaaagggcagtttattttcactgctaggcatacagatagacctattggtcattcagcggacaccagccctgaattagcagaaacctgtatcataaagcatatttggaacactttttctatgccacttttaaaaacacaatttctttcgataaacaataggaagcttaagctgcagatatcacagctgttcatattctcagatctcgtccacaattcaaacagcagcagctgaaacaaacgattttagggaagcaactgtcaaaaaacacactgggccttgggcttaagggtagtgtgaaaaataaccatatttgagatatactgaatgaaatcatgtggtgaaattccacgggaaatataaagcacattggaatttatgtctttgggacacatgctgcaatagataaaccaaaaactgtagcttttaatcaatgagaaggattttctttttttttttttgtaaaaaagaagaattacataaggtagaatttgtaggctcattaaaaaaaatagtattaagacactgtggcataaaattttctcaatcttcccatacattcttttgaatgacgaggggttcaaagtgagaaaattcctaatttcacatctaagatataaggaaattattggtaatactatttctttttatagggaagcagatgataaaattgagaatatgacaagaggacaacttaacaagtcaaagattcccgtatagaaaatagaaattttctcagtctatctcaatttctggctattgttttgaaccaaataagaataactccaagtgaaatataaatatatatatataattttattatatatacatatatttacatatttattctacatatatagtcatgtattacataatgatgttttggtcatcgacaaaactcatatatgacagttgtcccataggattataccatgtttttactgtaccttttctatgtttagatatacaaatacttatgattgtgttaccattgcctacagtattcagtattgcaatatgcggtacaggtttgtagcctaggagtaatatgctataccatacagcctaggtgtatagtaggctataccatctacatttgtgtaagtaaactgtggtgtttgcacaataatgaaatcacctaaggacacatttctcagaatgtattcccattgttaagtgatgcatgactgtatataattacatgtgtatgtcagtacatctgtgtgtgtgtgtgtgtgtgtgtgtatcacagggacaaaacatttatgaggtatttttattcaaagagagtttaaaaattgttatataaagatttacctaaaagtttatattttagtttaataaaatgtaaaaaggaatcttgaaatgaaatccccatagttctttgtaattaagcatctgctatgttacataaaccgaaaagtcctggggaagttgttctgccttagggagttgtcaggttctttgtggttgtctgctgttgtgagaagtaatttaagataagtaagaacaagttaacactgcatatacaattatctaataaaagcttgttcaagcattgatatcatgtgtatatgtttaaaatctccatgaaagtttaacacgtccactttgtatttgccacatattatgtcttattaatatggactattagtacaactaagtacattcctttatggtgtccaggtcagtctatatttccactctgtgcgtctttcaaaagttactagtttagagccaaccctttgtctctgtttactgttgcagacattttaaaaaattcatataaaatatatctttccagataagatggttccagtttacaagtgatcttctgtagacaatagaaagccagtatcacacgtaaatttgtgaaaacatccgacgctgttgcaagcccgaggttaatttatccgttttaggaggaagacttacggtgcttctgttaaccgcagccatttgttgcatcaagggtcagccctatctgcattagcatttaccaacatctctatcttttgtttcctgtctgagtttacttaaatatggaaggtaaactcttcaacctatctcccatcagcctatcaaccaaccaatcagtggaccaaataaaacagactaaagaaccaatacccaaactcaaaacataaacataaaaatactcaaaaaagaggggaaagtcaatcctaaggggagggatcatgaatggtgtctttggcttgcttgcccaggagagacgccctacttaacagtgagcagaaaatgagtaaacgaagagctgtgtagtcctcagaaaaatggttcgcggtagttatggtgtcagagatatatttatactaacatactctgcagctcagccccatgagcatactgagtctagaagtctcttagaacattcctgtaattcatcagaagggcaaatttgtctagggaaggaattttgtttggctacaatactgttaaaagtatttaaattagaatgccttttagcgggacctaaactatcctttattttcttaaaaccagcccgcttcactcatttgtatacctgcttggccattgaagacatgtgcatcttcaactttcaatagcctataccattgttgaatggacatcaagtaactaacaaaattattattattcgcattttactcatgaggaaacaaaccaggagatgctgtgaaatgtgtcaaacatcaaatggtcatccaaacctaagtctgtctaactcccaaagcataggtctctccactgtttcactctttctcccataaaataatcccaataagtaagactagaagtaaatgatcctggatgtttttaatgacaattagacacaagcacaatgttttgagttcgcataaaggcagacaatttgatagaaacatgtagtagttcttattctcccacttccatcccactataaacagtatcgattaggggttctagttctgtttgtcactgaatatagatataaaaacatggagctggcactatgaaagcacatgttccttttgaaaatattttgatcattttgttccatttaaaatcattttccttttttatattttgagaatggttttctgctaacttcaattttgcacttatgttggcaaatgtctagctttctatctaggttaactttaaagtgagctgcagttaaataaattttaagtgggaaaatagcctcagaattattgtggtagaaagacaaggtgcagctgatactttctcttactctcaggactcagaatgagccatgtgcttctttaaagggcctatgtggtcgtttcagagcaaatgctctctttcatcttatttaagttctgtttggcttgcctcccatatttgctcagtggggataaggttaagacctctgaggaggccactctatcccaattacttacccagtctcttttcttttcttcaaatagcttgcgtgtagttgtggagaatgtttgggggtcattatcttcttgatggatgaatccagagataaacaaacattttctatttgaattctaaaggtatgataaagtttaatccaaagacttttatgttttgaattcatccaggcaccaattcttgcagcaaaacatccaaacgcctgctaaggccaattatttcttttgaaatctggtttttctcagaaagttcttcccccatccacgtagtttcctattgtctcaagttgccctccagcctctaattcttaccgagatttaccttgtcattcattcccttctgtcctttacggaaatgttaagcatctgtgctcagtttttttcaacagctatattcaagcacatgctttatttcctcgtactcactctagattcccctgtccaagtttgagtctgaatttttacagtgtttagattctaactacatttctttcttgcctagttcctgagtggtctttctctggcctgacattctacttccaggcaccaatcctaatataactggatcctgctttgggaactgtaaggaggattgttttacttctccaacaccattgtctgtgttaattttgctgataggatttttataggaagcagcataacagcaaggcagtcatttcatatttgtaaccaaaatcaagtaattctcaggtagaccacagatgtattttttcctgcttctttgaagctgaagatcgtttgcaataggtgcctataaagtacctctgcagtggaaaaaataacatcctatgtggcatggcatccctgttcctccatggaaaccacagttagttttgacattgccagaatttttgaattttggggagaagctatggggaaaaaatgtaaaggctttctcatctggatttaactcgagttaaagcattacctgaagctctgtgcggccttgtttgggctttgttctctaaacagtttgtagatgattgtgttcagaattcccagcccacattagctaactgcacacatgtggaaacacagagaggctatgacctttagatccactccagaaatacaaacttggtctctaagtttagagaggaaattcttccctctcactagccaggatctgggactgatgttttgcccaggtcacacatatgtctgagccgtgccagttagtaggggaaaaaaatgacctcttgggtaatttgtacgtcatgaagacttggctctgtcttggtccagggagcagcagctcatttaaagtgcacaggaccttatgagttttagggggccacaaaacatgaacccaaataaagtggaaatttgtgatgattggtctatgagaaggcaaccataaaaataatttaagaggcagtgagcaggcctcttgcctttttttctgtctgatttatttatttataaaattttaattggaaaattaaaaattaaaaaaggttctgaaggtagattccatttcttggctattgtgaataattactactatgaacaagcaagtgcagatatctctttggcatactgattctattcccttcagatgtgtacccagtagtgggattgctggatgatatggtagttctatttttaattttttgagaaacctctatactgttttctctaatggctatactaatttacattcccaccaagaatgtgcaaggattcccttttctccacatcctcatcaacatttatctttcatctttttcctaatagccattctaacaggtgtgagttgatagctcattgtggatttaatttgtgtttctctgatgactagtcatggtgagcatgttttcatatacctgtcggctctttgtatgtcttcttttgagaaatatctattcaggtcctttgcctatttttaaaattaggatattgaattgatatatgttaaccccttattagatctatggtttgcaaatacttcctcccgtatcagacatatgttatgtcttcaccatgttgattgtttccttggctgtgtttttcagtttgatgtagtcccattcatccattttcacttttgtttcctgtgcttttagtgtcatgtccaataaataagtgaccagaccaatgtcacagagcttttcggctgtgttttcttctagtagttttatagtttcaggtcttatatttacatttttaatcccttttgagttgatttttgtatgtagtatgaaataaaggtctaatttcattcttctgcttgtggacatctagctgtcccaacaatatttattgaatagactgtccttttgctcttgtgtattctcagtacctttgtcaaaactcaattgactgtaatcacatggatttgtttctgggatctctattctgttccactgatctatgtaatagtttttatgccagtaccatactctgtttattattgtagctttgtagtgtattttgaagtcatgtagtgtgatgccttcaattttgttttttttttttgttgtttgtttgtttgtttttactcaagatagctttggctgtttgaggaatactgtggttccatatgaattttaggacttttttttatttctgtgaaaaatgttattggaatttttatatcaatcacatttaatctgtagattgctttgggtagtatgggcatcttaatagtattcttctaatcaatgaacgtgagacatgtttccatttatttgtgtattcttcaatttcttttatcaattttggatctttttttaatgtacaggcctttcatctccttggttaaatttaattttaagtatttgatatttttgtagtgatggtaaatgggattttaaaaattgcatttttggctattcattgttaagtgtacttaacatatattactatattgtatgttgattttttatccagcaattttactgaatttgtttattagttccaatagttttttggtggaattttttaggctacattatagataaaatcatgttacttacaaacaaggataatttaacttcttcctttccattttgaatgccctttatttctttttcttgcttaattgttctcgctaggggacgtccagtaatatgttcaatagaagtggtaagagtgggaatccttgtcttgttcctaatctcagaaaagaaaaatttcaactttccctcattgaatgagatattagctatggtccatcatatatgtcctttcaggtattgagatacattccttctatacctaatttgttgagattttttatcatgaaaggggattggattttgtaaaataatttttctgcaactattgagattatcatatggtttttgtccttcattctgttaaggtgatttatcatatttatagatttatgtatgttgaaccacctttacatcactggaataaattgcacttgatcatggtgaatgcttcttttaatgtgatgttaaatttgacttgctagtattttgttgaggttatttacatctatgttcatcagggatattcgcctgtaatattcttctcttgcagtgttcttgtcaggctttgatgacaggaaaatgctggccctataaaatgtatttaaaagtattccctctgctgcaattttttggaagtcttgtttgaaaagtattagtatcggttcttctttaaatgtttgttaacagtgaaatcatcaggtcccggacttttctttcatgggaaaaatgttattactgtttcaatctccttgttattggtctgttcagattttccattacttcatggtttagtcttggtttttatgttttagttttatgtgtctaagaatgtatccattttttctaagttatccaatttgttggtatataattgttcatagaagtctcctatgatcctttgtatttttggtatcagctataatatctcctctttcatttctgatattatttgagtcttctttctttttgttctttgttggtctagctaaaggtttgtcaattttgtttgtttaaaaaaaaaaaactcttggttttgttgaccttttctattgtttttctagttctgcttcacttatttctgctctgatctttgtttttttttattctgctaactttggccttaatttctctttctttttctgattccttgaagtttaacattaggatatctctttactatcagctgtatttaaaaaaaaatgaggttcttttatgacctcatttcaagagtcaataaactttccatactctttaggtacatacactagattatgtaatttttttctacagaaataatgttttaggaatagaaaaattatacacatgaatgcaacctttgctttgtattcctgaaaacttggaaataacctaatatgcacaaatagaaatggctaaactctggttaaaactatagagtattttataattatgtaaaggaaaaattgttaagactctgaggcagcatggaaacctagctatagtatgatattaattgcgaaaaaaaaagacaaatctatgtatgctctgctaataactaggtcaaaatgtgaagtatgatggcttctgacaatgtttttacttgatatgtgtaattatcagttgacatgtctctctcctctgcactgtgacttctttgatggggagagcatatttttccatatgtgcaaaaacaagacctagcacataatatgagctaataaatatttctgaattaacccttgaaaaggtagcaaaaaaataaaattatataattgtatccatgatctgaccacaattctctaaacataatgcatttagaaggcaaaggtctaaaggaattgtatagaagtgattacaagggttcttgtgtggtgaggtattgatttttcaatgttcattatatgtttaaaaaattctcctatctataatagaaaacaacaataatgactaaagtagtattagcacaatttagcaatactgagatgcaagaaaaactcattttttcaataatgagaaaatatgaagattcatattgtcattaaaattcaattatatatgtgaaattttgaatctctgttatttggaatgagatgtcaagaaagagaaacttctaactactaatcataatataaggcctctcgtcatctggcttgttctctcctctctaacaccagaaatagtgtacatttgtataatataatctattttttccccatatctccttcttttttaattattatactttaagttctggggtacatgtgcagaatgcacaggtttgttacataggtatacatgtgccatggtggtttgctgcacccacgaacccatcatctacattaggtatttctcctaatgctatacctcccctatccctccacttgccaacaggccccagtgtgtgatattcccctccctgtgtccatgcgttctcattgttcagctcccacttatgagtgaggacatgcagtgtttggttttctgttcttgtgttagtttgctgagaataatggtttccagcttcatccatgtccctgcaaaggacatgaactcattccttttgtggctgcttagtattccatggtgtatatatgccaaattttctttatccagtctatcattgatgggcatttgggctggtttcaagtctttgctactgtgaatagtgctgcagtaaacatacgtgcgctttttttttatagtagaatgatttttaatcctttcggtatatacccagttacgggattactgggtcaaatggtatttctggttctagatccttgagaaatcaccacactgtcttccacaattgttgaactaatttacactcccaccaacagtgtaaaaccgttcctatttctccacatcctctccagcatctgttgtttcctgactttttaatgatcgccattctaactggcgcgagatggtatctcatggtggttttgatttgcatttctctaatgaccagtgatgatgagcttttcttcatgtgtttgttggctgcataaatgtcttcttttaagaagtgtctgttcatatcctttgcccacttttgatggggttggtttttttttttgtaagtttgtttaagttctttgtagattctagatattagccttttgtcaggtgggtagattgcaaaatataactcttgagtgtagggagtattcacattctactccatgtgaatagcatctctagaattatacaatgagcaacctatgtggccatagtgatggctctggtcaattcttatctcttaccacatatccaaccaaccatacctaattatttacatgccacatggaaaaatactttggtgcctgttctctttgcctgtaacgtaacaagcaccccacatttactaataatgactaatatatagtgagcattttctatgtacataaattattctaagagttttacatatatgatagcagttttttcaaattgatataattattgtcttcattttctaggtgaaagagacaaggaacttgcctaagttgccataacatgaaatagcagatttgggatataaattcaggtctgctttgttttaaagcctgggtatttaatgtctcacatgtcatccctcttttatgctgcctgtgtgctcttccttgacttgcgagactcagctgataaattcctcaaagctttccctgtgccttccacgctagcccaagctgcctttggtatccttcctctatatcccttaatacaagtctgttctcccaaaagtatacccagaatttagcaagctgtgtataatcagtgatttttctttattcatgtttcacttaaactatgggcttatcaagagtgagaattgtacacctattcagaacaacaacaaaggactgtatcgtattcatttcttgttcactcatgcttagcacatgctttgcacgtgaagtagttgtccaatgcatgtctaaaagaataaaatgatgaatggcttaaccacatctcagattctcaattcatggttatagcacaaaaaaatgatcatgcatgtgattttggctgtgattagaaactgggataaaattgcagccatttatcacagagatggaataagcacaatttcttattaagtacctgtggactccatacttttgcagatacactgcttctttaaacaatgctttaatcacaacatttggctgcttcaaacctgtatgtgacttgttatttcattctttatcaagtctgaatttctcagtatagatttaaagagcactgatatcatagatcaacccatagtgattttcaccttgttctaatatgtatctttgacaccaagaagaccagtcactttactctcccaacgcgctatacttataccaccattcagtctttactcagctcatactccagctcattattcttcttccattctaaacctgacttagattattaggcaaacttaaattctacttactttatagagggttccctgcctaggttagctcttggtaaagtcccttttctattgcctatgtcaaataatgtaccatatgatacaggttgagtatcccttttctgaaatgcttgagaccagaagtatttcagatttcagatttttttttcaaatcatggaatatttgcattctaattgagcatctcaaatccaaaaactcaaaacccaaaatgctccaataagcattttcttggagcatgaattttgagcatcatataagcaactcaaaacatttcaaattttagagcttttggatttcagatttttggattagggatgctcaatttgtaatattgttgactatttgcagcattgctttagttatgttagcattgtttattttttcctataaagatatgagcagatgctatgcatttctcttgtttaaaattacaagttattgtgtgcccactctgtgctaaaatctattctgcatgttttacaaatattttattatgaaaagatttgagtttccttttggttagtgataaaggagaaaatctttcaacagatgccatgagaactgattaaaataaaaagttaattttggccgggcgtggtggctcacgcctgtaatcccaacactttgggaggccaaggtgggtggatcactaggtgaggagatcaagacctattggctaacatggtgaaactctgcctctactaaaaatacaaaaaattagtgggacatggcggcatgcacctgtaatcccagctacttgggaggctgaggcgggagaatcacttgaacccaggagcagaggttacagtgagctgagatcgcaccactgcactccagcctgggcgacggagagagacttcatctcaaataaaataaaataaataaaaaaggttattttaaaccaaatttctaaaaataagtgtgattctcaaatttaacagtgatcctaataaggtatatgaacaggcgatagcataaaactagttctgtgcgtgggtgttttgtgtcactttaatattcagtatataacatgtggagaactagttttacttttccatggtatttgttggtgcctctgtgagtcacgatgttgggtctactgattctaactcatgtcaaaagacctcaactttatatttagcccaacactgccaatgtctgctgttggaaataaaggggagccaggcaaaagagtttgaatcagcacaaataattaaaattatggaccctactcataggaccatcatacataaagaataacaccccttttgcctttatttggagaatattactcaaccacttcaccatttataagaataataacaaaaatgggattttcacattatgactttaaagttgaaggatccaattgtgtcttgggaaaaaaatgaaagcatatgtatcacaagactaactgaaaacagaaatttcatttctgttcatattcagagccactttgttaacactgtgctcctgggtttggaattccctggagagaagaagttagaaagtaaaaggcaagcgttcccagtaacatttggtttaaatttgcatgcaattaaaatcttatgttatggtactaatattttttcccttttctggtttcagaaacactaggtgtttctgacacatttagtaaaagcctccttttccttatcatttctgactctttattcagatttactaaaaataagagtcaagagaaagaaaaaatgggaaagtctgcacaatgaaaaggtggtcttccttatttttcatcagttagtcaggattatttaccaagcagaggactgctctgtcatttttatactaatttaattctaaataaatatatcaaagatttctaaatgttggatttaggcatttgaaaaaggttttaaaaacagtaatttatcatttagctgcagcatgtgataagtgcaatgaacaaattttgattcatctgacattagttagaattaaattattatctagagattataaatgttgcattaatccttctttaatttaataattaagatttataagtattcacaaatatatctggaataagtaatttaaaaagtcttaaaactttaagatttgatatcaggatataaacataattctatttatttatattttccatttgatatttgatccatcctactttatgactttcttttcatcaagaaactgacccaaagacttgaggattactactaaggacttttcagggaaaataaaaacgaaataacccacaccaaacaaaaagcggcggtggtacagccataatacttcctgttccttgtagatcaatctgggacaaaggctgtctaatatttcaaattctgtggcatgtgaacaatactgtgtgcactgggcttccaaccttggcatttagaatgcatatatatgagcagaggaaaattccaacaatctatcctttctttataatcttgcagcagttccaaaagtccttagctgaaggatatatttggaaagcgctgcttgtctgctctcaccacattcaggtaaccattccagagttcttaggttccacttgagaggtaacttgctattaccatttgtgctatgtgtcataaaagggccctattattttcagcaagacccctcagcagcagttccaaaggagcagctagagatttgattatataggtctctctcctgaacacatcctttcgcatttgacatttacactggtggcggatttttatgtaacttgttagagagcagtctgaaccttagaaaggtgttagtcttcctagaaccctctggcaaaggaaaatcttttattggacttaaatgttttgagttgaaaactgtacttgtttgattggaaaacctttcagggaacagatttcgttatttttctaagctaggctgcaggaattgagccgaagatatcactaaccaaagacctgagaaccaaaggaaatgactccagtgtttaaaatccttttatttcctctgtgaacgatatctctgcaactgagatgaaccattccaactggcccccacccagactttatgggaactgagattaggaagttgtatggtcacaatagtcactgtacaaattgctttcagtttaaaaacctcaaagttcttgacaaagccataatttcttgccacattttattttttcacatgggtgactgatctgtcattcattaattaccctgccaggattcttcagttcttttagaatgatctatatatataataatttcatttgggaggaggacacagagtttgtgagaagtatgcagggtgcctgtaaaatttgtctttgcgagacaccacatattttgcccatttctgttgccttctatttgaaaaaaaatattgttgggccacagtcaagcttataaaaatgtgttcttttcctttcctaatttcattctatactttccttcttgcctagcttttccatagctgagatgaataaaatgttggatgtggtctcaaaattcaacactcctgacttcctttgacacaatcatgccctggggaaatagaatcatattcataactctctaaagcattctctgcccttgctttctctacccaggctggagaatcttattaatctttctattccttgtgcctaacacagtgcctggcatgtttgaaggcactgatttatatttaaacgtgaagtagcctagaataggaagcatataatagattggtaaaacatagagtatgtaaggaagggattattacacactttaaaaaatcagggactgttgtctgaattaaacattgttaaggatgtagcaatgacacaattctccattcttctaaaatttttagtacttccctatattcgtctctggggaatttatgtggcagaatgctctctcaccatgtttggcaacctaaagctactcagacttccttagaggtagtcgctcctctatctcaaaagctttcttgacaagaatgatttgggttggatggggattggtagtagttttctcatttaacatctgcaacacatattaaaatgaactttagtaacctgacatttagcactgaatgggatttacacatacgagttgctcaatctaatgtgatttgatccaacatttgtcaaacatgtacttttggaaaaacactgtgattgacactgaggataagaaaaaggaagcgatttatccccaaatgctcaaggggaggagagataggtgcatatatatatgtgtgataggcacatatatatatatatatatatatatatatatgataggcatacatatatatgataggcatatatatgtgtatatgataagcatatatatatgataggcatatatatataagcatatatacgataggcatatatatatatgataggcatatatatgtatatatgataggcatatatataataatatgaggataatagctaaaaataatacctaactgtcagtgagtactttatgcatgtcagattttcttctaataactccagatgtcttatttaatcctacagaggcccttcgaggtagatgtcaacgttaccagcatttcacagatgagggtaatgagccactatgttcaagatcaatcagcttccaaagtcacagagcctgatagagtccaggaagttcccaaatatatgctcttaagtactatgcagtagtgctgtaaataacatgctcttagaaagaatgaggaagtggtcaaatcgaccttaagtttggaaaaggcttaggtgaaagctgcaggaggaaggtagtatttgagctttgctctccaaaatgaatgtaagtttatctagcagggatagcaggaaaagatttacctggaaaaggaaagagcatggaaatggcagaaagttgttgaagtgcatgacattttctgatgtcttcaaagtgcagtgcttgcataaggaaacagtaagtgatataatctgaatgcaagctcgtcttatggtgaagggtcttgcatcaaggctagggtaaagagcttgttataaaggcaatggaaaccaaggagaggtttataggcagaagaaataatatggccagagtaatattttggaaagtcgattctggcaaagaatttggaatgacaaagaaggaagaaagctagatgcaggaagacaggctggaaggatgtatcctttctcttgcattcatgtgctaataatagaaagaatgactaaacactgacttaaactgtttttcacaccgcataagaaggagactgaaggtaagcaatccagagcagtagggtgactccatctagacactcagcacttggtgtgtacctttcacttcctgcctttgccttgtggttgcagagagctagtccactttagcattacatttgcagtacatgcaggaagaccaggaaggctaaagggcaaaagacaagtgccagctgagtgtgtccttgttcaaaagctttgtgcttttataattggccccaaactgtaacatggtcgtgggttcttaatacccaaatgatgttggaaatagtagtttttatacctaggcacatgccaaaacagaatgccggtagggaagagaattccgtcaaaattgatattggaattgtttatgtgagagttgaagaggacatggaccagggactttaagggtacaaaagataaagtggggacaggatttaggaatgagaatcaggaagacatggggaccaataagatgaggcaggctgggaaggggattgatcaaggaagatactgttgtttctgactttggcaactgcatctgtgatgatcgttttagccgaggtgtggagaatcaagtaagatcagtttttaccaataaaataatacatgtgattcaagatatattgagtttgatgtatttctaggacatccgatgaaaaatttggtaagttgatataaacaggcctagaggtcaggagatgacgatctgagtgtcagaataatctaaaccacagaagttgatgaaatcactaagaaaacacatagagtggcataaagcctgaagactatggagaggaagtttttttttgtttgtttttgttttttggttttgttttgttttttgagacagagtctcactctgttgcccaggctggagtgcagtggtacaatgatggcttactgtagccaagacatcccactttagcctcctgaatagcagggaacacaggtgcatgccaccatgcctaagaaggtctcactgtgttgcccaggcttgtgtctaattcctggccccaagctatcctaccacgtcagcctcctaaagtgttgggattataggcatgagctaccacacctggccaaggagaggaacttttcaagagcaagctgaaaatatcagagaaaggggagcaatatcacaaaaattaggagtaatatttttaaaatgaaatgctcaacagtatcaaataccttagaagatttaagaatgaaaggagatgttgagttagcaattaggttatcattagtgttcagtacatgttgaaacaataaatgcattaaaacatgaacttctagccaggtatggtggtgcaatcctgtaattccagcaatttgggaggttgaggcaggtggatcacttgagcccaaaagtccgagaacagcctgggcaacatagtgaaaccgatctctactaaaaataccaaaaaattatctgggtatggtggcacgtgtctgtcgcccagctacccaggaggctgagatgggagggtgacctgagcccaggaagtcaaggctgcagagcgttttggttgcgtcactgcactccagcctgggcgacacagcgagaccatgtctctaaaaaaagaaaagaaaaacatgaaattctcatctgtgtatgtgaggtgatttcatatatgtgtgtgtgtgtgtgtgtgtgtgtgtgtgtgtgtgtatatatatatattttttttttgttttttttttgaaacagagtctcgctctgttgcccaggctggagtacagtggcgcaatcttggctcactgcaagctccacctcccaggtttacgccattctcctgccttagccttcctagtattcaggactacaggtgcctgccaccacgccaggctaattgttttgtatttttagtagagacgggatttcaccttgttagccaggatggtttcgatctcctgacctcgtgatccgccttcctcggcctcccgaagtgctgggattacaggcgtgagccaccgcgcccggccctacatgatctcatattcttgcagagacagttgtctactgctactgtccactatttctattggacagtatgattttctagacctagggggaatactgggtttttgttagctgttttatcttacagaagatgttttcaataagttaagagaagaaatcatatagaagtcaaggcagatcaaaaacctattgaaagacaaaaattgtagttgtgggaaaaaaatgtcaaggaaatgggtacatactgtgagtaaagttctaagtgaagtcactgaattttctattttatttcctgttcctcagaaattctttataacctttttcttccccctaaataatcattcttgtagcttttgtaaaactgtcttatcttagggtagctaaaaaggcaaaaagtaggcctgttgtgcataagtaagagtaactcacaatgcctacattttttagataatccttacctcttatctctttctgagagcagggcattcattcacatgcacatgggtatatactgagtgaccattaggtgcctgatactgtactaagcacaggttattgggtgtagctagcacctgtattactgtcaagaactgcaactgtttgtggttaaatttggagaaatactaaaccaatatccaccctccttctgtgggcctatacccacttagaaattaatgtcttttggaaacttatagatagaacagttgttattttatgagttatcatgtcatggcattgggtacaaaactaatgcttctatttcttgttttagtcagtaaagtagccagcgccatgtgtggacatgtaaataataaaaatgccttaggaaatatacagagattttattgttaataaatgtgcatggctatctcctgatctattgtatagtaaaagaaggtcattattaaaggtgcatcctttaacagaaaagaatatgaaaacatttatgttttcaggatcaattagcaactctcttttcaccttggcaggacatgtctaaagtttaagtagccattttcatctcgtcaacacatttcataccactttctttattcattttttaaatttggtacaatattccagctcattcacagtttgcaatttgctgaaggcagaggtctacttatacactgtatgttaatatgtagcagagatgacattctaattttgtgtctcaactagcaaagtatccacttcccttataaagaattaattatgatgttcactaaaaacaaaagacaactgtagatgatagggctacttctgtgagcaaagctgttgggggcctggagtgagaagagaaatgggaagcaagtgattgaaagtggacattttatattagtaagatcgtaatgaaccatttgaaggaaagtagaatacgcagagagcaaattctgcgctttgagtgtattttcgtgttccaaaagaaaaagtaataatagcatgaactggcaatgtgacagtgaaattacaatgtcttctgttgatatctgtaacgtaagttggtacaacccttctagaaagcaatttgtccatgtttcaagccccatagatgtgttacctcagcatttacactactgcaaacttattttggtatagaaacttatccaagagaagaagaaagccatctgtagaacctaaatgaggaattatgaggactaaataaggcgagggctgtgtcagtgcagattgagggaattcaagaagggttagaaaggcacattgactccgttgggtgatggaagggacagatgtgggatgcaaggtgaagaagaggaaggagcctagaacgacctccaagcaactgtcttgattcattcattgagaaacaaaatataaaaggagcaaaaaatagaaaggtcacaaacattttgcttttgaaaacagtctgaaaaccactcagtcctatgccattctcctcagatgagggtgtggaactcagaggtcaaccaacagaactcaaatcttagttaactaattgactggcagttcttttgctgtttggtttctatctgaatgaaaaatctcctgcttggctttcacacttcctgtcaactagaccaattaggataacattaagggatagattttactatggaaatctcaagcttggacctcattttccccccaaaatagtatcaaactgccttgttattattaaaatgggagctttacgatagcattcttaagtatggtgatttttttacaccacataataacttttactgtgatttattgagtctgtggccaaaagtctgacccttctgttctaatcacagttgccagataaaatacagatgctccagttaaatttgaatttcagatacataatgaatacatttttagtacttgtttcatataagtatttttattataatgtgtcacatgcaggtattattcattgtgtatctgcaattcaaatgtaactggccatcctgtatttttatttgctaaatctggcaacctagtcccaatattaagaaggtccattcattctaatgatctagacatagcaatggtagtcaaggagccaagtgtagctactgagcacttaaatgtgcttagtccaaactgagatgtgctgtgagtgtaaaatacaaaccaagttttaaaaacctactattaaaaagcgtgcagtatcttgttaataattttaaaattgattgcatgtcaaaataataatattttttatagctagggttaaattaaatatatttaattttacctgttccttttactttctaaaaattcggatactagaaaatttgaaatatttggggcttgcactacatttctattggacagtactgattttttagatttaagggaaatactggtttttcgttagctgttttatcttgcaaaagatgttttcagtgagttaaatatacaccaacagcatagaaagtgaacaaaagttgtgcaaggtttacacaaaacaagtttagccaacataaactgagaagaaggagagtatatcttcatttcgatacatatagtttaataaacacgtagggagggtttttttagatcagaaaacacatatgcactatatacaaattaatatgaaggatgtattatgctttattcctgtgtctcagcgaaacattgaaagtgctgatttctttgtgatattaaaaatacatgtagtatttcttcatggggttccagtcataattctttggtgtttcattctattcaaggaggttaaagaatcttacagcatagacacctaatttggaaggaatctcaatgaaatacctgctaaggtcaaggttcatgtcaaaactaatattaactgttctctctgcctgtagagtgctttccacggagagtctcaagggttgttcctaactgtgttcaggtctccgctcacatgtcatctccgctcacatttaagaggccctcctctgacttattatctaaaatagcaccctgtcactctctcactcttaccctgccttattatttttttccataatactgacatcctattttatcccaccccatccttgattatattaatatttaaaattatagtaagtagtttctattatttttcatctccccagaaaagcttcatgatggcaaagttgttcactgcagtatcttcataacccacagaacttatgaaccctagttcataggcagtattgtgatcctatgagctctctgatatttcctagtacatttatcattacttgttacttaatattttgttgacatctcaaaaactgagtctttcccattttgaaaagcaggaaaatataacttctgaatatctgctcatttgctttctcgtattgggcttctgtactgagtcagacacatggtagatactgggaatacagcagtaatcctatagccaggtctccaggactcaacaagcttacattcctggaaaaatctcactgttactgggagtaaactttctttctgaactggcataccagaaaattgagtccaggatgtacaaatctgtgctaaaaattttgtttgctactttttaagtggacttgataaaatatgaagcacatgctttgtgttcagcctgttcttacctctttatgtacattccctcatttattctcactgtaacatggagtgctatcattatcttcatttttcagtagaggaaactgaagcagcgaaggcatcacttgctcaggtcatacagtcagtaagtggcagagccataatttgaatccagaaagcctaactctggaaatttttaacaaccctgatacataaggttaatgcagctgaccttgtgtatttactaaaagatagctactgttgacctcttcattgaaagtttaagatcatgagttatttaatttggtttggccatgcagtcagtttggaatgttctttatcttcatcttaacataatccagttcattttacaagacctagcatgctataaaattagcgtttagttaggaaaatggaaacacatctaggcagtttatgaagaagattgtttgcacagagaggaaaatctaagaagctaaacagtctagaggagcaatccagaggttaggataacagggaacactggcccacctagttttttgttttgttttgtttgagacagagtcttactctgtcactcaggctggagtgcagtgctgtgatctcggctcactgcaacctccacctcccgggttcaagcaattctcctgcctcagcctcccaagtagctgggattacaggcccccaccaccatgcccagctaattttttgtaattttagtagagacggggttttatcacgttggccaggctggtcctaaactcctgacctcaggtgatcggcccgcctttgcctcccacagtgctggtattacaggcatgagccactgcaccaggctaatatctaggtttcgagggatagtggaaggaagtggggttacaggaagctgctaccaatcctaggtctagaggattgtggcaggagatggggttactattaagtcagaaggtggagccatctaatgaaagctagaaccatgacagggctgccaggtgggagttggtaccaggaggaaacactgtaggagaaagaaaaaccttgacttctccttttcttcagtcttttattcgtctgccaatactacccattggccaatcctactggaatctagttgacaaaggagtctggaaaaggtagatttgcaggatacagagcatgagactggttctatagaccaacagggagttggccagcacacatgaggtgctgttttgtggagctgtcatttagaggtcctctgaatgcagaattcccatgacccttacttagtacttctcttttgcagcattgtcggtgtaacagtagtgctgagcacacagtcacttattatctactagcactgctatgagtgtcattcatatagtaacctcattaatcttacaagagccttgtgaagtaacaaaaactattatctcaatattccagatggggaaactgaagcacagtaacattttcttcaatatcacacagttagtagcaaaacctgaattcaaatccagactacctggcttcagcgtcgattctcctaaccactaccctccactgcctctcaagatttttttgtctccttcacctttctaactcactgagcacccagtagtgggcacgacgtagcaggtgctcattaaatacttgtttgaacaaaatgattttctaattttaatattatgttgtagttgcttagaatcttaaatttttatagtcacttgggtgtgttttccaaactgttctttttttttgtttttaatgtttcaaaaatcctacctcccagtctgactgttcatttttatactttttcaccttcatagctgaatgtttagtctggaaagcagcatccacagggtcaaatatccagggttatttcctggatatcttcattggacatctccaatgttacctagggaagtgatactgcaacaaaaaatacttctcattgataggaacagaaccagttatgattcttgaagccttaatattattgaggcaagcagtctttaaacagctactttctgttgtcagtctgctattgatggcttactagactttgaaagttttacatagatgatctctttttttcttttttgccttttaatagttgagacagggtctcactttgttgcccgggctggagtgcagtgacataatcatagctcactgcagcctctacctgtccagctcaagcaatcctcccacctcagcctcctgagtagctgggattacagaaatttgccacaaatccaggctaattttaaatttttttttgtagagatgaggtccccgtatgttgcccaggctggtcttgaactcctggccacaagcaatccttctagctcagcctcccaaaagtgctgagattatgggtatgagcccctgcgcccagcccataatctcttttaaatgcccagtacaaccctatgagcttcctgataaaattttccaattcacttactttgtatccttttttgttacccagttctttttccaactattaccatgtcaaatttcaagatgaagaaacaggttcatatacctcaaccagtaagtcgcagaaaggggatttgaactggtatctgtctaactacaaaacttacagaggtttcagtgaaactcaataccccataacatgaaatcatgctgtgatgagggaaatgcagcttttccttatgatgcctgagaactgatgatgcttttttatgtacacactgtacactgatttcataaaacactttaacctggaagatatgagtgactccctttacatttttttttttttttttttttttttttttggagacggagttttgctctgtctcccaggctggagcgcagtggtgcgatctcggtttaccacaatctccgcctcccggtttcaagctattctcctgcctcagcctcctgaatagctgggattacaggtgcgaaccactgcgcccagccaacttttgcattttatttatttattttttttagtagaggcagggtttcgcaatgttggccaggctggtcttgaactcctgagctcaggtgatctgccctccttggcctcacaaagtgctgggattacaggcatgagccatcacgaccagcctacattctgaaaaaatgacctcttgagaggctgggtgtggtggttaatgctgtaatcccagcactttgggaggctgaggtgggtgggttgcttgagcctagcagttttggactagccaggagaacatagtgagacattgtctctaaaaaaaattttttttaattagctggcatggtggtggcatgcatctgtggtcccagttgttcagggggctaaggcaggattgcttgagcccaggagttctagggtgcggtgagctatgatcatgggaccgcactctagtctgggctgcggagtaagacgttgtctctaaagaaagagaaaaaagacctcttcaggccacagagagcaaagtaaagcatctgaaatacatttacctttttttcctttagtgaggaaaaacattaacaaacattttaaatgtaactgggaaagaacatttaagaaattcatgcccctctcttgtattccagctttcttctagttgggttctgcatatgattgtgttattagggactatgcctttaaaaatgaaaaaataaaaataaaaaggccatggttagcctgtgagcacatttttttattctggctctggccacaagaaccaagtttgactaggctctgtatcaaaataaaatccagagaggcattcctaaacttggaccttttgtccacactcacttcctgttgaccgagtgacatcccttcagctggccctccatcaagctgtttgcacagaatagggagcagtgttttcaagggcagcaaatcttgcagcttattaaaagtagcatggtatgcaactcagatgccagttctctttcctttttgggtttccttgagtccaaaggtcaataggaacacagaaaagctcagtgtattggtttgtaattccactcccactatggctcaatagtacaatatattcagatccttgtctcattgagttcttcaatcttcaatctttgttccctaaacacaggcttgtgtgaacatgctattagctagcagggttcaatttcagtattaggggttacattcagtttcaagctcctcacagttgtctacactgggtatgaatctggaactgctgccaattttctttgagggcattttagtatcattatctcagtgcttatgctattatctctgaagtgttgttttccagcgattttctgcctctaaaaagacaggatggtttagccattttatcaatgaaatttaagcatgtagtgtcgctgactcttgtgatttccttcacttcttttgttctactacctacctgaggaaatactttaatatttccagtgagaaggcaccttaagggagtctctaaccgctcaaaatgtggtctatagagggacagcctgggcatcatctgggagcttgttgaaaatgctcaatcttaggctccagcccataagtgctgatgtagatctgaattttaataagatcccttcttgtttcacgagcaaggtaaagtttgagaagcaggggtcgggcgcggtggctcacgcctgtaatcccagcactttgggaggccgaggcaggtggatcacgaggtcaggagatcgagaacatcctggctaacacggtgaaaccccgtctctactaaaaaatacaaaaaattagccgggcgtggtggtgggtgcctgtagtcccagctactcaggaggctgaggcaggagaatggcgtgaacccgggaggcagagctttcagtgagccgagatcgcgccactgcactccagcctggacgacagagcgagactccatctcaaaaaaaaaaaaaaaaaaaaaaaaaaaaaaaaaaaaaaaaaaaaaaagtttgagaagcagtgatctggcccacatctggtcttctaagcaattctgagagggattttagagcctctttttaatactcccaataatagagatgccactggtgtaaaatttgctggacagctaaactctgcctacttataatttctacacttagtctttatttcatctctttagagcaaatggaataagtctaatatgacccatctaatatttaaagatagataacgtttcccaactcctcacctccaattcctccctctctttctctttctctctcatgtctctttcattgcctgttgcttactcttccctcacccctccctttatctcttttcatgctaagcatttattttcagccattctctgctttgcctggcttccaaacttttcaacgtgaccattcctattttattaatggactctagttaccaacttgtcagtttattatatgtgttgtaaaaaagtgcaggggctatttaaaattgtagaacagagatctactgtgctgattctgaaatatttaaaagcgttctcttggtgtctaccaggccatgatatctaggaggacccaacgagtgacaatagggtttcagacgtgattgttaggtagagtaaaaaaaaaaaaaaaaaaaaaaaaaaaaagatggaaagtagccacttaaatgagaactatgctaaatagtactaaagcttcagtactaaaatacagaattacaatttgaacttccattagctacattcactacctaatgccatgtaaacaagtaaagtcctaaagtagaatttaggccattcttttcagatctagtgcattgcactaagatgattaaattaagcttcagaatcaggaagcagttggccggaactcagatatttgtgtgaatctgggcctgaatttttgctgagcaactccataaccaggggctcagtatgtatgaggcatatcttaatttctatgtaaaagtctgctgtacacttttcatgttctgcataaatccatcatcctgaagtcctaggttatatcacttttcttaactgttggtttatatttggcaaaatgtcactcaaagaaatatcaattgataacaccactttaatttaatgtaggaatgcttcctgatttataattagacttttcacacagaaatagcagatacattggtgtgctgcacccattaacttgtcatttacattaggtatatctcataatgctatccctcccccctccccctaccccacaacaagccctggtgtgtgatgttccccttcctgtgtccaagtgttctcattgttcacatgcaacaaacctgcacattgtgcacatgtaccctagaacttaaagtataataaaaaaataaataaataaaaataaaaaataaaaagaaatagcagatataatctaaaaattcttagtgtattttttttaccctcaaatactcaagcactgcactggtgattgattgtaaagaagcataaacaaatcaggttaagtgatcaagaaatgctaaacttgttgaaacatccacaaatgcaagcaagattttttttttttttttttttttgagatatggtctctctctgtcacccaagctggagtgcaatggcatgatctaggctcactgtaacctccgcctcacaggtccaagcaattctccttcctcagcctctcaaatagctgggattacaggcgccagccaccacacccggctaatttttatatttttcgtagagatggggtttcaccatgttgaccaggctggtctcaaactcctgacctcaagtgatctgcctgccttggcctaccaaagtgctgggattacaggcttgagccactatgcctggcccacaaatgcaagcaagcttaacaaatacctttaagtgctatatgtagtactagatcttctaaaaatgtatactaaccacatcagcacacattattcaagtgtctttgatatgtcagatgttggtcacttagaatgctcctgaccttaggaatattatcaattacattttcatgatcattttatacttgtaatttctacagcattttatgcttactccagaatttgtttttaactttaggtatttttgtttagagatttaaaacctgacttttgatggagtaccatattgaaaaacatctgaaaaatttaaaaattgctttcttatattattttattttgagatggagttttactcctgttgcccaggctggagtgcaatggcgtgatctcggctcactgtaacttctgcctcccaggttcaagcgattctcctgcctcagcctcctgagtagctgggactatgggtgtgtgtcaccacacccagctaattttttttctttttttcttttttagtagagatggggtttcaccgtgttggccaggctggtctcgaactcctgacctaaggtgatccacccaccttggcctcccaaagtgctgggattacaggcataagccactgtgccaagcgaaaattgctttctagaaattgttttagtggcagaatagtcatttgctcttatgttgtcttcgagaaaaaataaaatctgtcattgatttgctgctcatattttagaattgaaaatgagtataaaaaatgtgagcttatgggagtgtatttattgatctattgtaactgttcagacaaggggataagcactttgtgatagaagacccaaaaacctaccatatttgagaggttttctcataaacaggatctaatcttccaaattgtgtctataacttctagaattatcatgaacgtagtttatggccatgggggcaaaaagggatggagagaggcaaaatttggagacagaaagaaggaaaaaaaacagatgagcacaatttgcatacacgttttataaattcataaaattttacttttttgaaaacgcatgattctgtgagaagaatttagtcttttttatactttatttaatctaaatctaaaaaagagctttctgttttaaagagagcagaaactcagatatacatagagtatatatatcccatagatattttgatttttttaaatataaaatacatttcaaatttttcatataggccattccactgggaaatagtaaaacaacatgagcactatagatgtgagtgttttggtgaggtctaaggatcaattccctaattgtgctttatctaagaatggataaagtttcattttctattctgtgaactggaagcaaaattcacaaatattacaatggtgaaattacgggattttttaagttaatggcatctatggcattgtttgtaaaattccagtagcccttcataactgcatatggataattattggaagaagaaaataaatatctgaaaaaaactgatatactacaggatagacagagaattgatttcacttcccaatactctaggtagggtggatggtatgctttattggatagtaagtaaatattttcttcattccaatatatttcattgtcctcttgagatttgcattccctctgctaggcatcccctgccgtacacactctgggaacttgttcttacacctcaaaagccttttttaccccaatactcatctaagctgacctatgtatagccggatccagagccttttccgttttaggctgtttgtctgagaaataaatgcaaaccctcttttataaaattcatatttgtgcaggaattaatcaacaccgattctgacaacagctgaaacagcacattgtaaacattccagaaaaatcaaataatataaaccaaatttagaattgtgaaatttccaccccagaaatttggatatgtggaagtaatagctaccaaagaaaatcacaatgataaaacttgatgtggactaaaaaaatacaatttgtaaaatgtgcatgaaaaataactgacccagaaaataatttccataaagtgaaatgaaaatgttttgatagcacgtatgtaaaattgataaagagatggacttggctaaatgcagttgattttggaatatactttatgaaagtgtttctgcctggcacggtggctcactcctgtaatcccagcactttgggaggctgaggcgattgaatcacaaggtcaggagttctagaccagcctggccaacatggtgaaacgccatctctactaaaaatacaaaaaaaaaaaaaaaaattagatgggcgtggtggcggctgcctgtaatcccagctactcggaaggctgaggcaggagaattgcctgaacccaggaggcagagcttgcagtgagctgagatcgcgccactacactccagcctgggtgacagtgcaagattccatctcaaaaaaaaaaaaaaagtgtttcaatgcttacataatctgatctaaaaggttttgtatccataaacatgtagttaaaatgtcccaaaaatggtgggatcagaataccctttcctctcaagagcttaatgggttattcctcccagggatacttatgtctttgcagagctcagatttgttaaatgtgagagtttaacaaagtgaaaagttaacagtgaaaattcaacagtgccatccccgaggacagtttcatccagtgaggaatggaaacttcgtattttgttaccaggagaatggtggtcaattcccttgctactcaaacgtctacaaaacaggagcatcagcatcacctgggggcttgccagacaggcagactttgtatcaaaccaagtgtactgaatcagaatctgcattttaacaagatctctagatgattcttatgtacaataaaatttgagaaggaccgttgtagtcaaatgctgtgtaagtcaggcttcaaccatgagacttacatggattgttttcatttctgtttatttcaactaatgactccatggtgatgccacccacatttatgcttgttatgagatacgtcttttattcttcatttgctcaattttttcacttcatttatgaggaaacacaaatgatatgatttgaaaagaaaaccttgtcatctctttcagagcggaattttgtagctagaatatttatagaatacgagacactgatgttccatgtgtccttgtttgcggcgtctgatgtttttgttgttaataaccgcccttcccttggtgtttgagcatctcaagtgttcttgctgaggcagcaaggaaaatgcagttctgtgcatctgcaggatgttttcctggtaatgactatgatgctaagcctctatccctctcagtatttatcaaatttggacataaacttcaggaacaaaaatagaacttggaccatgagagttaagccacatttggttaacccatttggggatcagtgtaaactgtcttttgtcacgtagcaattccctagtattttccctctttttccattacttgtacattcatctaggagcctgactgactattttggtctccagtccatttacagtgttccttggaataacagaaacggagccgttctaagtcttaggaggcttgagttagcatagtgcctgataacattgcagccattcaatacatgtcacttgtttcctctctttttttcttaatattaataactagatagtcactttgatgtactgtttaggtcttctatctttcacttatctgcacaatgaaaattagacagaaagatcattcctgatctatgtatatatgatctttcagtcttattttaatttcgcatatatatgtatatatatatatatgtatatatatatatatatatttccatagacctgttatgcatattattcatggtgctttttaagttggtacgtcctaagacaagagtcccttggactaccagttttcaacatacatttcttaggtaccattctgctttgggggaaactgagtgaacagggatcagtttcctccttgccaacactgtgcccactgtacatattatggttctttataaaattttgattggaaaaagtttccaagctcttacaaataagtgtgcaagaccagcctgcaaaacatagtaagactctgtctctacaaaaaaataaaatttaaaaaattagccaggcatggtggtgtgtgcctgtatcgtcgctactcaggaggatgaggcagggaattgcttgagcttaggagttccaggttacaatgagctatgattgtgccactgccctctagtgcggacaacgtagccagatccagtctctaaaaatagcaacaagaataattgtgagacctgattctttaagaagttaaaaaatcattagtgcaaagcaactcaaaaacactgtaatgggaagtaatgtaacacatttatgtgtgtggccttttcacttctgtgaagtgaaaaaaaatcagaaaagcatggctcctaaaatgtcttttgaatgaattaagccactggatacctatataagtagtattacttcgatttttgaatttctacatagatctttttttttaggtactgccttaaaagtttctgattacttttctctcacatgcctttatcctattttgaatttttaaagtgctatgttttatgccagtcaattatgaagttatcataaaccaaacacatttagcctaaatggtcgatagaaatttcttctttccaggttcattttaatgcagttatttttaactactattacctattaaatgccccttctgggctaggtacagtggctcatgcctgtaatcccagcactttgggaggctgaggcaggaggatcatttgtccccaggagtttgagaccagtgtgggcaacataaacaagaactcatctctgtgaaaaataaaaaaaaaattagtgaagtgtagtggcatatgcccttagtctcagctacttgggaggctgatgtgggaggatggtttgagcccaggagtttgaggctgcagtgagctgtgatcatgctattgcactccagcctgggtgacacagtgaggccctatctcaaaataaaaatagggcccggcatggtggctcacacctgtaaatcccagtgctttgggaggtttcagcaggtggatcacgaggttaggagttcaagaccagcctggccaacatggtgaaaccccatctctactaaaaatataaaaacttagtggggcatgatggcacatgcctgtagtcccaggtactctggaggccaaggcaggggaatcacttgaactcgggaggtggaggttgcagtgagccaagactgcaccactgcactccagcctgggcaacagagcgaggctccgtctctaaataaataaataaataaagccccctttggagtttatacttcactcatttcttactataaagtttaagaaaatctatttctaacctatttgttctgctgaacattaaatgccctgtgattaaaagccaagtaagtattcaccaagtgtttcttgatcaacattatgggccactccttaagtgactcctaaatccgctgcatgttcatgtccattttgttcatggaaatgtaaacacaagagtaattaaacactgtgactcaaattaagaaaggtgaccaggctgatgtctgtccttgtaacttcatgagtaaagtttcctatttatcttaggctccaacttcacataataatagcacctgccacctgtagatgcagcaatgtttctgaaggatatagtcttctttcttctcagcagtgtggggacaaaggtcacgttgcagcaacatcctgagctaagcctttactaccaactggattctactttgaaactcaatcagttatccttaaacaagaaatctgagtttctgcggaaggaaagagagtaatagccagatacgtcatgcctccaaaattggtaactgaagtggctttccctcacatttatcttggttgggtgaaacaaggtcataggtttacctcattattttaagagttatctcattttgtaattattatttaaattcatactctgtaatagggaagaaaacaataaaaatgttgtctttcttacaggcatatcacaggtgggagataatttacatctgttaaatatgataattttttcctaaaggttctttacaccttgagttagcattaagatatttaagatggcctattttagatttatagattttgttggaattagtttaaccttttggatcatgaagatatttagcagtggggatttagaataatttatatcaaatcttctagatggtgacaaattaattatactttaaataagccctgatcattcatcagccttcaagttcagttctatagctttcagcagcatagctgacatattatccactcgtgtcatatgtcatcatgcaaacttcgtgaattataactgtaacattaattggatgaaagttttcttgatgggaaagattattgattaaatggagtaatttgaagaaaataaagcccaacacaaattgagaaaagaaaaaaaaaacacagtcaacaataggatatatggtagcaactggttttatggacactgctaaactaaataccaaaggtgtattttattcctgtgaataaaactgagtgcaaataatggaggaatttagcagaaaacttacaaggtcatttacctaagggttctttatgatggaattccgttgtcagaaaaaggggttcatgagtttttaccaattttccttaggggtttttagagcaagtttgaatggaagcaataaaacgtatcatcttatatagcaaaaatatttgtgtgctagagatggtaatgactacattacaataaagattttgaaaatgtcactttgtgtttgttttcatcttgataatttgtgtgagattgtaaatgcatcattctgtaatctcattggctggattgtaaaatcatttcccattaaaagtttttcattatatgttaaactgtaatgaaactgttcaaattctttgactatggctaaaaaggagctaattgccatcaccagtaaattcattctgccttttgggtataaaattctcctgattaactttttctaccctctcaagatttctggagattcaggataatggagttttcttggatctggagtttgacaaaacctagtctacatcccagttccttcaacattctctagaagcactagttgtaaagaatttgtaagacctataaaacagatgtctatcaaatcaggcatttaagtatgagttcaatgattgagatcattgctctttttttttttttttttttttttttttttttgctggtaaatagcagttaaattgcaactgatcaagaggtattcaggatggtgagtttggactgcatggctcccttcatggactcatttataatttaaacaagtgttttattagagttatttcccatttactagttaagtgatttatttatggtctattcagagtctattaattacatacatttcagaataagtagcaaatagtcattgtaatagtttccatagtgtactaatcttactcctctttaaatttcgtctgaagttttgaatcttcacagaattagctagacatatatgttacccactacaaatgacgtctgaatctcttaacaaggatgaataaaaagacctgaaaagttagcatggtgggtactctcaaactattttgttttttatttgcatagctttcctaagtaaaaaatgtctgggaaaggcaatgccaagaatctcttggtagacaggcatgctccacacatatacagtaggagccaaacagtcatttatggtaatttcattaaatggaagcttgatatgcaagggaaaaatttttgtatgtgcatgtgactatttttcaataaccaagtaacactagtattaataacatgctaaatcagcatgtattaattttttttcagactggccaaaaaaaatttacttccaagattactgaatgaatattaagattgcttatcttgaccttccttatcactgcgtcatgtgctgcatcagttttgttattgttctttgttctgttctgatgtttactgacttggaacatatgctattataactacaccacaatctctcttctatttctctaccataaccttgcaaggggttaggcaaacttggagacgtgtcagaagaagagcttaccaacctcatatgttagccgtattgcacagcagtactgcagaaatgagctgcaaattccaagcaacatattgagtttgtgatttatttgttttccaggcaggccaattaattgttttgctgtgatgctgccctaaattgtaaatagaaagagcaagaaaatgaattgtcacattctgtgcctgtgtctcttgctacttaggatgacaaaagcagtttctgctccgactgcaagtgatattgtaaaatatgagaattaggctggacctaaatgtgttggtcagtgtgtttcagaggtgcgttttagaatggctttaaagacattgtactaagactttactaccagtaggttctggagagaatgttataagacaggaaaaaggaaaataattcttatttcatgcctatcatgtgtgctttctttcttgaaatgatggaaaatgatggcttccccatatttccaaactgattttttcaaatagatttggaatgtttattatattaataaaaataagtgtttttagatttttactaaaggggaatgaaagagaaggtaaaaaaggtaaaactgacacatgagggaaagtagtttgtcagctgaatggactattggcacattttcattagttccagtggaatttgaaatggtttgtcaggactctaactttggccctaaaggcacttggtgaaatactgttttattttacttggtaaataataagtattttaatggaagaacattttggctttcacatctgctccctcgtggcaacagcaatttgaagtcagtacatgctactgaatgccatgaactcttaagaaattaccaaaataccttaaactaaatttcttaggtgaaagttgtttcaaagaacgattgagccattgtcacaggaaccaatgcaggaggctttataaaaacacatttttggtcgggcgcggtggctcacgcctgtaatcccagcactttggcaggccgaggggggtggatcacaaggtcaggagaccgagaccatcctggctaacatggtgaaaccccgtctctactaaaaatacaaaaattagccgggcgtggcggcctgagcctttagtcccagctgctggggaggttgaggcaggagaatggcgtgaacccgggaggcggagcttgcagtgagctgtgaccgcgctactgcactccagcctgtgggaaagagcgagactccacctcaaaaaaaaaaaaaaaaagaaagaaagaaaaaaaatttgccccgataccatgactttgaatcttttccatttcatcttcacattgtgagtcatgatgaactactaatacaatatactggcaatatttaaagccttgtatttgctttttgcatatatatttaagttttgcaaaattttggaaacagggagcaaataattttatatcttggaaagtaacctgggcctgtcatattaacccactgcttatgaatggccctagggtaacatgtcattcacattcttgggcagcttgtcacatgtcacagaaagcactatagacttacattggatttgactcaagaaacatgaataaagataaatgtggataggtagaagataatcaaatactggaacatttatggtgctatcaagcacataaacacatttataaactgttttggcctctgtacaatttatgcgccctggattttcccacagaagttctgaagtaacttacaaaaaatatactttacaatgaatatgaaaaactcgaactagaaatagtaaaccaagagcactaacaggaagaggaaagagatatatacgattattgagtgcgaagtttcctggcaacccaaacaaaaaggatacaaataaggaacatcgttatccttattataactgaggaagtcccttagcagatgccaaagtttttcctggcagaaatgtctaaaagatgttcttaatttgtttaagcaagagttgcttagaagcaagtgagtttgaatttgtctggtgcttaaaaacagtgttatgggtagatttatgtttccaaattataagctttggattttctcagtattacttttataaatgccatcatattacaaagagaggataataagcatccagtgggtcactttggtagacttagtccttgtggttaatgaaggcacatgttgtcctgcaggcagtatcgtgtcaagccaacctggattcatactgagctgtgtgtcctttgtcaagttctatgacttctgtgacattccgtgatttttttatttctgtaaaataagaatgctcaattacatagttattaagattacatgataaaatatatgtaaaagagctaaggttatcacagtactgtcttaaccattaacagctaaagatgaaataaccccatttttttgcttattttcccttcttgtcactaatttcaacttatataatggaggaataacatatacaaagaatgaatataatcacagaaattataactgaagtctgggcttctgactcagttccattctgcatacactattacagctgtttgggtcttacaggaaatgagttattatggagatataggcttccaaagctaagcatctacccttttggaaacaaaatacattgtcgatgcaaaaaaataaaggtaactatttatgatgaaattcagtttcaaattggattgcagccttccttgtttttaaaggtgaatggaccaagcaaaaataaactcctttgtagcaatttagaatcatcaggttttattctgctttaatatagagcaaactctgagtactttatggtccttgaaaagttggtcctacacaagtagcctcagcgtcttgtgcatttggttatttggaggtcagtctgttccatttaccagcccttgaagcccttttacctccctccagcttattacatctaatcttctttggactcaagatcagataactaagctaactttaactgtgaataaaagaagaatcaacagaatctggtcatccaggtatcaagtacccgagtttttaatacatgaactctgagacttctctcttagttctttggagctccttttgacttttaattgctagttttcactgtgctccaaaaggtgaaatgttattctatttttccccaggagttattaaagactgacaagacatcaggagtaccccacatgcacaaagttcaacattatcaaaatttttgaatactcaaatattcagttatattcactaataattatagctctcttactaaagtttactttggattattcacagaaggtatcagtttatttcttgaagaatttgagagaaggaaatcatctttttcttggtaggtttgctcaaaggtttagcaatacttatcattcaaacactctttcttatgtctcacctaggtgcctcttggtaatattctgttgcttttttactgggtttcattcacggtaaaaatgaaagatattttaaaacaacccctaaagcattttaaattaactatttaatgtctaagttttatgtttcattttaactaccatgcacttaagtatttccttgtccataggccatacttcctagtacacataaaggggatatttttatatctcatctgttcttcaaatcaaaacagtaataagtgcttcccaaatggcaaacaaattctaaggatgtaataaactgtatacttccctgatatattatgacaacagaattttttatttttaaaatttgtttatatttctttattgcaacctttgttgaaatttccattaggcagttaatttacctcttttcatttgactctactctataaggctctgtattctatacaacatttgttaattaagaagcagtggttccacctaatatttctgatgtgtttgtaacatcctggatagtatctagaattcttctagttctctgctagctaacatatattgtttttctgatctgtgctgagctctggaatcaaggctttacatacatgatgttactatattgatatagtaactctcgaacacagattaaattataatcctcctcgtacagatgaagtaactgggtcctgagaggttaggtaacttgtatcacttagcttagtagatgtgtgagctaagattgcacccaggctgtgtggactttcccctttatgccaatactctgagtggtgctactgacacaggcctatgggtttcggttgatgtctgggagcagaaaactgctagctatacccataatatttctttcagaaagagcagtggtgatgcagctttgggctcatcgcaatttaacatagggatggatttcttcacaatttttgagttttttcgggaagtgtttccctactcccctaaattgccttattactctcatgcaaatacccgcagctaatcttgtatttgcccctgattttagggtaatgaactgagacacagaaaactacatagcccattgtgtgcctcacacggatgtgaagtggcctaaccgaatttacccttggtgtcacctgtaactgtttaagtgggtaggcctaaattttatactattaagcactaaatgaatataaaatatgactttaaatgccatctacatgtgaaaaactcccaaaaatgtattcggagctcagacttctccccagaaatgcagccacacatgcccaactgtccagttagcaattccacttaggtgaccaataggcctaacaagccaaaacccatctcacagtttttcttcccaaaccggctcttcttggaagctttcctaacttagtaaaagtcaactctgctcttccagttgcttaggcctaatgtctcaagttagcctcaaatttctttcattctttttttcattgatgcccttcccaccacagtatagcaaacaacaaagcccactggtcttaatttcaaaatacaagctgaatctcacctcatttcagcaccttcactgccacaacctcgtgtaagcgcaggtgtctgtcacctgggaccttgcagatgcctcctaaattggtgtctggcttcatcccttgcccctcttctttttcttctcaactgacaacctaaggggtcatgtcaaaatgtcattcctgtcctcaaaacaactccagtggcttcctgtctcacatagagtaatgcaaggcttatgccatggctggcaaggtcttacatcttctgtcccccacctcctctgccccttgacctcatcactttgcccccacctcacctgctctattcactgccgcagccctcagccctactgtctcctctgcttcaatgcccctccttggtgtacatgcttgctccttccctcttctaggtggttcctcaaaggggttttcctcacagtgagtcctcctcatcccaccccagctaaaggatcaaatcttgttccatttctcactatctttttccccttgaaaattatcacaaatatatgtttagcatatccccattatcagttgtctgggttcccactgtcatgtaagttctatgaaggtaaagacttctttctgcaacagaccctgtatgtccaggatgtagaacattctggaaagtggtgggttctcaaatatttgttgagagaacagtgaacaattactgggtgagattaataattcatcagaaaataataactatccccctttttgcttaaaataaatgtagaaagtgatgtcttttcatttttaatactttgcccattttttgtcccttatcctaacaagcaggtggtattattcttcacccaaaatcaagaattatcatctccaatttttttttgtttgtttgagaaagagtctcacccagtcgcctaggctggagtacaatggtgcaatctcggctcactgcaacctgcgcctcccgggatcaagcgattctcccgcctcagcctcctgagtagctgggattacaagcacttgccgtcacacctggctacttttttgtatttttgtagggacggggtttcaccatgttggccaggctggtcttgaactcctgacctcaggtgatctgcctgccttggccttccaaagtgctgggattgcaggtgtgagccaccacgcccagcccatccccaatttttaaatggaaagggatgtgacagttttctccctattaaatactcagttccctctaataagtcttgaactatttctaggttgactgacagttgtaaagtttaaataattcttcctttcttttattttaacatcacctaggggcatttatgtcaaagactagcctcttgctttttgtaaaaagatcagagaatctcttaagtaacctgtaaaatactgttcaccatccttggcaaaggtaaaatttaatagttcataagagttttcagaagcaatgcaaatatttttaaatgatttaagtttaagagaaatgataaaacatgggttatagtcactgtgggaaagaatccactgcatagcgtcccctctttgaatgagagagactttctagaaaatgggcagaggacagagaccaccacatatggggaaggaagcagagtgaaagccatgtttctctttgacctccaagagacatttccatcaagtttaggattagaggtgagtattaatatccaaagataaacctaagttctgttacacaaaccaggcaaagatttatattttctgaatgcaatttgagataaaactagaacaaataatatgaagcaagaaaaaaaaaaggccaataaaaccacaattctccatagtctttgaacagtttggattgtcttttagaaaaaaatgttctgaaaaaaatcaaatataatttgacaattcatatttacaaaataaataaaaggatcaaaaacacttagatggctgggcaaggtggctaacgcctgtaatcccagcactttgggaggctgaagctggtggattgcttgagctcaggagttccagaccagcctgggcaacatagtgagacccccatcactactaaaaatacaaaaagtagccaggtttggtggcgcaagtctgtaatcgcagctactcaggtggctgaggcaggagaattgcttgaacccaggaggtggtggttgcagtgaactgagattgtaccactgcactccagcctgggtgacagagagagactctgtctcaaaaaataaaaaataaaaaagtaaatcacttagttgattctctgctttgtcacagaaaatgtcaccgtgcattgcttaaggtgtgttctgtaacctgatcctgaaggaactataaggtacatcgtttttttcaggctcttgtctatcttctagaatagttgtaatattctttaaaatagaaaatataattattgggataattaggatataattatttgggtaataaaagtattagaaggagattggtatcaaataactgttcatcatcctattgatatttaatagtttatttttataatcattatggaaatagtgaatactttttaaagtaatgtaattatttataataataagagaattgtcaagttgtcattgcttccctaacacagtatacaaaggaagaagaaaacgctgatccaattctatcttacattgtgactttagtattccaactagattgtaaaagacaaaaggttaaagattatctactaattcagtttcacttttgctagagtttaatatcacacatgtaatgaataaagtaatagaaaggaaggacattaggggaagtctgggggaaaataatatcttagaaattacttattaattcatgttcaattaaatttgtttttcactgatgataaaatcaagttgccttcttgagaagtcttacaaatttgtttttttttaggagatgtcaacccaaaaggtcacctattttttatattaaaaactaactttggaaattttcagaaataaaagaaaagatcactaagctgagaatccaaacacttgactttattgtgaaagtaattgttaaatgttacctgtctcagtggtattctctggatttcagtgatctgcctgtagaacaaaaaggtgaggctaagtcttcatgactttatataagatttccagtaccctctaattgctaggagtcccactcgagaatatccttagataagaaaaaagaagggagtgaaatgtaaatgtgtgtgtgtgtgtgtatagttgatgatagccttttatgacaaaagaatggtctgtattagtgttcagcaaacattttctgtatatttaagaatggtgtggctgtattccaataaaattttgtttacaaaacagataacagatgggatttggcccatggctatattttgccaactcctaactatatatgctaataaaggtgttagctggtttagccctttggataggcaatattgaggccaaatcagattttatgtaagttcctagcctttgacacagcaatctcacttctagtaacttatcctaagggaatatttggacaaatacataaagatattatctgtaaggacatttattataacattatttatgacagcaacacaatgaaaagaaactaaaagcctttcaataagaaataaattatgtatattatggtttattcctacagtaagatactacatattcagtaaatgatgtcacatatttatatgtactgatgtagtataatgtccataatgcatccttaattggaaagaaataagctataaaacattaagtataatactattctggatttgatgataatctccagattatacgattagaaataatttcattttcttaaaactctatgatgtttttgtgtatactatattgcttttataactagaataaaaaaacagcaaaggtatttcaatttgggaaaaaatgtgtaacagtaagcagattattaaattatgatgaagcagatactttcaataaaatcctaaaaatctcatagccctctaaataatcttacatgttgttaatttagtttttaccatgggaattcacacccttagactatcaaagaaacaggcatttcagcgctatgttgaagacaaccatcatgacacaaattattcaaaaaagaaatagtgtgttgtatttaacattacaatttaggctcctctcagtttgtcttaagagaaaataaaagatgcttcttgccttcttgtcttttttttgttttgttttgttttttgccattgtagctactgccaattgagacattctgtagtttttctcagattcagagaagaaaatatctcacaagtttgttcatccaacattgtaatatgagttcttcagattcctagagaaagctcaaaggctgtccaaatccccacagctatggccatctctagtcttttgattttaactatacaaggaaattcttattatgaaatctttttatgaattatttttaaacattttttaacatttgtaatgttagtttttccaaggaaaactttgttgttagcagcaaatttttccagaataaaacgctgacaaaaaaatcagtaactttttaaaaaggctttatttagtgctttatatgttgctggcactgtttgatgagacgggtttgtgtgtgtgtgtgtgtgtgtgtgtgtgtgtgtgtgtgtgtgtgtttcacatgaaatatgcacatacacatttattttttatttaatttagctactttagctcatttaatcttcatgacaaccctacaaggtgcatttgcttatcataaattatcattcattttatggaacagaatgaggcatagagaggtaaagtatattgcaaaaacgtacacagctagtaggtggcagagcaggattcaagcgcctgtaggttgtggtataaacattttcctcaactgcctcacaacacttgctatgtagcctccacaactgtatgactctaactgatgggatacgtacacatgaaaaatggttaagaggccatatacagcaaaaaagtttgtgctgtacgactgcttatatgcacctaaaacaaacaaacaaaaacactggtgtgcttaccttaaaataaacttgagactttattacagttctggaagaaaaaattgtttttcacagacctgagctaaatttttgacaatgtataaacatacatgagggctagtagcacagtggggatgccttgcaagtgtaagttttgctagtctatgattgcattgggctgggatacagaaattgctacttaggaacactcaagagatgtttggtttttgagtagactcatttcaccttggaattcaaggtgttttaagagactttggcacctcttcctacctgaatcagacatagttgatgacagcaagtctataacacctgtagacatggaatctatctagaaatcttacaaaatgtcttccggtaacaacaaattatgctttatttagacatttagacctcaatattttattaagttttatcttttatattattactgtattttttagagacagggtcccactggtcacccaggctggagtgcaatagcacaatcatagctcactataacccagaactcctgggcacaaaggatcctcccatctcagcctttcaagtagctgggactacaggcacatcaccatacctggctaatttttgtagagacagggtctggcaacattgtccaggctggttttgaactcttgaccacaagtaatcctcctgcctcagcttcccaaagcactggaattatataccccctttaaattttgcagagaatttgcccttcttcatcctaaatgacattcagaaagtcatcaaattactgtgggtgacaattataattatcattcattatcactcattatcactattcaccaatacattgtaggtagtaacttgcttctcactttcagaaagatcctgagcagctgatctatcattactcttctatcaatcagttccattaagcaattggaaaataaaaaaatcctccccccgccccaccattattataagctccattaggaaagacaagaggaaagaaaatggaagtatccaatccttaatagtattatttatatttaattttttcatattgctgagggatattttctgattcaggggattcactggccataattacatgcacaaatagctaaacagactccaaatgaaaatttttaaaaatatatattttttaaggaacgacttttcatttcttagtccaagtcttcagagaatagtctgtacagatctgctaggagcagagtcaggtcatactaaattcagttgattgataagcttgtttgtggattgattttttttttttttttttttttttgacagagtctcattctgttttccaggctggagtgcagtggcacaatctcagttcacacaacctccgtcttctcatgtctcagcctcctgagtaacttggattacaggcatgcaccaccacccctggctaattattatattattagtagagacggggttttctatgttggccaaggctggtctcgcacttctgacctcaagtgatctgcccgcctcagcctcccaaactgcaatgaggattacaggtgtgagccacagcactaagacagattgaaatttttcttaggaaagaaatccatccataaaaagttaatgaaggtgaccaggcaccgtggcctgtagtcccagagcttgggaggccaaagcaggaagattgtttgagggcaggagtttgagaccagcatggacaaaacagtgagacgcttgactctacaaaatagcaataaaaaaaattagctgggcctggtggcatgcctgttggtctagctactcaggaggctcaggtgggaagatctcttgagcccaggatttcaaagttacgatgatctatgatcgtgccgttgtactctagcctgggtgacagagtgagactctgtctcttaaaaacaaacaaacaaacaaaaaacaaaacgacgttaatgaaggatgtaagtaggaatgcttataaagtttattaaaataaatatatatgatatatgattaaacataaaatactttttaaaggaaaaaaccaaaatgacaaataagaacaataacaacagtactttataagaaaaaggaaaactgtatcgaacctgaaaaccaagcaggcttctataaacttattgttgaatatcacatgctggcttccaaaaacgtcatctagtattaaagcttcaagtcaccagtgcatgtaacctctctccagtcctcaacatccaactcttcattctgcaaccacttcccagaaaagaagtcttctcagtttaccaagcaaactcttaacccaatatttctaccaccaagaatatagaaaaaacaatatgccaagcttaagaaagagaattttggccaataattgttattttcacagtaaacctaattctcaaatgtaaaaatggtaaaacagaatgcaaattattttaaatttgagcaagtcttttcttttgaataaaaaatcaccaaacaaataatcaagaaaacaaagatatgtacacaagcccaaattctccttttccctcctacttctgtttttttttttttttttttttttccatccctctccattccaccctcacatctatacttatatcttccttatggcttacttgaattttcttgctttccttttatatttttctccttcttttcccccagttctttctattgccaatatttgtgccttctttgtgtctctcagtgacatctggaattgtactggtggcagatgcaaaatttagggatgaataatatatctgtgctgtgtttacagaagaaggtgagctaggacaagactgcttttggtcctctagtcctggtcattttgggctcagaggaaaatcaaagaaaacaaatacaattggattgattttttttttttttttttctgagacggaatctcactctgtggcccaggctggagtgcagtggcatgatctcagctcactccaacctctgcctcctgggttcaagcaactctcctgtctcagcctcccgaatagttgagactataggcgcccaccaccatgtccagctaatttttgtctttttagtagagatggggtttcactttattggtcaggctggtctcgaacacctgacctcaggtgattcgctcgcttcagcctcccaaagtgctgggattacaggcatgagccaccgtggattgatttttaaaaacattaaccagaaaaaatattttaagctagcaggaatatatggaatgcttaacaaggctggcagctatgctagtgcacagagaaaaaaaaaatctaatatatggttcttggacttaaggcagtaaaatatttttttctagctttacgtgacccaacaacaaagttccctggcagatggtcatattatatactactctcttgtcctattgcttattctgtgcttgtccttgctcttatatatatataggcattaaaaaaaatgaaacaaaaacaaccaaacataaaattaatcagctctggtggtgtcagttctcatttccaaacattcactgcttctcccttgctccaaagtaaaatggaaacatctaacttgccagttgaagctctcaaatatctgatctcattcttcctttccaacattaagctccattggttctgttttagttaggacagcgtaggctttgcagcagtaacatttcagtttttttctgtgaattcaaggaacatttatttctcaccaacacaaagttgtatcagcagatactcccttccatctggtaagtcacaccgtgaagttcttaccactttgtaatgttacatttcatagggctgccagatttataaaatataggatgctcaattaaatttgaatttcaagtagacacaatgtttttagtataagtatgtcccatgcaatatttggaacatatttatataaaaagtattcattgctcatctaaagttcaatgttttagaaaaatgatttagtgtaataatagtataaaaagttttcagtattcaaatagtataatagtaaaataattcagcgtatagtgtataatatttataatgtaacataagactattatatagtttataatacagtgtaatatatagtatacagtattatagtgtaatagtgtaataattttgtataataatttttggtataaatctgtttcatgcaatatttgggacatgcttacacaaaatttttttggtgtttatctgaaatttaagtttaaatgggagcactgtgttttatctgtgaaccctgcatattttggcaagtgtatttcaaggttacagaagccaagagaataaagaaatggagcatcactgacactttatctgccttgacccggaagcagcacacatcacttctgctcacagtcctttggacagaactggtcacatggcctaagtataactgcaatgaagactgggaatgtagggcagatcatggagaagtggtgtccactaaagtctctgctacattctctctatgacatttatacatcaagagagtgattacttggcagtagagaggtctgggagttctatggacatttaaagaaagaaacaatgtctttcacgtgagatgctatcgtggagatgaaatttaagccttgatgggcaggtaggaagaagtaaaatagtgtaaaccttgtcatggaggtaagaaaggcagaacatagaaatgaagtgaacatttttctgatcacattttgattgacatatagatcttttgagatttgtccatcatctctactctcatcctattaaaaagaggatttaattttagattgacagatgatgtccttgaagatgatcaggaaacatgggagagagcattgcagattacagataaatttgtcaagagagttataatacataacaaaataagatagtaagccccaaattagatgtattcgcttatgctttcatccataaaaaccagggaagatcttgtcagatgaacaaatctgaagttcttggaagttttgggtaaatgctttaaaaattagaaaaataaaatagggataaagaaaataatcagtctcgattgtatgtaaggtcttacttgcatattcgtcataaattcagcaatttgtaagtggcaagttttcattacaggacatatgtcttgttcttattgaaatgtgagaggaataatatggaagatgctaggaaaaaacatattttactttgtgaaaaatttaaaaagtaatctgacaattcaagtgtgacgaggtatccaaatctatctttttgtttctggaaacattcagtgtaccaacataaagtaaaaggaattatcatcacagacaccttataagatgtacatgtcactttatcctgtgaacacaggccctttgctcctggaaaagaaagatagaaaggtttgccttcccattccctgctgcacacgcagtacctgctgaacctaatgttagtttgtcttagtaagatatatttgcagtcttcacaaataaaaattgttctaactcacaaatgcttaaaaaaaaagaaacactgcatgacaaatttacttcaagattaaatgcaaatttgaatcaggagtatatttcagggattaattgatggagttctgaaaatcaagtttaaaaataaaaatcttgatacaacaaaccatggcttttggaggtgaaaggaatgtttactcttgctgaagttcgttggcaaatctcctcagaacatcatgaagaaaacatatttcaggactcaggactatgttatcttgatgtttcacattcctgcctctttgggaagttgtagttattattccagagtctcgggagatttgctgtaagatctaaactgccacactctccctttttgaactagacatccatagtcagggtatgtattttaagaatgcatatctttaatgaaaacagtctttgtactctagaatcttccccgcagcctgactctgaaaatggcctggtcttcttttcatttgatttttacaatccaagaagtgttcagaggaagcgttatatttctctttaaaacacactgagcataaatttaattggtaataaaatgcatcaaccgtcttctctaagcaaaaagtgaatagcagtagtgttattccgatggtttctcattgagcttttccttcttcacaacttttattggatattgactgaagaaaagaaaattaaaaaaaatataatcacaatgctcaacacctcagaactgaagggttttgttaatccctaagacattataacaccaaatggaaatggtgaacacaaaatatatgtgttctctttgcttgttcaacttcttagggcattacactctggagttagtaaaatgtatctctaggtagtatctgggtagtaaatggtatctctaaatactatctagagatagtaaatggtagaagttcaatgaagctatatgaccctgagttagttcaaaaccttgttctgccactagctatataaccctgggtaggttaacttactactctaatctcagtttgcaacctgcgaataggcctgatagtgaatagtatcagcctcataggcagttttgagcattaagtacgttcatatctgtgaattgcttggctctttctgtgtcttgcccataagttcttagaaaacatgaaagcatattgcttttattcccaagttactaatgtgtatgttagaaacatttttcctatatatgattattttcaactttttaggttttaggcagatttagttataaatactgttttaaggtcaagtttcctgggaaacaggctacgaggcagagatttgcagttgaagtttattatggagtgtaatttggatcaacagtagtagcagagagtgaaagaatcaggaaccagcagaaggagagcctgagctgtcacaatatctcacaatcccttgatctgatgggttggaatggctcttaaggttgtcccagtttagacagaggggatcaggtctttttacacccctcacattgatgagtccttgaatgcaagatgcagctctggatgggaaggggaataatcttgggccaggtggctcttttgggctgagggtgctgcccagatggtgactcatctggcagctgacattcaccaaaacgatcaagagctggaagagtgagtgtccagtcccaaacagggcacctagtgatgcaccagtgtaccatcacatgtgcatatataatattatttgcattcattatgaatgtctcgatttgttttgtaatagatctcccaggctcagattgagaaaaacataaaacaatttttattacaataccaaaattaactggctaattaaaaaaaaaaaaaaagcattttcctaggcatttgcctccttatctcctgaaaggtacactgtgtgaattttaatgttttagcttgtcatcttttaagtgtggatacaatctctgaatttgtgagttaatgtttgaacattttataattactgtaaccttcttccaaatctagcttcctatgagccttttgttttcatttttcatggcatagatagcattataagaaaaataaggggacttttaaatgaaacttcattattccatattaagatatcaactgtatttattttttctaattaccacgttctccttcctagtatgctaatgtaccttatataggcatatttatagtaagtagtttatattagtttttatttaacttaacattacatcctaaatattttcatgtgactaatttttacaatagtaattttaatagaagcacaagagtccaatgaattgatgtgctatctattgcttaactattctcttagcctttggctttcagcctattaccaggttttgcctacaaaatcatactataagttatacattttctaactcagcaattcagttagattcactaagcagtaacagtcaatgctggctcatgctattaaaaggaggcagacataacaaacataaaacttaatctttccctcagaagtacttatgaatgaaaatgagagacttatttactataaatggaagtaaataagtatccacaaaattaaacatgaccagtgatatgctggaccagagataggagcaattatttctaattgtgcaggaagaaaagacttcatagaggaggaagattttaagctaggcttttcaggatgtgtaaaatttagacaaggaaaaaggatgatcagggcattttgagctaaaataaaagtaacagcaagataaaaggatataaaagcaatttacagatataagaaactatgagtcatctggtacgggtggcttatatgagatgaagaggtgacaggaaagaataatttagagtcatatattccaggaacttgacctccatactataaagagtttcaattcctctgtaagcaaaaatataattttttgaaccgaatagggccatgattagattagtgcttcagtagaaagatggttgcattgatatgaagcaaggtagaagacttatatccctgttagaaagatattgcccaagttcaaggaaagtttattaacttattcttttattttttgttctttccttcattcataattcatgagtatataatcaccttagcagggtgttagaccttggggctgttaagataaaaatcaatatctatttaaaattatacatttgttcaacaaatataaattgagagcctactttgtgctagatgaatgaatcagagcagaatttacttcagtcattgaccttaagttctgagtctgaatagtgcatagcatttggtgattacagaccaatgtgttagagatatgaatagaacactaaagtccttcactatgtgacatttcgcagaagagattatacagaccctctaaatgatccttcatcccaaccgttctcttcaatgaagcatctctgtttgcttatatttcccctcttgtctacaaacagaaacaaagttgaaatctggaaatccaaacttaaatgatacagtatgaaggccaagtaatccgtctgcttgaggatctagaaggaattagaatactttgagacttttcatgctgtgttgctgagtttattgaaacatttctacttttgtgagaaaacaaggtgcaagaaatcaagccatcaaaatgcaaaatagaatctcaagaaatcagaatgtttatccagtagcaaaaatctcaggaatttattgagattctgttgtgcattttaacagtgttactcctagtctaaagtggaatttggttctgtctcctgctcctcccatctgtgggttgccctcaactttgttctcactcagacatagaccaggataccatgctattgttactctatcacttaggtttcataatcatgaatcaaccaatgctccaaagaaaactgctctgagaaaagacatatttcaaaagctttttcagaactaatgtagtaatagtaattcattcttatatattacctgctacggctaaatcgaatgcttgataaaatataagaaagctcaaaccagattacatttgaaatatatcatttgggaaaacatgttttaatttgaagacacattgaaagtgattagctacattaaagatttcaaaatatgcattgtattattctgccgtatcataagtggtctatcagccacaataaagtttaaaaaaaaagcttatatccaggtaaatcatcttttgctttgaaaagacaaaattatttctcagaattattttctaattaatgtaactttatttgataggtcaaggcaggagttaactacctttctgttggtgtaattagcttcccatgtctctggaggagctaagtatatgcagataagaaaatgaacaaggtaagccgggcgcggtggctcacgcctgtaatcccagcactttgggaggccgaggcaggcggatcacgaggtcaggagatcaagaccatcctggctaacacggtgaaaccctgtctctactaaaaatataaaatgttagtcaggcgtggtggcgggcacctgtagtcccagctacatgggaggctgaggcaggagaatggcatgaacccgggaggcggaggttgcagtgagccgagatcatgccactgcactccagcctggacgacagagcaggactccgtctcaaaaaaaaaagaaaaagaaaatgaatgaacaaggtatttagagaagatactctcagtgctctgcacagatccccttgaacaacttttaggtcttctgtgagcccctccccagacttgagtgtatttctgtttccaattgctagcacctgtgactgttcttcctagggcagttcttaggttactggagctgctttgcctgcagacaaacagagccaagagcctctagaagtccaagcatctctttctttcccagcagtggctcataatgactgtctattgcctgaatatgaaagctcagctaccttgcttgggttgggataaactctgaggtatgacgtacactccacagctccctgcaaaattaggccaaaaccaccctccatgaaactttgtttgaaagtgtacccttgcttgactgcttctctttctctgtctgcttctttctgtcactcaaagtaggttttcctggaagtatttccttaataaatagctttaatataaataatttgttccagggtatgcttacagggaagtctgagaaagtatttctgcttaaaacatctttttcctgtactccacattttgcagatatgttctgagttaataaatcttttaagctgtgtaaatataccctctgagagagaagaataacaaaacagaacattcccaacaaactaaaatgaccacagatccagtaactaaaattcaacaaccagattgcctgtgtgtatgttgtttttcaaggtagccaaggcatcatgagcatctctatcaatgtcattctttccatacccaaaggagtgcaattccaagatgttgaaactgctgagaccaagctctggctggaggtctaatttccacaagtaagacgcttaggtagcaagatagaaaaggagacttagtaggagcatttgcttggaacgaaggattttaatgtgtttgattggttcagagatcagatgcagagcagaggctacaagagcaaaccactgttcaggatactcacacaaagggactgacactggagctgatctagctgcagttcagctacaaatctgattgggattttaatccagatatttagagcatacaggtggcctaaaggaaacctactaaccctgtctatttataaaaaccaagtctgggtaattttctcctaattttggataaatggtaaacaaacaaacaaaaaacatagtaccctatgaaagccatccagtagcaaaaatgaaaaggaacaatgtcctgaagacaagaggaagagcagacctctgaagattatttataacaggaaccagagaaaatttaaaagactgtttatcatacttaatctgatttaagaagtcattgcttttagtaaacaggaaaagaaagccacaaaatagacaagctgagataaagggacaacaggatgagatgaaaagaagacaggatatgaggccaaggcaacaagctgggatgaaatgggagctcacagtgagataaaggaggtgccgagggagtccagcagaaattcaaaattaaaaccattttcatgtcaattcctccatatacatacacatcccataacggcacatagaagaacagaagaaagtaataaaagatatacaggacaagtgaaggagatacaaacgaaaaattttgagtttctggaaagaaactagattaactggaacagaagtagtaattaaagatgcaattgaagaaaactgtcctaaactagggggttgaagaggaaaggggtgggggaactagcaatgcagattacaggggctgaccatgatccaggcaacattatttaaaggacaattagacatatatcctgatatttttaaattataagaaaatagattgagatgcattcagaaacaaaaaatacaagttatctataaagcaattaatatttacttggccccatagaataacttgtaacactaaatttcaaagaatgatgaagcagatttagagtagtgttcattcattcgacaaataagcttctagtgtgagcccagcattgtgttgggtactgaaaatacaataatgtaaactcttagaacctgaaatgatctgtatatggaattaaaggtaattcgtcatcacaattacataaaaggtttatgtaaaggtataagcatcacaactatttatatgctgggctctaccctgcagtttctgactcagtaggtccaggacaggtcccagtaacttgcgtttctaagttcccaggtgatgctgatgtagctagtaccagaatcacacattgagaaccactgatttgcattaacaaaaatttgcgagggaatagaacagaaatgttccactgcagtggaattattacatcattttagtcactgaaataaacagccttaaagattatttaatactgtataaaaatcacaatcacacaatattgcatagataagtcagtgtgtgagacttgacatattaagctctttacagaaagtggttaaaaaaggaagagatagctatccaatgaacaaagatagtgaggaaatccaaaaattgttgccagtgattatctctagactatatccttatagttaaatattttcatctttttactgtattttctaaataattgtgcattaattttatattgagaaaaagaaaaaaaatctccagaagacccagttcaaatattgtcttcttggtaaagctcctaccagtcccctataccattaactcaagtgccagctatgaattctgttattgcaccataaaagcattcatcaccttctttgtctttcattaaaaactaactattctaatcccagctactcaggaggctgaggcaggagagtcacttgaacctgggaggtggaggttgcagtgagctgagtttgtgccactgcaccccagcctgggtgacagaggaagactctgtctcaaaaaaaaaaaaaaaaaaaaaaaaaaaaaaaaaaaaaaaaaaacctgactattcatgttagtactttaaaagttctgaagagtctcagtttttaaaaaggcttgtttattcttgcttgttccaggattttcaaacttgtctacaaaactatataaaccatctattaatgttctgcaagtaagtggtccacacagtggagttagccaccaatttgcatttattgaatgaatgaatgaatgaatgaaatcaatgaaccaatgaatcattgcctaaaatacacagaatacctatttattaatatgtttcctagtggtgaacctaaataaagagctttctttcaaagggcattaacaattttacttgtgtttacttatgcttctcatttccaaagtactcaagatagagtgtctcctgggtgcagggcattctgacatacaaaagcatcttattttacatggtcttatgtcagccaagtgttagtgcattacatcctcacttatctcagccttcaaaaatatttaaatcacttgtcatagatgattgtgtatctacatgatcattatttaaatttaaccaagagtgataatttcatacaatatgggcaaaaaatgataataggagaatccaagcatcctcttacagaaacatacaaataccagatggagtttcctgcattttgaaagttgatgacactgtatttccaaacaaatattgtatgccaaaaataagagcccatctggaattttataattaattattttctctgccaaaaaatttcttccccactttagtggctatattccatcccattactaactcggatcatgggatttcttatggtcctttatgtttttcaggagttacatacaaatattttaaaagtatggaaatatttgataacttagcaacaaaagtaggatggaatgcaatcagatgtaaacagcatgcttcccagcacaaacatacatcaccaaagacaaatagaaacaaaagtctctgacataagggaacagtcattattaaaatttaaattcactgttattttcacgtaagggttgcaaaatgcttctcccgcaacaccgcatatacagcaagtggccccaagtagtttgttcaataacatacaatggaattaaagaatgttgtgattttgaaagagaagaagaatccgggggtgactgaaattaaagatggtcattttgttgtataaactctgttttttaaatgtctttcttttaacttttaagtgcaggaatacaagtgcaggtttgttacataggtaaacttgtgtcatgggggtgtgttgtacaaattattttgacacccagatattaagcctagtacccattagttatttttcctggttctcttctttctcccaccctccaccctctgaaaggtcccagtgtgtgttgttaccacctatgtgtccatgcgttctcatcatttagctccaacttataagtgataacatgcagtatttcattttgcattcctgtgctagtttgctgaggataatggcctccagcgtcatccatgttcctgcaaaagacaggatctcattgctttttatggctacatagtattccatggtgcctatgtaccacattttcttatccagtctatcattgatgggcatttaggttgattccatgtctttgctatcgtgaatagtgcagcagtgaacatacatgtgcatgtgtctttataatagaatgatttttattcctttggtatatacccagtaaagggattgctgggtctaatccctttagaccaaaggatacttctttagaccaaagtatttaggtctttgaggaattgtcacactgtcttccataatggctgaactaatttacactcccaccaacagtgtataaagttttcccttttttccacaaccttgccagcatctgttgtttttgttgttgttgttgttgttgttgttgttgttgttgctgagacggagtctcactctgttgcccaggctggagtgcagtggcacaatctcagctcactgcaacctctgcctcattggttcgagcaattcccctgcctcagcctcctgagtagctgggattacaggcacacgccaccacacccagctaatttttgtatttttagtagagatggggtttcaccgtgttggtcaggctggtctcaaactcctgaccttgtgatccgcccgcctcggcctcccaaagtgctaggattacaggcatgagccaccatgcctggcccttgactttttaatagtagatattctgactggtattagatggtgtggttttggtttccatttctctaacaatcagtgatattgagctttttgcatgtgatttttggccacatgtatttcttcttttgagaaatgtctgttcatgtcctttgccaactttttaatggagtcatttgtggtttttttcataaacttaagtttgtttttttagatgctggatataagacctttgttggatgcatacatatgagaaacacagtgtagtattaactgataataaagagaagcctttgtaaagttagtgttctttttaaacatgatttagttattcaactttagcatcctgtaattctaattttcagagctggaagccttagaatattagaaatccaagattttgaatgatttttgtttgtttacaacagccagacatatcccaggcaagcaatagaatttagcgtggctggatgggccctgcaataaactgatataagcatgagcaaactgaagaaaacggcagcccctactcagtgatagttaactattttcacccaggcttactgctgcccgatcttctgattgttaaagagaagctgaaaatctgattcttatctgaaatttctcaactttgaaagtacgtttcagagaattaaaatgcatttaaaaattttaaaaatagtgctgaccaaagagatcacatctgtacactggctctactacatgggccactggtctacaaggaagaaactacgatgttgattatggagtcacctgtgtcaagtgaggacttgctacctccaaggactattctaggggtctacctgaaccaaggaataacttattttcccttcgatatacttgatatatggttacttggttatcaagttccaaatatactgttagaccttttgaggatctatcttgagttgttaattgccttcagggaggatctgccggtatcacctttcctccttctccatagattgctccttgtgcatgtatcccagcctagctatatcctgctctaacccatactcactcatcataagcataggttatctttgagtagaagactaaatcaatctctaggcaaaattattgtgtgttaaaaatataattcctacaggggaagccattcttgaaatatcaacatttctagatagttttgtgtttttagcttaaagatgccacttaaagtactggaggttggagacatgtctggaagaaaagcatagaaggaaaaaaaaggcagaaagaggcaaagttatggggtttatatggttgtagatttaacgctttgatctggaaaagacagtgcaggacatggtctcctgtgattctggcctatgaattgatagataaacctctagaatagcaggtcattgtaaaagactgccttttcccagtcataatctttcttctatcccattcccaaaaaccttcctgaaaagtaacctataggtctacagaaaagaatgttattatttcataaatctgagccagaactatttccattactttgaaagatgtagaagaagaaagacacatattaacggacaaaacactctcctaaattgcttggatatttcaagctttaattctattgtcaattacctaaaatgactgtgaccagcatgggtctgttcatttattcaaccaatatttctttagtacctgccacattccagacatttctgcagtgggtaaagacactgtagagattcaacagctagctgaaacctcaaccagtttcaggcaattcttacatctttgatctttatcatcaaaaaaggagcccatagtactaattacacgggaacaaaacactttgatgtatttttcacctatttattcaattaatatttattgagggcttacattataccagttactcttctaaatacaagacaccaaaaaataactttttaaaaaaacttcctgtttccattatgtgtaaatattataattggatgtatatttaatagaaaatgttgactgggcgtggtgactcatggctataatcccagtactttgggatgccaagacaggaggaccacttggggccaggagttaaagagcagtctgggcaacatagagatactctgtctctacaaaaaattagccaggtattgtggcatgtacctgtggtttcagctcctcaggaggttgaggtgagagcatcatttgagcctggaagattgaggccgtagtgagctatggtcacaccactgctctcaacagtgtgagatgctgtcaaaaaaaaaaaaagaaaaagaaaaaagaagagaagaaaagaaagaaggaaaggtagaaagaaaagaaggaaagaaaatgtttctacatttgtgattgagtcttttaaaacatatgtatgtcacatgaaacccacctgcataatttcacattgcatatgtagctaatctatattacaataaattttttttaggccaggagcaggggctcatgcctgtaatcccagcactttgggaggccaaggtgggtggatcacctgaggtcaggagtttgagaccagcctgaccaacatagtgaaacatgtctccactaaaaatacaaaaaatacaaaaaattagctgggcatgctggtgggcacctgtaatcccagctatttgggaggctgaagcaggagaatcacttgaacctggaaggtggaggttgcagtgagccgagatcgtgctattgcgctccagcctgggcgacaagagcaaaaagttcattaaaaaaaaaaaaaaaaaatttagttctctgagactaggttaccttatgtacaaattggaagtcataatattaataaagttataggacttaaatgagataaactaggaaaagaaattagtatatagcatatagtatgtaacctttatttttattattatgtaaatattgatatgtatattttggacactggagtttggttttgtctacctcaaaccagaaggtttacactaccttgcagaaacttcgtgggagaagagttggaatatttccctccagctgtaccttatgtttcagaatagaattcatcctgctgtaatgtgtcagcttaggcaggtcagtttctttaaagacaatgccatagtttgggcttagatacaagtcaattctatcaattccaagaaaaaaaaaagaatatctttaaaaatcaatctcaaaatatttcatcgaagctgttgctgctttgcttcctagacaaggatgctttaggcagcaggagtttcctttagattttttcatcctttcctttctcctaagggcagaaattaagcattcttaggttgatctttttcttccttgtgtaattcaagaccagagggaatttcaagcttcctgttcatcagcaaaataaactgatataaaatgaagagggaaatttattctcccctcatcaccagtttaggaaaggaaagttaaattatgttccaaacgtttatcttgtatatggtatttgataagtggttgaaggagcttattgtacagtgtaaaggagagctctcaaaaacttagagggaatgagttattaatgtgttataaatgcaccataaagaaaaaacttctggcttgtgacactgtttgtgaatttttgtgtgtttgaaaacatttccaaggtcatgtttttaagggcaggacttgaaaacagtgatttcactatggaattctggcattctctaaacaggacttctttgtgagcacccttgatcttggtattttttgtctcttcaagatgagctatgagctcacctatttttgttttccttctgctgagcaatactgttcctgggctcttttgttaagtcacaataaactaggcaagcaaccaggaggtccttgacacaaagtcctttattgatctgaaaaccacactgtgctaacctcaccttaaaatcctatagcataaatctctagttcctcaaaaacagccaaagtattaacaccaaaacactagatatccttgttttcaatgcatatttgacaatttagaaaaggtagttctttatgaaaaaaattgttttctttttagttttaaacttttatgtccaacatcttccaggtctctcttgaagataaatgttttgcccttttgtgccaaagagcacaaaaatacagtcaggccaatgtcatgattgtagggttggagttgcaaatttaaaagattctatgatgctccttaaattataatataaaagtattttataataagagaggcaaggaattgtgtatcagagagttatgagaattataatgcctgaagttatatatgtgaccaaatgaaaggcttttaatttgttaggaatttgctcattcattcacttacttattgactcgttcattcaatggctagtatgagccagaatgtgtggtaagatgatatagttacaaacaaaaccattctgttctctatgatcttggcacttacagcctcttagggtaaaatataataatcatataaacaaataaaataatccacaaattatgcccactgcaatgaaggacattaacagcatgctgtgatagacactaatggaggagaagaattcagctcctgtacaatcctggggagtgagtgctccagtcaaaagcaacagcaggtgcaaaagcctcaatgtggccaaaatatagtaaagcagtagaagagtagcatgcaaattgatgtaaaaattgtgaagctctacgtaacacataggtgatgttgcctgtcctgcactgttctacatgataccttccccagtgtctccactttggtcaagattacatgtccccgttaattgcttgaattcaccctttacttacctgtccccaaatatttgttcatacttgaatgctatttctccctcatgtctaaatgttgtcattctgcaaagcaaaatgcaaaaaaaaaaaaaaaaaaaattagggaaaaagagtatacattgtgcgattcaattaatggaagattctagaaaatgccaaattcatctgtaatgacagatgcctggttgctgggggtgtgtgtggaggtggctgcaaagaggtacaaatggaatttgggggatgatgaaagagttctgtatcttgatcgttatggtggttatgcaggtggattatctgtcaaaactcaacaaactgtacactgaaatggcatttatcatatgcaagttatatcttaaataagttgattaaaaagttatagaataagaaaaacaataaaaagcttaaattcatcttctccattatctctctaataagaaataacctttctttctatcatcatggcatgtactgttcatgtgttataggtttttgtatttgtgataagcataccacatagagccctcagtgaatgtcatgatgttaaagtgactatttcttcattgggtttgcatattaccttatgagagaaatcacgtctcatttgtacttttctccccccacagcacctagcttagaatacataaaagaacctcactgagcatttggtaaatcaatagcaatatttttatatttacatcctgactggttcccaaaaaggatgagcaggaaaagaaattgatttccaggagttgataaatgaatagactgttcttggcactggagcccacatcctgtctccatatgtaaaaattggtggtagaaaagggttttcaacctaccttcttcacactcatgcttacttactgatttaatgaaatgcttgtgatggtttctgtgttctccagtaggtaaacgctatacagaccctctgcattatccttcttaatagtccattattcctctgtagagagtccagtggtagaatcagcgttgtcaagctgcaaggaggggacacaaaagtgttataggaaggtgacatttatgccccattatgagtgaaggaaaatcgaaggagcaatagtggtctattgcataactgcccctgttgggttgttatgaggagaactgtgtaaatcagccctcgtgcttatccttgagaaattctttttcccctttcctcatagcctctctctgtgcaatttttggtgttctcaactggccgattacctagaatattagcttttcaaaatatgacacagaagttcaccaattccttccaactcataacactttaaaattgcaattccaaattattcctgtaaaaatagctgatctttatgactcctaggggatttcttattttaatctgaaaccttcagaaatggttcagttttgtgaaaatgatgggggaatgtctgcccttagcagtttttgtgttcaagggcaaatcaacctctgtgcttgctaactttaattttccaagggttatgagactttaatttgattctttatccagtgtgcataaaatgttcactggaatttgcataatacatttattgtataatcattcttcacattggttacctgcttcctcaaatgaacattacttttttaaagagatgaattaatgtagggccaatttgaacttagtaactaaacagaattaaatatatctctgatgaacaaacataaaagagacagggaaggagagcagatacttgttctgaaataggctattatgagaaaatagccccagtcctgtatttttaaatattcattttgtacatataggcaggagaagaattgctgtctttaaaaatataaagatttgttatgtgaagaaaggaatacatttgtctggtttctcttagaatgtatttaaaacaaacgaattaaattaaggtgctaaatttcagcacagtctaaaaagatgagggagttggagagagaaaatgcctttggcattaggccaggtgctttaaatgcacttaaatttattcaatgcccagaaccgacatagaatttaggtagtgttattattatccttatttttggttgagtgttctgtgcctgaggactcattgctatcaaatagtggagctagtatttgaatctagactgcatgatggcaacatctgtgcctttcaactacaacagttttctctgaaatacacttatctctcatggactgccttggaagactgtgtactccctaatattagaattgtccaggtggagtttggaggagtgtttggcaaagagattgtaggaagattggaagatccaatagaggttcaagaagatgacttttaagattcccattctctctatagttttatgagagtagcaggtgcagtcctgacttgctgagtggcttgttgcagtccagggagtctcaatctttaatgtgcatatggctttcttggggatcttgtcaaaatgtacagcctgattcagtagacctagggtaggcctgaaattgtgcacttctaacaagctcccaagtgatgccaacattgcttttccacagctcacatctgagcagcaaagtagaaaacctctcaggcgaggtgcttttgatttctgcttgcagagccattttcctagtttttcaggtcttgaccgtagttgggacaattatataaaaacatcctaaactaaacagttctctaaactgtatctgaaccaccatgtcctaggatcctgaaatgctgttttccttatacaattaggatactgcctagaggagagatttcctctgtaagtcatgaacctccagcaatttaaagggacacgaaagagctgataccatcagcaagcatactaatttacaaattacatcaaaatgttcttggagacaacatatctttgttgaaaaaaaaattccactttcaacttataaataaatatgtaatcatggtacaattacatgactattcaaacttttgatatcctttttgaatcacagatctcaaattttgtctcataagattctgatatatttccaaaaatcctttgagatggatccaacttaattacaatgaaaagaaaaatgggcttccaatcccttgtatttcaagagatgggtgtttgaatttgatctaactggcttctgatatctttggcttgcaatgcatgaaagtctttttttaaaaaaaagatctttgaatgaaacaaaaaacttaggaaaaatcattctctaaagtctaggaggctttgaaagcattgcctatttccatttcattaattttaaaaatctttccaaatcttggaataaaatcagttttgcaagttaagaaacatttagctaaggcaaactgtatagctcagaaatctttcagaaagggttaggcaattggaatgctgaaaatattagattgatgggattatagagatccatatttaccgaccaagaaaagcagttgcttagggaaaaatcagatgttaaaattgtatgtataatctgatatcattttggctaaaataaggaaaacaattttattaaaaatttattatcttggatggtggcatcatagctaatttctctttgtattggctgaattactataataaaattacataacttataaaattagaaaaaatcaatagtcattttcttatttttgaaattttaatttttgtgagtacatagtatgtatatatatttatgaggtataggagatattttgttacaggcatgtaatgcataataatcactttatggaaaatgacgtatccatgccttcaagcatttatcctttgttttataagacatccaattcttttagttatttaaaaatgtacaattaaattattttgactgtagtcaccctgttgtgctatcaaatactagatattatttattctttcaaactattttttgtacccttcaaccatcctcacctccccctcatcccctgctacagttcccagcctctggtaaccatccttctactgtctatctccatgtgttcaattgttttgatttttatatccaacaaataagtgagaacctgcaatgtctgtttttctgttactggcttatttcacttaatgtaatgacctccagtttcatccatgttgttgcaaatgacaggatctcattctcttttatggctgaatagtactccattgtgtataagtaccacattttctttatccattcatctgttgatggacactgaggttgcttccaaatcttggctgttgcaaacagtgctgtaacaaacatggaaatgcagatatctcttcaatatattgattttccttcttttgggcatatactcagcaatggtatttctgtatcatatggtagctctatttttagttttttcagaaatccaaactcttctccatagtggttgtactaatttatattccctccaacagtatacaagggttggttcccttttcactacaacctctccaacatttgttattgcctgtcttttggataaaaccattttaactgggctgagatgatatctcatcatagttttgatttgcatttctctgatgatcagtgatattgagcacctttccatatgcctgtttgccatttgtatgtcacccttgaaaaatttctattaaaatattttgcccatttttggttggattattatattttttcctatacagttgtttgagctctttgtatttactgattatcaatctgtcagatgggtagtttgcaaatattttctctcattctgtgggttgattcttcactttgttcattgttttccctcactgtgcagaagctttttaacttgatgagatcccatctgtccgtttttgctttggttgcctgtgtttctccaatgttttcttttagtagtttcatagtttgaggtcttagatttaagtctttaatccattttgatatgttttttgtatatggtgagagacaggggtcaagtctcattcttctgtatatggatatctagttttcccagtaccatttattgaagagattgtccattcttcaatgtgtggctttggcacctttgtgaaaaatgagttcactgtaggtacgtagatttgcttgtagattttctattatgttccattggcctatgtgtctgtttttatgccagtaccatgctgttttggttactatagctctgtagtataatttgaagtcaggtaatgtgatttcttcagtttagttctttttgcttagaatagctttggctattcagggtctttgtgattctgtagaaactttagaattatttttgctatttctgagaagaatgtcattggtatattgatagggactgcattgaatcagtagattgttttggatagtatgcacattttaaacaatattgctatccaatatccaatccacaaacatggaatatttttaattttttttgtgtcctcttcaatttcttttatcagtgttttacagttttaattatagagatatttttcttctttgattaattcctaagtatttaattttatttttgactatagtaggtggaattactttttaaatttctttttcagattgttccctgttggcatatagaaatgctactaattttcgtatgttgatcttgtatccttcaactttactgaatgtttatcaattctgatagtatttttggtagagtcttttaagttttttcaaatatgagatcgtatcatctgcaaacgaggataatttgacttctttctttgtcatttggatgccctttatttcttccttttctgacttctctagctagaatttccagtactatgttaaataacagtggtgaatgtgaatatccttgtcatgttcttataggaaagggtttcagtttttcctcattcagtataatactagtcatgggtctgtcacatatggcttttattatgttgaggtatgctctgtctatacctagttttttgagggtttttattatgaagagatgttcaattttttcaaatgctttgtcagcatcaatcaaaatgatcatatggttgttgtccttcattttgttgatatgttgtatcacattgattgatttgtgaatattgaatcattcttgcctccaagacgtaaatcccacatggtcatgatgagtgatcatcttaatgtattgttgaattcagtttgctagtattttgttgaagatttttgtgtcaatattaatcagagatattggcctgtagttttcttttactgatgtaacttttttctcgttttggtatcaggataatactggtctcatagaatgaatttgaaattatttcctcctcccctatttttcagaattgtttgaggattggtattaattcttcttaagtgtttgatagaattcagcagtgaatctgttgggtcctgggttttccttattgggagactttttattatggattcaatctcattgttagttattggtctgtttagtctttggatttcttcataattcgatcttggtggtttgtgcatatctaggaatttattcagttccctttgattttccagtttattggcatatagttgctcacagtagccattaatgatcctttaaatttctgtgacataagttttaagagctccttattcttttttattttttcttttgagatggagtcttgttctgtcacccaggctggagtgcagtggcacaacctcagctcactgcaacctccgcctcccaggttcaagtgattctcccacctcagcctcccgactagctgggattacaggtgcttgccaccctgtttggcaaatttttatatttttagtagagatggggtttcaccatgttggccaggctggtctcaatctcccaacctctggtgatttgccttggcctcccaaagttctgggattgcaggcatgagccaccatgctcagcttcctttttcatctcttatttatttctttatttaggttgtcttccttttttttcttcattagtctggctaaaagtttgccaattttgtttatcttttcaaaaagcaaatgtttcatctatcttttgtattattttctttgtttcaaatcatttatttctactctgatcctgatttcttttcttctaactttgcgtttaaatcatacttgcatttttagttctttaagatgcatccttaggttctttatttgaattttttcttattttttgatgtaggcacttataactataaacttccctctgagtactgctttttctgtattccataggttttgatatgttatgtttccattatcatttgtttcaagaaatgtttaaattttcttcttaacatctttattgaaccactggttattcaggagcatattgtttaatctccttgtgttcatatagtttccaaaattcctcttgttgatttctagttttatttcactgtggtcagagaagatacttgatattttttccattttttaaatgttttaaggtttgttttgtgacctaacacataatctatcctagagaatgatccacatgatgaggagaaaattgtgtattctgttgtctctggatgaaatgttttgtaaatatctattaggtccatattttctatactgcagattaactctgatgtttctttgttgagtttctatctgggagatctgtccaatgctgaaagtggattattgatgtcttagctattattgtattgaggtctacctttctctttagctctaataatatttgctttatatatcagggtgctccagtgttgggtgcacatatatttagaattgttatgttcttatgctggattgacccctttatcattatgtaaggacgttctttgtctctccttgcagtttttgtcttgaaatccattttttcttatataagtgtagatacacctgctgttttttggttttcattgtcatggaatgtctttttttttccatccctttattttcagtctgtgggtctttatacgtgacgtgggtttcttgtaggcaacagattatggaatcttattttttcatccatttagccattctatgtcttttgattagagagtccatttacaatcaatgttattattgataggcagggacttattctttccgttttgctatttgttttctggttgttttgtagtcttctcttccttcttaccttcctttcagtcttccttttagtgaatgtgattttctctgacggtatgatttaatttcttgctttttattttttgtgtatccattgtgtgtttttttgatttgaggttacagtgaggcttccaaatactatcttataacctgttattttaaacagatgaaaacttaacactgattgcataagaaaacacacacacacacacacacacacacacacacacaagaaaattaataaaaaccctacactttaacttcatcccctgctttttaactttttgttatttctctttatgtcttattgtactgtctgtatcttgaaatgcaattgtagttattgtttttgattggttcatcatttagtctttccacttaagagtagtttacacaccacaattatagtgttatacaattctgtgtttttctgcatatttactattaccagtgagttttgtagcttcagatgatttcttcttgctcactaacatcttcttctttcagattgaagaacaccctttagcatttcttataaggcaggtctggtgttgataaaatccatcagctattttttcatctagaaaggtctttatttctttttcacacttgaaggatatctttgtcggatatactattcaagggtaaaagtttttttttttttctttcagtactttaaatatgtcatgccactctctcctggcctgtaaggtttctactgaaaagtctgttaccagatgtattacagctccattgtatgttgtctttttttcctcttactacttttaggatcctttctttatccttgacttttggaggtttgattattagatgccttgaggtagtcttctttgggttaaacctgcttggtgttctataactttcttgtgcttgaatgttggtacccttctctaggtttgggaagttctctgatattgtccctttgcataaactttctacacataactctttctctacctcatgttttaaggcaaataactcttatatttgcccttttgatactactttctagatcttgtcagcatgcttcattgctttctactcttttttgtcccctctgattgtgtgttttcaaataggctttcttcaagctcactaattcttctgcttgatcagttttactattgagtgactctgatgcattcttcagtatgtcatttgcatttttaaactctagaatttctgcttgattcttttaaattatttcagtttctttgttaattttttctgatagaattctgaacttttttgtctgtattatctttaattttttaaaatttcctcaaacagctattttgaatactctgtgtgaaaggtcacatgtctctgtttctccaggattagtccttcatgcattatttaattcatttggtcaggtcatgtcttcttggatgattttgatgcttgtaggtgttcataggtgtctggacattgaagagttaggtatttattgttgtgttcatggtttgggcttgtttgtgcccatccttcttgagaaggctttccaggtatttgaaaggacttaggccctcagcccaatatttctgtggtttttgcagactcatagaggtaccaccttggtggtcttgggtaagatctggaagaattctctggattaccaggcagagactcttctccttttcctttactttctcccaaacaaatggaatctctgtctttgcgctgagtcacctgaaactggaggtgtggtgatgcactgggattgacccagtgtggttcctgtggctgccatcaatgtgactgctggatcagacctgaaacctgcatagcactgagtcttgcccaaggcccactctaaccactacctggctgtcacctatgtttacaaaaaacccttggcctctacaatttacaggtggaaaatccagccaagtttgtgtccctaccttcaggatggcaagtttccccaggccccaggtgggtccagagatactgtctgggagccagggattgtagtcaaaaaccttaaaaatttgactgatgctctgttatactccagctaagctggcactcagtccacaatataaagttctttccactcttcccctttccacaggcagaggagcctctccctgtgggcactgccaccactggcccattgaggggttctgccaggccactgcccatgttcccttaaagcccagtgactcttcagtcagcttgtggtaaatgctgccaagcctgagactcacccttctgagaaattggatctcctctggcccagggcaggtccagaaatgctgtctactagcctaggcctagacttagtgaccctaagagcctgctttttgctctatgccacagtggctgaactggtacctaagacacaagacaatgtctcctttacttttccttcctctacatctcagagcccaaggcccatagcaaacaacctgggttttgctgctggttattcagggcccaatggctctttagtcagcaggttatgaatccttccaggactaggtccttcccttcaatgcagcaggttgccttttggcccagggtgtttctacaaatgtcatctgagagctagggcccagattagggggcttagtattctgcccaatgccctattctaccacggctgagctggtattcaagacacaaggctcctctttactctttgctgtctgccccttaggcagaaggaaggagacactttcattgctgtgagctgccttacttatggctgggggagggatggcacaagcattcctttagctgccccggctggtgtctccctaggtctcatgccatgccaccctagtcctctggctctgagcccagtccagcactaggagttgcatatgagttgcagtccctgtgcccttgactgcctttcagagtttacctaggtccccagagcactttggcctgtgatggcaaggcttgccaggaaacttgggtatcaactgatgagatggatgattcttctctggctaggtctggtccaaatgctccctctgtgtgtgggcattggctgagcccagtatagctttgctctccactgtggcagggcagcactgagtttaatgtaaagtcccccagttgctgtattctccctccctcaaatgcacagactctttgctgcatggctcactacctgtggtgttggaggggtggttttgatgcttcaggactgtctttcctgttctcctcaatgtctctttcaagatatgaagttaaaattaggtactgggattgctcacctgagttttggtccttgagatgatgcttttctgtgtgcagatagttgctaaaatttggtgttcctgctgggggtacaaactatgtaggtttctattctgccattttgttctatcctttatcaactatttattttaggaaaaggaatgtgtgtacaattggagagccatttacaaaatctttactacaaatgtttttgattttataatttgtgataacaggaactatacttttataactctataaacctctgggtgtccctaatacatagaatagtgagagctcgagagttagttttagttgcctttccaggtaggaccatcagaaggaatgacagagcagtttgttttgaaggtagactaaagcaccaaggtctaggtgtaagggaaattacgttttactgaattgtgttttgtttggcttgtttttgtttttaccgtgtacatttgttactctcgattgtgcatatatacatataagtgctttttttatttttaaaactctaatacttagttaaacttgtatttgatatgtcaagtgggatggagaaaagtaatctggagtataagaagatgtagaatccaccgtgtctcatagtgacagggacagtatttgaggatatttatttaaaatatttgaaataaggcctataaatgtgtgactgaagagcatattcaatcaaatatgagtataaattaggaagtgcacaattgtagttagatagaaccttttatcaaagattttgaagggggaaatcatggatggaaccctgtcccaggaaaatgctagtgtgcaaaagcacacacggctctataaggaaatttagatcaagtgacaagttggcggagggaatatacagaatgtacagtatgacaaaaacaaagaatcacaggtaatacatgcttcttttttttttttttttttttttgagacggagtctcgctctgtcgcccaggtcggactgcggactgcagtggcgcaatctcggctcactgcaagctccgcttcccgggttcacgccattctcctgcctcagcctcccgagtagctgggactacaggcgcccgccaccgcgcccggctaattttttgtatttttagtagagacggggtttcaccttgttagccaggatggtctcgatctcctgacctcatgatccacccgcctcggcctcccaaagtgctgggattacaggcgtgagccaccgcgcccggccaatacatgcttcctaaaggggttaccccatatgtagaattcacttttcttcttttctgctctgaactatttcatgtatctttccgggttgttgcccaattttattataatggtctatcctctaaagatgaataggtggtaaaaagaaggatgcttcggttgtggggaagagtaagtagggatgagtacaagcatgcttcccaggccatttgctgaaactattgagtgtgaatatggattaaagtacctgggaagaggtagggggcttgtcctccagttgatacactgaggtcattacctctattccttgtatggaggaatagtctattgttctacccatctgtaagtctagagcaagggggagggaagaatgggacagccaggaatgaaattttagttaggtttgcctatcctaaattggggctggggtttctagagctataattaaagtgttcagtcatagcccacttttgtcataattataaacttgttggaattgttttattaatatgttgggcttgctcatgcagtcaccattacacacttgtacctcctgctgttttgatggtagagacacacaggaccaacagctcaaacaagacatatattttatttgtatatttgaacactgcatgttagcaaagcaaagctttgctagatggttcccagaggttaatctgcccatttactgccaagtacgctgctccttaatctgtgcaatattataataaaataatggttggtctttggcaaatcagtaagtttctttaatctcgataaagcatagtgactgcactaagcccataaataatgattctgatactcattttgactttattcagtataaagaagcaatttctctcatttaaaaatcaattgaacatgatgaagaggaaagtgagttttgggatttgaatttgtgtttagtttaataagattttttgtgtaacataaatggaatgagaaagtgttccattttcaagtgccgtactactaaatactttgctctctaaatttgtctgtctttgtaattgttttattctgctaggaaataccattggggacctattccttttccccagtccttatttttgtcatttgtgtgcaaaatatattgagttttcccccacctggaagaaacagttgccattttaaaatactagcacttttttcccacaatttatatggtagtgattactctctatatcttgtacttaatttcaaacaaactgagagacagaaagatagactaattcatacatatatacataaatttagaatatggataattttaccatcatggcacttactgaatggaacctggctcagttgttcagctctgttgaccagagctgtacaccctaagccatacatactatacggtataaaattagttcaataatatgaagataactgtgtctatatgccatttaaacataaactccactgcatttaaatttatttatcaactctactagacaataaactctttgtcaagaaaagccatgttagagtttttttttccttacagcatctggcactatcttccttgtatgtagtagatgcttagtaaatttaataatataataataataataataataataataaaaggaagatctcattgtggttcaaaaatgtcactaataataggcaaattcttgttccaaaagctgatgtcttattttagtatttctggcacacaaatttcagaatgcttaggcaattaaactggaatatgaggggactccagtggagcaacctgttttctgtatagtggatattgttacccatgttattttactctgtttgctaagtgtctgaggctgcaaccctccctgttcaggcagtccatatgtggcttcttttctgtatcaactccctgcattttatatttttaagacatttgaaagcataggtgattcagactataatggcttagaatttttctcacagtaagctcttttgtctctggcttttgcttttcagcaggaactatcttttgcctttattttttcacaaatctaaggtagaccatatggctatcatattggttcccctgtggtatcccggctttactataatgatcactcacagtaaatggatacaaaagaagatactgaagaaatgagtaggttttcttgttgttttaaaagaaaagttgcaataaatatatcaatgctgttatttcattatcttctgtgatcacataatgcaaagaactaggaaatccaataaggaaagatagtcagcaataactgaatagtttagggatacagtagaaatacagcagaaatacagaggtatggaggcagtctaagtgccatcagacttccaggcagcctgcaaaccacccctctctccctgcaactcagtcatcctattctgagcccagacaacagccacagagtattgctaagcccaaatggaaggtggggaaggatttatggaaaggtgattcattgttaacatcttcaactgttaaacttaagtagaatttcagctgaatgtatatataattcttagcccaaatgtttgctttttctgtttagaaatcacatttgactcacggttggattgtctttggaagaatttgggtgctacaccaagccatctgtgtttcaagcgagattttatgacagtcattctgaagaggtggaacaatacaaatgtgaaatttagtgtgcagttacactctgagagcaagtctccttggctcactgttgatggccctgcaaatctaaagcaggagttctagttttatcattactttcccccaatacaccccaacacacacacataaagaacaatcccaatgttggtaaataaataagcagtttaaatagagaacttaaggagcccacagcaacacagaagtataaaataagcttttgaagatggtaaagaaacatttaatgaaatttcaaatggattgtcacgcagtggttcaactgaatggcaaaggtctcagggaagatgttgccagcaaatgcactaaaggaaacaaataagaaccatctggacactactattctttgtagaattccattatagatagatagatagatagatagatagatagatagatagatagatacacacacacatacatacagttttttctctacagtcaccaggcttgtagtgcaataaaaatagcaaaactttaaattaacacacagggtttaaaacatttcaggaaagcattgattatatctgccaatggaatgagtgtatttggcaaatgacctaattatcacagagctggttctttctcattgctctacttcccgctaattgcagaactgctggccttctccccctgacaaggaagaaaaacaaggacaggagtgtgtggagaaaacagtgacattcagttttaattcatttgaacctgctgccaagcttaattatgtaattgagagagtgagacgggtgggcttacagccacttgggccagagtttctgatggttagcatttgccagtgttgtgttgaggattttagcagttaccggaaagcattattagctgaagctgaactaatctcccttacccttctcctcaccagatgtaggtacagaggttgctgttcccagacttgattatttgtcattaaggaaaacaaattgaaagcaaattaaagtggctttattccttgctaaatccatcattattctttaggggcagtctcctatttcattttgctttcttctgattgtgatgtagtatctgctgtcatgtaaaactcagtaatgcaatgtttatttctagaatgggagtatttttcagggttacttgagacatttttacataaacttctattgtaactagtgaaagtgtgtatatatgaaaaacacataatttggtgagatatttctgatttggtagcttatcccctatttttaattttatttatgaagcctttatcccccttggcttggaaccatcaatacagatattttgtacaaaagggccaacctctctctcctcgctggcagaatgactctttataagtacgcttttttcaaagtttagccagaacatccctgattcagagaactctcagggtgtctcctaccctcacagaaatgtcctccgttcagattgaagtttagtcctggaggtcaacatcttgattttgtaatatcctgtgtaccatgtgggggtggaaaggaggagaagaagccagagagaaggcacgctagactaaagggtgggagccataaaataagaggctgcctgctgggtggcagcatggctgaaacagaaccatgaccacttagcattatgtgttctttatagcccaacagtattaatagacacttttatcagttaatccccatcataattccatgaagtaagttaacattttttaaacgtgctttccatttattttcacaaatatttattaagcataggctagatgttaggtacagtcccagtacctggggtaatacaatgaaacaacacctggtaatggagagtgctcttttttcttccaggtacaatgggtgaaggggaggatccttgtctggcgaagggcaacactttcatgaagtttctagatacgcccacccttctactctctcaggaatgttattctataaattatccacttgtcctcctgtagttttaatctattttctgcttgatctttcctatcaatattcaacattcaaaaatgccaagaacagtatctgtcctgtagaaagtggtcaataatgatttgttgaataatttacatgaatactcagcagtttcctaccctagcttcacactggaatcaggtgggaaatagacacacacacacacacagacaaccatagcatctcctatcttaaagcaaacaaacagaaacaactcagttgaccttagatcccctgctagctaaatctgtttcttaattcttcttcccagccaagataactgcaaagaggcctgtaaatcctcctcctcatcttgctcatactcttcaactactccagcagacttcaatccccatcacttgcctaaagcaaatcatgatagtgacatcatgtttctaaagacactgggcatcttgaagctatcttcttgctcaaactctcagtagcatttcacataattgatctctccctcctcagaatactttcttaccttggatttgagacatctgattcccttttcatttccttcttcctctctgactctccagctttctttgcagtcttttcttcttatgtaatgcctaaatgctgaagttgtttgagttctaatcctggacctatttcttttatacttactctgggcatttttgactatttcctattaataacatctatatctttgtgctgttgtcctcctatatttccaatttcatctccatttctgagcaccaaactaatatatccagctgcgatttgacatttctatttagatgtctcgggcatttctgactcaacatgtctcagaccaataattagattttccttctcccctgctggttcttccttgagtcttcccatttcaataaattacatatccactcacccagtggcttatggcaaaaacaaaaccaaccaaacaaacaaaaccagtggtaatccttgtctatgtctttatgtcttccttctttccagttcagtcaatccatttacaaagccctgttaattctgcctccaaaatataactcaaagcatccatttcaccctatttcattgccagctgcctttcctctggaatgttgcaatagcccctaagtcatctcctgatcccattctagcttcccagctcccccgcaacattgcaatctcaatttaaaaatgcagatcatttcacaccactgcttctttaaaactttcaatagtgaacaatcaaaaattaaaatctatattatatgctgtcatttactttcaaggaagatctgcaattttgtaattatatattcatttgtatggttatttgttcttatccatctcccaactcaactattagttgcatgcatgggaactgaggttttctcccaccactatataccctttgcttagtgcagtgcctgaaatagaactttattattgaatgaataaataagccgatgaacggatgaggaagattggccaacgtgtaaggtacaaggtggttcccatgtcaatctcatcttaactcatcaactgctccattgacaaatgtacgattaaatgagctcaattaaattatcttatatggaattgttttattccatgccatttaaggaattttcaagaattgagtcctttctctgatgggcttcagaggctactagcatagtttacaacgtagggatataaagcaattcatggtatggtgtatttgaaaggacacatgcagactttacttcaaatcctggatctgctcaatgagtggcttgtgattcttgtcaagttggatcaccttaccctaacctcagtttcttcatgtgtataatggcacgaagccagtagtacctgatgttattatgacttcaccaagtgccaatgtgtcaactacctagcacagcaaccgacatgtgagagatgacatccagattatagttttgctttcttctccccttgaccctatttcttgactattacttccactttttttttctatcttactcatcttactgggtagtaatacttacattacccatttagtttgattttgtagggagagaagaattagcagtacttacagaacaggcttccttttggattagaaatacaaacttcacagcttctctgcccagcttttcaagagcattttacagtacactgctgtgtaacaagttcattttacgataacatgctgggagggagaaaaagaagacgagattcgaggggaaaaaattaaaaagttaattaaaagaaacaacttcgtaattggattcccttgcactcttctttggttattttggggtgagaggaggtgtcacagtacacctccttagtaggttagtaggtttgcttcagtggctcacctcaaaacttctaaatgagataagtataagaatacagatgattccctgcctgacagatgagaagaagtataggatacatatggtgagcttgttaagcatgccaaacaaagctgtccttatactcactcttgagcatttatatttcaaaatattcttggcagttaacattactgttaggctaagccttggactattagctagcttaaggacatacaaaatggacttttcattgatgccgttttactatttctttgctttcaccatatatagacatccacacaagcacacaatcagaatagcataggaaactcatatacccttttcagactgtacactagaaacaaataagcaacatagtatttcttatttttaaaagaaacatgaatatttatgtatttaatcattctttttcacagatctgtacgagtcaaaataatttaagatgctatcattgagatagacaagataatggaagagcatgggcttagtaatcaaatggaactaggttttaaaccctctcatccacaatatttacttattcatgaagtcaacatgtatttattgaatgcctactgtgtgccaagcactactgcagttgctgataaccttttgcgagttcttatcatggtttttgttaacatcaatatttgaggttttgaaaattaactttagggagagaattttctatattttccagcactttgtgtacctcacttttgccataatccatgaagaaagaacacggttaaacagtctattatcttactcaccaaattaggttaaattgggttactgattctacacccaatctccaaaacaatggctagaaaataagagttactattttatgtctagagacattatgatgttatctctcccaaagcattaaggaccactaatctaagagcctaatgttcaaccagggtaatatgtcagaagaaatgaatgcaagtctatctgtaaacttgtacttcatcagtgaagatagagattcagctttttgtgaatattaacaaggggattttgtgttttcacaggttatggttttgtagattttgacagtcctgcagccgcacagaaagcggtagcatctctcaaggcaaatggcgtgcaggcacagatggctaaggtaagattgatgtttaggggtgttttttttttttttttttttttgtgtgtgtgtgtgtgtgtgtgtgtgtgtgaaagagagagagagagatcaggaggaaggaagaaggagagattaaatatttctcctttgctctgagctcactcaaacgtggagtttgcaacaatttggtttatattttcttgttagggaaagtaagaaactccacattaggtttggcttaggagaatctgtctggcttatttcattgtttctttgcctatatttattattgtatcttttgttatggtaacctcattagagacttaaggacactcgtgaagtgctctgttctgcttgagaaagatggggtgtgtctgtgtgtatgtgtcttggacttctactggtaaacagttttagagtagtagaattatcagcaacttgtctttgataaactgtgtgctaaaaaaagtgtgtgttctcttagctggggagagctgattgttgaatgatggggttgtctgatctgtgcagggaaatgagtttaactgaagtgtaccgtgtctgtactgctagaatttcactttggcctttatatgtagagttttctaagatacttttaggtattaataattttcaataattaagtatcattaaatagaatatgtattctagaaccttctacctgaaactgtaatgtattttattatctaagaaaataagttaaattatttacaatccttttgtgtcctgattgcagtggtggttacaagaatctatacctgataaagtaacgtagaactatatatacatattgcgccaatgtcagttccctggttttgatataatcatataaaatgtaaaatttgtagaaacctcatgaagggtacataggctctctctgtactatctttgcaatgtcttataaatctataaatatttctagctaaaaagtcaaaacaattgtttataacatggatgcttattagatgtctgctttaaaatgatggccatttaggatttattcacctgcatcctaagtctttaaatattctttctgattgataatagtgaacttatttatctctagattctataaattttaggtggaatggccaacagaccttgaaatcctgatctaatgtattcatgctctgctcgtgtatacatttaagtattcccataagagttgagtgatagaatgataaggtagtcagattttcagttatttagattttgttgagattgctaacattatttgataacattttccaattttgacctcaaataactagaggtaagatatttggtttcttcatcttcagttgtcttctagtgaactgatacagaccatatctgttaaccttttgttgcaagtcacttcccatatagattactttggtgaactcattgtcctttatgacacatgactagttgttcaaggcagaataaatttgaattctttcagctgtgtaatgtattcttcatcaagattatgcctagaagctttggatttttttcatggactaagattgatgaagttagcatttttaattaataaggaaattatatacatgtcttggtttaaaggttacttggcaaagagtcaatggcattaagtagtgacttcctatacccacaaaacaaatgatgaaatgtagctgttaggtatatgtaaaataagtaacttgaatctggactgaaagtaacacctacttccaagaaaatgaatagaaaaatgcttaacgaaaaagttgttattggaatttcttgatctattccattggtaaactcccaaatctggaagttagcagattgtagcactttagaagtaatgaaaacagcatgcataatctccaccatttcaaatgtcctcagaatatgtatagttagttgttagataaaaaccactgccatcttgtgtaacaggaaaagaaagttgacactgattttataactactggggaaccattatgaatattttccctcagtttcccagcattctgctgcactgagaatccctctttctctctctctcttacccactcccccgcaccctctgactctttcattctctctctctaatcactgatatctcacctagtcagaaggctatttgatttggggaaatattttaaagacctcctaaaacgattatttttcctagccagcattttggccattggctcacgcccactgtacaaaaaatgagattccaattggaatgtttaaagtcacttttatttctgtagtctgctcaaagattttaccttattaattctgctgcctgtgaagttaattcttattctcttagctttagactcatatctgcctactggaaaactttcagcaatgaatgactctgtaatttaactatctataagaaaataaataggctccctttgagaataaaataggacaagcttgaccaccactgtattagcagatttctcactgagctattggatttcatggcattttcctcctttgtcctggtgataactattatttattatcatataaacctgcagtctgctgggtgtgtgaaacttgcactatatttttggccatttaagtatctactgaatcacctcttgcatccttgttcttatcaatatcctactatgcaggttgtggtgtcacatttagtgactccagcattttaaaataaaaatattaccaacactctagtttcccaatagtaaccttcagctaacataaaactctccaagtgaattgtcttatttagctagcttattccagtgtgtgcatatggaaaatccaactgatttgtcaaccaatagcaagttacccaggaagtggtaattgattaataatgaattaccattaacggagatgaacatttttctgtatacttactgttctgccacaaaggagtttatttatttttttttggtatcaaaagtcatgtttcttttaggaaatcagattcagaatattttagtaatacatagtggttaggagcatagatttggagagaagtaaacttggccttgaatcctggctctggtaccacctggctgtgtgaccttggctaagttacttaaatatctctgaacttctctaataataactcttaggttagagaactgctgtgagaattttaaaaaatacattaagtatttagcatagagcctagatcatagtaagaatttagtaaatgttagttattcaataaatattgttatacatttaattcaaatttgctactaaaccttctataaatcataatacatgttttaaatgtgttattccaaattattttctttaaaatatataataagtagcatcagtcagcaaacattttttattgcctactctgtctaggcagggtactgaatattggagaatgaagattgaataaaaaattctttttttttctgaatgtttaacacttattctatctcctgaattgctacagctccagactatgaattttggctgttactgttcttggcaacttcaggatatagagaaaaaacttattggccaaggaatatgtgtctctataagcatgaaaaaaagtgaagaaatccctgctaacaataagttaacttgcagatatttattttactcagtaggaagaaggccatagatagacagcagaggccaattctttggggtgccatcaaggatcaaggcagctctgccatcttttatccctggcttttatgtcacacatttataagatggcttctaaagttccagctcttgtatccacagttaatccaggaaaaagagaaaaaagcaaatagatgaaggagcagtatggctgattttgtccttttaaaggtttttccagaatctcaaatcagcaatttgtgcttacaactcaaaagccaaaactgagtcatatgatttcccgctttcttgtaagagagtatgaaatgatgagtgtttcgacttctttgcctctgcaagcagagaaaattaataatagtccatccccttggctatccagcatccatgacatcaataaaggtgacatgcatacatacattttaggtggcatgcattaattctttcccaaaaagaacccacctcaaagctgtgattgcatctggtgactcggttatctccaacaggcccatggctcctcctcatagctcagcaagtcatacctttaaaagagaagttatctgtctgaattcccgcaatgtagaatgacatagaaacaacaggatacatgcacttaaaggaaaatgactatttaggaaaggagaaaatgggaagcaagcctaaattattgatctcaaatacatatcaaatcctgctaggtggaaatagaattcttgagttgtcagtgcaataagttccttggttatccaatcacataacccctgattctgtcatccagagggatcttacttgccccttattctctgtggcctcattgaggcctcgctggagaactgcacagctttggaggcttttcctggatatatttagaaacactagaatgggtctacatattaaacagtcatgaattattaccagccagtccttgagtaatctcaggcttaacagacatctttcttatttgctttctgtcgattccaaatatgagtaaacacagtatatcttattctagaggaaatgtccgcagaaaagaagtcactccctctcagggccttcagataagacttcatcaggtgtactaccagactgccattacagttcccaaaggtgattcatttccagtgggatttgtagagtaaatctcagttaagcaatcacaaaagagactaagtgtcccagaggatgtcaagtagcttgaaaggcataatgtaaaaatattatatctaccatggcagaaaaccagattgagaccagaggaaaggacttcacttataaatcaatgaccttgacagtagttgtcttcgaaaaaaaaataaaaaaaaccagtggattttttacttgacatataaaaagatgaaaagtcaaaatcaaggaatatacaaaagaaaatattttaaattcaaacacacatacacacacacacacacacaatgaatttacaaaatatatcaccacagtgaagccatatcagttatattccagtagaagacttttagttaattaaggaagggtgtataatttacaagaaaaaaccaaacaacctcataaaaaaagtgggtgaaggatatgaacagacacttctcaaaagaagacttttatgcagccaacagacacatgaaaaaatgctcattatcactggccatcagagaaatgcaaatcaaaaccacagtgagataccatctcacaccagttagaatggcaattattaaaaagtcaggaaacaacaggtgctggagaggatgtggagaaataggaactcttttacactgttggtgagactgtaaactagttcaaccattgtggcagacagtgtggtgattcctcaaggatctagaaatagaaataccatttgacccagtgatcccattactgggtatatacccaaaggattataaatcatgctgctatgaagacacatgcacacatatctttattgcggcactattcataatagcaaagacttggaaccaacccaaatgtccatcgatgatagactggattaagaaaatatggcacatatacaccatggaatactatgcagccataaaaaaggatgagttcatgtcctttgtagggacatggatgaagctggaaaccatcattctcagcaaactatcgcaaggacaaaaaaccaaacaccgcatgttctcactcataggtgggaattgaacaatgagaacacttggacacaggaaggggaacatcacacactggggcctgtcatgggattgggggaggggggaggggggagggaaagcattaggatatatagctaatgtaaatgacgagttaatgggtgcaacacacgaacatggcacatgtatacatatgtaacaaacctgcacgttgtgcacatgtaccctagaacttaaagtataataaaaaaaggaagggtgtattcaatagaatattctagaccattttaccaaagtgcaactattggcctcataatgtggcttgtctaccaaagctactcttctgaatgcacaggtatatgacaggcattgtcagccacactcctgtagtataagatcgtattagtagtttttgtttttatcattcctaggtaaagcagaagaaacaggctatttgctatttattggtcactacagtgggatggagcctcctggtaaacatagaggcttctcaagggctccctatgtaggaaggaaagaggcattgttccagggtaacttgagcaggcgattcgagagttgtttcctgagactgggtgggaaacaatcaatactttatatagtgatggacaagggctatctggggatgctaatgttcctagaataatgtccatgtctttttgtttgtttgttttgcaataagatcaaaggatcagaaatccctatatgctatcatttgtttgtatcccatttttcccccatggggacaagggctgtaggctcaaactgaagcaggaatctctcattctcctactttcgcaacacatttatgttgaacacctgctatccacaaggattgttctacatgctacagacatagcactgagccaaacaaagtttcatgaagttcacatagggtattacaaaaagtaactgttatacaaagagatataatttattagattgtaacaattggtttgaagaaaattaaaaccagttacagttacaaaataggagatggagatggtggttaaataggatatggagatggtagtattttaggtacaatggtcaggaaaagcctttctaatcacgtgacatttgaacatgtatctaaaagaaatgagaggagaaaactatacttatatttaagcaatagttatgaaaaatttctatagtaatttaaaatagaccagactctttagtgagatagcatctttgggttttattattgtctatatcctgcatcttcataacaatagaagagttgcataaactaccatcatttccccccttttttgtgggagttgtctggtttcaagtcatcctaatattgcactgtttggaatttttttttcatgtgagtcaaattctaattgatcagtaaatttttatttcaacacttaccttcttcaaatcgtgttgttctattgttgtaccagtgggtgtaagaatatgacaagacaccttcctctacagttgtggaatgcactttaaataactgtgattccaaagaaaatcattctgatgttgcttttaacatagttcattactcttgaatgactgatgcaatgtaatgtaaaccttgctctatctcatttcctaaaatgaatatttgtatcatttgctcctgtgggatacatcttcaacagacagatctctctaaaaatatataagtattatttttctcatgattgaaaattttaaaattttctgtaaaagaaatacttactggctggtcttttacatgtctataaaatatttgtgaatatctgctttgttggctatgtcaatttggctcagtttttttcctgatccaaatgctgaatgcagggattcaaaactcaatattgaaattgtcagggttgatcttaatcctattcattaattatttgaagtttttgaagcagactcatctaaagttaaatatttgtattagcttatatcgaatgatttccataatctgcctgtgggtactaccctctgcttttgcaaggactctactatgtcatcttaagtgaaacagtgcatatgtatactagtaaaattctctgctttcctagcattggacaaaaacaaaaatcaacaaaagaattgcctcagtgtcttaaactgggatccctactagttgactaggcacttagttactgaaggatatgtgtggaattcaagttcttttcaacctataagaaatatcggccaggtgcagtggctcacgcctgtaatcccagcactttgggaggccgaggcaggaggatcacaaggtcaggatttcaagaccagcctggccaacatagtgaaatcctgtctctactaaaaatacaaaaaaattagctgggcgtggtggtggggacctgtaatcccagctactcgggaggctgaggcaggagaatcacttcaacccgggaggtggaggttgcagtgaaccaagatcgcaccattgcactccagcctgggcgacagtgtaagagtcagtctaaaaaaaaaaaaaaaaaagaaaagaaagaaagaaaagaaacatcaacactttcaaactttcatcctgcctctttgaagagaatgtgtccacaagctgatctgagtcaattactcatttctggatgtactgttgagaaaaccaaataatgaatagtcttcattcatggctttaataatttgttcttaaagttgaaaggaaaaggtattttctctaaacaccattgttgtccatggggtgtgcctaactaaaagtactgctttgtcccacgtagattctgatcccactgaaaaagacaaagaagtatgtcaaaataagaaaactattggttgtatgactgctggtgttacattaggaaaatgtgacttaggtttgtgaggaaaatgaatctttcaatagcgaatgtcaaaatttggtttagccattcagtcacagggagtgccggacaaccatgtgtctccccacccatggatgagatctttacttcttatgatactaggaggaaatagtgaatgtgctctctattggcagttagatcccaaggacaagggagagagcaatgagccacgcttgctgagctcttgctctcaaactcacaagaccggtgagttattatttctcccatttggaagtattatgtaagtggacaagtaagagaaggaccaggagtgttacaccactatctttccataagaaagtagaagcaatggaagctttcctggacccaactatgtaaccaactataattggctttcctgctttcctggccccaacttttaaccaactataattgctttctgcattttatttttatactgtactctaaaaatgattggatgaattggaatggtggaattatataatatatgaattatgctaaatggttgaacattttaacactgagaaaactacagactaccgaggttcacggtccaccttctgtttctgtgtaatttacttctggtgtgctctgagatgctcttcaagtcctttaactatatctattctgcaaaaaggcaaggagacagacaaacggatgcagggaataaaggagattatttcttgaacatcagccttaatgctggtgaataggttaagtgcttttataattattatctcatttaattcttactagggtccttggaggtaggtattattattccaattgtacaggtgaaaaaataggagatgtcccacattcactaagatagtcaagtggtcttgaacccaagcctttctggttccaaagccttattctttccaaggagatcataagtctgttaatgctgttttctagtctcttcagcggagcttggcttttgaatttctgaaacggaataacagactggataaaattattaaatcagtgaactgcagaatctattagagtccctgatatacatagtggggcttcatgaatctttgtggaattaatgaatatgggaatgaacaaatgaataatcagtactggttatattttaatggttttcaattctgataaatttttgtgacctcaaactgaattttgcacagaaatagtcctttaattcactatcctaatgaattattcagaacctaattcctgagctcacaaacaatggttcaatttaatccttctaactattgactggtggaatgggacaagatggacatctttgtttcttcagaaaatagatgacaagaatttggaaatgaagaccaataactcttatattttagaagtcttaaagaaattgggtatacacttgcatatatttacatgtgtatgcacacatatacattcccaaaatacatgtttttttaaagatgtttaattatcacaggtagctataatttttccatggaataacacaataactaaaacatgtttgatagttcctcagcacatctgacttttattgaaagtgaaacctaaagataagtaataaacaaacttgaatgataggcctctgtgatctctggttttgtgtgcatgctatatttattacactatgatgtgtatcacttggacacttgtgagagctgttcacaaatgcatacagtggacacacaaaaacaaaacagaaatgtgagtgttgtgaaaaagaaggcagcatactcagtttaatcctcttttcccaccgtgtccaggacacactttttaactgctatttgaatgacttaaccacaccgtgaaacttagagtctgctggctaaatcagtgggagttgacattccaacatctgtaagcacattaactccttcttcatatctaagaagtattccaaacttaagagaatattcaactttagaaaatggtaaaattcaaaacaaaaccagactttttttccctattgaaatggatttttttttcacttttctgtgaaaggacattagcaatatcatacctttctataaaggaaataaagttttaaatgacgcaatattaagagctcattttttcatactcatgaattacttttagcctaaggatccatttggaaattatattcacatatcaaagataaactgtcttccctggtgttcatatttaaggtaactgaacaaagttgcttgatgagaccagcacaaaatgaattttactcttttctgattcaaaggtaaatttcttgtaagatgatagacattactgaaatcatcaccgttaaaaaatataaatcacactccatgagaagaatgacatattacttgtggacgaacacttaccagtgtattgttagatatctggtttcggaaatatccatagttagacattaatgtaagaaatgtcactaccttataaagacacaatatcaaacaaagttaagtttattggataccagaatgcagcacacagaagtctgtgttttaaattcccagaaaatattgatttgctaatgtaacatcattaaaactgtgtacccagcttctggctttatatattcccgaggaagccactcccaatttccccatgaaatatgcaaaaatacagtaaagaatgatcaacaactacccttgaaagaccaaggttaataggcaacggatttccagaaagactcaaggattttataattactgagacaatcttagagcaaaattgagattcttaatatctctttagtctatacttaattattttatacaaaagtcctgtttttcttattctctctcccttacttaacttctagaagataagattacacacaaacacacaaacaaatacatatcaaccatatcatattgtcaaatataggcatctgatattgcattcattcctgctgagtatgattcatttgaggaggtgccttcatcatcttttttatttttctcttcttctgtctccccacctccgtctaagagccatcagatcagagtctctaagagcacaatctgagaatgtgtattttaaaaacatttctcctataatacctaatgcttaactgtattttttataaacttagatttttttttaaaaggaacaaaaacctacaaggaggaagccagcttcagtgcaaattcagtagggcaaaatgaagaaacattaagctaaggagcaaagagaactaagtgaagtgaagtattagaaagaataaaaattgtgcagtaacagaactaaattccatattggtgatagtcggggcagaattgacaccacagaaaatcaaattaatgtcttaaagaactgattaaagaagctttcccagtatgcaggaaaataaaggtcaaattatcaaaagaatgagagaaaacatggcaagcatggtgggcagagagtggagattttttttttttttggtaaagctactatttgataacataatagggtatctgtagccaataataactttattatacattttaaaataaagaatataattagattgtttgtaacttgaagcgtaaatgcttgaggggatggataccccattctccatgatgtgcttatttcacactgcatgcctgtatcacagtatctcatgttctctgtaaatatataatcctactatgcacccacataaactttaaaaaaaaaagataaatctaaaaaaagaaaatagaaaaaaaagtgagtggcggtctaacataacagtgagtacatcatccagaagaagaaataagaatagctgaaacagaagcaataagcagatacataaactaaagacatctttccagagatgacatatcctttcatggagattgaaaggactgaccacattccaatcaacatgaaaagacacacgtccacaggtgtgtaggcttattagaaacgtaactaaatttaaaaataaaaatgtacaaacattcatgtagcagggaggcttggttaactaaaaaggaacaaaacctagctcttcgtatatattcaatatagggttaaaactcagaaaaggatagaataatgattgctgattatggaagatatgatcacagaattgtatactcagacttctgcgtgaagcacagaaagactctccatttgaagtgcaaaaactgatcttaatccataaagtattcacccaaatcaggaaatatactaaaagacaaatatagtaaacaaaaaaagatgtaagcatacaagtcacatatgaaaatccacattataaatcatcataaatattactagtagtaaaataaatgtaaataaaaaaccaagatactatttttactatcaaatgtacactagttaaaacaaatagagtaatgatattttgataaagttacgaattgttgtggaaatgtgaattggtttgacttttctgaaaattatttttagtgtttgagctgttaatttccttctagaaacccaccttaaaatcaaaggtgcagaatgccaatatttgcacgtttgtcccttcaaacctcatgctgaaattcgatccccgtgttggagctggggcctagttggaggtgtttgggtcataaaggtagatccctcatgaatggcttggtgctctcctaacagtaataaatgagatcttgctctattagttcccacaaaagttggctattaaaaaaagcctgccactttgaccttctctcttgccgtgttatctttgcacagtctggcttccctttgctttctgtcttgagtggaggcaacctgaggatctcaccagatgcccagtcttccagccagcagggtcattagctaaataagcctcttttttaaaaatataagttatgcagcctcacgtatttcttttaagcaacacaaaactgactaagacacagatcacactcagttgtagcatgagttgtaaatggtaaaaatttgagcaacataaagtagccaaaaataatcctgctcgacaaagtctctgcagtgtagtagcttgaaaattatggcaaagccatcaactgctgccacttaaatagcattttttgaaagcatattcaatcttagggaaaaatggtcatagtaaaagtcatactaaaattctgtaggtagggaagtggggtcatttttttcttcaataatcatatctgtgttttccacctctctagaatgaacattggtcactatgtaatgtaaaaatgacaatatcataataaaaaagataataaatgtgatctataaaaagttacctagctgattattcagaaaccaaacctgtcacatagcatgtactggttaatggattgtcagagcatgaacagtgatggaaccctgttgatcaaatgctgaggcaaatcagcctctttaattaggtactgattgtgacaattgagttcatcctaataaaatagcataacatacaatatatatttattacttattttacataataaagatgtataaatatataagtacatataaatatatgaaaattatttacacaatgctatgtttcttgagcacatattatttaggaaatgtaattgtgatgtttgctaataaccatcacagaaactatgaaattcatataattctttatgctgaatctaagtaataaaagtgtatatgtcatcttcgaaattatgaaattggggggccctcctactctatttagtaagctgttaggttctaaaggatgtctaagataatgaataacattacttataaaggtttgaaacttttcaaatggtctccatatagagacagacttttgggctggaagagagcataaagaaatactcagtatgatgaagtgatatgccaaggtcaaatgatgaacactatgcattctaaaaattaaaggacttgtgtttgccttaataaaatattgccaataatcctcgagtattaaaaaacagactaccctcctattttactgttctaatgtttcactgtgcaaataatttctaattgtaaacaaagttgtcacactatcttgcacattaaataaaccattaattagaatactgtgagggacaaaatgctctggtcacttaagtatttaattcagactctcagtcttttttgtttgatgatgtactttttaatttatgccttgaagtcaccaagataaaacagaagaggagacagtggtgacatttgcttatgagtgagcataggctgtgaggtcttgagtagagttaagagggaccatatgtattccttccccaccttgggaactctgattagccagaaagcagcatttgtagattagaaatgaagaaaatgacaattgtcattcatttggacacagtctgatctctaaataaatcccttaatgctgtgtgggagtttcctggtgattagttctgtttcatactcctcttgctgcgggcaactgagtcctccaaattttaatagagttttgccagcataattgcacggtacactgacacaagttagtttttcttttttacacattttccttcacttgaactttctggccattttccacatgcatttgacagaagaattacaaatatagagtgttattatatcttagatggaggaaatggtccatggacccatgtctgaaacgttcagtcttggcaatcaaggctctcacctcagcatttgctgggacacaggaaaccagctaatggctgataacgtccaggaaattagtaacttgtgcatatggtaaatgctccaatcccagccaaatgatttgtttaactgatggctggagttctcatagggactgttagcacagtggaatagttgggttttattaactggactatgtgctaatccttgttgttccctagttgaagaatgtaaccataatgcaaaatacaatgggaaattgtatatccagaaagtaaagatgttaaaggcaccaacattctatactccaaaagaactgattttttttgcgtcaacattattagtatcacaattttcttacaactattatcttagttcagaattctataaaatgaattatgcatacctttttgttatggtaaagacattaaatacaatgtcactttgcttaacatcttattcctatctgttaattttgttagggacagtgatgattataacctattgcttgcattcattgattttctacagagtatccagatatcaggacagccttgtgctttcacatgttgtctccctcaggcccaaggtcaagtggcagttccttgggaaaatcttactgacacccaattctaggtcacgttcccctttttatctgttctcatagaaccttcttcattatcatagggtttatgtgacaatttgtaatttaaattttgtacgggagactattggattactgttgcttttccagactagagtataaaatataaatgcaaagatcataactgttaccactcccactgtatatcttctgaaccaaccacagtgcctatccagcaagtagcaagtaataatacttgttgaatgaaataactccatgtggtagtcgttaatgtcccagttttacaaatgaaataattaaagctcaaagagcctaatttattaaaatcatacagccaactggatgtcaatatcctatctcatgtctaactccaaaaccattaatgtattagagctctttctttttaattgagtaggacaaagaaagaaagtactgcaaaattcatatttccttttataacaaggttgaaaccttatctgtgcaatcttttagaacactggttctcaactagaggcattttgcccaccatagaggacatttggcaatgtttggagacatttgtggttctcttgactgagaggaaaattaatattggcatccactgacactatatgatgcatgccagagcccctccacacttcattggtcagttcagctacctccctcttttgtttcctttctttctagcttcctttattgattcattcagcataaagcatatgcatagactgcttagtgtatagaaaaccaataacaagtaagatacaattccagacctgaggaaacttatggtttataggaaagtgcagataagtaagtaggtaattattacccatggtaaagagctacctagaggtgtacattcaactggccactatgttaatactgaagctaacacctgaaccactgctttagagccctggttctcaactacaatatctataaacatttgtagtggtcacaattagggcacaagttgctttagagccctggttctcaactgcaacatctataaacatttatggtggtcacaactagggcacaagttgctactggcatctgttcggtgggtagaagccaggatgctgctaatcatactgcaatgcattaaatagtgtctcatttttgctacaataaagaattattcggtctaaaatatcaataatgtcaaggttgagaaacgctattttggaataataaaaccagatcattgtggttttgccattgcattttaaaaaatcaatcttaattttcttgctctccataattattttttacatattgtaactagcaatataattgtgagtgtataatatttcatcttataagtgacaagaaactatatgattacttattggaaacaccatttttaatatctttaatgacatgtcatactaacatttgtagtttattgtacctcctttcttttaaacttctatcatagtccaaccttaagcctttgtgacacttctattttttaagtttagtccttggatgctattccttttggaggcagaatccaggcctggtgcctcatcatccttcctatagagttctgcacatggtgggctctcggatttttattgaatgtctcaaagcaagttaattctccttcagaggctaggcaactaaatgtcgtgggaaagaagaatccaactgactaaaatagatatcatgctacagtacctgcaaatgagctcagatattaaatttttgatcactaaaaattccttcaattagagttggaaaccatatatgattatgcttctggataatttgcaatggatgttcaatttttctttcaggaaacagctctgttcctttagtttttaatatctatcactcagtagatcttagcagttagtgatcattagttttcctccagggatagactactagaagagtggaaatttggttggcatttgtctaccagcatatctttttaatggggttagagcatgatagcaattaaaccttaggtgctttgagatatcttttggcatattggatatgttgacatcctcctccaaaataaagcaaaaataaatcttataatgactttcttttctttattcatacactacaactttctcatagcttgttttgtaacttgcattgaatattatggttccattccttctttgtatatttcaagcataatatttatattctccttatatttttgtaaattgtttatcctcctttgcttttcctcctttgaaatacaatctgaaaacaagttatggattaaaggaagccactgtgcagactaaaaattcttaaactgaagaaaaaatgaaacattttacgattgtttaggtattataggcattgactggctagtaaaaaggtcaatgcaccagcagaaggttgtatacgctgttaacaaaggcaattcctcatgaaatgttgtacatttcaatatatagaatcatattgaataatactatggaaattcctttgagttttccagaattttaaatgaagtaaatttatacgctttctatgttgctcttaatatcgatgatcccagattattgtgtagattagggaaccacctacatactttctgtacttcatggtagatcctggtagaaaaagaaatgaggttgagagtgaatgcagatagcaagggttatccaaaagaatatagaaaaagtagaaatggaagataatgtaatattatttcataagttgatgaacttgtgaggataaaaatgaatttcagttatgcttgactttggcagttcagattctacaaggcggggaacagtacagctttgggacccttttttaatattctccctaagttgactttagtgggtggatttagtataccatgtcaagaatgctagtactgatgatttgtgtccttttgtactaatgttgctaacatgttcattgcacttccaagaagatcgtcacaactatttagaacctggtcagatatagcagtttgaccttagtatgtggttttcttgcattttcccctctttctggctttgttaagacatgaaacaaggtagtttttttttttttttctaactccttggaagtgtatatatatcttatgagttataccatcctagctttggtgaaactcacagtttacagtttgacctttcttagtaagtaggagttttgctgaatcatactccagtactgtgaggttgcagattgtctattccttaagtctttaggttgcttaatgataaattaaataggggatggctgtcttttctcactcctagattttattcaccacacactcagtggtgtaataacaatcccttcgcattgtcatatgattgatgtttaaagaccctattatttggaacctgattcccatcaaggtttatgcaaatatttatggatcactacttggcttacaggatgctagacattctgacatggtcacttgtataccaaaagattttactgacaaacatttcaagtgtgtttgacttattttgaacatcaacataaaatttactggatcccagaggatttcaataacaaatagaatttggaatcagagctggagttggacacattttgctcatgtcattagaatcttcctcagacttctcagactctctttgtataaagcatccatgagaagctgtcatgtctaatttcttataataagtagggtcaatttcatgagcagaacatatgactgtattttatatatgcaatataaaatcacaaccagacataagtggacatgggaaaaaaaacagcaaccagattaaacattcacagctgtttctgagtttttctgtattgttcctttactatttgtttattcattcttttatcttctagtgctcacttgcagacaaatgttgcccatgccaatgtttcagaaaatacatgagataaaacatagaaaaaattctatccatcaatgtgctatttttttctttgaattgaaaatttttccattgtattaatttagagtgaaatttttctcatgtaaagcattctataatatgcaatacaaacaacaggcaaactatgccagataaattaataaataaaataatctgacagagaaaaaagtactgtttgcttcacagtttcactaaacctaaatattctattaaagtcagtgtatggagtatgctggaaaatggcaaacattctgtgtgggtttcagaattgctgtattgggtacattttaaatatttggttatcatgtcaagttattacacattttagatatttatgattattgagatttcaataataagctattaaatattttatttaaagttccattctattttttgttgccttagtcccattgggctgttatagtaaaatgccatagactaggtagcttataaacaacagaaatttatttctcagagttttggaggctgggaagtccaagatcaaggtgctgacagattcagtgtctgttgagggcctggttcctgtctcaaatggagccttccagctgtgtcctcacactgtggaaggggcaaacaagttctgtgcctattttataaggatattattcccatatatgagggttctgcctttatgatctaatgattcccaaaaggccccaccacccaatatcatcatttttggagttactatttcaaaataagcattttggggggatgcaacattcagaccatagcagctgtacaattggcaaaaggattgcctgtttttaaatctctgaatttgattttttttcccaaatacctttactagaaagaaaatttaaacattttacatttttactttacatggagaaaattcatgtcttgctctgttgtaagtttcatattattctctgtttaaagttcccaatcagaacatattacaacaaaatctaaccaattaattaattgttttcactatcttgatcataaattttgtatattcctttacaatattaattctttgctgctagtcttaagaaaaaaataagctttgtggaaaaagataggtatatgcatattttgtgtatattttgcctttactatagaatttatgaaacatacacaaaagcagagaaaatagtgtaatttacatggtacgagaaatctcaacatgcccatcatccagcttcaacatttattctactatgaatcttatttcatccaactattttaccactttctcactcttcaagaatacattatattattttataatatttatagataaaataatatgtctgtctatatcccagacatcatattatttcacctatatatattttaccatttgcctctaccagccaagaattggtatgtattcatcatccagattgaggtatttttttaaagcagcattaacttttgtggaagtatcgtaataagacggaatattctgagttaaaatcaaacaaatctttccaattaaataattgagaattagctagaaaaatgacttaaaacttagtgtaataaagctagtagaatattaaagataaggcataacacatttcttcttacattcttagtttcattgtgatataaggattagttatatgctgcttaaagtcaagattatacaattacacagaaaatgttccaagctaatcccttggggttgattttggctgatagtctattatttagatgaccaaagatgacagaatatacttcttaatttacatgaattactcatctaagttttatacatagtttaacacatgctgcatgcatgtattaaactgcatgaacgagctgagatgagagaagaatatagtcaaggtaaaaatgaggagctagatacattcaccaaaactgcttagggaaagtatagcttaatttaccctttaactagaatagctgagagggcaagagatccaaatagtccctgagtgaatgcagaaactgaatgtgcttaatggcatatttttgtgtgtaaatacgtctctcttctgtgctccttgtttgcattagggagaatagtagggggaggcagaagtcttctcttatgttaatagaaagtgtggtttatgtattccttataaatttcattcatattctttatgggcagcattcactgcagaatgttggatgagtggagtgcttacttctcactatctgaatgttgtagaactagttatttttatttccaaactgttgtggactgatgcttttataaaatataataaaaataaattaccagaaaaataaaataaaggaaaacaaagatatagacataaaactcatctatcaaatgaatataaaagtttctaaatgcttactctgcatttctgtccctgtttcttctgagacaggttaacgaacactttaagtgaagatgacacttaatgtagtactggtccagactgttgatccatatgtagaggtgacaactgcagtattggactggcagtatggcactgtcaatgaccaggaagcacagacctcaatgaaagaactgatgaaagggtcctgggtgccctcttatctatcctaggttttaactggattgtacagtgattctgggcatcctaagggaggagtcaggtgaatgaggcagtccagaagacacttggtagggggagggttcagtcagcagctgttttccaacaggtatgggtggaagtatttcactatgtaaacaaccagcataaccatacacaaataatactagtgcctatcagtggagaatctgtactgctgtcatctctacatttatagatactggagaacagggagcctcttgttgcctctgtgcctggcaaaaggcctgatacatggtagatgctgagtaaatatttgttgagttgatgggtgactgattgaaagaggtttgtagaaggaattcttcccttttaaaatttgtattaaactgtgataattcagacactcaaataaggtgtgtatatgtcagtgtcaggatgtgcagagcttcctttctaatcagatgcaaggggattcgtgcacaaaaagggaaacagattattattgaacccatgtccaagtcaaagaattattaatatacatttgctttgaggtgcacgtagagcttttctgttcatttgacctaatcctatttgcatgtatgctgctaaaacatttcagccttttctcataagtagaaacattaattttaaaaatcaattttactttgaattaaagcctattctaaaataagttccctttaaatctttattctaaatattttagatgacttattttttatttgaggacaaatatccagggagatatggggtattaactgatgaaagatgatacaagataaatgtggaccctgtcgtgaatacaggtacactctagaatgaatatgacagattaatgtacaaacatcagctagaaacagtagcaaactaatgtaaggctaaatacctacaagaaataaattttatgcagtagtcaccataatttgtcatgttctttctcaagtccaggcctatggataagactgactctcaccaccctctgttacccaccttgatgaagtaacacaaagtcatttttcagatgtctgtgtagatgccacttcttgcaggaccattttgagggacagtgcctccacccatattcacttatcgccccttctttgagccttccttgatcctttctagcttcttgtaattagcctgtcaaaggccttaaagcatttttgcattgactctttccttctgatctctcccacactgttagcctcataactgctatgcaggaactgaaataatagataccaacagaaagatacatagtagattgtggatctgttaatgagccttcaaaaaactgaatggtcttatttaattcctagaaaacactcgctggtctcattcttgctgaccccagctgtgaatagagcatgacaccatatttttgaaggagaagtacttctgtaagagagtcatgcattctggtataattttacacatatatttttaaaatgacacaagcattaatgtatctacacacatattttctaccacagatccctgacctttctgcctttccttaagggaaaaaaaaaatcatccttcttcttatacagttaatgggatttgtcaagtctttggtgcagacatgtcttatttcctgagtaatgagatacttccatttgtggtagggcatcttgttctgccccaaatgagatatgccaagccaaacatgaattagaatgctgaacattatgtcttgtgtgtttgtcaggtgtgtgatctatttctgaaaacccaaatgcagttcaatgacatattttactatttgtgaactttaccttctgttaatatgattgaagcaactggaaatggaaattgtcagggcaatttaacaaagaagccctgtaaaacttattaaagtccaggtagtaaaaatccgtttagaaggcatattcttcaaacctgagttttatttggtaaaacacgttggtgcctgacctttccagaaacataccaaaaaggagtcatttagaggtccctgttgtaaattgtaaacagcagcctgatcaaattcggctgtattctgctcacagtatatgacagaatgtatgagtacaccaaacagacagctaaatgactgggtatttggatgagtttgatgtgtattttatgtaattgcatactgtacaaagcaataaaaagtcaatcttgtatgccagaaaaaaatgcaggtattgagtgagtcaaagaatcttcataagttcgtaattcaagttaatctttcaatggataaagccagagggcaggagctccgtattcatagacaattttaaaaattctgtagtcaaggtttcagggtagaagaccagaattgttgcacattttgtatattaaaacatatttttaggaaatacatttccaatgttaaaaaaaaactaaaagtttttagagtgtgaaatacaaagttaaacttcattcctcatccatctccagaggtgatcaatgttatcaggtctcatatgtggatccagacactttctgtatttatccaaacacaaatgtatcctccccaatgtacatatattaatggtagtacagtataacggttatgaatgcaaggcctacagtctaattcctgggtctcacccaccggctgtgtgatcttaagtatgttactgaacctcccaactcctcaatttttttgtttgtaatgaagaaaattataatatctatgtcatagggttgctgtgagaatctagcttagaagagcaccgactttactgaagaagtattcgaccaaagttaactattgattgttattatgaataacaacataatattcatttaaatcaagagaataagcatatatatgtaaatagtgattgcacatatatatattttcatatttatacaaatgtatacctgtagatactggtctgcaacttgccttttgacatatatcttggacatgttgtcatgctactatatataaaggtttatttgtaatcactatacagaatcttagtttatagatatgtcataatttaattatgagccctgtattaatgaatatcaatttttcccaatcctctgcttcatgtgaaatgttttagtagcatctttgtttgtacatgactgtgcttttataaaactgtatgtgtaggataaatgcatagaggtgggtctaagggaatatgcctttacattattggtggttaatgacaaacattctacaaaatttgtgctaagtttttcttctaccaccaagatgaaaaagtagccatgtaagggagatgttttgagaactgctcctttaaggccctttttagaataaatggttatgaatgaagcaccaagatagaagaggccactatggagtttatgaaatcaggcttaattagtaacacatgattgcttttgcctttttggccagtagtcacacatcataaaccaaagcttcagtggagaattatattccaaacatacaacttcattaaagtcggaaagaaatattacaaatgacaattttcacaaccttaatatgctattttaaaattgcataggtatcatattagtcttataattattgtaattaatttttaaggacatgaaataaggaatttggatcaagcttagcttatttcatgttcttctctatctgccttgccttattagcaccagggctgcattcgtgtgtgtatgacagagctccatgctcagtagggtcccacacatgaacaatgcttcattgttttcatcttgaaatacttaataatttttttaatgtaataatactgcaatgaacatgagagtgcatctttaacatactgatttcatttcctttggatatatacccagtggtgagattgccggatcatatgttagttctgtttttaattttttgaggaatctccatactattttccataatggctgtcctaattgacattctccctaaccatgtgcaggtgttcttttttctgcacatcctctccaacacttgttatcgctcatctttttgatgacatgatcatcacatgaatgctttttgatggaccctcatgttcattttgcaatgggtcacacaattttcctatagccagtcctgatgagcaataattacatttcctactaattagcctggctcagttgaaacacagaatatttgtttgtcttttgagaaatgccttgtggttgtgctcatactttatgataaaatagcattatttaaaatatatggaatatcagcaaaggagtgtcactcaatccaaaatatataagaagctcaaacaactcaatagtaagaaaataaataatcaattgaaaaatgggaaaaggacctgaataggcatttctcaaaagaagacacataaatggccaacaggtatattaaaaaaatgctcaacatcactaatcaccagagaagtgaaaattaaaatcataatgtgatatcacctcatacctgtcagaatggctattctgcaagttttggagagaatgtgaagaaaaaagaaccctgtacactactggtagaaaagtaaattagtacaatctttatggaaaacattataaagattttttgaaaaattaaaaattgaactaccatgtgatccagcaatcccgctgctgagtatatatctaaaggaaataaaatcagtatgtgaaagagataactgctcatgttcgttgcagcattattcccaatagccaagatacagaatcaacctaaatgttcatcaatggatgaatggataaagaaaatgcagtgtatatacacagtggaatactattcagccttaaaaaagaaaggaatcttgtaatttgcaacatggatgaacctggaggacaatacattaagtgaaataagccaggcacagaaaaacaaatactgcatgatctcacttatatgtggaatcagaaaaagcataagagcagagagtagaatgatggtcgcaaaaggctgaaggagggtggacaggaattagaaaggcggtggtcaaagaacgcaaaattttattgacaagagaaataagttctagttatctattgtacaacatgatgattattgttaataacaatttattatatacttgaaaattgctggaagagtagatttgaaatgttctcaccacaaaatgataaatatgtgaggcaatgcatatattaattagctttgtttagccattccacaatgtatacatattatgaaacaaaaataaaataaaaatttattaagttgatacaataaatcaatgggagaaggatggactatttagcacgggaacaactggttgaaaactgtagaaaaattaaattaaatttgctaatagccttatctcatatatcagtataaattctagcttgttaaagagataaatataaaataaatatgtgagatctctggaaactatgttttcaaagtgtgtcagtcaaataatacagagctgtgagaaaataattgtggatgagacttgatatagatctattttaaagggatcctattctgtgaaaaatcaaaatgacttgcatttacgtaactgtttactctataagggagtagtagaatatcactatacataaatgagtttattttcccactcaaagtgttaggccaaatgagaagttgctcattttctactgatgatgtatgctttagagatctaattatccaattattccaatttgaaaaacaaaactgaagctcagggaaatgtaatgatttgtgttcagtgacagcacattaatagcagatcttgaacttgaactgagtcagcttcgccaccttctctttcttcaccaggccagattttcctgccacattttgataactggttccagttggaagcaattaccaccataatattccatgactggattctccttcctgctatacaaatcaaaagcaattaaagatctttcaaacaactgtggaagatgagagctgctcatgtcttagaattagaatacttgggttcaggtctcctgtctgtgatcatgaatcttaagactacctctgaacttaactttcctcatattaataggatgttaataaaatctataccataggcattttttccaaaaaatttaatgagattatctatatgaaggacttggactacagttagcacacacacacacacacacacacacataaaatgattgtttaaaacgatcaaaccagaaaaatgatgcttcacataaacaattttttcatatatcataaataaaatacaataaaaagatgtattttaaatcagattttgttgttttaattaattacagcgctttggggtgctgaggtaaaaagactacttgagtccaaaaatttgagatcagcctgggcaacatagctgtggtaaactttagcaacgaatatagagttccataattttgaattccatttcctaagtgacccagagatattcagcagaagatggcaagctcataactaaattcaatttttattttcttgtatcactcatgtaaataaaacatctctcttatgtctttacttttggtttgttttaatgttaagagacataacatgatgagaggaaataaaaattttcaaaatgaggaatagaagttcttgctatgtagactttttaatttagggctaagggaactgaaggaattcagttgagggaaagatagtctgagcaattatagaagccactcgttgacgaccatgttcacatgacagggagacagctcaaggaggaaatgaggggtggttacaggagaaaagtacagaaaatttgagccagttctcctttcctctagttttctgttttaaggctaactttattgaagtctaatttgtgtacaacaaagggcgtttcttaaaaatttacaaattgcccgggcggggtggctcacgcctgtaatcccagcactttgggaggctgaggtgggcagatcacgaggtcaggacctcgagaccatcctggctaacatggcgaaaccccgtctctactaaaaatacaaaaacttagctgggcatggtggcgggtgcctgtaatcccagctactcgggaggctgaggcaggagaatcgcttgaaccggggaggcggaggttgcaatgagctgagatggtgccactgcactccagactgggccacaagagcgaaactctgtctcaaaaacaaacaaacaaacaaacaaaaattacaaatcaatgcatttgtgtacaactgtgagaccaccaccagtcaatatagtggatatttctgtcacccccaaatgattccttgtgcttctttgtagccaattccttcctccctgatgtgctgtagctacagattaggccttgaaccttggagcccaataacacctcttcgcatgtccctcaataaatttacctgctattattccctagggattttgtttttattcagtatattctttacattcctgggaaaataaatagaatatgtttcatcaataatcgtccagctttatttaataattagaatcaattatgtagaggaatcaatgtttatgatttaaaatgttcaatagtaaagccaaaaaacctggttccttattcaaaatccaagctggttgggagaaatatatacaggtggaaaagtcccaggaagatcagtttctaaaaatatgagtcatagctccctgcagtatggtgggagtaaaagtcatttttattttcactgcagtgcataaaggggacatcactaaatgaatgaaaagatggatagatggatgaaaggaggaagggagagaagaccacatcaaagtcacttaacttgtgataattcagaatattcagagactggaagagaaagaatgtctttgtaagactatactgcctgttgggcaggaacacagacttaacgttgacgagcctcaggttttaataccagctccaaaactaaggttgctgaacttcatttttgtgacttgtaaaatgagcaagatgatattgatattgcagacttgacttaatggttaaattaaatcatttgtgttaagaaggtggtacaagaagccagacaaaaaagaacgtacactatgatttcatttatacagctaaaaaactgtcaaaactaagctggggtgatgaaagttggaataggtcctacctttaagtggaggattgttactaggaaggagcatgaggaaggcttctgggttgttgatgttttactgttttatctgaggagtagttcactcacttagtattagctccaatcttgaaactgggatgcctaatctagtctttgctttgccatataggaacctatatacacttacagaaatcccatgatgttccaggcactggcaaggtcctagggatgaaattaaagataagatttgggttttgtgttgttcatttataagactatagtaccttcatttatgaaatgacaggatctggtgaactctaaactcttccagctctaaaattctatggaaaaaatcaatgaatatattcatttcttcttcctacaaatatttattatgatttaaaaactgtgctgtaggtgttgatgatggagtaaacaaggcagagaatgtccctgcgcttatcggacttatatccagggaagtgaagtcatgggagcgtgtatgtatgtgtgtgtgtatatatattcactacttaaatgatacatgctacctttttagataaaagaagtagggaggctacatccatatgttcatgtatgatgctgtaaaaccacctcaaagatatctcttagaaaatacactggttgcttgtttgggtaaaagagatagaagatggggctattcatagactacctcagaacatttatccctatttcaaggatataaatgtattagctatttaggaaattaaataaaaatctaaaaatagcacagagtaggccgggtgcaatggctcaagcctgtaatcctagcactttgggaggcggaggcaggtggaacccctgaggtcaagagttcaagaccagcctggccacaatggtgaaacctcatctctactacatctctaccaaaattacaaaaattagcctggtgtggtggtgggtacctgtaatcccagctacccaggaggctgaggcagaagaatcgcttgaacccaggaggcagaggttagagtgagccgagatcgtaccattgtactacagccttggcaacagagcaaaaactctatctcaaaaaaagaaagaaaaaaaaaatagcacagagcaaagcccatttctcctccttgtcatttctcaatcagtgtggtcctttgtgggtggggataggtaatggtataatgatgagcctgccttgaagttcttgttccaaaaaatcaactttttgacagaaaaaaaaaggcttttttcccttgtgatccataatattagtaaaaatactttggcttccaggggcgtctatgaggaatgtctgataactcaacaattctttctaaatgccgtaataattttggaaaatacctaccgtgcagcccatagcaactttctggaatgctgctttaatttgcttctctttttccctattccaacaagaacaatgacaacaacaaaaattaacttagagaagcatctgctggaacaagtggtgattatttccaagcccaaacaaaagtaggtagggaaagaattattcagagaaaacatttttcaagatcttctccagtgtgtgagagagtatgtgagaaggaaaatgcacatgtggataaaatgttttcatttgacgtcgaaaatgatagggaagtgagagtctgaaaacggtttcacaatgagaacacatggacacagggaggggaaagggaacaacacacgccagggcctgttgtggggtgaggggagaagggagggaacttagatgaagggtcaataggtgcagcaaaccaccatggcataagtatacctatgtgacaaacctgcatgttctgtacatgtattttatgtaaaaaaaaaaaaaaatgaataaagaaaacagttttagtttaaaaaaagaacaaaaatgcaaacaaagaaaaactcctttaaaatttgtgatgtacttattagaattatggatagctgtaaattgcaaaaatcacaatgataggcatgatagtgtaagcttctttatggtgaggaccctgttgtcaatttcttttgtatctctcttagcatggatataggcatgtagttgggagatctttttaagacaccagatgggcaatgtggcaatagagaaagcagtacatggagaagcaatatgctctctgctgaacttggaataatctcttatctcaccaagcctcagtgtatccatctatacaatgggtacaatgctctgattaacctctgccagttataaaatatgactcacttgattcagttgaacattccaaaatttctgtgctgtgagatttgggaacatggatttttttgctgctggtctatattattaataaaggaaagttttaacttttatacctcctgttaaaaccactattggataggatctagtttatacaccacttacattaagttgtcgagtctggcacgttctaacagtgaagtttttttttttacacgtgaggctgtttgttcttgtcttcctgagtattttcctgttgaatgttttatgctcccaaggaactctggtatgttgaattgtatttattgaaagcttgtaaacccttgatcttagagaataaaaatcggggagcaggagaaaaagcttaaaaatgctttgaatcctgagaaaatatttctgtaagttaaaataagggtgaataatggtgaggatagcttacagttccagaaaacaaatggaaaattttggagatattaaaggcaagaataaatttaataatttttttcttggctagcatgaacttttatattttggattggatcctttaatgcttagattaacatgccatccttatttttattgacatatttgtatgtgccacttacaattctaggatgttacaacaaatttttttatacattccaggttgcatattctatgtaattggctacttttcaatgacttgtttgcacaatttttgagtcttcactttagcccctgatttctctttcatatattgaagtttaagcttatatctcacttctcattgaagtcgccagtaactttaaatcatgactaagagaatcttaggggctacaattacgataaaactcttatgacatgggtcactgttctttaattgaggtggtccacttactgtgtaaatgttttaaaaaatcaattagaataatatttatattatctttatgtacttgattttcatattggcatttaaaagtgtgttttaactaaaattttattttgcaccaattccataagttaactttggcatcctctaaagaaatttcacttacagagaaaaaaaaatgtgtctaattaactttttccttagagttgtttgtttataagtcatcctagaactcattccctggctattttgaaattttttcagcaatctaaatttactagtttagtctttttaaaaacgttatctttttagggaattgaattttacggttttactaataactgaaatactgtgattaaccaattactttattattgtttttaattgtgataaaatatgcataccaattattttaatatctgaacatatctattaagactaagaaatagaatatttcttgtttttaaatgaagtgctctattccatgcccttaagtcatacctaggaaacccatagctcataaaggctgctggaacatgcaggcccatgtcagaattaaaccaatagagggtctctgaaacttgaattttcatcttggtgagtcttctggggttatttattcatgtgttcttgctccaaatgtctgcttcttttttttttttgcttttattgggtgaaagacagcataataattctatgtatttaaatgcaactgatataatacataatggggcagaactttaaactcttatgccctctgaaaacattgtaaaggctggaatgaaaacgtaaatgcaggcactcatgtagttataaaggatgaactttcgaaaattgaaacagtcttctcttcagaaagatgctcagtgatttgtgtgcaagatagggctggaacaagggactcctgactatcagggactctgcagattatttgtagttgtctctctgttgttgatcaaataatgaatgtaaaagatggttgttatatctgtagagagcctcattgtattttgtattaaacctttcaataaaagtgaatagttttacttccattagttggaaaggacaacctataacttatcagaagtctcctgacagcataataccaagttctagaatgaaaataaaatgcctacaaatatttggtttggttaagattaaagatgcctggttcaagcatgctactttgttgtggcagtaaaatgtatgcacaatgccatttaaacaacagaaaaaaaaggatgaaagaaaaaaaaagtttctcaggtaacagaggaaatctgaaaagatatcatatacctgtagaaaaaagaaaaaaacccactttatggaattagctccaatcttcaatttgggatgcctaatctagtcttcgcttttgctgtaggagaatctacatatacttgtggaaaacttatacttcaggcactggcaaggtcctagggatgaaataaaaaataagatttcgcttctgtgttcttcatttataagaccatagtgccttcatttataaaattaaaggatccggtgaactctaaactcttccagctctaaaatttcatggaaaaaaaatcaatgaatatattcatgtattcctcctacaaatatttattataatttagaaactgtgctgtaggtattgattatagagtaaacaaggcataaaatgttcctgcccttatagggcttacatctggggaagtgaagacagagcctgaaaaaatatccaaataaatataatataattttgcattgtaaaaaatttcgtgaagaaaaagaagcacatagggtgatgtgatattcctggaagatctatgtgtattaccagaatacagattggaggacaagctctgttctgagcttgtgttgttgagagtgtgcatgggcaattagtttttataatatgaatctaaatatagtttataaaataaatgcatgaagacattttgagagacagccttacataatatactcatgagaattattcagtaaaataatcttctatcagatgaaatgtacaataaaattggcttgttgaacgtcattgtcctatatagtggtagcatctatgatgtaaaacattgtctaggagaggacctgaatcttaggtgaatagtaagtgccataaaagtaatgccaaacatgaagacacaatgtgtagtgatggagggcacagactgtggagccagactgccccagttcacattccaactctgccactgtggaagcttaggggagtaactttatttccttgtgcctcagtgtgctcatctgtaaaatgggattaaaaagtagtcccggacaggagcggtggctcacagctgtaatcccagttttgggaggccaaggcggttggatcacgaggtcaggagatggagaccatcgtggctaacacggtgaaaccccgtctctactaaaaaatacaaaaaattagccgggtgtggtggcgggcgcctgtagtcccagctactagggaggctgaggaaggagaatggcgtgaactggcaagcttgcagtgagccgagatcgtaccactgcacttcagcctgggagaaagactccctctcaaaaaaaaaaaaaggagtccctatttcatgaagtttctgtgagaattaaaggggattaaattaacttgggggggggggtctaaattattattaatagcgtattttaatctatttaattttaagatggctataatgtaattaaagcactactttaaatatacgccgagtactaggcaatgagtaaacattataaaagtataaaagtcggccgggcgcggtggctcacgcctgtaatcccagcactttgggacgccgaggcaggcggttcacaaggtcagcagatcgagaccatcctggctaacacggtgaaaccccgtctctactaaaaatacaaaaaattagccaggcgtggtggcgggcgcctgtagttccagctactcgggaggttgaggcaggaggatggcgtgaaccagggagatggagcttttgcagtgagccgagatcacaccactgcactccagcctaggcgacagagcaagactgtctcaaaaaaaaaaaaaaaaaggtataaaagtcatttctcttcctcactacttccaacaatgacattttgagttacacaaacaattcatttttaaaagattataattgaaagtgtatgaattgtgctgaagaaactaagtaaacttcagctagaggaaaaaaatcccaaatgcccttcatcatcttactggacaatggaatgctcccttcattatagatatcaatagactaatagataatggaaagataacaatggactatgaatgaagtgtaacattttctcaaacttcccagtggaagcaaaagaatttttaaatatatgtctggcaaattaattttgtggagtatagtttactagaattatggggaaaaaaaagcagactgccagtatggctattattctagctatgtgctaaaatatatgcctataataatgttttaatttaaccctaacatcccaggagttacactgatatcgaacttgaactctaaaaactcatatttgcgaagacttccaacgtatacctcaggttacctgtaaatatgctcttaggcatgtgtacatgagtcccaaggaaacttttgccaaaatgtgtaattgttttatatgagggttttaagaaagcacttttaaattattttaaagtaggattacaaattgaagttattcatgatttaattcccttggctagtaatatggaagtctagctccccaaaactttgaaaaaacaaaaccccctgaaatttataaagcaacagtttttttaaagctttgttgctacaaagtgagactgtgagaatgaaagttaaaggcctttgctattccatccatattcagtttggatatcctcaaagtaattgaaaatttacttttgaatatgctgaaaatcgagtccataagtatctagtagaatagcttttgattggccagattctatctctgactcttactatgctttagaattcttttatgaactctttttctgatcactgggaagaagaaggcagtaagagaaaagagcaatataagaaattgataactccaagggccatagttcgtttatgtttctcatagttatatacgtcttatgttcattttaaaattttaaaacaataaaaggagcacatatatgagcataaataggtataaacatattctttgtttcccaaagaattttcagtatatgatgataccttttgaaggaaaggaatatagaaggttcagtgtatgacgatatcttttgaaggaaaggaatgtatctcttggtcccatcaaattttttcttgacttacaaaattgttgatatagtttgtctctgtgtccccacccaaatctcatcttgaatagtaatccctatgtgttgagggagagacccagtgggaggtgattggaacatgggggtgggttttccatgctgttctcctgacagtgagtgatttctcacaaaatctgatggttgcaaagtgtttggctgttccccactcccaccctctctgtctcctgcctccacataagacatgccttgcttcctttttgccttcacctccccagccctgcagaactgtggttcatttaaaactctttctttataaattacccagtctcaggtagttctctatagtagtgtgaaaatggactaatacaattgactacaaattttttaaaattctccgtactcaagcaagctgtggcattacttaccacagttatttttttatatttctgtggcatttttgtaacagaccacatagaaccaacttagaacaagtgtaagcaaaacctttgatcctgtagaagacaatttgatgcaagaagtcttttcttgccaggcacagtggatcacgcctgtaatcccagaactttgggaggccgaggcaggtggatcacctgaggtcaggagttcgagaccagcccgaccaaagtggtgaaactccatctctactaaaaatacaaaactaactgggctgggtgtggtggtgtgcacctataaacctggctacttgggaggctgagagaggagaatcacttgaacctgggaggtgggggttgcagtgagctgagattgcgccattgcactccagcctgggcaaaaagagtgaaacgccattaaagtaaataaataaataaataaataaataaataaataaataaaaataatcttttcttggtgaagcttctttagagccaccatccatcagctttgacagctttttgtgatctatggccagtaatctctgcttaatctataaagtgtataaactcttccagaacagcaaatgtgctgcccaggggttaggaaggtcaccaaattagttcattgctgagatataagaagacggccatcctggggatatgcacctcctttgaagttactgggaaaagaacagttccagaatatgactcaattactaattttagtggcaaccaacaaaaagccctttaaaaatataacagtgtgtatgtgatgggtgcctatgcttaattacatgagcatttgattataaagaaggaagaatggctctcaggaagctgttttcctgatctggaaacaatgcatcatgtagtaaaatgtaaaacgggcttagcagctctgcactagctgataatttgttctaggacaagtcacttaaactctgcgtttgggagtcattagtaaaatggggagaccaatatttggcctaccccattcttaaaacttagtttgtgattcaaaggagaaagaatgcaaaaaatgataataataacaggagactacaaaaagtcaggaacatctgattgaaagtaaaagcctatgaattttggcaaaacgtgatcaagctctcctaattctggatatcaatattagccattctaacctgtggaagatacaatttaaggataaatattgcagtgtgagtggcaaagtggcaatgagtggcctatatctaaatattaggaaataataatttatccagaatgacctgcaagaaaaatttttggtcagcatatgaatagtattttgctaccatttttgtttggcaatcattgagcaataaaatgggaatatacagatattgtagtggaaacatcaatatgaggagttaaaaaccacaaagcacctgcatatcggcaggatagatataaatgccaatgtttaataaatattacaaagtgtaatatagtaaatagaacaaggacatagtgttgagattcagggccctgaaacaagaagtcctgatatctcagattcattaccaactaaatcactgatgatgttacttaatctttctgtgcctcagtttctttacatgtccaaatgagaacagtaataaaattaagtgagtaagtatatgcaaagtgccaagggcagttcagaatgcaagaaaaaggtggctatcatattatatagaataataaagcctgggttgctaccctcgttctgtcactttttttctctgagtcttagtttccttatctgaaaaatagtaataagaatatctacctctttcattactgtgacggatttaataagatgaagtgacttcagttgcactgtagctctcaggaactatccaaatgttagtttaaaaaaatatttattgcagcaattggcattaaagtgctgacaaggacatctaccacctctccccatggatgaacatctcacctagtataaagtgagtatctctgtctctctctctctctctttctctctctcttctctctctctctgtctctctctctctcttctgcctcgctaactttaaagcagagtttcctaacctcagcactattggcatttgaggctggataaagcctggttgtagggggctgtcttttgcattgtaggatatttagcataacaatccttggcctctacctaataattccagtggtacagcattttccccaccccagtcaggatgtcctaggaggcaaaattgtccccagttgagaaccactactctaaagcattgtttatatgttagcttagatactacttcctccaggaaagcattctgtgaatatcccagaaggaatttaatctctcctatgtgctcctgaatgtacccccttgaaataagtgtttgccttttaataatgtttacatacacatttcctcctatagactgtgagtttatcttggtcaggaattgtgtcctacttaccatctgttttcatgtggtaagcactctatgcatatttgtgaaaagaagagagggagagaaggaggaagagagagaggaagcaagaaagataagtggttaatcagctgatcttgatactgtctaatgctccattatgtatctttcaggtccctctgctgtgtcagatatgagggggtaacttgatttctaaggagccagtgtagagaaaccaccatgtactcccaagcagaggcccagcttctgcaaaagacctggtccattattgtttatatggaaatcaatcctatattgaacagacatattaaattaccggattaaaaacccaataccatcatcagtcagatataaaacagaaactgatactagcccttgttttagaagaatgtggagggagtgatacatctgttatgagagggaactcttgcacaggtcaactgtagttggctaattaatgctcaatataaacatgaaacagagggatgcttcagctataccatgagttcatgattttgtgtaaacaacaatttaaaaaatgggctgaagtccacattgactgtcaatgaaattgaaacatttccctgctagataaagggagggatagaggctttcctcttataaaactggctgtgtcagtgattctctcctcagattaccttttccacctacctctcagaatggacttcagtgggagtaaacttcagaggggccttgtggtttttatagggggctggtacttgccgtatccaactcttatgactacagaaagtttgaatgagtacaccaacgtctcacctgaaaccctcacatttgaagtgtttaaaggatgtgattattgtacttcttatatgcatcattatatatgtaacttttacatgtaccattatatatgtacattattcatgttcatcagtatacgtttcatatgttcatcattatttcatataacacaagaaaagaaaaaacattgtttttacgctgacagcacactgtttcataacttaagatattttcatatagttcctttagatttatttaggtatagatttttaaaaatcttttttgtgtgctcataaaaaggaaagcataagcaaattaaggtaaatcattctaaactgtttttcacaattagaatctaattctaagtgattttttgactgagaattgtcattgtccatgtgttttccctcacacagtgtgctcagctgtgtcatcaagaccatcgttgacacagcattgcttggaaggatgctctaccgatgtctctggggttttcttccaaaccacccattcttgatgttttgaagtgcatatgcaggccatcatgatgacataatgattgtatctggttggtagctgttttaagaagaatcctaatttcagagaccattaaaatgtgaaaaaatgtgcattttagaattgatgaaataagtaatttacatcctaatgatgggactatctactttctactttaaagacttgaaaggattcaaagtgaaaagtgctgagaatccagagccagatggagctaaaatcacatttctctgctatctgcaggctattttaatgagggcaaattatttaactcttctgtgtctcagtttcttcatttgtgaaagctgcctcaaaggaacattggtgatgataaataaaaataaacctctttgccctgagtagttatacaaaaatatattctctttttaaaacaagagctcagttcaaactggcattttctctgtatttgaacattttatatgtaatgttctaagtggagactgctaaaattggtaaaaatgttatgtcttaacaatgaattggttacatttcaagataatgagcagattcagatagcatggtttttaaatacagtttatctaacagggaactcatccatagttgtcttgtgaactattttttctttctcctatcaagaatttgaattttctctaaggccaaatggtgaatcagcagctggtcaataattgattttattttatgtcctataccctttttcagtccaatttttaagtcaatgttaactcagaaactaattcacagcttaaaatacagttgacctgacaaggctgctatctattctagactaacgtgaatttctcagtgtaagcactaatatcttccagtacaaatcttgaaaattaaaaccaaaggattagcgttatcattactgatgttaattctgtattaaattcatagtaggtcacaggaaatcatccctttctcatgttatgaaacagaaaaagataggatgtcagaaactaaaaaccaatatatgtttgtttgtttttttcctagaaggtggctgaaacttagtagccacactctacctttgcagtttttatttttctctttgaattctgttgcttcttccatcttgccagcccttgaagaatctggaaaaagcatctcattttccatggaacaagaaataggttaatagtccctttcacaaaatgtagagtaggactttcattgaatgccaactcagttttgttttttaattctgtcgtacagcatagaaaagctggtgaatgatgtcatagtcactaacagcaactgttcaagttaggagaattttagagaaatggatattgtcattattcattcacaagtgttttattgtgttatagatttctattattccaaataatgagccatctgagaggaagaattggggaccaactcattgtcaatttcccccagtgcctactacagtgcctgctatacataggaaactcagtcaattcttgttgattgccacaaaaattagtaagaattggaaggaaaaaggaagagagagaaaacaagctcactagagaagattcttgaatcctttctgaatcatatcaacacagtatagcaactggcttaatcatagatgtcatcactggcatttatggttagaaatataatgtttaagccccatcccaggcctttgaatccaaatcctcaagagtaagtcttggaaatctatatttataattatcactcttggtgattcttatgttcaagcaaatttttaaaacactggaatactatgatgctttttagaaaatgtttaagttggtcaaacaagtaatgattcattttagaccaagttagcatttgaacatttcagaccaatgggaatattagaatttggtgctgggtagccaatgactgggaagggagttttcttgttttaggattggtttcaaaaccataacttcactcttatttcagagctttctattgcccattattgggcagtagaaaaatattgtttttattctaaactcaggacctaatatcctctaatgcttagcaaaatttgagtattttaagaggtatttagttggtattaagagaagtgactcagaaagtcagaaactttttctctttctcctaattgcattataactatcactgtaaagacaataaataatacaaaacttcttaaataatgtgaatatatgagcacataaaaataagaacattccttgaggctctacttttttacagctttctattacactatgataaatagatgaataataaccttgccaagttatatttgttcttttatttgtctctagacatgtacaattttggtgccatcatttcatctctgactgcttttctgttatcttgagggtctcagtcagataaagcattataaataataaatattcttgagtcatctgatagctcaatcccagaggaaataaggcgttcaaatttccatagaagatttttattaaccttcatataaatataagtataattatttttcaatagttttagaatattattactatcctttagtaagacatgttgacacaccacaggtcaaacaccagaatcccactagaacaaaatttgaccctaaccaaaataatcacacatgtccccgtattgctgatgcttattgattcatttgtaatgagattttctacaatgaatagcctagtttaagcatgtttttttctagtctttgtaaatcactatttgtctatctggaaacctattttgttctgtttgcagagtacctttcacttgctaatgatctgtgcaaattaaacagaaaaggggaggagaggcatggttaacttttcaaaacttctttcctctgggtggatggtaagcaagaagcaattatcctctgactctcctcactcccaaaaaacttcacaaccaaaaagaggaacaagcgacacatacatgtgcatttgcatgccaaccagaagagcaaaccagtgtgcagaaagtgtgtttacaacacttccttgcaaatgaatgaccgttagattagatactttccttattctgtataaactggtgcctgttgtatttctctgtagagctgcttcagttcagagcctgggcatgtgctttgatgtgagttttaccaatagaattccatttgagtagagaaaaatactatattaactaacttttgtgcagatgcaggcacagatgattcaaagtgttagcaactttctaaaaaccatcaatcatttaaatacccagtatgagaaataaaaattttgatttttatgtagttatctttgttctgcattaaatctcttttgtcatttttcaactttaacagtcctagggggagaagagagtaggagaactgggaaaggacttagtgtgtgcaactgaatctgattataattgtttaagatttattggttgataatgacaagttgtttttgtacattgaaattctagaaagttttaaattctatctttcatttaaaaactgagagctactaaatatttgggcatttgagtatcttggcacttgggaatcttattcctgtcttgatttgtgtgggtcgcgtttttgatgataattacaaagaggattttgtggtggctttgaaaatcctcagtcttgtaaatagcattttgtgatccaaaagccaagggaaatgactaaatggatctttgtgacattttaagaacaccaaaaggtaacttctttgaacgagatttatgaatgtagaaaacttaataagcaaagaatggatctttgtgttttttcttcccaacattaaatctaagaggttttctgtggacagtgcaagaacaaggccctgcagatccttcctctgcttatttccccacacctgatacagtttctactggcactttttaattattctaagtaactggcacaatgaaatgttttcgtttttattctaataaggtttagtatgtgctaaaagcaattttataaagatctctaagcaaatattgtactgtacttgtatacattacacttgagaatgttccaggcaagtaagttctaggtttttgctgtgcttatcctactgaagtatgatccctgcctctgctgcttttttcaaatacataaccataactgcctttatctccatatatcaatatgcagaaacaatagaatgcttgtatggctatctgtgcatatcccaagagaattatttgtactgggggaaatgcagttgaaaaaaagcaggaaaattaatagataggcatagagccttatatcttcatatatcctctaataatggtagaatttggttttgttttatgattcatccaataaaactatataatttactatgcattttaaaattaagaaacttatgcagaaagagcaccatgagatataagaggggctgtggcatatcagattatttttatatagtataatattactgtttcattgtcttgtattttggaatccagagttaatgttagtgctaaatgcaagtttactgctatcttggggacctggatctcacctacctatttatccccaatgtacatcatcacagaactttttagggcttccagcttgttttttcttgggaaactactgatgtggctaatgggcacaaacctgtttctaccctaaaaatgccttgagccataaactccagcccatagtacaagtagaggaagacatctttgcctactcaaattcccagaaacagagagaggaatccacagatgaatgccctgccatgttgttgtaatcagatcaaagatccagcttttacttttggccaatttccttaacagatcaagattggataccaaggtttctgacttccattccacattttatctgctgaatattaataattatgagtatataaagacttcatttaaataaccccactcaataatctcatctttttttctaaaagagcatttagcaaaatagagtcaactaacctgccaatatcttataaagaaattttataaagattggtttaatacctgcagtactaatttttgcttctgacaaaggaagatgtttatatcatcagaataactaaaaataaataatctgataggtattttgttgatcaccaacagtgttttatcatagtactatgcattgtgggtatccaaaagagggagaaagatacattcattccttgatgctgctcttctttgaggtggatttttactacctagcatttgtgaagtacagcatgttgtctcaacattaaaattgctttcatatgcagaaacatactatgtgcaattgtctgtgttaatatggacacatttctcatttagaagagagatcatgaactatctttatacaccaagtttaccttccccaacaatttagtaactttacagacacatggatattccagtcatattcccttgtcttttacctctgtacatggaaaatagctggttgcgaacatgggagcctctacctgcaagccttgtttttctggaaacagcagcccctcatcactaacaaatggcaagtaggtaaataaatgcccctattttggaatgattttaaggcaggtgttctatactgtgtctcagaggtctctagtttcccacagtggtaacttacttgataatacgctctttattgactttcttcctttactgaattattccccctttcccatctaggtgtttcctagaatcacttcccaaataaaccacttgtagttaaatccttatctcagggtctgtttctgggggaaccataaccaggacaataacgttttctaatacttcctattcctttaggttagaaaaacaggttcttccaaagcaccaccctttccttctccatgtttagcattttactcctcactgacactggcctatcgagccccatctttctgaagtacactagtttgaggcttctttctcccaggcctggagttccacagaagtgctctaactagaagcattctgcagaagtactctaaatagaagcatttctacttctcacttgtataattttcaggcaatcttacaaatcactaccagacaagttttactaatcttctattgtatccatggttttagcatttataaaacttcagaggtttctgcattcactaccttagtaatgccattcagttttatggctttatatattatatatatgccacagactcccaatacttatatttccatatcaaatctttctctcattccagtcttttagataccactacctacttgacatctgcacttagatgtctgttagacatttcacattcaaaacatcaaacctaaacccctaatctcctcagacaaacctgctctttctgcagccttccccatctcagttgatggcagtaccatccttctagtggctttggagagatccttgatttattcatttggctcttaaatataccctgaccgaatccattaggaaatccttgtgttcataccttcaaaatatattcagaagctgaccatttctcctcctctccaccagtgaaactctggcacaagccagcatcagctttcaccaggaatgctacatctcctggttgttctccttgcttcagtttctgctgccttctatcctcaacactaaaggcagagacatccttttaaactgttgggtcacagatcatggccttctactgcaaaaagccagcatgcgatagatgcatgtctcactcgggtaaaagccacaggaactggggttacatattgatcaagatacacgtttcctattctcttgaaacgttagggtttctagtagcttttgaagtataatagttttaaggtataatcctaattaactgtacttctcagctctcctcctccgtccctttccactagaatccatgtcccaaatctcctacctatgggtccaggtggaagaatggaaaagaatcaagcaaggaagaaacagtgcccacagaaagcaaaactaagaaatcctgttacaataccataaggccactgtagctgcaagggatcctgggaaatgcaaatatttagaagggtctgatgctgtcatcaagaatgtgtgtgtgtgtgtgtgtgtgtgtgtgtgtgtgttttcagttagggagaaagaatgtacactgtgtagataaatagtttctaccacagatggtgaaaaaatacccatggtttacactaagtctaggtcttgtccagttctgagcattttaatcagaaaagcattactatactcacttgtgtttatattaaaataagggctatttattgccaccagctcaggaaatgacccagtgtggccgtgtaagacagaattaatttgaagtgactccagctaaaagttggctgccttttaacttaataacttgagaactgtcagtatcctttgaagttaatgatagttgtaaagtgcaaataaaaatttttctaaaggaaatcaaacacactacagccaataaatggctgtcactagaatgctctgtcactgaaactattcaggtatgtgcgaggggagggtggaaggctggtaatctgtttagaatttcattgttattttgtcttgttttgttttggcttttggattatagaatgcccaacaagttttccccttggaaatgaaatttaagccatttaatgggtttctagttgttgggtagcatgttagaagcaaagttattttgtatgagcatttgtgttggaaatacttgcaatactagtgtcacctcaggcataaatgtatttgcgcagcacgacttcacatggtaaatgaaagcattattacttgcttgtctttctgtcatgggaggcggttttccaaataggtatatggtgcaccatgttaattaagttttattttcgttaatgagtaaagtaactggctgaacaaagagtaaaagatttatcagtatggaaagagcaggcaactgtttgtctaagttatgcaaagtagcaaatgggtcatctcaactaagcatcaggcaacatatcatgtatgtgtgaaatgtaactgtttctaatttcagacccaggttattagcagcatggaagctcctaatgaggctggagaaagtttctcacataggagcatcctgccttttatttacaatgatgccactcaaaatttgtttcagcaggaagcaacactttccatttttttcttgttgctcatttgtgagtttatttctacttaatttgctgatccaaagcgatgccagattgacatccctggggactgctgtttcctgttggtgcctgtgcaaatgaaggcagcaagcagaagttctatgttttctggatttcttggtggttttaggttgccataggcagaaactaaaaaccatatagaaaccttagttgatatgctctacccaccaccacctccgaaagatgcagcagccaagttaatttggttaaggttggttaaagggaaatgaaaggatccttcctctttacgtctttcttaaatacaacattttcagaaccccaaactttgctataacttgatgcttctaaaatagtctgattacaagacatatgagcttattaaaatgtggattttaagtttcttatcttggagattgaggcctaggtgatacccaagtttctatacttttaataagcatcttaagtttctgttatcatcaggcaagtttaagaagcacctctcttgcatgtacaggcagcttaatggactttatattaaaacactaagtttagtaatgtattaactttgtaagtccctcatttcctcattatggagtatttattaccaggatacatgtataaagcatttagtgcccataacaacatgggcactggaggaaaccatttctctctttatcaaataggactaatagcattaaaagcaataaacttgcctgacaacactcaaattatccaagcattgaaagacccctaagaagccactggtagtagttagatgccaccttctttcctctttgccaatgcaaaacaaaaccaaaaccaaaatctattcatctcctttgaacatccatccatttggaagaatcatggtttgtaaaaggatactatttgtcttaaacagctatgtttatttcaataggataccacataggtcaaggtatgtttgagtgtgttaagcaatttggaaatatgttcttggaaagcacaggaagacacgtccccctatccccaccaaataagaagacatcagagcccaaaacacaattttaatatatcagagaaggatatgctaatgagttttcttgtagtaattttttttttttacatattgtatctatcttgaaaaacatgctaggacaggttcacaaggaatatcatcctctggaataagaacatgtattgaatttcaatccatgtcaaggatagattatgagcctatcttacagtatatgatggctatatagttaaaattattaatccaccaaggctgtaactcacaactcttaatattctgatattattctgagaatttcatttaatctccctggatcatgtggcttataagattttctctcacagctgaaaaattacttgatagtttattcatcaccatcttctgttacttggcagagctcagaaacttttgatgagtgtatcatggtcactatttgcagtacaattcgcaattcttgccgtcctggaactactaaaagatagcctcaatcctgaaatgctcagttgcattttaggtgaatgttttgtaaagcatttgaaatctgcaaagatctgcaaggaagatacaggccaacacatcccgtaatttctcctactctaaaatttcatcgtagacattacttcacttgaaatattataggaaaggttgaaaaactgttattctttaggcattactgtattaggtatatttttgttgttgatcagacattgcttcgagctggaaaattttcttaatgtatatcgctgtaaattaagactacattttttatttgaaatattagaaaatattttgattcctgtatctgctataagtgtgaatcataataatcctttctttaagagttaaaagtttcttttatcgtattgtattttgaaatcttacaaatttcaaattatttactctggtttacttacaaaggcacaaaaatgacattgtaaggaatagttcaatttgagggaagaggcctgggtgaggctttaggcacgtttacatggtctaccttggctgaatttccaagcgatttaacttaatctctttctgaaagtttccagaaattaatagtatttatctacttttacaaaaagttagaaatgactttcatgtctaagggaaaggagatgatcatatacaggaaggataatttggaaacactttttgcaaactatggatttttaggtcctatcccagacctaccaaatcaaaatatccaaggggaaatttttgaaaattgtattttttttataaacacgcctagtgatacttttatcattctgcaaactttggaaacatcacactaatacatctgtaaggttgaatttacttggccattacattctgcttccatagtgtttgtactaagatgagaaaatgttcactgtaaaatactgtatggcaaaaaccagaatatacactatagatgatagatagaagatagacagagagagagagagagagagagagagagagaatgatcagaatgcagcacagaataaataaaaagtgtcactgtaaaagctggccttggaagtcctctttttgtttagaaaaacacttgcatataaatagagaagcccagtatctgcctgagagaaggatgagtgtgagacaaagcataaccgaagagcaacagcaatttttacttccctggtttttcttggaagaaggccagatattttttaaagggaaaagaagagacactgaacaagagattaaagttccaggagaaaattgaataactgttcaatgaggtattcagatgacggggagatataaaaaaaagaaggatatctgctattgaaacataaactttttgctataatgtgttgtcctgaactctgatataatcccctcctatgccctgaccatcaggaagcatgctctggaagggcttaagagaaaagccactgctatgtcactatattctacctacaggttgatacaaggctgagagaaaggaatgctagcaaatcagaatggcatatgagcagatacagatgtgtaactatgccaagtatttccccagatgtactaggatgactccagaaatctaaaatatctggataatctcatgcagtaaacattttattgacattttggttacacacacacacacacacacacacacacacccacacacacacgaaagacggaaagaaaacagcaaaaggtagaaagtttatctctggatgttaaaattgagcatatattacctgcataacaatgaggaaaatgattaagcttcggggatcattcttagacattttaaacaaacacaattctaaatttaacagaagataagcgaagtttgataatttaaaattctataggaccaagagcttgcttcactagttaatatttagaaacatcaattggtcagtctgttgtaaataaaatccctgggttcttgaaggatgatgtgttacacaaaataatttacactgaactatttgatcgtgcatagattccactggttcaaagtggaggaaaacattttaatgattttacattcatctgtacaattctttctgctatcaatcatatagtggtccttggcattttttccttgttttaaagtagctttttaccctatataaagaataatacatatgaaacagtattgtatttaaccctaaaatattccatttctgctgtcagataaactgagtttgaaggctatctctaccccttactcctgtgtgaccctgggtaagttatttactgtctctacagctgtgtttacccatctttaaaaatggggataatgattcttcctacttcatagggcttttgtgagaattacatgataatacatgtaacaaacttagcatagtccttggccaattgcacaaaataaattagctatgaaatgtatttgttcataatagaaacttcaagaaaaataactaggaaagacataaaaatcctctatagtctcacctccgaagcaagcgataactgtcattttggtatcttttattcttccttctttatctaaagacaaattacaaaaatgaatctattcatacatattgtattttaatctgataagttgtgtataaactaaatcattttccctgttactaaatattgttcaaaaaaattattttcagtggccacatgctttcccatttgtaaagcagtatcatactgtattttaaaaatatattgctgagcataatggttgtttccaaaccaccagtatttcaaagaggctgcattgaccatccttataagtaaatatctctacatattcataataattggtttagaatcgatttctaaagttagaattgctgaatcaaatggtatatcttaaatgtatatttcatacacgttttaatgtactgctaaattgccttccagaatgtttgtgccaattattacttttagtagtatatcaaatactttttaaacaatagatacattcactttaaaaagaaatggcaatgacttttaattttttagcttattttattgagtttgaaaaagatttggccacttgtttttttctctcttgtatactgtatgaacatttgaatttaaaaaatgtatactgcactgcttctttaattgtcatattcactgaggtaacatttgttgagcatctactcaagacaggcacactgcacagggtgagagatgtaaagaccaggacacttatgctaaagtcagtggtgtccatgaagagcagaggcacagtgaaatttgcctggtccttctaggggctttggagatgcatattaaacatctgaagccaagggattcttcttagagctgtcctcccaagaaagagggaaccaaacaatgaggagatttggcaagtcctacccaaagagaactgacatttcttaggcattttatgaagagatacatagaactccagttccacttgttaaaagcaataactgctttcacttactgaacatgcacgctgtggcaggctcactgctgatattttacaactttctgcgatcagaaaggttataacccgtagatctgccaatgagtggattctgaccctgggtgaagtgaatgaactagcccaagagtttgcaattctaagtggaaatgctgggattcaccatctgatctgatgctttgctctgtcttctcttatttacacccaggtttctcagctttccacctttgttatatttgcattttgccatacctgcctgttaaccttttcttaaaacaaattgatcatctatgtttatttttgaacactttgttgttagtttccttaaaaaggaaactttgtatctctattataaatagaaaatcagttatatttgccatataaaaataaaataagtaaaaatgtatggtttcatgtgtaccaccaaaaagcatttcatctttctatcccctttcccatctcttgccagaggccaggctataacacctgaggaaacactgccccagtcactgcaaacatttagtcactagggacagcagaacaagactgtgggaacttggtaagaacctgggaccctttgtacctttcttctgttggtttctttattctcattctcttctggatggtctccagaataactggggagacaacacttacaggaaaagcgcatgtgttcttgtctcagagtggaagaaagaagagccgccgtgttccagctagtgctcagagaaggtgctctacatatcttgttgaccttgatttgagctataaaaggctgctgactcagagcattaaaacagaaccactggcttattctctgagtaattcaagtctgcctttccctcagtcgatcccagaggtggctagtcaagcctggcgatgttcatttaccatcagagattaagcctgtctggccaggctttgtctggtagcattttcttaatcaaatataatgacaatttgaataaactcaagtccattgaacattgttcatgttttattattaagaaaaaataggcactttgattcttggaacactttttaaaaggctcctcgctgtgtcagtctctgtttgttattttggggcatgacagttatctaaagagaaccagccagatttaatctgacagccacagtcagggaagagcgctaccaatctaattatccagtaatctagtcagaatgggagtaattctaggcctttctcaggcagctaatcacatttcctgtgcattagcagccacacatggggagcttttaggaacaaggtttttggcctgcacgggcttcatgagcctcatagtggtataatttctttgttgacttcttcccccagagtggtttcttcaggatttttcattttgttctcattcctacttttcccctgcattgccgagggtgtcttagcttagcttcaagttctaagtttgacgagcttctgactttcctttcagaatgcagcagaggaggaagggtacattcacggatccatatgcttatttcttgtgcagggacaaattaaggagcgtaacacagtctgcagggaaaaaagggagaaaaacgtgaaagttgttttcttcaaggaaagcgccgttgtttgtgggccatttttcatgtcatttctctatcaatgtgggtgatttgagggaggtttctagagaaaaggccggagaaaagagacagttaatggatatttagttctgtcgttgtctctgaatgtcaagctgtaggtaatattgatctcgtctcatttctgtaatcacaattttaacatggaaaaaggaaaacacacacacattcagggagtgggagcattaatgaatttcctgccattttctttctctgaaaacctccgtttaggataatttcatattagtcctgtaaagcagaatgtttttcgagtgcattggtttctcacactccaaaattgaggtttcagtggcagtatgccgcttctacccccagctttcaaacatttctccagcttctcataatcacagcttggttagtctgaatccaaacatttgaatctaatagaggggaattctagtcactaacaggtttacaatatagtaattttccccaaagttatccatgataaatgggcttcccaaatagcctctagcaatcacagcataacgcattagatggaacactccaaaaaaataaaaaaaaggaaatttgaaatcctgtgttaaattgtcgtgttacaattttgaacgggtttcaatcacaatttgcatcctctcaactgaaatttttgtgggcttaaacaatgcttttattccagtaattgtgggaggtatatgccactaggggctgcatagtttgggtgtgcctccatgcacagacaagaactgttgctgaatcataagtatatttgagcctcgtgtctgaagcctgtggacctagagcctaacgtgtctcagatggaacacgtagactggttccagtgcttcttgttctgtttctaattatgtcgtgtctgcattcattctaggtttagatctcacaaatgctattgatagaactttgcctaaaaggttcagtaaaactacaaacaaaccctagttttgaactgtcatccaatatattataatagtatatgaattttagtctttcattgcaggcactatattgtttgactctgattgtattgattgcacaggcgaaagtaggattatagccgaagagtagttcatggctgacatttttatcgatggttccatgaacctgaatgtgtacttcaatccactaaggtcactgattaaaatgtttacccaataaaaattacatttaaatatgtcaatagtacatcaacttacataacatctttcatctgaaaatataacaacatatatgagaaattaatggcatagtcactaatccctgtagaagtattgcttaaccatggttcacttctcacagaatcaaaaagagagaataaaaatggtatagcaaagacttttaatgattccagcatctattagggtatcattgtcacaaataaaaagaataccagttcctacatttctcaaggctatttctcaatacaagttaaaatgattcaggaatgcaggagatgcaaaaaaagaggctgcatattaagagcttgtttgagcaatggaacctctatgtatttacaaatgtggcacttttctctctgctttaaaacttagatcttgaattactcgagtgattgtgatctgcaaatcggtatacattgttgatttctctgttcaaattaatatctgctgaatgagttgggctttgtaaaagttcggctttgtgtcttattcattctctgccagggtgtctggtgctgtccaaggaatgtcccaggacagaagggtctttgtataaggaacaataataaattccattattgccatttatgaattatcaggctgccttgatctagttaacttctgtacaaagagtgctatcaacttcaaactttagttaagtcatcatgaggcaatgattccaagttttgatccattttataagggatcttccattttactgtatcattctgaatactgttcattttctgtcatttttaatttggtttttcttttaaaaagtcagcttctgtaacacgttttgactttgaggcagagtctactttgggtttgtgctaattttttcctcttagacaattaaaactttccaagaggacatttgatgttttgcagcatggatgtcatacatcccatattggcattgtgtaatgtttttggtaatattaaaataattggtagtttaggtgaattaccactgggtcactggcctttatcacccacccatatagatagccttttaaatttatattgtctgtttatgtgatttgccctggcccatatttggaaatacctacaaagccctacattacctctaatctgcttaggcaatcttgctggttatgcattggtattttatattggtaacatacaagcctgctatcatcttcgatgttccctttaatctatgctgtccaatagtgtaatcatttggctgtatgcctgtttaaattgaaatttaaattcattcacattaaatacaaattcagttccttaattgtactggtcacagtttacatgctcaatagttacataaaggtagtggcttccagactggacagtacaagtatagaaaattgctgatattgcataaagttctggtggacactgccttaaatgtctgataaacttatcaaggagaatgtctacattggcttagaggcagaaaacaattgtggctgtacaatttcaggttcaatactagaaacagcaaagtcaataaaagtggctgagactctcagaaggtgcacacttgtaattgcatctcatcatgagtgcttgctgcaattaaatgaaatcattcaaatgttggttttattaattctttaaaaggaacagggaaaatggccacttgagagttctttttgtttcactaccgttaatatgttacctaatgtctcttataagtatgtctacatttaaatactggtttaagtttcttaacaatttttatgtttttttttcataccaaatcatttctatgccatgccagccaaaggctcattttttctcctttttttttttcatcctaactacagttttcccttctcatttttcttcccttcccttccctgtctcctattcctgcgattctgtcttgatgatgtctaggtgatagagggaaaaaagggaggagagtttaaaatcttttaaagtagatattctgtttttggaatctcccacgtgatttgggtaaagtggaggagtctttgggggcaagtcagctatcttgcatatgtatcttcctcattcggaatgcgtgttagataagtgcaggataatctggaggcaaataccaggcttcagaagcatccttctcttttctttcttttcccttgagacagagtctcactctgttgcccaggctgaagtgcagtggtgtgatcttggctcactgcaacctccacctcccaggttcaagtgattctcgtgcctcagcctcccaagtagctgggactacaggcgcgtaccaccacaccgggctaattttttgtgtttttagtagagatggggtttcaccaagttggccaggctggtctcgaactcctgacctcaggtgatccgcctgcctcggccacccaaagtgctgggattacagacgtgagccaccgtgcacggcctcttttcttttttatcaaatgctgaaatctgaatgcccagggagattggtggcccttgccaggaagtgtcttaacactttgtggatactgctgcctgttgtctttaaaagctgggactcatcaaattaaaaacaaaaacaaaaacaaaaaagctacgattcaaagttttcccatgagacatttacatggcagatgcctaaatgttccattgtcatgtttctagatagaggtggaaaccataacaactaaatatgctgaaataattcagtgtggaaacaaattcacaaactaaaagatgttgtgttactccatagtatcttaaggcttaggattttcaagaacttggtatgattggaacatatctctcgcaggctgggtattcagagcaggaggtaaccatcttaaatacatgtgtaggcaaacctgaaagtttaagatttggggatttcatagcactctgatataggcatatgattcctgccatgatgttgtttaactaatgtgtgtgatagtcacacacatttctgttaaaatatagataaaagttattaagagtatttttaaaaatcctcaaatcttttgtgaatgtcctgtccaatctcaattataaagaattgcataagaatggttaagatctactgggtctactgaatgaaaaatcatacagaggtgttactgtaacaccatatatgaattcctgaaagacttcatgttctgcaaaatcatgcactaaaaataatgagacatggaaaccagtgggatgggcagaccacataaaacatataacaatttgtaacctgaatatttataaatacatttgcaatacaatcttaaaccctgatgttgtcccttgctccttctggatgtagatgttggatggcattcaattctcctagagactctttttattagatttttaaaaattatattcaattatattttcattaatctcttgttctaacatagggaaaatagaaaatgtctattttttttttttttttttttttgcgacagggtctcgctgtgtcacccaggctggagtgcagtggcatgaacaataatggctcactgcagactctctgtcccaggctcaagttatcctcccacctcagacccccggagtagctgggactacaggtgtgcgccactacacctggctaagttttgtattttttgtagagacagggttttgccatgttgcccaggctggtcttgaactcctgagttcaagccattctcctatcttggcctcccaaagtgccgagattacagacgtgagccaccacaactggctaggggaaatgactttatacttcttaacatgaactcacggcttatgtgaattagcttaaaggaaagcaaggagattcttgaaacttcttgcactaaaggaaacattttgcactaaaggaaaacaattctgtagaattacagtgtttttttttcctaaacatgtccaaatatttttttatttacttgtaaaaaagcttacccccgtcacttctagacattaacaaacttgaaaaagtctccaagaaaccaagacttccatgttattcttacatcattctcttcattttcaaaggcatatgagctaattcatgtcactgaaatatccagtacagcagaacaaactcattgtttccagctttaggaaaatcccctcagaaccaatgcaacttcaccacctgttttggggataaagaaggcgcccttaagccttttggcctaactaacatggtaactttgtcctcattccctgcttcagaattaatatgattttaataagtataacttctttggtctaaggttttcaaagtctgttaccccttcattccatttttataagcactactttttcccatgttattttttctctacttaattaatttttaatttgcaaatttatttagtttttgaataggtaacatgttcacatggcaatacatgaaaagatgagtctccttctcatctgtgcccatcattaagaaagtttcccttaagaatccatggaatcttgctctgcagctctggggcacaatttccatttgatggagttgtacaaatgtcacgtgaatttatcatcacatttcaggctgtgtcatcaaattctaacacatgacattttaaaaaactcatacaagcatattcttactttttttaaatttttcactaacaaggcaagctaactaagtgaagtaaatatatgatttttggcctgtgaaggtgtgcattacttaggctcttacaagtcataagggaaaaagtgctgtcatgggtgatgggtgcttattataatcatatgtgggaactgaggaagcataatgaaccttctaggcagctgcaaagtacctctgagtctcagaggttcccaatctgaaatgtttatcaagtaactggagaagttggagatgacacattgtcattcatgaaacaaggacaagtttacttgccatattttcttaacttccacatgaaaacatttttactatcttttatgtatatgcatatgttctccaaagataaaattttaatgtactagttagtatccaatgtggagatactcagtattgtctctcatcatactataattatgtaaatgccatccatatctattggatgccacaaactccacattaaactggcaaagatcattataatcaaggagtgtcacatcgcacaaggccaagtgctcttattcggaaggactgattccctattggccacgcccctcaggatgcaattgtggtgagcaagtcaggaagatcaacatttcagagactgtccagagaagagtggtttacattgtgtttagtttcacatcctcatacagagatgttacttgatttcatttgaaaaggattgtctgagatattttcttaaaaagcaatattttacaaacagaaaagaaaacacccagaaacgaagtgtatttgaattctttctatgagatgcctaggcaatcttttaaacccaaataagtcaattactcctttctttcttttttttttttttttttttctgagacagggttttgctctgtcacccaagctggaggctggagtgcagtggcgtgatcacaactcaatacagcctcaacctctggggctcaaacaatcctccttcctcaaccttccaagttactgtgactacatgcccatgttatcacacccagctaatttttctgtattttttaaagacaccatgtctcattttgtggcccatgtaggtctcacactcctgggctcaaatgatcctcctgcctcggccctccaaagtgctaggattataggcatgaggcaccacgcctggcctccttctttgctttttctttttgaagagataggttcattgtggcagccaaagtgtcacttatatgtagtgcctgacaaggtacttgcccggttgacaaatgaattgaattagataaagcaatttaattactgggtaagacactgcttaagttattaaaaggcagcactaaaataatctttcaggtatgttagctaaaagtacccattttattaaagctgcattcttatgagactaatgcttcaaccatctatttgtatggaaaatctaagggtcttaaccacatttcaggaatttaattaatatcatgttgtgtttaggaatgctggtttattcactagggtataaatgcaatttattttacagagcctgaagtctttatatgtttctatacccctggataaatctcaactattttagttgttgattttttttgatgttgcctttaaaaaatcaaaactatatttattactttatcaaaccaataggccatcaagctgtcacatgaaagactaaaagactgacttaatcacagcatcttcagatcaacaacaaatgctttccctgctacagaggctactgatttcaggacatgggaatcagaatagaggtcttgcataggactctacctgcctgagggaattaatacatgtaaaacatgttcagtgtgttctatcttaattagaaacagcatctaatattgcacttagaaaattagagaaaactcaagaatacatttttgaaagaaatcagtttgctttatcatggactggaactcaggagtgtctaacgtgattattattctttgaacaagttaaattggtggattttgacataatggaagaaaaccttcctctctcttatctcatgataaatttaaagctgaaaggtcacttgtggtttgtacatgcatattcagaattaagcaaaaaattcattttgatttttatcagttttcaaaattaagaaaacatacaagtgtacacacatacacacaccgaaaaaccacagttttttattgaaagttggttagtttttaagtactgcccatcctgaaatagtaatgttttccctaatcctaaatagaaaactcttttcgttcattatccatcagtagtacttcagtgatataaatcctattactacaacttagtttctcccagagcaaatagctgaatgatttacaacaatggcagtttggatggttgatagctttgcaagatctcatccaactcagccatacatacaagttgtcatgcatcatataattttaaatacattctagaaataaataaataatataatttcacttaccatacttatatttttcagcctttgcagaatacatggtagttttaaaacattttttatcaacttaaaacttaactgtagcatactccagcttatacgcacataaatatgtaactatattctcctccttctctttggataactactgaccataaaattctgaagagtagaaaatccacctttctgatgatggtggcagtcagaagatgtctttcatcccgaacaatttagaaatgtagaaatttcaacgtgttggcaaattcccaaagtttttgtaaacctgtgaaatgtacagagattaatgtggttatgatttcctcaacggtaatttcaatttcagctgtctggtttttatacatataaattcttatgttaataaaaacttctcccttaccttgtatacttgtagggaggtgggagctgaagtaaagaaaaagtaaaaaactcatataaataacaattatttaagcattattaggatgctctccaaagcacgtagaacctagataaacactgaatattagataagaaaaccaatattatttataatttccatgcctacatttacccatttaatatttatcacaaatcaatggttttaggccctcctgctagtgatcttggggaggagttgactaagaggctatagcagaattgtatttctcacatgcatagaatcagagacaaaattaaaatttcccaaagaaatttccttttggaagtttctaaattgatccatgcaaaaaaataaaaataaagctaagggtgtttaagcaggcaaaatgtttggaattttgtttcttaaatgtctttaaggtttgtttttgtgactaaagctctctaatctcggaagtcttgaaggaatctttttaccaagccacatgctcttttgtgaatttctgaattctatggaaatgtaaacttcacaagtattgatgttctgctcccagaagtgtaaggctgacctctgaagttcaaagtctctttcaatttctttggtgtaaacatccaagaaggttagaagagacaacttttagaaagcaaggaaatgggtagcagcagattttatatcaatggtaatgtagaaatcaacttctatagtcaaattccaaataagctgattaagaagaattaactggagatattgatgggaaagagaaattgttgggaaaaataaaatgaacagccttggtgaagaattccattcgttgttaagatttgctcagaaattgtggtggtggtggcgccatggtggagttttagatcaatacaaatttagcatttaattctagatctgttgcttattagccattagatctcagataagctaattaaaattctgagtggcatttcctcatctgcaaaattgggattagtatacttatattgcatggttgttttaggattataggttttgagtagaaactattaccctcacacctggaaagagtaagttagatctactcttacttcactttcttatcctcattgtcgtcattatcactgaagatgcataacgctgtttaaagtctgaaggatgatacagaactgacggtaaacctctctgaaccatgtttaactgcctaaggctagacacgcagtgatatcagaattaatattgttttctttcaaatgaaggattctgagctgtggaccagagtgaggatgtgtatttatgggcttctaggtggtaactgttcttgtgtctaaaccttaattaacataacactctttcacacgaataaaactttcattcattatggttttggcccataaaagttgaagttttttgtttttgtttttattttttcaccaaatcagccctacagcgattcctccacccccattagcaaataccgtaatatatgtctctagtaatcatcctctcacaattctgcttttcctaattttgccgtgagtcaagtttcttgaccacaatgttatgctgaggaagatctaatgttttccatggagcagaaattgttagtcctcaactccaaggtctgccttgtcaagccctgttttccgtgtcttcataaaccttgtcaggcatttatttattcagcacatatctactgttctctgcacaagaattcataaggatctgatgaattatgtcccttctgagtggaatttattcccttctacatttctgcaaaacaggaaattggtagtaagtcaatttgaaggtactatttagctggcacttctgccctttcttttttaacagctgcctctatagacagaacgttgaaatgaaaagatagggaaaattggcagaaacactctgcatgtaattcctatttagacagttttaaacctattttacaaatgataaacctggaatatagtagggagagatttggtgatgaaagaatctagatttcttaactccttattaatacgtactttaagtattggactacaaacttgcatatgtcactggtaatcattgaacacatgttatcatgtaggcactatcaaattggagcctataattgatgaatgagggatatcactactcatctacagtaaagggtcctgaaatgcagaaatatggaactggtgtgactgtatctttggatatttcaagagaagccagaatacatgaattggattcgtgtgtgtgtgtgtgtgtgtgtgtgtgtgtgtgtgtgtgtgtgtgtgtgtgtattgggcatgtatttgacttttaaactttttttttttgagagagtttcattctgtcactcaagctggagtgccgtggtgcaatcttggctcactgtatcctccacatcttgagttcaagtgattctctcacctcagccactagagtagctggaatacaggcacacatcaccatgcccagttaatttttgcgttttttttttttttgtagagacagagttttaccatgttgaccaggctggtctcaaactcctgggctcaagcaatctgctcacctcagcatcccaaaatgctgggattacaggcatgaggcactgcacctggccaaaatattaacaactatttttaaaggcagtactagccaaagaaaacgtgacctgatagagattgtgacttcagaagtttaaggttttacctcctaaaccacatgcttcatttcatattgcattttaactgatgcccttttgttttattctgtagcctcttccccttactctttcttcctcagtgtcttcatctgtgaaataggaataagaacatttattttttgccttcaaacgaccaaggattgtggtgcatgtgaagattaatgaggtcatctggttaagctcttctccctgggtggaagaacaatggcttgtgaatactaagtggcatttgaatcatgtgtgctttcatggaaagagagctggtccatttagctccccgtctgcagggagttataaaagaagaaactagggaggaagaagctgaaaatatttcttcatgactatttcctctggtgaagcataaagtagcaatgagaattctgagatttgtttgcgtgatactttagtcatgcaccacataaagatgtttcggttaaggacaagttacatatgtgacggtggtctcataagattataatagaaattaaaaattcctattcctaagtgacatcatagttgccataacatcacagcacaatgtgttactcacatgtgcgtgatgatgctggtataaacaaatctattgtgctgccagtcatatgaaagtatagcacatacaattgtgtatggtacataatgctaatcatgataataaagattatgttattggttgacatacttactatcctatatttgttattttagaatgtaccacttctacttataaaaataagttaactataaaacaacctcaggcaggtccttcatgagatattccagatgaaggcattattacagagatgatagctccatgtatgttattgcccctaaagacttctcgtggagcaggatgtgaatgtggaggacagtgatactgaacctgaccctgtatatgcgtggattaatgtgtgtgtttgtgtctttttaacaaaacagcttaaaaagcaaaaaaaaaaaaattagaaatgtaaaaaatagcagaaagcttatagaataaggatatgaagaaagaaatatttttacagctatgtgatgtatttgtgttttaaggtaggttattataacagtcaaaaagtttttttaattaaaaaatttataaggtaaaaaagttacagtaagataaggttaatttattattgaggaaagaaaattttaagataaatgaagtgtagcctaagtatacagtagtctacagcagtgtacaacgatgttctaggccctcacattcattcaccacccagtcactggctgacccagagcaagctccattcatgtacatcatttcaaaatcttttataccatgttttcactgtacccttttaatgtatagatatgtttagatacacaaataagtatcattgtgttactggccacaatatacagtacagtaacatgctatacaagtttgtagcctagaagcaataagcaacaccatatagcccagctgtatagcagattatgccgtctaggtgtgtctaagtacactctgtgatgtccacataaggatgaaattacctaatgatgcatgtgttagaccagatctctgttgtgaagcaaagcataactataaagactctgtatgcaatataatgtaaagagagcaaaaccctcacaatgtgagttcatgagtttatacctgttagcaggtgtgtgtgggaaataacctgtctacctaaggttctgtgtagataccttaggacacaaggacaggtgtatgtgacctgtctacctaaggctctgacccataaccgttttttatgctctaatcaaattgtctttttaatcactggactctccctctctctcgtacattagttagggtagactaactactgaaacatacctcaacatatcattagattaacccaatagcagttcatttctctctcagatgtttctagctagtgggtgacatttcatataatgattcaggaaaccaagccttttccatcctatggctccatcatcctctgggcctccccattagctagcaaacgcgataagaatgcagtgaattataggtggaagatgattatgagcgaagtctgagagtggcacatgtgatttttgactcacatttcctaggctagaattcagtcacatttccacacacaggaggctgggaaatgtggtagagctctgccctaagaaaggggacctgattttggtcagccacagacattgtcaagcataaagtgtttccagtcatttgccctcccattttataatctaccaggtatatggttaattcatttaacagaagatgctggagatggaatttgtcattctgtttactctgttgcagctctgcagctattatactagcttctcgattttcattaaatatatctcacactattttgacgggtgctttttaacctttctgttttctccatatactaactgcattctccaccttattacttgaaagggagatttcttctccactgagcattgaaagtgttcaactttgaaaatgtttattgtcagtaagctttgatggtgacaagcatgcctgtgactgtctgtgatttccttaggaatgtcctggtggaacttattaattcctggatagaaatctaaaaatatgtttgttatttttagttttttattctgagactctcaagggaggggcagggttctctttggaatgatgtgtaatataacgataaaatgattgaatattgtgaaattatggagtgactttgattagtgtaggcagtcaatactaatcaacacacacaaagcaatacaaatgttcttgctcttttaactcaatgttttatatgatgtgactcttaatgattgataaatgatacgaaagaaaagataaatacacattcacccaaactgttacttgtcacaagaattgccaacccaagtagccatgaaaagcataggtttatttaacctttgacaaaacttctcaaaccattcatgaaaatggaaagcttcaaggaaaataaatgaacaaaaatatcccccaacgattgtctgtctttaggccgtagagtgtagtgtttaagagttctataaatggactacccaggtttaaatcctaggtataccaaatgctacctgtaattcttggcaagttaattctgaaacttattttcctgttttgtaaagggaagataataaaaataggacccgtgatgtcttagcaggaattaataaaatgatgtttgtgaagatcttataacattatgcatggccggtagaaaacacttgataaaggttagttgtggtaatcacagagagaagaaaaccatcttcttacagagcaaaagaacttaaaacaatgcttctcaaaattttgtgggcatagcagtcacctgagtgtcatgttaatatggcagattctggttctttaggcatggcatggagcctgagattctgcatttcttacaaatttccagatgatattgattttgctggttcgtagaccacactacgaatatcaatgaattaaacttcagttatagttatatctttatctaaatcttggattatctgctctttagctatgaatgtaatcattcgattcctggcaaatgatgagaaggaaaaaattactcttcgtgatgcaaaatacttgagaaatttccgtaagtaagcaaaagatgctgttgagctagatgtctgaggaacaaaagaagttatccaaattctcattcatgccgtaatttggtgacaagaattattatggcctaggaatgtagttttaagagccagtgaagtaagagtaatctgcctcaatattaatgaggctttttgacattctgatttcttatttatttcttatttgctgttttttgtttgtttgcttgtgtgtttgtttgagacggagtctcgctctgtcagccaggctgaaatgcagtggcacgatctcggctcactgcaacctccgcctcccgggttcaagcgattctactgcctcagcctcccgagtagctgggactacaggcacgagccaccacactaactttttgtatttttagtagcgatggggtttcaccgtgttagccaggatggtcttgatctcctgacctcgtaatctgcccgcctcagcctcccgaagtgctgggattcgaggcatgagccacagcgcccagcctttattcactgtttttaaataaactttattgagaaataagttatatagaatgaaatgcacattttaaatgtacagagattttttttccaattttttatattggtaaaatataagtaacataaaatgtaccatcttaaccatttttaaatgtatagtttagtggtattaagtgcattcataatgttgtgcaaccattaacactatttatatctagagcccttttcgtcttttaaaactaaaactccatacccattgaacaataattccctattcccccattccccagtcactggcaacagccattctattttctgtctctgtgattttgactacttttcatacattatataaatggaatcatacagtaagtatcttttgtcgctaatttcatttatttaatgtaatatccccaaagatcatgcatgttgtagcatacataagaattttcttcctatggttgaatactattacagtatatgtatatactacatttcccttatccattcatcagtcaatagatacttggattgcttccatgttttggctattgtaaataatactgctatgcacatgggcatacaaaatctctttgaggccttgctttcgattttggtgggggggtggttacagagagctggaattactgcatcatatggtaattccatttttaatatttttgaggaactgccatattgttttttacagcagctgtaacactttacattctcaccaactgtgcaccaagggttcttatttctctacatcctcatcaacacttattaccttctgttttcttgatagcagccatcctaatgggtgtggtgaaatcttagttttgatttgcatttccctaatggttagtgatgttaagcgtctttaatttctttcagtaatgttttatcgtttttattgtgcaagactttcacctccttggttaaattaattcctaaatattttatttattttgatgctattgaaaataatttttttataattcccttttcagtgtgttcactattagtgagagtggggtattggagtctccaactatgattgtgcaactgtctaccccttcaattgtcttttttttacttcatatatttgatggtctgttattatgtgcataaaagttcataatcattaatcatcttgctatattaaaattttagtaatatgttcttcgtctcttgtaaaatttttaaaatttagtctatttagtctgagagtgtagccacaaccacccttgcactctttgggataccatttgcatttctttcatcctttcactttctatctgtgtctttgaacctaaaatgagtctcttatagacagcagatagttggattatgtttttcaatccattccaccaatctatgtcttttaattggagagcttaattcgttactgatacggagagacttacttctgtcattttgctatttgatttctatatgctgtgtagcttttttgttgcctccccagggttagctgggtttttttttatctcttccttttggttttttgaatgttgtagtttaaaaatattgtctctgtaccaaggattagcctgatgtgtaaacctaaattctttccagatcttttctgcacttgcacctttctcagggcatgtgtggtcactttctgatattccctatacatgcagtttctttcaaatttcctagtctttattgtcagcctcctatgcacagataaagagaaaaatgaagggaatagggataaggcactggaaatcattcagctggagggaagggggcttccaccaatgggaagaagtgcaacagttatgacagattctttgtctgcacttttgtaatcagaagcaataatcagcaatcagtgcacggatacccagtatttggagtacgtgatcctttttgcccactctgactcttactagctatctgcaggttgctccaggagcatgcgtacagctacctgccacgaggattggggtggggaatgggtagctgctattgagtatatgctggaatttgctgaaattaaccacaatttatcatccaagccttcccctggaagttgcaagccttcaacatacttcagagttacaaaagagttgtatcagacagattctacctgtgcaattgttgtccaggtggggagacaaattcttgattcttcatattccaccttcccagaatcccctatctgctggttgtgtatagaatctctttgagctgttgcctaccattttggcattattctggcattattatttctcaatatgctaaagaaaagactagagatttaaacggtagacaataactagcctttaagtttgtatagtatttttttgcctcctgtttttgatagatctcattgcactatttttcagagcagtgtcttaggattcctgctagattatttaatttaggtcactactgtttctgttaatatcatttattttttccccttaattgtccttttaactatgtataatcctgctgaatgtatgtcattgttgggagtgctctaatattcagattttgaatccactggtcatttctcttttgaatattcattttttcttatcttccttcaaagtacgcttatctttatttttatggaattctatagccaagccaagacgtggtacatgatgtacgtgatggcttgcaggtaggctttgaagtctctcaagagggttgcccttcattctccttgcacctatcctgctgctgtatttccatagtaaatggcatgatgcccccaacttagtgaaggtggatggtgaagctcccagagcctggaaacccagagcactcacctgatcaacatctcagttcccacttcttgtcacaatgtaccgcaaacattgtgcatcctcagtgcacacgttttcagtttttacaaccaacagtcctatttatcattttattataattgtcagctgaatgatctatgcacattttgtgacaacattgaccttttgggaggaaaaatagtctgtacttaagggttcatttataggggattgttctgttaaaaatacaacacatagagaaaaaagaatgtgataactgattatatttagtgatgcatgtataaatatacatatgaaaacttatgaagtcatggctctttgggaaataaaaatgttgaaagagagcccagttacacactttgacatctcctagtttttcaacagaagaaccattctatattacctgtttatagacactgaaaagggggaaagggcattaagattaactgacaataaataaatgtttaatatttttcgaaaattgagcatcaccttatatatgttaactcagtccatttcaactgtatgtagtagaaaaagctcatattcttgtgttacaaatattgacaaggaagaagaggtaagctttgatgcatacctaaagtgaccaaaagttagtgacagagccaacctgttaacaaaaccatgctgaattccaacactatgagaaaactgggattgaaagtaaatgctcacaccccaaagtgctctgatcatacttacttgatatctctgcttgtctccaaataattatctttgaatcctatccacgtgattctactctcttcttaaactgcccttctacagatttcttctccatgggaaaccagcagtgagagacatggcagtatagacatttcaagaagaatgagtgatagccaccaatgatttggtaatacaaagcttgtgctgcccatcttaatattttattaatatgaaaataaatgatataaaacatccgtttcttctaagagtatctttagctgtgaatatacatctaagacagttttaataaatatgtggggatttttggtgtaaatgtgttatccagcaagagggaagacagtagaatccttggaggcagaggttactgtctgacagaaagttatttggaggtaaaagttctatttttcttgcttgtttgtttgtttggttggttggttggtttttaaacaatgtcagtcatacaatgcctctcatagagtaggtactcaaaatatatgtgtgaaattaatgttgcctctccacaatttctccttgtggaataaatttttttaaatggcttttagttttaaatcatcttcatgaacatttcctgaaagagagagagagacagatagtgctttaatttctatcatctcctatgaagtatacaaatggtcaataacctctaaaattccttagtagcctatgttactgtcatccaattataatttcttgcataacgaagaccttgactctggattatcagtaatgacatttttggacatgtgtgaagaaacagcaactttttgtagttttgattaataaagtggccatggagatatctttgtggcctttaatgaactttcttttctgattcttcttacaatttgatagccttcttccaaaagggaaaaataagctcctcttgaagcctgggataatgcaatagcattgaggattaaattgatgaattaaaggtaagaggcaatttggggagctataattataccagtggcctcgagaagactatactatctaacagcttctgttatttttctgactacaccatggcatcactgggaggctcctcgcaatctactatgatcagacattcgtagattgtttcttttttaaaaaaaaattatatttcagatacagagaatatcatggttttggctaactcatatatatggcccttggaagtaaagttttgtccattagttcaaggccatgttcccagtgtcttgaacagtgcctggaggagcaggaactcaatagatattttggataaaggaatgaattaattgctcaattgaaaaatgtctatggcttcaattatctattattgtaaacctttaacaatagaggtattgaaagttttctgaatactatcattgaattgatatataagtatgaaccccttgaaaatagtaaaattatctggtaatcacttctgatcatgaatttcaccacttttcagatggaaagagaataacgtctctaatttggatccagaaatctgagattctggatttaagggaactggtgttaagtgcatttgttgataaaagttaatcttactgggccaggcacggcgacgcatgcttgtaatcccaacacttttggaggccaaggcaggaagatcacaaggtcaagagatcgagaccatcctagccaacatggtgaaaccctatctctactaaaaatacaaaaattagctgggtgtggtggtgtgcgcctgtagtcccagctactcgggaggctgaggccagagaatcgcttgaacccaggaggcaaaggttgcagtgagccgagatggcacgactgcactccatcctagagacagagcaagactctgtctcaaaaaaaagtaatcttagtgacaagtcatttactatgacttgtcatggttttccaaagttgaagcaatggttttttataaatatggtagatagccagtcaaatggaaatggtatgataagcattatacaaaaaaatagaactgaggcaaacacctctgcccaaacaccaacctgatagtaggctcagatgattaaaaaaaaaaaagtactttattttttttagagcaataggtattaaagaaagaagtcttttgaagatagctaaacattttggatgttaattaaaaccctattctatatgtgggttgaagcatagtttaggacacttctaggtaaatgtggtttatttctaaacaccaaatagaaaagagttcttagaggacacatttaagattattcaagatttctgtacagtgcaagaatccattgcggaagaaaagaaagagaaatttcttatttaagttaatgggaggaaaaagaaaaaagaatatttaaagcccaataggaatgggaagaatagaagaacttatgaagaataatgtttagtgaaaataacattctagctttctatataataccagctaaaggagtgtatataataaataatgaaaatgctagtaaccagaattaagcatatccagtcttttagaaaccaattcttaccagatttctgaaagataaatatttaactagtttttctatgtgtggtggactatgtggattcaaactcttccttactaattttactgttactttttaaacatgaggctgctgaagaataaccaaattctacattgtcctcaaggaagacacagccaattatatacgattgatttatttaattttgtcatttttttcttctttcataaaaaatcaatatagtttgaaaataaaatagtttacataacttagctttaactgaatgtaatattcaattagatttcaccaaataactatttcaataattcagcgttctttttcctcctcccctttccaaacactatctgtcttttctcctcccagtcaaactagttaatttgtcaggaatcgtgtcacgaacataaacattctgataatagtccctctttgcaaacagaattgatggcaatataaacaattgctctaagtaagtcagcatttaagtttgccaacattgcccttttaggctctataacttaccgagaactcatttcattttgagaacaacttattggtaaccagttaaaactagcttgatcttttttatttcaaatgttttatatgctcccagagcaaaaaaattaattaattatcacttgcatctggtacagaggtagggattctatatgaaacttaccaactgtgtaatgcagataaagtttctaatcttaattaaataccagttccattatctgaaagtaccagttcatatctaatgtttaataaaattccttacaatgactcctcatctcacttagggtaaaagccagtcagaataatctaaaaggctcgtctacagttaaccctctcctcaccttcttgcttcctctgttcaattcactagggttctctgctgtctgaaaatttccaaggcacgttgtcatataagagcccgtgtgtactggcatttcctctgcctggatgggtattctcccgaatatccatttgcctcctttatctctttcaagcatttgttcaaatgtcacttgataagttgaccaccctgaccatcctatggaaaaatatgtctctgctacttcagtacttcctatctttactcccattttatttttcattacagcacatatattaagtgctttacttttcaaattgtctgttttcaaccactagaatgaaagcatgatgaaggcagggatttttgcaattgttactgctgtatgcccagggcacaaaacagtgtctggcacctagggaggacccactatatgttttgatatttgcttaatgaatgagtaaatgcacatttactgcatcttatattttcacagggctttcagactttttctttctgtcagtagaaatgtgtacttttgggttccagaatcttatatggctaacatgtgggttaatgagaaagctaactcctttttatacttgaatggagggaatggcacatacataatcaaatatacgatttgattatgcaaaaccaatttttatcattaaaccattctattaagttaatattaatataattgaaagcagtatcatttgcatcatcggcattaatttcataactttttaggaaaagctatatgaatctgccaaaaatatttaatttttaaaaaataactggttactttgtatagaaataattttaatatttagcatgcttatacaaatgggaatgagcttatcacagttgttaatgagtagccttcaatttgttagctttgaagttcaatcatttacgtagcacctactcacctaatttattaatctactattaagttcaaggattatcttgctaccaccaaatagggcgaaaaagaataaaaacagttttactgccctgtcttgtactcaataagccaatgtttgaaattatctaaaaatgtaaattaatatttaatatttaaccaaattgtttccctgctgcaaaaatatctgggaaataatgttcttgccctcctttccccaaataaattgtaaagataacaaatggaaaatattggtgataattggacaagctatggcaatctgaatgagatgaaatatgattttgaatagattgctacctactgtcaagttgacattgacatagattggaaaatatccatttttcttgtgtaaagaaccattacttggcttcatttaattctcgggcattctctaatctaatctatcccagtggtataaccatgtagtctctggaccaaacaacgtcagtatacccctgagaacttgtttgaaatacaaattcttgaaccctaccccaaacctattaatcaaaactctgagagtggggcccagtgatgagtttttaaacaactatttcagatagttctcatgcaaatagtttgagaaacactgattgttcctgttctgtcaataaatatgtagacactattatgtataagatactatgtcttatgcagaacagtaagatgcaaaatatatgtttcctcccatagaagaaattatcctgaagattactataaagattctgaaggaaagtcttctgaaatgacattctgctagcaaccatgaatattatttgttgaagaaatgaagcactgacccagtctttctctggcttttgttttatttttagaaatctctaagcccatatttataaatttaaatttgggagataaaagagtttaagtttaatataaaaacattagtaatcctgtcaggatgaaaaatcatattcatgtacaattgtaacacaaaacaaaataattcttttttatcatacctccataaattttgacttagaaaatcgagtaagaagtaaccaatcagaataaggataggagatgttcaccaagacacttcctttactatctttgaacgatacaattaatcactgtttcaatttctttcatgtcattctcattgtaaactatattagcttcttcatggataggatacatttgatattatatgtcagttgtccagacagaaaaacacaaaacactctaggtatttcagactaagagcctttaatacaggaattgtttacaaaaatgttaggactggaggagaaaagagcaaaggatgacataaatcagacattagaaaaaagaaattgctacttcccctaaggttggccaaccaaaactgaggagcttgtcttagcagatcttagggttacatacctgtctaacactgctgtaggactctgctactcagaactgccaccaataccactttgagagctgccaaatactactactggcctaggctggccctgccattttggtcagcagtgctagagcaagctagcagctaaactggaactgcaggtttgctggaacgtgtagctgcctactgatgttgaggacaaatctagaagccaagaaaaaaaaaataacacttgccttttttcctatctttcagtatcccactagtaactcccattatcagaagtaaccagaagttagctggaaaagtgttgtttgcagggtctcggcccatggaatacaaaataatgcacaaaagggtggaatgaagctaaaagaaaggaggtacaatacttacacagatgtgaggacatatttttaaaaaatcagttggacttcacagaatcacagaatttaagagcttgcctgatccttgatatccttttgcctgtgctattttttgaaattttaatacttttcagttatataactgaggttttgaaagaaaatctgaggaataagttcattgtaaaatagataaaggcaaaactgtgtggaaactgatgttgaaaggttagatccctgcctgtagtgggcactattgggatgccattgtaccccatcattttcccctttgccagattgactgatgcgtttcccacttagttgatggaagtgttggtttcttctggctcacagctgccctgttctctggaaaattgccctgggctgaatggaggtgccccacgccctctgggtaggcttgctgctctgacaaaaagctattctccttgtctcaaggcagagccagcctgtggtgtggagtgtgctcccgaaccctcatgggagagaccaaagctagactttaccttaaactatattgtcacttggctcttctttcttccccttacggctttacctcacctacttcactccctcaataaatcacatgtcctgaatccttgtctaaggttctgcttctaggtactccaacctaagatggtatccatactgtttctcctcactctcaaatttgagcttcacatgagttgcctcattttacagtagacaatactgagtcacagaaagtcatctatctaagtgccttgtccaaggtcatgttgctttaaacctagtgttccagccctagattcattgtaccacacggtttttaagtctcattaaaataaaaaaatcaggatatttttgtaatttcccttaagatccgcaaaatgaagtccggagtgactggtagataaaaattattgatttaaaaacaaagctgtcattgaggtgttagattaaatgactcctagaaacattgtgggggttccatgggtgatttttttcagccttcacatgagtgtacattctcttcctcattccactttcttcctcctttttgttgttcatgttccttttcatgttcagtgctagttttgttgttgttttttaaaccacctgtgctgaaggaaggactggtttcttactggggcgactgcacacatgagtatgcaataactttgattcagctagcaagtgcgctttcatagaatcatgcctgggaatctttctgaataaatcttacactggtgtcctttgccaaacttcgcattttcaaattgcaggtcttatataagggctttcaacttaacatttgtcagtttttgtttttgtttattagcttctgatctcttttaacaaagagatcattccatgtaatcattccttataatatttgataggtctttggtgctagtcaaatacttttctacacagtaaatgatgtttaacatattcctacctacataaaaggctaaacggacccttattatgggttaaatggcgttctcccaaaattcatgtgttccttcccccatctataaatctgaccttatttggaaatagggtcattgaagatttaattagttaagaaactagtaggcttccagttccaagaaggccaaataggaagagctccagtctatagctcccagcatgagcgacgcagaagacggatgatttctgcatttccaactcaggtactgggttcatctcactgggacttgttggactgtgggtgcagcccacagagtgtgagccgaagcagggcagggcatcgcctcactcgggaatcacaaggggtcagggaattccctctgctaaccaagggaagccatgacagatggttccgggaaaattgggacactcccaccctaatactgtgcttttccaatggtcttagcaaatggcacaccaggagattatatcttgcacctggctcagagggtcccgtgcccacggagccttgctcactgctaacacagcagtccaagatcgaactgcaaggcagcagcaaggctggtggaggggcgtcctccactgctgaggcttgagtaggtaaacaaagcggctgggaagctccaactgggtggagcccaccccagctcaaggaggcctgcctgcctttgtagactccacctctgggggcagggcatagctgaacaaaaggcacagaaacttctgcagacttaaacgcccctgtctgacagttttgaagagagcattgcttctctgagcacggagtttgagatctgagaatggacagactgcctcctcaagtgagaccctgacccccaagtagcctaactgggagacatctcacaataggggccgactgacacctcacaaggccgagtgcccctctgagacgaagcttccagaggaaggatcagacagcaacatttgctgttctgcaatatttgctgttctgcagcctctgctggtgatacccaggccaagagggtctgtactggacctccagcaaactccaacagacctgcagctgagggtcctgactgttagaaggaaaactaacaaacagaaaggaatagcatcaacgtcaacaaaaaggacatctacaccaaaaccccacctgtgggtcaccatcatcaaagaccaaaggtagctaaaaccacaaagatggggagaaaccagagcagaaaatctgaaaattctaaaaatcagagtgcctcttctcctccaaacgaacacagctcctcgctagcaatagaacaaagctggacggagaatgactttgacaagttgacaaaagtaggcttcagaagatcagtaataacaaacttctccaatctaaagcaggatgttcgaacccatcgcaaagaagctaaaaaccttgaaaaaagattagacgaatggctaactagaataaacagcatagagaagaccttaaatgacctgacagagttgaaaaccatggcacaagaactacgtgacacatgcacaagcttcagtagctaattcgatcaagtggaagaaagggtatcagtgattgaagatcaaattaatgaaatgaagcgagaagagaagtttagagaaaaaagagtaaaaagcaacaaacaaagcctccaagaaatatggtactatgtgaagagaccaaatctacatctgattggtgtacctgaaagtgacggggagaatggaaccaagctggaaaacactcttcagggtattatccaggagaacttccccaacctagcaaggcaggccaacattcaaattaaggaaatacatagaacaccacaaagatactccttgagaatcagagcaacccctagacacataattgtcagattcacaaaggttgtaatgaaggaaaatatgttaagggcagccagagagaaaggtcaggttacccataaatggaagcccatcagactaacagtagatctctcaacaggaactctataagccagaagagagtgggggccgatattcaacattcttaaagaaaagaattttcaacccagaatttcatatccagccaaactaagcttcataagtgaaggagaaataaaattctttacagacaagcaaatgctgagagattttatcaccaccaggcctgccttacaagagctcctaaaggaagcagtaaacatggaaaggaataaccggtaccagccactgcaaaaatatgccaaattgtaaagaccatcaatgctaggaagaaacttcatcaactaacaagcaaaataaccagctaacgtcataatgactggatcaaattcacacataacaatattaaccttaaatataaatgggcgaaatgctccaattaaaagacacagacttgcaaattggataaagagtcaagacacatcagtgtgctatattcaggagacccatctcatgtgcagagacagacataggctaaaaataaagatatgaaagaagatctaccaagcaaatggaaaacaaaaaaaagcaggggttgcaatcctagcctctgataaaacagattttaaatgaacaaagatcaaaagagacaaagaaggccattacataatgtaaagggatcaattcaacaagaagagctatgtcttaatatatatgcacccaatacaggagcacccagattcataaagcaagtccttagagacatacaaagaggcttagactcccacacaataatgggagactttaacaccccactgtcaacattagacagatcaacaagacagaaaggtaacaaggatatccaggccttgaattcagctctgcaccaagtggacctaatagacatctacagaactctccaccccaaatcaacagaatatacattcttctcagcaccacatcgcacttattacattcctcagcaaatgtaaaagaacagaaattataacaaactgtctctcagaccacagtgaaatcaaattagaactcaggattaagaaactcaataccgcacaactccatggaaactgaacaacctgttcctgaatgactactgggtaaataacgaaatgaaggcagaaataaagatgttctttgaaaccagtgagagcaaagacacaacataccagaatctctgggatacatttgaagcagtgtgtagagagaaatttatagcactaaatgcccacaagagaaagcaggaaagatctaaaatcaacaccctaaaatcacaattaaaagaactagagaagcaagagcaaacacattcaaaagctagcagaaggcaacaaataactaagatcagagcagaactgaaggaaatagagacacaaaaaacccttcaaaaaatcagtgaatccaggagctggtttttttttttttaaaagatcaacaaaattgatagactgacagcaagactagtaaagaagaaaagggagaagaatcatatagacgcaataaaaaataataaaagtgatatcaccaccaatcccacagaaatacaaactaccatcagagaatactgtaaacacctctatgcaaataaactagaaaatctagaagaaatggataaattcctggacaaatataccctcccaagactaaaccaggaagaagttgaatccctgaatagaccaatgacaggctctgaaattgaggcaatagttaatagcctaccaaccaaaaaagtccaggaccagacggattcacagccgaattctactagaggtacaaagaggagctggtaccattcgttctgaaactataccaatcaatagaaaaggagggaatcctccctaactcattttatgaggcctgcatcatcctgataccaaagcctggcagagatacaacaaaaaaagagaattttagatcaatatgcctgatgaacatcgatgcaaaaatcctcaataaaatactggcaaaccgaatccagcagcacatcagaaagcttatccatcatgatcaagtgggctttattcctgggatgtgaggctggttcaacatatgcaaatcagtaaatgtaatccatcatataaacagaaccaaagacaaaaaccacatgattatctcaatagatgcagaaaaggcctttgacaaaattcaacagcccttcatgctaaaaactctcagtaaactaggtattgatgggacatatctcaaaatgataagagctatttataacaaacccacagccaatattatactaaatgggcaaagattggaagcattccctttgaaaactggcacaagacagggatgccctctctcaccactcctattcaacatagtgtcggaagttctggccagggtaatcaggcgggagaaagaaagaaagggtattcagttagcgaaagaggaagtcaaattgtccccgtttgcagatgacatgattgtatatttagtaaatcccatcatctcagcccaaaatctccttaaactgataagcaacgtcagcagagtctcaggatacaaaatcagtgtgcaaaaatcacaagcattcctatacaccaataatagacagagagccaaatcatgagtgaactcccattcacaattgcttcaaagagaataaaatacataggaatccaacttacaagggatgtgaaggacctattcaaggagaactacaaaccactgctccaaaaaaaaaaaaaaaaaaaaagacacaaatggaagaacattccatgctcatggataggaagaatcaatattgtgaaaatgcccatactgcccaaggtaatttatagattaaatgccatccccatcaagcaaccaattactttcttcacagaattggaaaaaactactttaaagttcatatagaaccaaaaaagagcctgcattgccaaggcaatcctaagcaaaaagaacaaagctggaggcatcacgctacctgacttcaaactatactacaaggctacagtaacaaaaacagcatggtactggtaccaaaacagcatggttctggtaccaaaacagagatatagaccaatggaacagaacagagccctcagaaataataccacacatctacaaccatctgatctttgacaaacttgacaaaaacaagaaatggggaaaggattccctatttaataaatagcgctgggaaaactggctagccatatgtagaaagctgaaactggatcccttccttacaccttatacaacaattaattccagatggattaaagacttaaatgttagacttaaaaccataaaaatcctagaagaaaacctaggcagtatcattcaggacataggcatgggcaaggacttcatgtctaaaacaccaaaagcaatggcaaaaaaaagccaaaatagacaaatgggatctaattaaactaaagagcttctgcacaggaaaagaaactaccatcacagtgaacaggctacttacagaatgggagaaaatttttgcaatctacctctctgacaaagggctaatatccagaatctacaaagcacttaaagaaatttacaagaaaaaatcaaacaaccccatcaaaaaatgggtgaaggatatgaatagacacttctcaaaagaagacatttatgcagccaacagacacatgaaaaaatgctcatcatcactggtcttcagagaaatgcgaatcaaaaccacaatgagattccatctcataccagttagaatgacaatcattaaaaagtcaggaaacaataggtgctggagaggatgtggagaaatagcacttttacactgttggtgggtctgtaaactagttcaaccattgtggaagacagtgtggtgattcctcaaggatctagaactagaaataccatttgacccagtgatcccattactgggtatactcccaaaggattataaatcatgctgctataaagacacatgcacacatatgtttatggtggcactattcacaatagcaaagacttggaaccaaccaagatgtccatcactgatagactggattaagcaaatgtggcacatatacaccatggaatactatgcagccataaaaaaggatgagttcatgtcctttgtagggacatggatgaagctggaaaccatcattctcagcaaactattgcaaggacagaaaaccaaacactgcatgttctcacttataggtgggaactgaacaatgagaacacttggacacagggtggggagcatcacataccggggcctgtcgtggagtgggggaaggggggaaggatagcattaggagaaatacctgatgtaaattatgagttgatgggtacagcacaccaacatggcacatgtatacatatgtaacaaacctgcacgttgtgcacatgtaccctagaacttaaagtataataaataaatttttaaaaaagaaattagtaaacttaatttttcacctgttacgcctctcttccagtttccaaattcaattattcatattactgcttctacattcagttttataagatttacattttattaaacaaccatcataaccaaaattgttcactttagttctgtatttaaatgcaatcagtagtaactttgaatcattttatataatgactgtgcaatccttaaattctcatattgatatcacagttttctagattttgtcaaccagtagcttttgagagaaatcatatgagtgctatattctaatatctgtgcatatttttaaataccttttaaaaaatatacatgatgataactttactgggtgtaaaacacatgccattttttccccttcaaaactaattgcagcatagttttgttttgtaatttctttgcttgctgtattagtccattcttgcattgctatgaagaaatacttgacactgggtaatttatgaagaaaagaggtttaattggcacatagttctgcaggctgtacgggaagcatgacagtatctgcttctggggaggcctcagggagcttttactcatggtagaaggcaaagcagaagcaggcgtcttacatggccagaacaggaccaagaaagacagaaagctacacacttttaaacaaccatatctcaagagaactcactcactatacagtactaagggggatggtactaaacaattcatgagaaaccaccctcataatccaatcacctcccaccaagccccacctccaacaatggagattaaatttcaacatgagatttgggtgaggacacaaatccaaaccatatcacttgctttgatgtttgttttcttccgatgatagtgttgctaaagtgagtaatcctgaattactatctgatcgctaacaagctagatgccttaataattttttctctgttcttgaaattaaatagttattgcttgttctgcaacaaaatttttctaaagtttggtagtcaattttcatatgtagatttatgaaagtcttcattaatttttttttagaaatggctttttaaaatttgaatatttttgtttggtgttatttttttgaaagcctgtgcactttataggtgactcattttcaggagtatctattcaaacgctcattgcaaatttctccacatttgacatatatacttcaacatctgctctctgaacttgtggcatttttccagttttactgtagacagcctcagattctgaaattttttgtccttttcttctttttattgggttttctggaaaataggcccttttttccacaggcagtctaggactattttcctgaaaattagatataatgaaggataacctaataagagttgttacactcttggggttagtgtaatgtaatagaaaaagcaccagaatgtgagtcagacaagctgaattttaactaggattctgtcacataccagctctgtggccttggttaaatcaccaaatactctgagcctcagtttctttacaaagtttttgtgagaattaaataaagaacctgcatgaaatcatgagtaagttacatgagaagtataaatcagaatgctagcgattatttatttaaaatgaactatggggctaaagaaagtaaggttactacattaaggaactaggaaccagtccttccatcatgctcagctctggttaggcctgtgctcaagttctctgccccatttgtcaattcctgttaatacatgattcattgaaaccttggttgatataaaatattctagtgacttggggatggtgggagataagaagagaagggatttcaaaatatatgttaaataggagttttgctttcaagtatttacctttgaaaatttgaaaataattgaaaataattcagaggagatttatatatatattattaggggttaggaagtagttcttacaccaaacagtaaagaaaaactgatggtatttttctttgaggagaaaagtctgaaagaagatttaatattccattacttgtgatacaatggagattaataaccaaccaagattctttgtctccaataattatagggcaaatgaaaactggctttagttgcatcagtagtaatctccagagagtgaaaacagggtcggacatctttgtaaggaagagtcacccacttgtgatctcagggattgatgccataatttccatatacaaattttatggtttgacaaaaaatattttgtcacccatgaggaggcagtcacccaagaaagagatagtataacaattaaaaatttgagagaatgagttactggagaaggctacgggatactggattcttgaagggggaagaagtttatatcaggtagaggggaaagattcaacatatggagtccaggggcccatctacccctccattttattgagatccaaccctcagtaggagctactagccactgactggctattgactgagatgatataatcacctttcggcacactttaaaagctgaacaaataatttacaggtatcttacattatttcccaaacttcctgacaaccatttagtatggtggctacatcaaaatggtttgagcaagcactgctccagatagtcctagaatcacagcttcagaatcacctgggagcttgtcagaaatgaaaattcatgggcaccacctagacctgctaaattagtgtctctgcaaatggagtcccagcattctgtgtttccatatgctctccagatgagttttatgcatgataaagtttgaaaaaccactgatattgattactctttacttgtgaagaatatatatgagcttcttgtatttatttttcgactcaacatatacccatgtgcaaacaaccaaaaagcagagtaaaatggggttttgcattatccgtcgatttttctatttttgagccaatctcttaatagcatttattagagtcacttttgccatacaatagattgccaagatcatgattaagaagcttattaaaatgaatttaaaatgtttaaatggaaacgacctggagatgtaattgccaaaatttaatcaagcatttaatttgtagctcataccagccaaatggattttcctttttttcagttccctgtttgtacaaggaaattaaaaagtatggaatcacaggccaagcagtgaacccttgatactgcagtgtgctcacttactctcattagccgtattatatcatcctactcctttggaattttagtttcccaagccagtctagaggatagataacaattgactgtatatatacacaatgggtgagttaatatgctttagcaataatttatactacttgactgtatatatatatatatatattatacatagtgttataaattactgctaaaacatattgactcaccccatcagcattaataaaataggctaaatattctgatcttaattctgcttgtttaaaattcccttgttttagcatgcctgtctagctgcccttaaattgctaaactggggagaagtgtgatttagaattggaacatatttcatgtgaatttgatgatggccaccgctgataaaatacctttgtgttgcctcttccattctgccagtgataataggttttcactgagctctttgcacttgttttacaaaggctcaagccttgaatactttgtgcctcacagtatccatcatttagactctgaaatccccagtgtcgatttgacagaacagtcgtttatcagccacggtttgccaagtcagcattaatgcctatgtggcctgaggaaaaaaataaataagatcagtgatgttctaatcaagctcagacaaacatgtttttatacttgcatttgagtgatgttttgcctaacagaagtgctgggttaagatacattaacttgggtcccattctattctctcttgctctggatgtgatgagcatagcgagttctaagcaaaatagtgcgtgtttttctcctctgagtagagttttgttggcatttcctaacgcttctttatgaaaaagaaaatcaagactttccagtaacaagtcattctatctaatttcacttggtgcaaacagtgactgaaatatttcttgattttaattagaagaaagcaagagaaagacagaccacaagagtttcatgaagagataggcatatattgtaaaatttccctaacattttattataaaattcccaaatacaatcaaagatgaaaaggagtttacagtgagctcactgccttaactctacaatgaaccttttactattcttgttttattatatgcccgtcactctttcattcatcctatttttttcaataaggcatctattacaggtatcagtacacttcacttctaaacattcagcatgtatatcatcaactagagttcaatgtttctatttttcctcttttaggatggaatttcaatacaatgaaatacaggaatcttaagtatgctgtttaatgagctttaccaaatgtatttacctgtgtaacttaaaaccctattggagaaataacattgctgtcaccctggaaattaattcatgtatgtatgtctgcattgatgcatacatactgctagacctctgatacttttcttaatttaataaagagagtccactagtacattacagggtagctgtgggggctgacatgttcatctctctgctatctttctctactctcttaatgaaaattacattctgctcagcctacttgttggcctatatatcctgcacttactgaatgatttcttaaatgttcttcatgaaatgtttcattaaaattagtgtaagaatgaaaaaaatgtacaaagagaaagctaatcagcttcttctcctaccaacacctccaacataagtaaatagcctcatgctgactgatctataactttatttttttttcttcagcttttattttaagttaatgggtacatgtgcagcatgtgcaggtttgttacgtaggtaaatgtgtgctctggtggtttggatcacatattatcccatcacccaagtattaagcccagcatccattagctagtcttccttatgctctccatcccccacacaatccccccagacaggccccagtgtgtattgttcccccttccatgtgtccatgtgttcaatcattcagctcccacttgtaagtgagaacacacagtgtttggttttctgttcccgcgttagtttgctgaggataatggctttcaaccccatccatgtccctgcaaaggacatgatcttcttcctttttatggttgcatagtattccatggtgtatatgtaccacattttctttatccagtctatcattgatgggcatttgggttgattccatgtctttgctgttgagaatagtgctgcaatgaacacatgcatgcatgtatctttataataaaatgatttatatttctttgggtatatacccagtaatgaaattgctgggcaaatggtacttctgcctctaggtctttgaggaaccaccatactgtcttccacaatggttgaactaaaatttgcacttccaccaacaatttaaaagcattcctttttatctacaacctcaccagcatctgtcattttttgacttgttaataacagccattctgactggtgtgagatagcatctcaatggatccacaactttctttgtgctcaccaatcttacgaaaggatggcttgatgcaggaaggcaattagatgtttgtttgtttgtttgttttgagtcggagtctcgctctgatgccaggctggagcgcaatggtgccatcttggctcactgtaacctcctactccctggttcaagtggttctcttgcctcagcctcctgagtagctgggattacaggcacacgccaccatgtccaggtaattttttgtttgtttgtttgttttagtagagacgggtttcaccatgttggccaggatggtctccgtctcctgacctcatgatccgccggccttggcctcccaaagtgcggggatgacaggcatgaaccaccatgcccggctagatgctagtttttaaacaagctctgattcattgataatgatttttggctgcttggggtgctgtgttaggaaggatcctgtctatacttagtggaagagtaccaagatttcttacagtttttgccacaggcaggagttgaaactggaaagcaagggagtgggtggcattcctttcccattgtaggtttggggagcgaactgctgcacctggcaactgaaagggccagaagggcacagagtaccactctataacatttctattctggttcatttttgtgtcctattaaaacagctaatgtttctctgcaacagtgctattcacaaaaaggctgtccaagtagggtttggatacacaaagtaggaaagagagagagagaaggagatagattggcagaaactagcatattctatcattctaagaatgcaaacgtgtcaccatttgccttaaagctgatatactctaggaattactcttcctatgcaaagtgtacaattctaagtgtttaagtatttggatcactgttactgtgggataataatgtccagttcaacttcactgcttttctcagagaggcaaatagatactgggtcagtcaagattattcttagtgtgtcgggggcagaatggtggggtgaaaaatcaagctttgctttcattttttactacccggcttcctacataacacttcagcagatgtcaagaccatttgtttggttcctcatagcctccatgtgatctttctcttcactgcagtgttccccaggtgtgagttgctttgctcaagatcattttcaatgactcaattttcaaagcaaatgtacacacaagacagtagtattttcaaaaacacaggttatcacattttccaagggggatagacaagagaagggaggatgccgagaatagagtgtgagtttatttcacatagcaggtctcataaagattgcatccataaatgtgctgccaaattgaacaatagcagtggggaataaaggggaggagggaagagaggactcagatgaaggcaaagagaaaaaacaactttaggaaagtgtgaagtttaaggagacatgcctataacactggctttctacccagtctcatgctaactcctggctagaaatatatagggacacagacacacacacacacaaacacaccacctccttgaaggaagaaacattttatttaatcaggattgctaaggaatgttgctgctgataaggcgacagaaaatatttctgggagtgcattttcggaacttgggaacagagacagtctgtctgaacccagctcaacttttctttcttatcactttttaaaagcatgttatctttaagagccaaattaacttttcatgatatggtttctcagcagctgacacttgggcattacagggctggacaggaatgactaagcagttttgtaaaatgactatccccagagctgctggcttgctggttttggtgtcaatcatatatttaggatcttttttcctgtctagatttatgtagctctttaagaatagaattgcttggtccaggaaaggtgtgactagtataataaacaaaagaagccacagaggatattcttgtgagaaaccaattaattattcacaccaatatgttataagtacagttcattttctcttttgactattgcattacaaagaattttctcaatgcattcaggagatataattaataataccctaaacagtaattttaatagttatggtgttgtactgggaggcctatcaactaaaattcaaaaataaaataaacacagtccctacttttaggaagacaagagtcactgtatttaaatttttacttttgatgtctttattatttgtggacactctgaaaaacataaaatgtcatattataacagactttaatgttttaaaataagtgggattttcaaaaacacacagttctggaaaggtgtatttctttatgtacctatctatatgataagaagttttaccacatggctgtatcatttatggaatcaattaaaaccaactgtggtggtaaaaaaataacctctagtggacttattcaactgtatatggaattttatttagggagttatggaatgaatagtttttttccctgaaagcattgttttgttagttttctgattgtttgatagatagacataaaaattttccttataagtccttggatataattttacttttcacatatgattgatcccttctatttattttgccatcagaaaccaattttttaacattgcatattatccagaatttgaatgtcacaaaattcaaacaggtaaaatgtaaggtttgttatgtacacacacacacacacacacacacacacacacacacagacacatacactgagctaaagaggatggtctttgtgtacagaaaaggataacattttttccctttagtatgtttattgatgaacacaaacagaattctgtttggtttatgttgcatgttttattgtttctttttttagattttaattttcctgttactatgtgtgtatgtgtgtaagtataagttttatatttttcaggggtaaaacagtttccggtaaacaatttttttgttttgctttgttttgttttgttttgttttgagacggagtcttgctctgtcacccaggcgggagtgcagtggcgcgatctcggctcactgcaagctccgcctcccgggttcacaccattctcctgcctcagcctcccgagtagctgggactacaggcgcccgccaccacgcccagctaatttttttttgtatttttagtagagatggggtttcaccatgttagccaggatggtctccatctcctgacctcgtgatccgcccgcctcgacctcccaaagtgctggcattacaggcgcgagctgcagcgcccagcccggtaaacattttttttatagagggagttttaatacgttctgtattagtttctctgttttttcatttgtatatttgatgtgatactcaagttgctatttaagctctattctacctttttttgtcccatgggagtccattccatcctctaaaaaagggaagaacatcagttctttagccattacttggtgcaaaacaagttccggtttcctccttccctcaggtgtggataagagcagaaaagtagatacacaaagaggtatatacttattagaaagaaatcacttgcttaaacaataggcaggaactgtgcgactcgacctggaacaaataggcataaataagcaggaaaatgtaatatttgtttgagagcttgaaatgcagtcttttaggacatatctaggacatccctgcatcatcactttggtaagaacttcagtaccttgcctgccagtcatttatatgcacgttccgtcacagttagtcccacctctccccacaccttctgcaccactgctgccaccaccatcactgtgcctggcagctgggtgaatcaggaagacttctaacgttagttttcccatatttaccaacaagtcttccaaagtgggcccaaattaaagttgtgtaacaacatcgctttccctctctggatcttcattactggagatggaggcaagcactttactatggtaagcacttttgaccttagacaggtggcctaaaaggtgggtaccaactagcctttaggacatattcaggagggcttctataccaagactctctggccaacgtaggctaacagttcttttcccttgagttttcatttgcttcatcttaaccatatctctattactctaatcagtacattctaataaaattacttgtatgtctctcagtaaaaatatggtcttcttgagtccccccatttcaaaattattttattagatctttttaggcttactgtgtctctgaagggcttggtgtatattcattgtttgatagcatatcatggacagttctgatattttaaacaaaaaataggccgggcatggtggctcatgcctgtaattccaacattttggggaagatgaaataggagaattgcttgaggccaggagtttaagaccagcctgggtatcataagagaccccatctctgtaaaaaataaaattaaaaagccagatgtgattgcatgccccactagtcccagctactagagacgctgaagccagagggttgcttgagtgcaggagttctaaattacagtgggctgtgatcacactctatcctggaccacacagaaaaaccctgtctgtaaaaaaaattcaaaaacaaataattacaaagaataggaaattaattaaatataagaaccaatgattgcttacattttcatacgtctttccttattttcctttatcttggtacatataaactctaaaataataggatataacttaacaaatgtttattgtttatttttttcttcaatttctatgtgtaacaaaaccttaggattgtcagaaataaagtcattattttgtttaaggaggagggtcctgctagccttagtaaacatagcccttatctttcttctctaagataaaatggcaggtactggctagatgctgcactctacaagtatatcatcagttttgttttgctttcagactagtactaggaaagaatgaggtcatgcattttgaaagtgggtttttgtgggttttctttatgtgtggtttctttttgagtcagataagtttttttccttccttttcaggtcacacttatacttttatgcaaaatattctaagttgtgtcaactgaggacatggctacagataatagaagtgattttaaaagccacttaacataaaaggattgttccaatttcccagaacagccaggtttctgtttaatccaacccctttagaatatagcttatatctctgatgttcaaagccatgtgttcgtcttgaaataatcaaaacaatagaatcctcaaagaatccagtgcataggcaacatgtattatgttatttagttagttttgacaaggttatctaggcagttaaacattattatctacaggatttctttttccttcaacatgaagacattaagttcagatttgtagagcagagaatatctgtttcatatttgacacaagctatctcaatttaatccccattttccttcattagacaagcgaagctaattattttgagaaatgaatgataaataactactgataattagacacaaaggttttcggggtatgctgtgttggttcatatagggaatgttcataaaacattataacagcaaaaacattaatttgaagaaaaaatttggacccttcaaattttgctttcctgttttcccatttccatatgctgagaagataccaatattttcacaattgtgacttgctagacataagttacgagggataataaaataatatcctacctattagttgtagcaactagcttcaaggggattattagacccatgaactgaagtcaagtagtatagaatgataattacatttattacagtatgcccagattatagatattttgatatgtcttgccacaaaggacaccagagtcatattatgtttcagtggtactagaggaagctgcacgaataattaccgttagtttcatggaacatctaaactgatattattttcacccagctctactccaattgcaaattgcttttcccaaagcaagagctagctttctcatctttctgcttgatgaaggtaagttattcagccctgatttgccttttcttctcttctcttacctcctgttattcttagccagtaccacatcctgaaacaatgaccaatcttccaatgcttttatgtgcattgatttcctatccccattttcttgagggtagagagattatttgcctttgcagtgatccaaaaaatacttatcgcaagttgaagagcttaatgcactcttgttaatagttattttgtcagtttagaagagggcaaagacaggggacagtttctatccacaaactataatccttctaaagacttcatacactctcatcatccacatctttctggaagagggtagatcccacattgtgaatttaacctctggtttagtatataaatttgtttttcgttttgattaatgtaaatagtcacatcaggcacaaaagttacaggatttttttttttttttttttttttttttttttttttttgagatggagtcttgctctgtcaccaggctggagtgcaatggtgtggtctcagctcactgcaacctccgcctcccaggttcaagcaattctctcacatcagcctcctaagtaactgggactacaagcggatgccatcacaccaagctgatttttgtatttttagtatagacagggtttcactctgttggccaggctggtctcgaactcctgacctcgtgatccactcacctcagcctcccaaagtgctgggattacaggtgtgaaccactgtgcctggcctaggatatttcttgctaaagactgatggagagattttttcttaaaaaggaaatcagagaggtgggaatttgtgaagagattatgatttggcctttgcataggacaacttcacgatgctgttatctactaaacctgtaccaaaattcctagggctaatcatttaaaaaaatacacatctatatctatttctatgtacctatttctatatacctatatagaaatagatatagatatagatatagatatagatatattggcttcttgcttcctttagagcttgtatatttcatcaaagtaatttttttaaagataaactgctttagaaatttaaacttatttattataatgcttcttggatattatccttgccttaaattaagcaaaattcataatttcataaaaagatctacatcttttttctgtcattaattatgtgctccccatacccataaagaattaaataaaaattatttgactctttttctttattcattttttaaagtacataaatgtacttatgaaaatatgtggttttaagcttaattttgtgacatacattttgaatatttaaaattgggctgacaaagcagtagatattctcaggagtttaattttacttgtatggcaagagttgataatttgtgagttttacagtattttattagagaaagtttaccagggaagcagagtggaaaatatataaaaatgtattctaaacctgcaaaataaagccctagatagaatttgtttacatgtactgattaattagaaggcttgctttgtaaggaagcactatgcaaattattttttctcagttattagtctaagaaagagacaaaaataacttttattacaaagaaatctctgcttgcatccatattttacatctttataaaaatgttttaaaagagaggtatggccaggagcagtggctcatgcatgtaatcccaacactttgggaggctgaggcataaggttcacttaaggccaggagtttgagaccagattcagcaacatagcaagatcctatctctaccaaaaaaaaaaaaaaaaaaaaaaaaaaaaaaaaaaaaaagtgaaagaaagggagatgctattactgtttctttcataatctagctactggctaaccaaaagaaatgaaacattgctgaaggtattgattttctggtatatgtggaaagtatacattttattaatcacatatctcacaatatatagaataatataaattatatttataagagatcaatagagatttttgagagaaagtaaaatgacatatctggccaggcgtggtggctcatgcctataatcacagcactttggaagcccgaagtgggaggattgcttgagcccaggagtttaagaccagcctgggcaacatggtgagatcttgtgtctacaaaaaattcaaaaattagctggacgtggtggcatgtgcctgtggtcccaggtacttgggaagttgaagaaggaggattgcttgagcccaggagtttgaggcttcagtgagctgtgttcttgacagaatgagaccctgtctcaaaaaaatgaaaaacaaatgatatatgtatatttttaaatttttctgttataactgattcaaattgttcttcacctctaatcaattatctctaatcaattatgtttctttgtgataactttgaaatgggttatatattttcatgactcagttttgacagtattcaagtgctaaattgaatctctacattcatgttgccaagagttttgaaagtaattgttgttagttagtatacttatcagaaattttagaggcccagaattctctttcaagttctgtgctttccataccagtattttagttttgcatttttgttttgcctaaacagtttgaactttgtgctctgtcataaactcctacttttacttttctgctttttgctacaatttgtttatttggactagtgttaatttatcacctagaaaagaatgttattttaggaatttttgtatcagtttaactcatggaactgaaaatctgtctcatgtctcagtgcaaaagaatgggaatatattttagatttcataattagcatgtgcttaagagggtttttatattctttgtgtgcaatgcttagcaaggtttatacatgtttggaggattaggtacacctagaaaatataatctaccagagggagttctattatcttatggttttcagcaagtttaactccatggaattgcagacagaaagagatattgtataaatatgccagtcatattttgacatcgcagtcttgtattgacactttcatcaaactgtgggagaacagagcatttcttgaggtataagttcttgtaagtattttgcagaacaaaagttttctcttctatttgtactaaatcttctaggccacaaagcgtcaagaagaaaattgactaaataattatgggttctgtaccttctcccagaatacttacccttgacctgaggaataactttccttcatggtaagattgacccaaaatatggcttgaaatgaactttctctgctctagtattaagaaataatagcacacactcttggtacttctcttttcatgacttgttcgtgggtttctgtcaacatcaataaagtggttctttgtaatagccaatcatttgtttaatgcatgcctcatttctactcatcttagaaagaaaagtcaagaagtcccacagaaatgccccaaaggaaaaaataaaataaaacaaaatggcttaattcatgacacttgtgatttattgagtcttctttcatctgtcatgtaagatgtacaagcaccaggttcaatttttatttttggttggtttctctgacagagactcataattctgccctagagttaaatcttatggaaaaaaacactgaaaataaatagcacgtttcttcctctagatgccatcttttctctgtcacataacaatgcggatttgctcccaatagtttatgtgcatagctttcaaatctaacactggtagcaatcaaacaagttaagtataaatcttatttatgtgtgacccttctctctctctctctctattttttttttttttttttgagatggagtatccctctgtcgcccaggctggagtgcaatggcacaatctcagctcactgcaacctctgcctcctgggatctcggctcactgcaacctttgcctcctggattcaagcaattctcctgcctcagcctcccaagtagctgggattacagatgcctgccactatgccaagctaacttttgtatttttagtagagatggggtttcaccatgttggtcagtgtggtctcaaactcctaacctcaggtgatccacctgccttggcctcccaaagtgctaggattacaggtgtgagccaccgcgcccgacctctatattttttaaatgcctcatgtttccattttaacttgatcttgcatatataaccatttaaccaagcttgctaagacttaaagaggtataattttagcttgtcaatattcattgttttgagccctgtttataatgaagtataacaataagcattattatgctttagtgagttgaacttgaatatgcttgagtgacctgacttgctcacattaaaaacggaacaacagaaccgtagaaaaagtggagtaatctcaagattttcttgtaaacgttacattaagagactttatttgacaacctaatcaaaaaactgaccatgtgttttcctcttcccatcattttctcagattccctttctatcattttctctcccatcatttatcctcatgatccatagcgattgcaaagcacatcgcaaatgtgaatagctatattgttcctgcatgatagtaatgagtatactgctacctccaaaggggctgaaagttaagataggtcttttacaaagcaggaaacataaccttaagcataattataaattatatatataatcatgctctcttttctttaggataagtgattagtgttcaagtttagtgcttatatttgctttaaaaatgtacattgtgctcatttatgttttggtacggacagatcctttatatgaccactgtgctaaatatttttttaaatcactgactagacatcctgatttatgtgtctagatttatatttccagaaacatacactgtaacttattctgtttaatggctaagacacttctgcataatttacattgagactaaagtggttttttactgagatacttttctctatgacaaaccaacattatgatatctgatagaaatacaacactcttctttacattttttccccaaattttagaatgaattaaagacaaatacccatcagaaaacattccttgaaaatgcataattgtgatgtgtgatgctgtacagagcaaattcagactaatacatagacctcaaattcatgactataattttctctggatagttagaaagatattttaaggtgtttcatgcctgaggaataatgtcattattgaatgcatatacatacatggatgcctctgaggatgtcctatatctaataaacagcccaagtcatgggcaaatatatatcttataaacagggggatgggaaaagcatgccaatttatttctattgagctaaaatttagggtccacatttatttattgactatgatcttgggtaaatgactgagttttcttgtgtctcagtttacttatttgtaaaataaatcatgttacttcaaaagattattgcaaagattaactactattagcatataagaaagcttaacatactttattcatacagtcattcttcagtttcataaatgtgcccttctcggtagagaaatgggtaacatcagtgaactaggttgagaccgaagctgtacataatgataatttcaatgatttgatcaataatttcagattgatttttgttcatcctaagacaaaactttgaattctctatcttttctgtttgtcccctcttagctaggttggaaatactactcttgttttgttctttaaaggcaaatagtaaaatgtttatccattatttttcaaacactgattactgtagacagtgtcaacatgatcagtgtttgagttttaaagcaatagttgaatcaagttgcttcacagtggtttcttcaaaataccacaaaatgacaggaacacttacgcagtgaacacttggatttgcttcttgatccttggtatttgaaacatgtatggaatgcatcctctgtgtcagccaagacagcctctggagagtgaggcaggtttgtgtgttgagggaagggggtgtgcaagggggtggccatggctacattagttgcctctgcttctgatatctgtttttcattacattttgatagattatgtcatctttttgtcacatacattttcacccaagtctggaactatatttctctttcatttccaacttacatcctcaaaatcattcatggaagcctttgtctatataacaaatttctctactattttgagggaacatgtcctattgtagaaagataaaccttttacaattgttcgtcataagaggaaatctgctttaaaaatatttcatagggctgtcttactcttattcctaaaaaaagttattactgtagaactagttagcaagagttactctgttctgggttacttgggattcactgttagcaaagactaacaattagtttgtatatccgtatatggatgtaggtggtcacagtaatttcctgcttgattttttttgaattccaattaatataggaagtttctgaatttctaggtatttcaggatttgcatatacttagagttcaattatgttttaaacacattatctgtgcaagtgactgtcctaaatgttgtggctaaagaggaggaagcataaaaaaataaaaaaaattaaaaactgttcttacccatctcccaccccagccccaaattttaaaatctagcaaagtaaaaagctgcatgcaaatttttttttaaaaaaaaaatacaaggcagattgttttatattcatgtaacaattgtcaggcacaggagcctaagcagacacattcctggtgtggttattcataacttagctaagcaatgtctgctatttatcactgcacttataggctggtgagagtctctcattgcccactgctgagtcactcaccttttcattttgaaagcaagtttggccattttttttaaacaacacttttgctcaaataacatgaaaaattccaagtccctttggagttttactcttactactactgtagcagtttgttcatattaggatctcgcagactatctagaagcaatgaattattatctagtcttgcaaagatctagtataagaaaggataaataaaactaacaaattttaaaatggtatgaattcaggttttgtgactttttccttattaataaaaaaggattagtgatactaatgctactggatttgtagaaaggttaaatgtaagaatatggacaattggttggagacatggtaggcattccacaaatgtaagctcactgcgaacttcttagaactctgtgtagagtatgtattcctatgtttgttgaggaggggcattttagttaatatatagatcctacttttaattattattttcactctttaaatgttagttcttcacttctagagttgttattctgttggcttctcattttttcccctttttttcttccaagtgcaaaattttaagtgaaatctcaggcagccctcatttaacaatttcatgtgaaaaaataaccattgtgaactctcagagtagtaattacaggaagttatgaaactttgctaacttttactaacagataaagcattttcttttgattgttaggaaatcgtgtgtggacagcacgggagaacacactctgcctgtacacattgccaactcttgcttcattgagtttcacaaacaatcccaagcttaattttagccaaaaatgtaaaccagttcccacagtaaaagttgtgctaatttccaagttgatttttatttctttttcattcctctgttgtttgaactggtcaaattgagcagtgagatggccaagggacaaagggtaaggccaggggggtcactaaaccaagaccaggctctaggatttcaatgtttctttcttctttcttgccgtcagtaaagatcccctaggcattgacattttaaaaactctccatgtcttctgttaactcccttaggatcctgatctctgtaacaaagatggatggtgacacttaattatggacactcacaggcatccaattcaagcaatcctggcttccaagcccagatctgccccttactagcagtgtgacttcacgtgagttaggctctcagtttttttcatctttaaaatggggattatatttcctgattatagtagctgattataatacagattatggtgccaatctcagaggtaagataaatgcacttagcatacaacatagaacacagtaagtgctgaataaatggtacctgccattattattgcaagctaattaaaaacgatcatttgtactaaattatgttttattcaaggaaggtaatgtcattcctcaccaattaatcatttgttgatgaaaggcccttgagtagcaatgtcacacactgtatgagaactggaaaggatagatcttttgttacatcagccaccctgtctcatagatgactgctggctcctcttttctgcacgaaggccagaacatgaaaagttagatatttataaaattgctcaattcataatatttgagagttgatgataatttctgttttagctcttgctccccaaggagcagatgcttctggggaggttcaggagcacgtgaagaaacaacactgatagatggcgatcgggacaagagcaccttattaattcagctaccactgtgggtgactgcaggtcaataccctagggcaactccaagagccagtgtagggtacacatcttagagtcatcatacacaaggggtgagggagctaggttatttatacaccaacccctgattgactagtaaaatgtctcccctggtcgtttgggttttttttaatttttaatttttgtaggtacccctagtagttgtgatttctccaaaacttctaacttgctacaaaggaggacaacagagattatccagccagagaagttcttacataaagaaatgcagggcctgtgtgctcagcatggtaaggacaaggtaatataaacaggcacaaaaagcatttgtttttatttcttatacagtaatatggatctaagtttgggaaaattttaatggaatcttcctgaacatatattcttaatgatacaattggtttatattaaaatttgctattgaaacaaatgtagttttggtaaagaaaagctatcatatacctatggaattttagacaacttcctccaaaccattaatctttgcacacttgcttcttaatgagcccatttgcacaatcctatttatcattttacttacatgcttgtccatctctctgaaacgttgggggaacatgaccagaacttcacccggtttacttttctttccattgtttaatccacctatctgagctaccttgtttaccaatgttacccatgaactgacaggagtttattttaatctaatattctgcttttcaaaggaagaaacttattacagtttgaatgtatcttgtccaaaatgcctgggaccagaagtgtttcagatgttgaatttctttggatttttgaatatttgcatatatgcaatgagatattctgggtatgggacccatgtctaaacacagagtttgtttatgtttcatatataccttatatacataatctgaaggtaattttatacactatttgaaagtaattttgggcatgaaacaaagttgcgactgttttttctgcgacccaccacataagatcagatgtggaattttgcagttgtgcatcattttagcgctcaaaaaatttctgattttggagcattgtggatttcagattttttatttagagttgcctaatctgtatacaaaaactttaagtactctcctgcctgatatgcttagtagtgcattcatctgcagattctaccaacttctgtccttttgttatactgctgataatcattattcctctgacatattccacgtgcacctgtcttaacaactaagggggaaaagcaacacaaaaatcttcatacttggtgcttcattttatgtgagctccctgaagggacaggcttgtggctgtgcctacattccagtgaaattaatgctccttcttcagactactgttattctatttatagccacaggacttcaattttataagagtccagaaagttctgagtaatgcacagaattctacatacacagcaaatgcagccatggcaaaatgtagtccctggtgagggaggcaaacagagaatcaacaatcctttgcttttattggaataataaaaccggagcagtttgtgtctgaatgtgctgtaaaccagattttttttttcatgtaaattctatagccaggatatcacagacattgccatgaaagtggtaaatggagaaatacagtctttggaggaatcttgacttctcagcactctttgtttattcatttaaatgtgcctatttttatggatggtgggtcaagatggcggattcaatgaaatagtatttcataacaaaatgagcatgaagagaatttgggcatgtctaccaaaacacgaaggacaagtgagtacaatcatatattgttaccatctcccaagtcttctcatttgctttttttaaagtattgaaaattctggaaagactctgtgtggactatgctattcttaatgtttattaaggagaggacactttacataatttatagagcttatttttaattattgttttgacccattggatgtaattacacattttttgttgtacgaaaaatttatataattaatactaccatattaaagactattataaaatatttatcaccatttattagactaatggtagcatactattcacttttattcacccagctttcttcacataacaacatatcttggtgctcctttataataacaaatgtaaacattttcgacaaatacataaagttccattttgtgaatacttcacagtttaataaaccatttcccaattgataggcaattggctttgttatgaaatactatcctagtgaagaggcttaaacatacacaaaaaatctttcaataagtaccttcttgaaagaaggtttcaaatgtagagctattttcatttttttgagatgaagtaccactctgttgcccaagctggagtgcagtgtcacaatctcagctcactgcaactccgctttccaggttcaagcaattctcctgcctcggtctccgaagtagctgggactacaggcaaatggcgccaaacccagctaatttttgtattttaaagtagagtcagggtttcatttggccaggctagtctcgaactcctgacctcaggtaatccacctgtcttggcctccctaagtgctggtattacaggcgtgagccaccgtgcctgtcctgtggagctattttctaatggctaaaattcagaatttgcaaaaatgaaaatgaaaatcaactataattttaccaatttattattaactctttccagcttttgttctgtttgcacatacaactctaaaagcgtaggaaattaggatgtatgtaactcatgtagcctttttttctcagttaacattgtgacgtaagtattacctatgtcaaaaataattctctataaacatgattttagtgtccgcatagtatggtaatattataattaaccacttatccataacgtacagacatattacacccccatacatattgctatattacatataagggaagatatactgatttgtacactaaaccacagtgcacatgtacctacattacctgtctgtgtaacctccttcagattatgattcagtaggtctgaggcaggacaagaaagccactgccacttatccttggatgaaacctcaaatagcaggggtataaaggatgatgatggcctattattttattttacttcctttaagactgaacaaagggactggatttgtcatatttaaattagatgcattggcaccctagtagttatatttattgaactctctaagagactttctaaggtagatgctcggtttaggctattttggccacatcccaaataaagtcacaatactggactatgtgatctctggatatccttttttctgaatcctttgattccaggaacacttttctctcacttttcagtatctgccagtagatctattatagatgtgttacagttaaacatcaaaatatggtggctctttgctgtgataagctagagagtaataatttattagtcaagacaggaatagtatggagttctttttcagtctcttccatatgttgcagaattaacgccaaactgtgtacggtctgaatcctttccattgaggcaggttgtagaacatgagcttatgaggctccagaattttcctggaatacatctttcctacatctcttgtagagctcatgttcccaaagtaatcattatacaaatactcagctggctggctctaggaatccaagtataaatagcaaattttacttgctctcaagggcctttgagtttaatagatcagacaggcaagaaaattggtaattatagaacatgtatggtaagtactatagtaagatatgaataggtgcaaaagagggaatcctaactcaattatttcagactttttttttttttcaggaaagtgaagacaagctataattagccaaggaaagtaatggggagttaggggagaagggaatatttttcaggaaagcttagaggttcaaaaaggatagaggaatttaaaaaaagagaaattagagagctgcaagtaatctggttagaggacacacgagggagattataagcatgtgtgtgtgttcgtgtgcatgtgtacacgtatacgttggagattggacattgcgctttttagaaaggtgaagaagttggaaaggtaagaaagggcctggacttgaagggctttgttaggctagctaaaccatttgaaattaattctgagaacaatgaagaactgtttaaaagttttaagtagtactctgcccgccttggcctcccaggagttcgagaccagcctggccaacatggtgaaacccagtctctactaaaaatacaaaaattagccggacgtggtggcgggctcctgtaatcccagctacttggaaggctgaggcaggcgaattgcttgaacctgggaggcagaggttgcagtgagctgagatcgcgccattgcactccagcctgggcaataagagcgagactctgtctcaaaagaaaaaaaaaaagaaaaaaagttttaagtagtgaatgttacctccgtaaaaaacaagctaggaaccagaatgtaagagctcactcactgcagtctagagaatgactgtttggtggcccatggtgagaggtaacagcctgctggcagccctcgctcgccctcggtgcctcctcagcctcagggcccactctggccgtgcttgaggagcccttcagcctgctgctgcactatgggagcccctctctgggctggcagaggtcggagccagctccctctgcttgtaaggaggtgtggagggagaggcgcaggtgggaactggggctgcgcgcgtcgttcacggccctgtgtgagttctgggtgggcgtgggctgggcgggcccgcactcggagaggctggccggcgccaccggccttgggcagtgagagttaggcgggccagcagctgcggagggtgcacctggtcctctagcagtgccggcccactggcactgcgctggaattctcaccgggcctcagctgtctcccagcggggcagggcttgggacctgaagcctgcgcgcagccggagtctcaccgaggagccccaccccctgctccacggcgccgcccggtcccatcgaccgcccaaaggctgaggagtgcaggccctcggtgtgggactggtgggcagctctgcccgcggccgtggcgcgggatccactaaggaaagccagctgggttcctgagtccagtggggacttggagaacttttatgtctagctaaaggtttgtaaatatgccaatcagcactctgtgtctagctcaaggtttgtaaacacaccaatcagcaccctgtgtctagctcaaggtttgtaaatgcaccaatcagtgctgtgtgtctagctaatctagtgggacttggagaacctttatgtctagctaaaggattgtaaatccaccaatcagcaccctgtgtctagctcaaggtttgtaaatgcaccaatcagtgctctgtgtctagctaatctagtgtggacttggagaacttttgtgtctagctcagggattgtaaacacaccaatcagcaccctgtcaaaacagaccaatcagctctctgttaaacagaccaatcaggtctctgtaaaatggaccaatcagcaggatgtgggtggggccagataagggaatgaaaggctgccagagctggcagtggcaacccgccggggtcctctttcactctgtggaagctttgttcttttgctctttgcaataagtcactgctgctcactttttgagtccacaccatctttatgagctgtaactcaccacaaaggtctgcagcttcattcctgaggccagcgagaccacaaacccaccaggaggaatgaacaactctggataggaggaatgaacaactctggatgagaggaacgaacaactccagatgcaccgcctcaagagctgtaacactcaccgtgaaggtctgcagttttactcctgaagccagcgagaccacgaacccaccagaaggaagaaactccgaacacgtccgaacgtcagaaggaacaaactctggacacaccacctttaagaactgtaacactcaccgcgagggtccgcggcttcattcttgaagtcagtgagaccaagaacccaccaattccggacacaataggaagctgaaaagattgttggaagccctagagtggttaatgatgactaactttcgttaagtgttcatgttagcactagatgatattattagatgtatctaatactgatgcagacgatgttttgagctatttcaaatattacttaactttcaaagcagctattttaggtgtgattgtttattacaataattctcacttacatttaagtacaatgaaacacaggcataattgcattacatttccgaagccatagaactagggagttgtaaaagtttgtagtttgtttcgagggtccactcacttcactacggagctgtactgtcttctccatggaaactatgatgaagacagtaggtataaaccttttgcttgaagttgattgacatatgtacatgtgttaattcaatgtgtggggaagaacttggctgaaagtctagtgaaattgtaagaaaacattgtctataggaaacaatttgaagagatcggttgccagaaacaacttaatgaatgctatttaaggagaacatctgaatatcagatgggaactattacggttgggaactttctatcttagtacatgtaggttcacatgtgctaacatatctgcaatgcccagagtatttgtacaagtagtaggtctaaagttctaccctggtagtgccatgttataacaaagtattttttattatctttccatttctatcaagttaattgctattgaagtaggtgcaaactcacctgattagaatggatttagaagatttagagccaaaattgatgattcccattcttattgtgaaagacctgtaaaatctttaaatattcatttaatccagggatccccaaccctacaggttgtgttacaaatgggccacacaggtaggaactgggccgcacggctggagatgagtgctgggcgagtgaatgaagctttcatctgtatttacagctgctcccaatcacccacattatcgcctgcactccctcctgtcagatcagtggcaccatttgattctcataggagcatgaaccctgttgtgaactgcacatgcaagaggtctaggttgtgtgttccttatgagaatctaatgtctgatgatctgtcactgtctctcatcaaccccagattggactgtctagttgcaggaaaacaagctcagggctcccattgattctacattagagtgagtcatataattattttattatatattacaatgtaatagaaataaactgcacaataaacgtaatgcgcttgaatcatcccaaaaccatctccccacacaggttcatggaaaaattgtcttccacaaaactggtccctggtgccgtaaaggttggggacccctgatttaatctttgcttctatttcaattacttaaaaatgaatcaaacacatgtgtgtattccagaaagagattggtatataaagaaggtttcattggataagtgtttccagtgttgaaatacagatgcattttggcccttacacatttccatttaaatgtctagttattttttaaagataaaaacaaccttccaggagcaagagaagcaactcatttctatccaattgggcaaatcacttaacctctcaaagtcgcagttgcctcatctgtaaaacggtgatactactgcctgttttataggattattgtgataaaatacatgtaaagtagcaggcatctagtgggcattcaaccaatgttggatcatttatttatatttcttccttagctctgcagttgcattatcattatttttaaatgttgatactagtttttgaattgctgtgttgatttcagactttctgattgaaataatttaaaaaattgttagatagaagggaagaatgcagatttttttgacaggaaaaaatgttattgaactttgtttcaacataaaagttggtagggtttacccacaaaaatactttttagagaaaagccaacatggcatttattagctttggccattgcttggcaaggggttagttcttacttccaaattcataatgttgtcaagatatcttgtcacatgatcactggcataattaaactgttaccgcatggtgttccaaggggaatgctttctggagtcagttcccttgtgcatgtgatgaggccctagattttagctaggggctttttgtttcaccaaataaaacgatagctttctcgcccatgtccacggtgaataacaatcctattacaccttaccaaccattacggccacattgcagggtaaggagttgaaagaccttccagcatttgttatccacagggtgtgtcatttaaatccagtatcacataaagcttgaaaaataacttttatgcagaaaaatgtatatgaaggaaactctccaatttacctttggaccagaacatggtctataaaagtggcacattatgcaaatgaagtttactttctcctcctttctttttgcttgtgtaatataaagaatcacatgttatagaaactgatccttttctttgaagccaggggctgagaagtccctccagagcataacacagtgcttaagtactgtacttaggcacagcaagtgaaaacataatgaaatggaaaatgtgctttaaaatgaaatataattaatatgaacattcaccaggtttattcttcttgttgtgaatgattatagtttattgattttactttttcagttatttttagttatttcctacattgactcacctgtccaccctcctgcacatctcctcttgtaattataccctcctatgcaacctcaattcacggagaagcattatcatggcataattacatcacagggttgtggtgaagaaaaactgagataacatatatgatatacaaattcatgcaaatattaggaattagtattggtattcagattaaagaactaaggtggcactaagtccatacagttgatgtcactattcacgtaacaaactgtggtaatatcaggtttgtttactgcctgaaaacaagagagtatagggtattggctgagttttcccttattattcaacaaaacagcaggtgtaccagcaagggctctgccttcccttctgtggctgtcattcacatcaagctggttctagcaattgtgagacactgaagctccaaggacatgttgtcacctgctgaaggcttccagtctgttgtgacagaataattggtccctggtagaaaggaagcatatgccattaggtgtaagaacactgccacttgatgtcaggaagagaatctgccatttacctacctttgtcatgaaaatccccttcacaaaggcattctagtcctgacattcataattacttgctttctatagagtaattccagtgttgtaatttcttgcattgatacttgtagttccctccctctaataaaatctctgaaaatcaagcatctataaccctgattttctttgctatgcaaggagggctatgatattgtcatgatgtcaatccaaagtgacacataatcaagacttccagatccaagcaggctcaattgctctgctgcattgtttatttcacagacggcactggagcaggaggtgaagaggggagagctgtctaccaaagacatctccaaggatccctttcagtgaagcttagactcaggatttggcagaactcatagtatgaaatcatgtaccccactacaccactctctcacaagaaactcttcagggagaacaacgaatgacatcttgaaacattttgcagatcttcagggataaagccgtgaatgaaaaagatgttcatagagtccatcaccatcatttaaacactctctatataacagaaggatgccttagcaaaaccacagtatttttcccagaaacctttgtgcacaggatatttttattattgcttttccaagttaccctaagaatagaatatggtgttaagagaactgaagtccccaaagatatcttgcatccattttcttggagtggaaggaaaggaaatacagacttttttaaaagatggtttgctacttatatgttcttgacacaatcctgaggtcttagagagatcactattgcccccttttaggatggcaaattaatggagaggggtgagctttgtacttttcaaattcaaatggggtctatacattaattgtctctgcctttgtgtgggttaaaaaatctaagagacatgaagaaactgcttgaaattaatgtctttcataaaagatgactttttcacatctggaaaatgttcctttatattcatatttctgtcccccaaaaactataaaattttatcatgtgtactttagatagattatgccaatgcctatttagtttctcttttacagatgattattgcgagaagtgaattaagatgtttgaaataaatcagtctacttttgtgcctgggtagattttactcattgggttaataaacacattcatcgttatagctagaacatgtagatgtaaaatcagggattaatgatgttccatagctattttaaattaagagcaatattttccagacctgttaattttgaaaatacggttccatgttaacatgatttttcttaagtgtagcaatgggttatcaccgtctttactataaaaacaaacaaaacatctgacaagaaaaaccaccaaataattcttttgcacacacaaaaaagctgacagtttttctgtcttttccataaggaaaaagtatgccttgctttttgtctatcctctcaaaaccacaaaaggccaagctagacacaattcatgtttacagaaatcaaagacacttttattttatggtcccctgccatttctctctgccatgggacaatttcttactgcgtttcttgccaaacgagggtaggaatggaaagactatcaagtgccagtaagtccatttgagaaaagacaggtcaaggcttttcattttagaaagcctacaaaatacggagcagcttatagttatatgttgtgatgctttcagtggacacttttattgtggagtgttttattgttaagtttcatcgaacatcaagtgattggctcagcctgtgggatggccctcaagtgtgacagagtcaaacattactggttactggtcgtaggcctgccgagggctgattgcaccttccgtttagagagtatcatgccttttgcaacaaaaagcaaattaaagcccctgctgattgacagcgatatatgctacttttgtttttaattatttaacacttgacactctcagatggtaccttatataagaagaagaccaatttccaaagcaaccttgctttagaattgaaaaggcaagataacagattgaagatgactttcactactgattatctcttgttttcatttaaatatcagatgaaaggtttagaagcatgctgattatgttgttaaatagtcactgccctatatcttgaaagatatagtagccaccatttcaggggcatggctatttttggctctaaatgtaggcaagaaaattaagaattaccccaaattattgactgctgcagatgttccatttgggaaaataaaataataaatcgtgtaattcctacagagttagaattagatcttgtaagaaacaaattgttttctttgctgaagtattaaaagctgtgcaaacttaatttctttttcattgtcatttcctggatttgatattcccacccaagatgctaggagaagtcaccagtgattggggtgattctagcagaggctactgctccttggcactgaagtgggtggcttcaattcggtcgtctctgatgggaagcagagactatgggtgggctccctacacctgtttctggtagatctattaggaatcatcataagaagactatctaactttggcagtattgaaggatgtgtgacactgacatgccatccacacatcccttcagtgaagaacttgttgtctcagctactgggaaggctattgacagacaactgtcaatccctaagggaattttctgagttgcaggaagctagttgacccaaggtcacgccttccatggggtaggccatatccaacaactgatcagtgtgattgtattttatgcctggccgtctcagcccaactcagttcaattaaggaccactctagctcccactggggcctgctgaagtccgatctgcgtcacagcttgcgttctcccttcgttcactcctgcttccttacgttccctttcacaggcaatgaccccaaaacctctccttaatacacatgactccctctaaactctgtctcagggttggcttcccaaggaaaccaacctgcagccaacgagtaatcagtcccacttagaattcttgtacttgattgcttgcaattacagtcacattgtaggattgtgaccctgctttatgtttggtagctcttgttagcaatgccagcaacttcacggctgacattaaaagtgcagaaatgttccgtgaatgagtctaagaaaagtcccaagccttcatcttttcacctgggaccaagtatcagctcttgatggaattggagaaaatgaaaagagtatattctgttttgtgagaaatatgttggctttagtgtaatgaagcttttatagtttttgagttatgtgtatggccttatgaatttttgtcttttgaaaaacttctctctgatttaagattctaaagaattattgccttcattatcagtactcactgatgctgccaattcaattatctacaatggagggcagtggtgtccaatataaacaaaaacaatgatttatccagaatctcttatgtttgtccccgaagtacattttacttgcatttgaatgcaaaggcctatataatgcacatttaaaaacctaacttttaaataaactgcctgtagataattgaaaaagtctatatttatatttaattcttcctctaagaaagctataattatatataatcatagagataaagcgttatcttgcacaaaagtctttttgatattttatcagtcataaagaatattaaaaggaaatagagtagatatagggtcggttaagtgaaggaatagctgaaagacacttgaggagaaaaaacacgttaccatttttcagatgacattcgtaactttcttgtgaaatggaaattaatcaaatggaaggagattattcatgtgagcaattggcattacctgttcaaacttggttgatacacatacgataatttttaaagaagaaaccgtttaggctatttccattttaaaagttcacctctctattattggaagtttttttgatttgcctttttggatttgtgaatagaaagaaccaggccttattaatgcatatttttatctttttctttgatgggtgatagtcattaagaatgctaaatttaaatattctccttctcctctatgtcaatagtaaataataatatatcagtaataatcacagctaaacttcattgcatatattctctgctcaggcactatactagcactactacatacattttctctgtgtttctccagaagccttataaggaagttctcagtaaacctgtgagagctaaggcttgaaaatttaagtaatttaccaaaggtcacacagctacacagtcgcaggcacagcattcggggtcaggcagcctgactggcactatactctttccaatatactgaacgtttatgggtgacagctctgagtcctcaaaaggaatagaatcagcttcaagtgaaaacatagtgtgttagttcagagactgaaaaccataatccgtctcatttcagtgaattcccttcatccagtttaactgtcaggccatgcattacaccacgtgtttttaaacctctgagattcagtttaaatcattaccattttctttagaggctttcagagttatcaggctgctctttgcatatctttttattacttgtcactgatttaatgctatacattatggaaatgctttaatttctgaaattttcagtataaataattgcttatacagccattactatacatgccaagagacattagttcatcataaaatatttgagcacctactatgtgtcaggcactgttccacgcattaaatatacaatacagtagctccccccttatttgcacaggatatgttccaagccccccagtggatgcctgaaatcacagatagtacttagccctatgtatcctatgtgttttcctatacatacatagctgtgataaagtttaatttataaattaggcacaataagagattaactaataataaaagaggacaattgtaacaatagactatattaaaagttgtcattgtgatccctctctcaaaaggtcttattgtactgtaccttaggtaactgaaactgtgcaaagtgaaatcacagataagaggagactagcgtagtaaaggaaatggacattgtgtccactttcatgttgttccttagactgttcctggaaatgattttctccatattcgttggctctctcagctgttctgaacaaatttgggaagagagtttctatggtttgactctgtggacttggcctgagtatgaataactgggtcatgttcttgacctccaagaaacttggagcacagcctaagagattgcctgatggatacagtcatgaaatttagaacttgaagggacattagagaccacctaatccgaccattttaaacagatgcagaaacttcagagccaagcagggtcagactactaacccaggatctcagaatgagcttgtggcaaaagccaggccagaatccaattttctccttcaagggtcactttcttcccatggctccatacacatgctctaatctttggcacaccctggtcttaacctagtaaatactttggatagggttataatgaggattagctattgccttttgtggttgagcaaacatctgggtcaatgctagtaactgaagaaaaggaaaataataaagcaaaccaactacattatttaccaatatgaaagtgaatgctagcataaccattaaaggttaaaaattcaatggatgacaactgctcatgtatctttggatagctcataaataacagagacactgtgcttttaagtgatcactttgctgctcctttttcttctttatgtgattaattatggtaggagagcattttcccctcgaataaagcctacagcttaaagaatcagacatttctccctaagtttgttcttttgcctcattatataagagaaaaaggttttctctgtttttccaaaatgagatttataatcatccctagctgtggtggatgattttagatctcaccttgactgggttaagggatactcagatagctagtaaaatattatttctggttatatctgtgagggtgtttctgggaaagatttgtatttggtttttatttttgttaatttttatttattattattattattttgagacagggtctcactctgtcacccaagctggagtgcaatgatgcaatcttggctcactgcaacctctgcttcccaggctcaagtgatcctcctacgtcagcctcccaagtagctcgggctacgaatgcatgctaccatgccctgataatgtttatagtttttgtagagacagagtttcaccatgttgtccaggctggtctcaaactcctaggctcaaacaatctgcccacctcggactcccaaagtgctgagattacaggcagaagccactatgccctgcagagataacatctaaatcagtagactgagtaaagaagatctgccctcaccaatgtggacaggctttatataacctgctggaagaccatatagaacaaaaaggtggagaaagggtaaattggctcccttctgaagctggaatatccatcttctcatgtccttggacatcagaacttcaggttcaaacttcagactctgagactgacaccaggcacccactaggttctcaggcctttggactagaaatgaaatacatctccagtttcccacattctccaccttgcagacagcatatcctgcacttctttgtttccataattatgtgagtcagttcctataataaatcccatttctttttcagagatagaaagagagagatatctcttattggttctggttctcaggagaaccttaatatattttccctgtgaggatgtgattttggtaatattaattcttcaagaccttcttagtgattgattattgtggctagtatctattatattatattatatataatataccacagattacatattccttgtagtatcaaactttagaaaagtgttcaattgcatgaaatttctcttcatttcccccccattaatgatcacttccatactttcgtagaatattttcaccctctctttgttcagtgtttgccctctgttcccatataaggatgattaaaacccttaagctgcttctcactgaaaagaaagataagacataatgtgcccttctcttaaactacctggcataccattcccagagtcaaagagaaaagtctgtaatggaaacctacaggtagcctagtacctggagaaaattatttcttcctggttctgtgagtatgccactcacctggctggctacatcctgtgctggctccattctagaaaaagactggtcatttctataccagaagaaaagcaataatatatttatacatgcactgatttagtttttggccaggaaacttctctagtcctgcctctccacattctcttcaaacattctagcaacaaatatgagtaagaaaatgttttatactttaatgcattctcatatacagtgtctctgcttcctccaagcatatatactgtcctgagagcagtggaaccattctatggtgaaaaactttgctaaaaatctgttattgggccaggtgctgtagctcacatcagtaatcccagcactttgggaggccgaagtgggtagatcacttaagtttaggagttcaagaccagcctgggcaacatggtgaaaccccatctctacaagaaatacaaaacttagccaggcatggtggtgcgtgcctgtagtcccagctactctggaggctgaggtggaaggattgcttaaattcgggaagcaaaggttgcagtgagccaagattgtaccactgtactccagcctgggcaacagagggcgactctgtctcaaaaaaacaaaagaaaagaaaagaaaacaaaaaactatttttaacaaatatttattgagcacccactataagccaggatctcttctaggggctggggccatatcaatgaacaaagcaggcaataatctaggaccaatgagcagtggtgtacatatgaaggaatggttaaattctgaacagttctgaaggtagaattgaaagatttaatgagtactttaatttgaattatttcacaatttatttgaatatgaaatatcaaagagaggagtcaaggatgacttcaagttttgtggcctatgcaacagatgggttaaagttaccatttataagacagaccggctgggaaagagtaagttggggatgggatgggacagtatctatgagacatccaagtggaaatgttgaatagacagccacgtatgtgagtctggagacaaggaaaaggacaggattggagatatgacttacagatggaatttaaaatcatgagacttggtaacataaccttgtagggatcacaggtaggagaaggaagacagatatacatgagaatgaatatttagctgtcatcttcctggaagcacaaagagcaagtgtagtaaattactttgtgttttttcccatttaacatgtaaggtaggattaggttgtagaaaatagtttagatatccacagatgcatgtgcacacatgtacacacacacacacacacacacacacacacatactctcaaacaatagctctgaaaagataaagacaatgttgaatgggctgctttagaaacttggcctgtaatgaatatgacagcagttagcagttacagaccttgaggtgaatctttttctcctgggccttagtctgattatttgagtagtgagctatatattttccatgtcatcaaacacaaggggatcttgtgtagtttcatccctcatagataatagttttaatttcttggaaaaaaataaaagcaacaacttcttgaagataattccattcttctttatgctcccaactcctatccaattagtggttttctttgaaattatggtttgaagatattttccagaaggtgatttccctgtcctttatgaattgtaaaataatttcctccagtcaggcaagatttatttctttaatgaactaatgtgaaatccaggggctacctcaggggtgctcatatgtgccaagcattctgtgggcatttcacaaatgtctgtacctaatttgccagcagctcggtgatattggtataatatgcttcattcatggctgagaaaagtgagattagagagacttagaaactggttaagttagtaaaatcagtttttgtaactcaaatcctatgctcttttctctgtatatcatactgcatcttttttataacttgaacttttcatgctcccctccaaatttccgccttcaatttaagccaagcagattaaatatatctactgttagttccctggaatcagtgcttactctcttccaaccatgtgactaagcatttaagagtgaattctattgacagcgtcttcccttggagaactcccttgtatgttcaatgtgaaaccaccttgatctcctttgcccatgaatggctgtttttctgattaacttcatttcatagacctggtaactgagaagtgaaaaaccaatctcaatgtcagaggtaaaagcatagagcctattctctagtgacaaatcgttttgttcagggtatactacctgctgagacattgtaagtgttcaatgaggggattgtccaatttagtgcatcaatgccttatcatatttgtgtacacttcttccatgtatatgctcatgtgacctgcacaaatcctaaatgggtctgattagcctttgatgccttttcatgttttgttctgccatattatttctgggaagttagaaaaagggaagagatgtcttaaaatatgacctttgaatttcaatgactcaaagagatgatggcatagatggctgttgagttcagcaaatagattggcaaagattaagaagatgggtcacactactatagtaggtgtgtgaggaaaacggaacttttacatattgttgatagaggtataaatttgtacaaatttagagaaatacctaaaacacattaaatttgtaattcctttgatctaataattctactgctagaaatgcatcctttagatatacttgcacagttaccacaattaagatatctgggcaaagtaactaggtcgaaatatttgcttattaccatacaatggtgttgagaagcaaaggacacttacatagcattctaaaacaaacaacaagtagaataagctctgaattgatattagttattttgctaataatgcaagtcatcgtttctatgttaaaaaatttgaaaccatagataaattagaaaaaagaagaaaggaggatattctttgtgccaccacccatagataaccattattaaaaatttgatgtgttttccttcagttcttttctgtgcaagagtgttatgtgctaactttgtaacactgccattttccttttattaaaactttaagaatcatttttaataagctcaagattccttgttatatataagtacagtaaaacgaaaccttccccttgtgtaggatacttagttgtttccggttttgctcaagtattataatggaagcaggcaaaaaaggcatctacatattccttttctattaattaattgtttctgtcccacttacgctgatagattctgggtttgtggaaacttagttaatagtctaagtcagtgtattctaatttgtttctttcttggtaaataatgtttatggctggtagagtaagtcagctagttataatcattgtagtacatgcatacgtattacacatacagacatatataatacgtattttctttttattttagcagcagcattttattttggcacatatattttgggagtagcacaagctacattattggcggaagtctggtatcctttaggagtttgcattctagagtgactgccttagtttgaaccttgactggtagctatgtgatttgaggtagatcctttacccgctcacagccttagttgcctcctctgcaaaatagtgatgacaataatacctacattaggggctaaatataagtattaaaggtaatgcaacgcacagtgctcaatacataataagtgctcaataaagagttgtcactgttactagagttacttgtttctcattattcacactgttcttttgatgttgttgtagtttttgctttgctttgtttcttgccacacgttctgtttacttctaggcaagtataattttctcagctataaattgtattaatcttatgcattcatttctgtaatgagcacattctcctttctcttcttctgtccctttttctaccccaactagtgctaaaatatgaattgtaaactgctagcattaaaatgaaatttttggcaaaaccatgagatcctactttcctttatatctatatgaattggtatcttttaaaccagagctactagattgctaatttttaaaaatctgttaacgtttttgtagaaggacaattattcagtgtgtacagtaatgaagccgttgatccattagaattgtgcagaaatatagggcttgaactcttaaaattctcttacttacctcgtaagtagtaaaattcagactcagtgattctagtataaacttcaaaatgcagtagaaggagaagcagaaaaatgacttagcggagtggcaaattgataataacccgtttagatctcttcattatgccccgtggcttttctgcatccttaacatcagattttgctgcaagcgttttgtatttctcagggaaaataattcataaagatcatgaatgcccacgctttgtgaagagacctattgtcattagcagccagattctcatgggaaatggaagtcacaggaggacaatcataaatgacatttctgattatgtaattttgtagtatacactgacatttggtttcctatctttagtatagagattaaaggatccctttttcctgatgtttttcatttttccttctgtttaagtttatgaaaatataaatcaataattgtaatgataaaaatagaaaaaatctgaagtaaaagtctcctgtcaatctacctccagagacaaacattatcattttcctatgtagactttttgttctttctccatacattcaagtctatatgcttctatatatcacatgtctatattacatacacttttaaaatgatactgcttttttttctttcaaagcagcccacgaggcaaaaattttagtgcattaagtttatttaggaagtgatccatgaaaacagaagtaaaggaatagggaaaataagatagggatggggaaaatgttcaaaaatcatgttctattaagcaagtttgagctccagcagaactggagctcaattctgctggaaactctgaggaaccatgtagaaagcaccgagatgaaaagtctggagcatttattgttcaacttccatactccattggttggaggttgccccagagtgttaactcccctgcaacttggactgcatgtgtgcacagctgagcaaccttctgcagctttggaaaaagcagggcagagagatccagcacatgcttggtatgtaactagtaacagtctatgactctctaccacagttctgttgtaatcaggtaggccaaggagatgtgctgccgcataccaggagcctctgcaatcctgacctgcatgctgttcttcaactagctttttaaaaaatataacaacgtatccctggatacatttccaagtcagtacatgcacacattctttttgtttttaatgacagcattcctccgtgaatattagagtgggctagctaatcatttaagtgagtacaatgccagcttttgtcttcattttactgtgtgaacatataggtatgctaaatattcctccataaaacaaagagtgatttttgcttctcaagcttttatgtacacatgaatcacctatggatcttgttaaaacgcagatctgatttagtatatctggggtggggcctaagactctccatttctaatgattcctcaagtcttattgatccataaatcaggctttgagttcatggttctaaaatgaaacaacgtgaaagaaacttgtacgctgtgaaaatgttccttataaaagtctagaaagttttccacaagctaagacattggactaggagctgaatctaatttccagctataaatttgctttgagaccttgggcaagtcttttcttaccttggttatcactcaggtgccttggccataggtagtattttatgatccaatatgttcattttttttacttgcaaagagaatctgctttttgtctactcagttccacgactgtgttgagccaaactaaggctataaaaccagatttaagaaattccagggttcctgcatgtttatatttatagatcatcactactcttattaggtgaaactagatgagtcagattgcaaaactagatgtttaatggatatatcaaacttaaaatattcaaagtagagttgtagatttcccccctcacatttggccctccatcttctatgataatcaatagtagctgtgggccaggacgcaaaagtcaaaaccctgagatcatccttggactttcttttctcaaattcctcaaattctgtgcatcagaaagtgtgtagaatttacctgcaaaacagatttcttaatccacttttctttataactatcttcactaatatatccagaaggactctcctcatccattacaacagcttcccacctaattggaactcggctccatttattggccctacattttcttacagatacattttttttttttttaggcaaatcagattttgtctttccccacttaaattcatcaatgtcttctcattgtacttagcataatcccaattcacagtatgtagacccacatggcccacaaggccctatgtgatctggcccctgcctacctttccaaagtcacttcatgccattacccgctagctccctctgttgcacccacattggccctttttatttacccaggatgcaggaagctcttttttgcctgagaaacgtggccttttcaccttccttgaaaatgttttggattttattaattttgtagtactttttagtaaaactgaaattcatcaatcctttttctatgtaaattgtatcatatgtagccattgtaagcattttctcatttacttgggaagaaaatatagacaggcacccagtgaatgtgtacagccaattaacaggaagaaaaggaaagatattaacatttacaaagtgtccattaatctttacagtaaccctatggtagtagtagtattcttgtaactgacagtgaaataaaaactcaaggaagtgaacttattagtctggaatgatagggtctacctatgtatgtatgtgtttatatatataaacatatacctaaataatatgttaaatgcttttggatttgaaagcagattgatcatccatgcaaatctctggcatttttttgttgtattggcattgttctcactaaagtgtgtggaaataatttttaagaattcatgagttccctgtaagaatctgtgtgtgtgtgtgtgtgtgagtgtgtgtgtgacttttcattctatggtaatcttttaaaaattatgaaagcatatttgagatcatctggaggatcggtcaacgacactgtctgtgtctgtatttatatctgtaattatctggtgccaaagaggcctgctgtcattgtctggggctaatgaggaaggaaagagaaaagacgctgactaaataagtaaatgatgcttttaaaccaaatgaaagctgttaccctggcaagctacactcagatgaaggttttatagaaaaagtagtggaagaatctgaatgtcatgtggcacaaagtatacagcctatgaatttcaaaaatatttagtgttgcagcagatactagcagattcacactgcaagcggcaatttagatttggcaaaataacattatctatgatactaaattaatattttaattgaattgttttggttatacaagttagcttttatgaaattttaaaatgtatttggcttaacagttgtactcaaactataacagaggcatttatgcctcgttacatccttgcacacatgtaaggactctttaatgataaaaatacccaaatcaacattggaagccttatgtatatttatataagatatatatgatatatggtgatgtaataactatataacaacagagatataatattaaatatgtatttttttctttcctcgtaagtggtctaatactagggtatagcaaccttggcatgacagattctttcacaggtaattctttgagtaggagacattcctgtgtgtgtagaatgccagtagcagcccctacagtgcagttgttacaaagaaaaatgtctccagatgttgccaacagtcctctgaggggaaaactgccctgtttcagggtcacgggtctatccatttctctaagatagtaaccactgccttattccatgttgtggatgaggttgtaaactcacaaaactatgatgtttccaactattaatgaggaaataattctgaaagtgcatatataggcaacattatgagaagaaaatctggcagagtcaggtgagcatggggatagtagaagagaaatatatctgtaattaaagagaatttatgtggctcttcttttatttactattgcctattgatgcctggaatccagtttgaatgtccatcttcattctctctgtacacacctaagcagaaatattgcctaaaacctttagtggagaccatgagcgagtggtatgcaaatgaaccaaacaaataaacactgtccaaggtactgctgagtatgttaattgtgcaatattaggagaagcagatgctgaatttcgtgtttggtattctttctgtctcaagggagggcagtttgaatgcaagacacaaaatatacactgtcttaaatttcttttataaggtaaagcacttatgaggaatacttttatatttttggattttggctatcaaaattaacagcttgtttattttattttttcagttttttcatgttatttttttgtaattttaaacttgtaaaaatgttgcaaaaataccataatacttttcacccaaattttccacgtactaacatctcttacatttgctttatcattttctctattaatatatacatattattattttaagatgtttgagactaaatttaggacatgatgccctcgtatccataaagagtttagttatatgtcctaataacaaggtaattcatttacattacaacagtggaataatcaacatcaggaaattaacactggtacaatagaaatgtctaatctatagaactgagttgaattttgcattattccataaatgtcctttataataaacaaaaaatttttttaggggagggtttgggatctaggattcaatctaggatcaaatgttagattcgtaagtctctcagtgtcctttaatctgcaatcattcttctgtctttcttcatcttgacatttttgaagattataggccaattattatgtagagcatccctaccttagatctatgggatgtttttctatgattaggttcgggttatgccttgctgaaaggaatgccatatagtgctgtgatgtccttctcagtgtatcatatcgagaggcacaagatactcattcatcccattctgctgatactactttgatcacttgtttgcggtgatatttgccaaatgtctccatggaaaagttacagttttccatggagattgatgtacatttcctagttcctatcagacttttactcactctttttttttcttttcttttttgttttttgagatggagtttcactcttgttgcccaggctggagtgcaacggcatgatcttggctcactgcaacctccgcctcccaggttcaagtgattctcctgcctcatcctcctgaatggctgggattacaggcgcacatccccacgcctggctaattttttgtatttttagtagagatggggtttcaccatgttggctaggctggtctcaactcctgacctcaggtgatccacccacctcatcctcccaaagtgctgggattacaggcatgagccaccatgtccagcctcactcactagtttttacatacactgatcgttctagcctaaataaattattaccattggggtgtcatgtggtgattttgttaacgtcaatattccttctacatttattagcttttattatactttaagtacaggtttatctttttcctcttttgtctagtaattcacttatataagaaggaactcatagattgtaactttatcatatgtgttaaaatcattaatgacattttatatacagatgctcagacagtttaaatagagctaagaaggtgatcatttatgcactagttgcattttcctcctctcctctcttctataacatcttagctaatattgttgtcctattccattattaggataatccagcagaatctgttgctgtttcgaaggttgggtgccagttctgccttagtgattcattgaggtggagctgaaagagcagaagtcaccctctccttggaagccaggagcattttattgtttttaacagtgctgagaatgccagtgactctaaagatgagaaaaaaaactctcttaatgagtttcagcattttaatgtactgcaggttcccaattgtatgagtttaagaagcttagcaattcggtatcttctgaataatagcatttattttatactgtaaatactcccagggaagtctgaataacactacagcttcttcggtgtaatagctttggtgagctaattgacttgaacagtggaattgctccttaaaaaaaaaaagccacacagttttgattaatgagcccagtaataaatcattaatctttgtcgctcacaaatgataggaacagtgttatgtttcccaccctgtaatatatttcttgattctcttgctaatacagtggccacattttaaggatctcattatcaatttaatatgcctacctccatataatttaatataacatctagtaagtttacacttatgaggaacacaatgggacacattctaaatagtgataattgttctgtaattaacatgacttatatttacttagtagctgtcctcttaaagtgttctaaatttccttatgtaataaaaattgtagaaatgatcatgatttactgagcttctgtattcctgaaactctgctaaatttttagtatatcataacattgaatttctacaataaccctctaaggttattagtattattatctccatttttcagtcaaggaaatttgctgagaagtgttaataacagttagtgtcagggccaccatgtcattacatgttcacagctcatgcctactcaaagttttctggaagcttaagaacaaaatcatttttattaaaatggaagtatatagttatacagtcaatccaaattgatgtttgtcattgttttagggcttaatgtatctcagtgtcttttacattttaaaatttaattttcatgcatatcatgtagctgagacaccgtttaaaaataatttagattgtcaaatcatcattttaaggaaaatggaatttcaagttaagggctataagagttaggggacagatatctaattcttcgttgccctaatgtgtcagctaacaaaaaatagcactttattattgaaatttagttgtgtaacatccactagtctgaactttctaaggcaggcagagatcatgtcctattacatctttgtcctcagaatttagctcaaggggtgacatacactagaagatgaaaaaactattgaatgagtgagtgaatgatcaagagcaaatatgaaaaaataagtggatgatccatttagtaatgtgcccaagtcaagagatggaaatcgacaagtgactttgagttggattagtgttgtgaccacgagtacctccatttgttcaggtgagctacttactgaatcacaagactcctgtagggagaaaacatataactaagaaaaactaagatgtatgcattactttttcattgatagcctaggcactctaagtaaaattatttaactcattgtcgagtcacattaaacgtaagacttatttctttctaacttacgagttttttaaaaattgcaaataaaaattcaaaagctaacagaagacaagaaacaactaagatcacagcagaactgaaggagatagagacatgaaaaatgtttcaaaaattcagtgaatccaggagctggttttttgaaaagattaacaaaatagagagactgctagctagactagtaaagaagaaaagaaagagagaagaataaaatagacacaataaaaataataaaggggatatcaccactgatcccacagaaatacaaactaccaccagaaaatactataaacacctctatgaaaaatctagaagaaatggataaattcctggccacatacatcatcccaagactaaaccaggaagaagtcaaatacctgaatagaccaataacaagttctgaaattgagacagtaattaatacgctaccaaccaaaaaaaccccaggaccagatggattcagagccgaattctaccagatgtacaaagaagagctggtgccattgtttcagaaactattccaaacaatagaaaaagagggaatcctccctaactcaccctatgaggccagcatcatcctgataacaaaacctggcagagacacaacaaaaaagaaaatttcaggccaatactcctgatgaacatggatgcgaaaatcctcaataaaatacttgcaaaccgaatctggcagcacatgaaaaagcttatccaccacaatcaagttggcttcatcccagggatgcaaggctggttcaacatatgcaaatcaataaacataatccatcacataaacagaactaatgacaaaaaccacatgattatcccaatagatgcagaaaacgccttcgataaaattcaacaccccttcatgctaaaaactctcaatatactaggtactgttagaccatatctcaaaataataagagctatttatgacaaacccgtagccaatatcataccgaatgggcaaaagctggaagcattccctttgaaaactggcagaagacaaggatgccctctctcaccactcctattcagcatagtattggaagttctggccagggcaatcagtcaagagaaagaaataaagggtattcaaatggaaagagaggaagtcaaattgtctctgtttgcagatgacgtgattttatatttagaaaacaccattgtctcagcgcaaaaactccttatgctgataagcaacttgagcaaagtcccaggatgcaaaatcaatgtgcaaaaatcacaatcattcttatacaccaacaagacaagcagagattcaaatcgtgagggaactcccatacacaattgcatgggagaataaaatacctaggaatacaacttacaagggatgtgaaggacctcttcaaggagaactacaaaccagtgctcagggaaataagagcagacacaaacaaatggaaaaacattccatgctcatgggtaggaagaatcaatataatgaaaatggtgaaaatggccatactgcccaaagtaatttatagattcaatgctattcctgttaagctacgattgactttctttgcaaaattagaaaaaaagtactttaaatttcatatagaaccaaaaaagagcttgtatagccaagacaatcctaagcaaaatgaatgaagctggaggcatcacaatacccgactttaaactacactacaaggctacagtaaccaaaacaacatggtactggtaccaaaacagatatatagaccagtggaacagaacagaggcctcagaaataacaccacacatctacaaccatctgatcttcaacaaacctgacaaaaataagcaatggggaaaggattccctatttaataaatggtgcttggaaaactggctagccatatgcagaaaacagaatctggacccctttcttacaccttatacaaaaattaactcatgatggattaaaaacttaaatgtaaaaccccaagtcataaaaaccctagaagaaaacctaggcaataccattcaggacataggcatgggcaaagacttcatgactaaaacactaaaagcaattgcaacaaaggccagaattgacagattggatcaaatcaaactaaagagcttctgcacagcaaaagaaactatcatcagagtgaacatgcaaactacagaatgggagaaaatttttgcaatctacctatctgacaaaggtctaatatccagaatgtacaaggaacttaaatttacaagaaaaaaacaaccctatcaaaaagtaggcaaaggatatgaacagacacttcccaaaagaagacatttatgcagccaacaaatattaaaaaaaggtcatcatcactggtcattagagaaatgcaaatcgaaaccgcaatgagataccatctcatgccagttagaatggcagttattaaaaagtcaggaaacaacagatgctgacatggctgtggaaaaataggaatgcttttacactgttggtgggagtgtaaattagttcaaccattgtggaagacagtgtggcgattcctcaaggatctagaaccagaaataccatttgacccagcaatcgcattactgggtatatacccaaaggattattaatcatgctactaaaaagacacatgcacatgtatgtttattacagcactatttacgatagtaaagacttggaaccaaccccaatgtccatcaatgatagactggataaagaaaatctggcatatatacaccatggaatactatgcagccataaaaagaatgagttcatgtcctttgcggggacatggatgaagctggaagctatcattctcagtaaactcacacaagaacagaaaaccaaacactgcatgttctcacttataaatgggagttgaaccatgagaaaacatggacacggggagcggaacatcacacactgggggcctgttggggcaggggggtaaggggagggagaggattgggacaaatacctaactcatgcgaggcttaaaacctagatgacgggtcgataggtgcagcaagccaccatggctcatgtatacctatgtaacaaacctgcacgttctgcacatgtatcccagaacttaaaataacatctaaagaaaaatgtaaataatgtatatgccaaatgatgccggcaatcgtgatgaaagacattcttttaaaataaaaaaatagtttaaccttatttgaacaccctcaactcactgttgcacctcttctttgctgtttctctaccaaagtcaccaggttaatataagaaatgaaggcaagacagtatcacctagttaggttccttctccagctaacatggcattaataaactgattttcattatgatatatacacacacagcacaccacttttctccaagctaatattaaggatcacagtttaccaaaagttgtgcagcctgttctctttggaaagcctctctttggaaagactaggatgaaataaatctactatatgccatccttcacttagactgacagaattttaatgtatagcagaatttttttttaagtgccaatgtagagctgactgcttcctctataacacataaaatgcatatggctttacagggccagttttctgtacaattgacattggacaatttaggaataaatgtagattcaagcaaaacagcacacaagagaacattttgtatcaaagttgtggcttttcactttatgtgttaaatatatatatatattttattatactttaagttctagggtacatgtgcacaacgtgcaggtttgttacatacgtatacatgtgccatgttggtttgctgcacccatcagcttgtcatttacattaggtatttctcctaatgctatccctcccctaccgccccaccccccaaccccctgacaggccccagtgtgtgatgttgcccgccctgtgtccaagtgatctcattgttcagttcccacctatgagtgagaacatgcggtgtttggttttctgttcctgtgttagtttgctgaaaatggtttccagcttcatccatgtccctgaaaaggacatgaactcatcctttttatgtctgcatagtattccatggtgtatatgtgccacattttcttaatcctgtctatcattgatggacatttgggttgattccaagtctttgctattgtgaatagtgccgcaataaacatacgcgtgcatgtgtctttatagtagcatgatttataatcttttgggtatatacccagtaataggattgctggatcaaatgctatttctagttctagatgcttgaggaatcgccacactgtcttctacaatggttgaactaatttacactcccaccaacggtgtaaaagcgttcctatttctccacatcctccccagcatctgttgtttcctgactttttaatgatcaccattctaactggcatgagatggtatctcattgtggttttgatttgtatttctctgatgactaataatgatgagaattttttaattgggaaaaactacttcaaagttcatatggaaccaaaaaagagccctcatagccaagacaatcctaagcaaaaagaacaattgaattatagaacaataagaagaacaacaaaaagaacaataagaattataacctcagctttctcacatgtaaaatggggctatctacctcaagggctaaggaatataaacataatgaatttaaatgattttaaagcatagtattttttcatatagtaggcagtataaatactagataatatcataccataaaaaggtaaaggtaatgatatatatcttacctaacaacaaatagtttatataaaatgatattaatgttaatcttatatggcaatggataattttagtacaagtatgtcttatgtattattcatgatatactaaaaatagtatttgttgtttatcaaaaatttaaatttaacaagatgtcttatattttattgggcagccttaatatatatgacacagtgtttgtcaagtgagctctgttgcataattccaggagtcatcatttgtgctgtgttctgggcggggggcggggatgtcagtagactacaatgagaatggttgtctttgagtggaactcaatgcccctaatatcttttacatttcaatggtatgtttttgtatgtttaccaaaggtgaatctaggtgagcctcagcaagcctaagctgtcatattctaggcagaagatataaaaatgttttgcatctgttctatatttgtatgtgttatggtgattatttcagaagtaattagtagtgtatcatagtaaacctatggctgtcttcatgtcatttccacagttccatagttgtttggggcatcatagtctttatcgataaatcagttacagctttctatctcagagttcatagcaggtggataaaatagacattcctggggaacctctttctgagcagtgaattaaactctgagatttgtttacaatattgagtagttctctatagttttgtttcctgttctcatttttgaccatcaggaccacgagtacaaaacaatatatatttgtgatatggtaatatattaaaataaaactatagagagatctcaatattgtaaaatgttaatttagcattttctcacaggagaaaccatcacatcagggctgataactggtgatactgagctcaagttcatgaggtgtatatggagggagaaatcaaggaaagccagagatccaatctggccacctgttccaggaccaaaggtaacttaaatttagtcataaaggctggagatcctcatggaatcattcactgcctaactcaattgaaggctcctcaattgatcttgaaataaaagccagcccaagccttaaagaatagcctaaatgatcagtggttcaacactgggcattgtttcacaatcaggtccctgctgagtttgttctccagaattaaaccttccaattgaacttgaggacatgaactccagttgctgacactgtgcttacattatatccgaaataagtaaatgcttctttttaaaaaagtatttcttggggacattgttcttagtgtttcttatcttagggaaattgttcttatttttgttttggaaggaaaaaattggcagtcaccttcctctaactgaatcaccatgcagaactaacaaaagagaaatcaccttttctcttttagtagagacagaagacaattgaaaatatagaggcaccttcactgcttagcaaacaggacagagggcatgtttttaggtaccatttaagggtgaaagcctacttctttgcagtccttctttactcttccctttggtctttaatgccttaccttggatgtttgcttctggagcgcctgtcttgaggtaaggcatcttactttgcctagtcagaggcactggctttgtgtccagggaatgcagaagtcctagtgggaagttcagagctgatcgtatgtcctcatttcttcatagcaatatagatttgacaaaactaacacattgtattagtcagggttcttcagagaaacagaaccaataggatgtctctacctcactccctctcgtgcactctgtcactctgtctccctctctccccactgcaagtctctctctgtccttctgtccatctccctctcttcctctatccctccatctttccctctgtctcccatttccctctctccccatctccccctctgtacctccgtccctttaccttaatctctcactccctctctttttctctccctctctccctccatctgtccctctcctcctccctctctgccttccttcctctctcctccacatcactctatcttacccctcccctctttattgtatgaacttgactcatgagattatggaggcaacaagtcctaagatcttctgttggcagctggagtcctaggagagcccacatggttgttccagtctacaggctgtcaggttcaagactcaagaagggctgatatttcagtcacggtctgaagacaggaaaatgtaattccagctcaaaggcagtcagacgggaggaagtctttcttaactctggggaggatcagcctttttgttttattcaagtcttcatctgattgggtgagggccacccacattgaggagagcaatctgtttcacacagtgtatcaatttaaacgttaaactcattcaaaaatagccccatagaaacacccagaaaatggtttgaccaatctgggcacactgtgtctcagtcaagttgacacataaaattaactatcacacaaatatataatactgaagcaagtatggctgaaacagcaggcttccatcagttctcatctagaggtgcagtaactatcaccagaaaagtgaggacatctttgttcgaattagtgttaaactaattccaaaatatctgatgcctttagggcagtttgttaacatggaatgctctgattccctgttttcaaagtgagaaaaaacatttagtttttattattattaatttttaaattgctgcagcatataaaatagactgttccattaaaaaaatcttgctcccttgcatccacattaattttcttttctacaggtgagagtcactgaataacgatatttataggcaatctctagaattggtgtagtgtagtaaaaagtactacatcaagtcaaacaatatcccttatgatattgcttattcacttactaacttaaaatataggacccagttttctcatttgtattttttggaataataactctttccctatctaccttatgagatagataaagggccacatgatataaaatgactctgaaacatttaaaatattaaaaactctgctccatgtaaggtaatattattatctttagtctatatatacatctttctcaatgtttttaaaaaatatctatagttgcatgcttgctttagagttgtttcatacctcttcagggtatttctaaatgttttgtcaccactgctcaagataattcatcttgagatagcattttttcacccagtagttaaaaaatttctataaattcgttatacacaattttgtgacttaaaagctcttggaataatcatggaggtgcacgtatctttttcatatagttatttccttttttttttggatacttagtaatgggattgctgggtcacatgttagtatttttagttttctgaggaccctcatactgttttccataatggctatactaatttacattctgactaaaagtgtatacgagttcccttttttcaacgtcctcaccagcattggttattttttattttttctgataataggcattctaataggggtgagatgatatatcattgtggttttgatttgcatttccctgatgattagtgatgttgagtatatttctcatatatctgttggccattatgaatagttggcagatgaatagtatgcaaatatttttgcccattctgcaggttgtctccttactcggttgattgtttccttttagttggatacagtcccattagcccgtttttgcttttgttgcctgtgcttttgaagtcttatccacaaaaaatctttgtccagaccaatatcctaaaccctttcccttatgtagtcttctagtagtttacagtttgggggtcttacatttaagtctttaagccgttttgagattttgagttgatttttgtatatggtgaattataggggtctagtttcattattctgtatgtggatatccagtttttatagcaccatttaaaaatttagtatgtgtacacacacacccacacacacacacacagtggaatactatttagtcataaaagagaataaaattctgtcatgcatgacaacatagatgagcctggaggatattatgttaagtgaaacaagtcaggcacacaggaagataaataccacatgttctcactcatatgcaggagctaaaaaacttgaactcatagaagcagagagtagaactatggttactagaggctaggaagagtagcaggaagtggggatatggggctcttttgataaccaggtacaaaattacagctagtgaggataaataagttctagagttttatggcactgtaggatgactataattaacaataatttattgcatatttttaaatacctagaagaaaggagcttgaatgttcccaacacaaagaaataataaatgtttgaggttatgaatatgctaatgaccctgattcaatcattacacttgtattcatatatcaaaatatcactttgcaccacatacatttgtacaattattactggccaattaaaaatgttttttaaaaagggttcgatagtatataaagtaagcaagaactaatcactcactgagacccatagggtgttccattatgaaaagaaatagtaggaatatattcccataaagcagttctactcaaagtttgttacttgatacctatccacaatgaaatatgtacagaaattgagagaacgcatttaaaatcttttataacaattaacattaacataatatcaaatgcaatatgtaatttggtgtccgttgagtgtaatgatgaaaagttggacttgcattttgcatatccttttattttattttctattaatttatttttcttatattctacaaatatattgatccatggcatattggaaataaaaacagttcacactccaggtagcttaagaaattactctaaaatctcaacttcatgctagtactgtagctacttccagagcatttaaatgtcattccatcaaatgtgaatgttagcagattgttgttaagttttaaaattgtgttctactaatagcctttttcagaattatgtttctataatagccataatgcatattcaaaaacccagacgtaacctttgatctagatagggcagtgttttcttgtcctctacaagtattcatttgcttagccaccttgaaaggttctgaagttctgaaattgtcttaaactgctcaaaagcaaatgaatgacaataaatctgattttgacagcatacatacactaaaaacctgagaaaaaggaagtcatttcagagaaagtaaattatttacatatttttgcgtaagatgacagatctgggctcccattaacaatggagaggatacttttctaacttttaatgagcttttgacaaaactaaataataaaccaagaaatccttgtacaaatgaaaaaatgtagaaacagaccaaaatgggggagttacttatagtgacatggacagttatatgtaatagatgtatgaattgtagtcatatacttttacaatctaatatacactgcaaaatattcattcaatgactgtgtgtagaatactagctaaggctaggaactcttttttcatagccttcactctttgactcaagcttattgacgaataggcaaaagtgaataaaacaaggaactcagatatatttatttttgtctctataatattcttttgaaccacaacctatttattaatcattggattttaagaataaagtcagtgttgtaaattggcaataacatcagattatcatctatttctagcctgttcctctagctgagtggccttgggcaagtcataatctcaccactagcttctgcttttttccatctgttagataacaagattggataagatgccaccttaggtccattcaggagatttggccataaaaatttaagttaaaaaattataaaaagatctttttgattgcagttatcttgtgaaaaacttttccggaaaattaaaaggaaagagttctttgtttcatagtgccaatgaaccttttgaaaatgaccatccatttacataaacctgatatataaataaaattgaaagtaaaaatataaatgtatgtactattttaaagtttattttatgcataatttaaattctattttcaaccaatatattcaagactaatactgcattcatttcaaagaacagaattacttaaataacactccccaatgtcatattctttctgtgaatacaaattaaagaacgacactatccaatgtgctactgtctctgtgaatacaaattaaagagttggccttgttgtttgaatttggattcagaaaatagcttaccaggcaatcccttatgtactaagctctgcgtatttatggtacaccattttgagcagctgcaatgcattcaatactcagggaatttggaaatgattttgaatttggataaactggtgcactgatgcctggagaaaattctaaggtctgtacagtaccctgagacaatggcgtagactgtaattattaacctgatcaagggcaaaggggtattgaatattgagcaaattccaacccattcataggactgtcatgtgctgtggcccactcattggtaggctctgggttgatgaggaactccaaagctctggggcacgtatttcttgtataacttgagtagttctagacatgtgggactcagaaatcacatcataagaaagttgttcatttctcaattcttctttaattctgattcttcccagtaaaaagactcagtctggtgctagtgtgcttctaacacttccattaattatgaattccctttgcaacagagagtgaagcgggagcaccaaagccttctgcaaacagtatctagctataatttgaaaacatgagtttgttcactgtttttacagtaaccttctatttatggcaagtaatactggccttttagttatggtaacaacacaaagtgttttttttttgagacggactctcgctgtcgcccaggctggagtgcagtggcatgatctcagctcactgcaagctccgcctcccgggttcacgccattctcctgcctcagcctcccgagtagctgggactacaggcgcccgccaccaggctgtctaactttttgtatttttagtagagatggggtttcaccatgttagccagggtggtctcgacctcctgacctcgtgatccacccgcctcggcctcccaaagtgctgggattacaggcatgagccactgcgcccggcctacaaagttattttttaaaatagatttatttaagccccagaggtatgtttatttagaaaaattttaaaataagtaacaacctatgactgtcaaaaatttctaacatttggtgtttcaaataattgaagcttgagaaacattggacttgtggaaaatacactgagctggaagataggaaaattagtcactaaatctaattttagccctgtcactaattattagattgtccttgggcaagattgaatctttcatgtctccatttcctcattatccagtaagtgtagtaatatttgccaaactacttttggagcgacaatgtgaagattaaaattaaatgatgaatggtgaaatactatgaaccttggaagttatacgtagataaggttcattattatgtaactgaaatgtcccctttttttttatttaccacttcacaaaaacaaaaacaaaaacaagatcaaaaccatttaaagaataataatattatctctgttttttctctaggaccattaacagttactggtggtgatattgatgatggtggtggtgatagtggagtgtgtgtgtgtgtgtgtgtgtgtgtgtgtgtgtgtgtttatatgtatgtctgtgacagagaaagagagggagattaacttcactcattcagtttctatatgtaaactattcctaaatattaaggctctagtcatcttttccagattgattatattttatttttgctatttcccacggtgctaaaaagcttgaaaagtaaactgtgtttaaaatgaaactaataatacatcatattcactccaagttttaataaaaatatcacaatctatctgaatatttagttgttaaaaatacagaaatttagttgcatacaaaaattatttcttgacctgaaacaacatttggattcttgtttattctacttgtttattgtttttaaaaccgtaaatatctaataatatgatatcttttcacaaaagatattttactgttacataataccattttctatagacttcaggatttctttttctaatttaatgtctggcttatccttgaagctaaggtttttgtttagttaaaatataatagttcaattaaatatctggtacattttgatattaatgactaatctgtcaagtttttgactgttttatttgagacataaatacaactaagttctaaattattaattcattatataaaatagagaaaattgatacacacagaaataatgctagtaattgtggtttggtttcccattctattaagcaaaacttatttaagcattattggtgctgaattaggagatgatagacatcataatcttatttgtatataaatatttaggcttggtctaggatggcaattctcaaacttaagctgtcatcaggatcacctggagggcttgtcaaaacacagatttcttggcccactctcagattctgcttcagtagttctgtggtgaggcctgagaaattgtgtttccaataagttcccaggtgaggctaaggctaatgttgcatttctgggactatactttgagactcgttggtctagtggaaggcagtagaccagagcaataaatcccatggactttggtgataggcccagatttcagccctgactttggcacttatgagctgtgtaacttggataagttagggatcaattttgtcatccataaaatggtaattatatctattaagaatattgaatgaaataatgcatgttaagtgtttggaacaatgcttagcatattatgaactctcattaaatgcaatatcagtaactaattgtgatggtagtaagagtggtagtcatagaagtagtggttaatggtaataaaaaagaatatacacatttgccttagttcaattgcattaaaagtttattggtcggccggacgtgatggctcacacctgtaatcccagcactttgggaggccgaggtgggcggatcactaagtcaggaggagatggagaccatcctggctaacacggtgaaaccccgtctctactaaaaatacaaaaaattagctgggcgtggtggcgggcgcctgtagtcccagctactcgggaggctgaagcaggagaatggcgtgaacccgggaagcagagcttgcagtgagtcgagatcgcgccactgcactccagcctgggctacagagcgagactccgtctcaagaaaaaaaaaaaaaaaaaagaaaagtttattagtctttctaaggaatgatggatggagagcttggctttcattgatcattttgtctatgataaacattctgcacaagacatcagtaaaaagaagtaatgcccctagtgaaagcactttcaagagcattttggagattattatctagattgcagtttaaacaaaagtttctctatttgtacaatgtttctcaatactcagaacttaccatatttgttactttccttcccttagcaacaagagcaagacccaacaaacctatacatctcaaatctccccatttctatggatgagcaggagcttgagaatatgctgaaaccctttggacatgtcatttccacaagaatactaagagacgctaatggagtcagcagaggtgttggctttgccaggtaaaattctttctttgtatgtaatcgttctttcctcattgttccttttaaattccattccttttttagtactagagcccaaagcaatagaatatgcaaaaaaaaaaaaaaaattaaaagtagcttatcaaatctgtcatccctctgtgtctttgcttggagctaaataatttcaatgtaattataaataaactgtgcttgttcaaatgtacgtagaatgtgtttatgtgtcttgagtcataataacatacatactcagttcccagtcctctctgtgcctgtggatcaacaaaatcagatgctgccaatacctgacagagacaataaatgcccagtaccccaaagcaaaagagcccatgtggtgaacaaagcatctaagtgtttttgcattgatttccaaaaaagggtgctagcatttctcagtaaagagaaaataaaagaaaggaaacatttagagaaacaggaattactgagaagacccagcaaactcagaaatacaagggaggtcaagaagccatttgcatttaagaggccctggctatgtttttgatattttaggcagaacaggggaaaaaaaaatattcctttcattgtaagaaaaggaagagtaattttcattttaactttgaaggaatgtttacaaaagaggatttcagccaggaatggagtttaaatagttgtacctgctgtgctttcatgaaaaacaaagctaaagagaccacagagtaaaagaaactgctcaatgacaatgaagaaaaataagtcttgtctctatggcttggtacatttatgtgtgtctccagctgatttatcatggatgaatggatggatgttaagtgttatgtggaagtcagcccattgcagacaagtttgttcatctagggccaggcagggtggctgacgcctgtaatctcagcactttgggaggctgagaagggcagatcacaaggtcaggagttcgagaccagcctggccaacatagtgaaaacccatctctactgaaaatacaaaaattagccgttgcgtggtggcacatggctgtagtcccagctactcgggaggctgaggcaggagaatcacttgaacctgggaggcagaggttgtggcaagccgagatcgcgccactatactccagcctgggcaacacagcgagactccatctcaaaaaaaaaaaaaaaagaaaaaccattccaaactaacttccgttaactcactttagaagataacaaatcgtcatgtatatgttaactaatctctaactttatttccttggagttgtggttgtggaccatgtgtgaaaattcttcttattctccataatgtatacatagtaaaccaggagacaaatgcaaggtacatgcttgatgatttgaatagaaataaacagaatgaagaaaatctccctgacttgaatgtgtgcatgaggtattcaggctttcaggacattgacaactgttgattttcatggccaaggcagagcttatgacactacttggatctctgaatttagccaatgcagtcattcttatatagtgtgcaactagctattggaggcctgagcgatgtgggagttcactgaaccaactgtcatgttttactttacataccatacacattcctttggttcttcccccatcccttgccctccaaaaactctccaataaattagtttctccttcatttggactcttgctgggaaataaatgcatttcaaattcattaagagcacatatttccaagaagacctacagtgatatttttttctttaaacaaaggatgtgttcgtacaaagtatattagtttcctaggtctgtcataacaaaatgtcacggaacagtggctcatacaacatgaatttattttctcacaattttggaggctagaagtcagaggtcaagatgtctttatagctggcttcttgtgacacctttcttcttggcttgtaaatggctgtgttccccttctgtcctcacatggtcttccttctgtgcatgcctgtgtcttaatctcttaagagcaccaagtcatattgcaatagggcccaccctaatggcctcattttaacttaattacccctttaaaggggtaattacaaatacagtcacattctgaggtattgggggttaggacttcaacatatgagttttgtcgggtacacaattcagttcataacacaaagattgaactattcatttctctcccatttatcttttctatacaatgagagtttgcttaaaatgaggcatatttttcttaagtacagagtcaagtaatatatattctaaaaggcagaactataatgctggtatatgagatcatgaaagaataaaacttacaaagttatttttctttaggaactgagggagggtgggaattttacattttagctctattctgaatgcagcctctctctctcctctgttgcattttgcatatagaagccacagtgagcccttcaatattcaaatctcatcatgtcagggtcctgcttacaatccttcaacatttcacttgccaacctctccagcatcattcttgatattgctcgccttcctggctttgactctgtctcatgttcaggcacaagctgcccttcttgcctggttatactttccatggctcttctcctgacttctgcctgctcatctctcaggcaatggcttaaacatcttttcttcaaagaatttttcgctgacctccaatctttggctttggacaaagttaggtgctcttgttatagctcctataaaagttttgttttttctttcaaataaaatatatcacgattacaatgaattcattgtttaatttctgtcttcaccaaatggattgtacatttccttgggtcaagttttctttttctttgttggatggatgactagatatgtggctagtggatttcataattaccgttctgtgaagtttcagaatagctaaattcattggtcttttacaactttgagcttcaaatatgaattagcagtcacattccaattctgaaatttaggtatctgtatttcagaaagtgccatgtggactgaaaaggcaaacataggttcaagtcaagccactgatttcttatgcctaagaaataaaaatgaagtgtgagtctgactatcttttgaaagaagccaggaaaccaacacagaaaaagtatttcgttctccatgtatcttagattttaaattttgaggagcagaatcccatataattagcctaatttgatggggtgagaatatatttttagctgtaccataaatagatctgcccaaattcctacttccctataacattggctgtgcattttctcaagcaattatggcttttgccttaactaatttgatcattcacaacttaattcttgcacaaatgtttctccttttaaaaatattatcctgtcccttttccactctgcttttctcatctgaaattttccctctgaaccacaaaacagagatgatttcagtcaccattttcttgattcttccaagaatagcacatagcaagtgagagaaattattgtattacatgaggatgtcttgggacagtggttctcaaagtgtggttcccagatcagcagcttcagtgcttcctaaaaacttgttagaaatgcaaatttcctgcccccaatctaccgaattaacagtctggtggtgagggtgttcagcagtctgtaatctgtgtactaacaagcactttagatgactctaaaagcactctaaagctttgccttaggtcattagtacttgttcttaggaccacctgaatgatctgttaaaactctgattgctgggcccactcttaaagtttctgatccagttggcttggggtgagactcaattatttgcatttcttttttttttttttaaattttattattattatactttgaattttagggtacatgtgcacaatgtgcaggtttgttagatatgtatacatgtgccatgttggtatgctgcacccattaactcgtcatttagcattaggtatatctcctaatgctatccctcccccctccccccaccccacaacagtccccagagtgtgatgttccccttcctgtgtccatgtgttctcattgttcaattcccaccaatgagtgagaacatgcggtgtttggttttttgtccttgcaattatttgcatttctaacaagtttccaggtgatactgacactgctgatatgggaaccaccctttgagaactattgctttaaagttgtctgtgatttttccaggtggagttgattcctgttgatgcctgatttacattgttttactttctcaaaattactaataaggaactatcccccttcctgttcctcaagggtagaggccatgccttcttctttatatctgtccagtacttagaatattgacacataattgatcttgagcaaatttcttatgataaataaatgaaatcactttaaggttttgggtttttttaaatatagcaatatgcagaaagacatttgatgataatgataaaccaattgtgagatagagtactggaatattagaaaaatctgtggtagcaccaacccaactggtattagctcacaaattgtttcttcctctaggagtttacagttccacaggcattattaaaagaatatgccggctgggcgcggtggctcacacctgtaatcccagcactttgggaggccaaggcaggcagatcatgaggtcaggagttcgaggccagcctggccaacatagcgaaacctcatcgctactaaaaatacaaaaaaattagccaggcgtggtggcacgtgcctgtaatccgagctactcgggaggctgaggcatgagaatcgcttgaacctgggaggtagaggttgcagtgagctgagatcacaccattgcactccagcccgcacgatagtgtaagactccgtctcggaaaaaaaaaaaaaaaagtgcttatttaattgggagaatacctagccaataattgtgtctagtaaattgttgtacatatctcttgaatgtatgactgtttcaattcagaaaacctgaataattttttcagtggacttcattttgaatgttactattggtgacttctaaccatcatatgtggtccttaattcatgtacaagggattccaaaattcctttgactggaaagaacccccccgcctcaattattattttacttgcgactatacattaatcttctttgataaccatctcttcaaagtaaaaggagtatcttcattttatatttaaaacgctgaatttcaaagcattgatttgaatgccagtggggcgcacagacagcaaaattacaggcttttcaaagttccagaagcacaagatagtgtctgaaattacagacattttattttattttgtgtgtgtgtgtttttttttactctcttgtaacttaaaacaattttgtaagatccacccccctccaggcagcattttatagccaatttataaacctctaaaaaccgaagtttatggtgggaatgctgacagtcagccccactactgcagagctagtgaatgccaacagagtaccttgcctgcgagggtaaggatcagagcgtaaatcatccagagtctggagggccatgactgtgtgttcatgttatccatttcccatttccagaaacatgagactgattgtccagcaaaaatcacattgagagggtgttatgagaggccagtaaagaatgacccaaagtggggaagtgatgggtgggggacagggggagcagggggagcattcacaattaatccagcttcaacatctgggaacatagaacctctttaagcaatgcatttactatcccctggtgagctaaagagcgtgagagaccactgaacagagagacctttgtgttttgtagtattttttgcccttcctcaatactcttaatctgattctcatggagctttgtttgaatgacttctaacatatgggcagccctgtgttctacctctccctactgaatgtgcaagttttctaaataaataatttaagtttttctttcttttcattaagtaaaaaaaaaaagatgggtataggcatacaaatactagcctgcttactaaatatcaatcagtataaatagcaggtcttttttgtgttttctactaataactttgaatattattaaaatgttatttatttaccttctactgcctgatacttcttgttctcttcttccatctgctgaaatataatgagaccacagaaacagaataatcatatgaaaatacaggaattttaaaaaatatgttaaataacaatactttatttgaaggcaaatatatgactctttaaaatgcccatcaagtctatcaaatttttttaaattgtttggaattgtttggagtattgttttgactgtatctgtcttgaatccatcactgcagtaacaatttctccctcgctattttggcaatccttttgccgttactattttaaacacatgaaaccaggaaatcaaaagtgactaaggcaaatctctaaagtgtaaacttagtgattagtaatctccaaactacagctgtgtttgtacagaaacaggttacaactgtgttttctgagattgaagagaataaaggttgtatgtttcattctttttggtaattttaattcttcttctaattgccatcagatgtggtctgctggagagtatactcctggaccccctgcagcttcttcatctttgttcttcttttgtgtgtctcatcttgtttcttctccttgcctctttgtctttctcttaccatcagaaagtcaaaatcacagctggagagtgatgaacattctattttctttttcatatattcagagccctgggtttcaaaaccctaactaaccagtgaaccaaccaaacaaataaattgcatcaaataacttgttattctgaagtctccgagacggcagtcttgttgtatatatgcctttataaaaatctaacaaaggagatacaatatatactttattgctttattattataaaataaaaatgaccacatacgaaataatgccctctgtgaaatgcggagagagttctgaaaaattatttacctatataaaatggaactgggggagctttgttacctccagattagaaatggtggccattcagtatgctcagggctcataacatgtctttgacctgtacctgctgtaaacacaaagcatgtcaaggactattggagcatccagaaaagtggggacattggaggcagctagtctgcttctggccaatagaaaagtaagaggtggaaatatagcccaatatcatttgagcctcttttatttagtatattttctacactctcagctttctgtgaattgggccaatacatttattctctgtatctctatggttataaacatggttctacatgggtctgaaataacttagcttacatcttagttctgcacctcttacttgtgttcttggggcagttatataaactctctgagcctcttttcctgacatctatctatctatctatctatctaggtaggtaggtaggtagatagatagatagatagatagatagatagatagatagatagatagatagatagatagatgtcaggtcactattatccaatactggcttggtcaatattccagtaattgttatagatgaagtaattcagagatgtacatacacccacaaaaaaaatctgcttttacagaccaacattctactggattggggatgatgcaggatttttgctccttagttcaactaaatctgggttcttttctcatgaccaggaaaaattaggcatgtggatacactgaagtgtgaaaagggcagaatttattaagtgaaaggaaaactctcagcaaagaaaggggtagtatagccctaggtagtattggaaaaggcaacattcgtttggttaaaaggcattattcagaaagaatcaatcaggaaagagcgggcaaacaggggcagaagttgtccctctgggtcacaggtttcagttggaaccagcagtcatgtctttcagccttcaggctgttttaggcttgaaggtgatgtttcaccagggacccttccctatctgcctaggtaatttgtctgcctgctgcctctatcagggagatgacaataagtatgtaataaacaaataatcaaacatcagataatgaaaatattacaaaaacaccccaaacataggggtgtaatagagagtatggggcaataggaagcaagaggtaagagaatgatgttctgtcttcagagggaacattgaaactaaaatacaaatcagaaagaaccagccaagaaaatctcttagtgggagtagggaggcaagagaacaatcctggcaaagagaaaaggaagtagaaaacctaaggtggggccaagtttggcatgtttgggaaatagaaaggaaacaaaattgtgaaacattgagtaagggaaagaggtgtaataggtaataatgtcagccttaaataatgagattcagaaaatatgattaagtacagagtttatttgagctcagagcttgaagatggccactcaggagtgtagattcaagttgccctggatatacagtccaattagcagtagttacaagtgggtcttgaaaggaaaaaagaagcagtttttaagtttttgctaagaatatacattaaagtaatgtattgattggctattcatggttctttgtatcacagattccaagaacatgaagataatggtagaggcagctaattaggaacaaaaatgcctttaaaaaactaccctgggcatggatgctgtgaggaggggcatgatcaaaagtctccaactcatggctctctgggttggataaattttgcatacctcacatagctcagcctgatctgagttttctcatttccctccatttcatcaagatgttttgaagaaagcatagtagatgaactaaaagcattttgactccttagtcctatatcataaggaaggttcattcccaaatggttctgtcccactcaggtgggcgtgtggggaaggggcaggggagagaatacatctcagtaagaaattttaagtgtgcctaaagctgaattggaatggtatcacagggtggcaaaaatgagacttcagccaaatctcagtcaacttatttatatagttgctgtcacttattgaatcatcctggtctttagaatattatgactttaattttctcagaagcagtaaaacagtgagagatacatattgcaagtaaggattaccattacaaaaagagaacatgtattccaaaatgaaaaaggaaacctgttccactggtgagtacactgaaaacatcctgaagaaaattaaacccttgtcctttagagactcatagataggaaataattctggatttagtctaaaatataggaaaatcataaaaactcaaaaacagtagtcagtgctggaatctaatagcaggtgtgctatagttttcttctgaaacattatttttctctctccagttccccatgtaaaccaaggataattcttagtctgatcaatttatttgcaaaataagttttagtagtgctcttggcctgattatttgtataaagtgtaacaagaataatgaatggccatataggctcctttaagttggctttgctagaactttttcataaggaatctcaaattagatttttaaaagcctcttgaggctaggaaaacaagccaaggatttgctgtcaggttgtgcctgtaatacctatatgaattgggtaaagtcctctcttcttgaggtcccaaaatatcttgaggttcctggacctgtcagaaagtgatattctttacttatcataaggtcaggaaccttgtaagagaaccatgtaaaaatgtatcatgccagtcttttccagaggccttttattgggtttctaaagtcaacttcaattcctcaaagcaatctggtcatatctaaaaatatgccattccaataaaagctttggaaaaattaccagtgttcaatgtgtcctgataccaaaaaacaaacacattcttattgaacttatgcaaataactatattgccataaaacaagaatactcattattagtttccatattttgaagaaatcagctaaagagaaaagtgaacatttcaattttgcttgcaaatgtatactttaccccgttgctataagctatgaatagctgaaaagaaaataagacaaaatataaaagagtcagtaatgttgcaaacaaaaaagtcataaaaatcatttcagtcctctatcagttcagtaaattgaaataacttttgattgacgttgacttagcaatcttcattaatgtatcagctttttaattagagttctggcagattttacttcgtccaaaagtaagatctctaaatttatcagaaatctttattcaagaattcttgttgggattcttttccacgaattttttgaagaatggactatagctgattataaataacgttttgagaagacttaaagtaaaacgataattgtctgtggatgacaaaaagagtagccatggtcaaagatacaattgacaagaaatttaattatttttatggcataaaacaatgtaatataataatcataattatgtctgatagcatatatcaagacatatctgaatttaagaatctcatataattttggaatacatgttaatacatgtatactaatataactcaaacctatttttctaacttttattttaaattcaggggcacatgtgcaggttcgttatataggtaaacttgtgtcatgggggtttgttgtacagattacttcatcacccatatattaagcctagtacccattagttatttttctgatcctctccttcctcccaccttccaccttctgaagggccccagtgtgtgttgttcccctctatttgcccatataaacagcatttcttatttgacaatgcttcctatatgattttaacataccaaataagtgttatatgtctctcctggacttccaggggtttctcctttatgtccaggttagtacaaattaaaagataattttagaatttgaaatttaatttttggaaatatgtaaagtattaagggtttaaaacacttgatattgaaatttaaaaatgtttaaaactcatgatcaaaatagaatctgaagtcaatgcataataatagtcatttattttgtgaaaatgataattcaaaggtttcagaaagcaaaattttttattatttgatagggaagagatttaatacccaatcaagggacctaataaagacaacatgagggaaactctccctgcagcttaattattttacagtttactcaaaaagtaaacaaatcttttactatctcttattaatactacacaaaattcttgttctaaggagaaaaccaagttttacttttagtgtgttatcaatactaaagctaattttaataaaacattatgaccaaatctgtccaatctcaatcagctttgacctcacaaaataagatttccataaaccttttataaccttttgtaattttctattaaaaatgatcagtattttgagaaaaccctgtggcaacataggggcacagactgtggccttacatcagtgtgcttttgatattaatgctcagtttttagaaaaacatataaataatttctaattttagacaacttgaacacacacaaaatttctttcccaagattaatcttccacaaaccctctacaacgtgcttaaaatgttttgccactacctaagcaaaaattctatggataaatacataggtattttcctgatcagaagacagctattttcactaaaccaacaatattaaactagtcttaaagatttactcaaatcatgtgaactaaaaggcacttgagctggttttgagacaggatagttcccttggtacctttgtgggactcacaaaggggcggctcggttaggcagcccgcagcactcaaaccccttgtgggagggttagcacgcaggtgagctggtgcaggagccggggcaagtgcctttgggtgcctgcaggaacaaacactgtacaggcccatggcagcgcctaggggttgcctacgacccctggagccccagaggatgtgtgttatggtgtggtcctttagctttgtcatccatggatggcttaagtgtttaacagctcaatggggagttagtgtgacagcctcttccccctcacctcagttcttgtctggcatccaggaggagtgaggtcacacgaacaatttggagggtggtgaatgcagaggattttatcgtgtggtggaagtagttctcagcaggaaggggagctggaagggcaatatagtgggaagataatcttcccctggagttgggccatctgtggcagaactcttctatgaaattctgctgtcaagccatccctctgaagtcaagctgcttctttctaatatccagctggttcctcttttctccttccctgccagtggagcttggagtttttatgggtacagggtggagggtggggccggccagggtagttttggaaaaggcaacatttgggtgggaaaacagggatgtgaagttttcatttagggcattggttttgggcttgagggtggagccctcgccggggaaccaccatcttctacccagtatttccctgcctcctgtctgtatgtagtttctatttttctgataaaatatttgatttaaccacttacattttctttaagacaattaattggaggttcttcatatatgttgctagtaaaatgtcacatacacatgccacatttaaacatatagacatacaggacacatagaagcaaattttgtattaatagctttataaggttctccatttgccagtttgcaaatagtttctttcctctttagactctcaagccctaaacaattattagctaggctatcctaaatttacaatcacaaaaacatgactcttaggtgaaaatttacctcccaaaggcacagaacttagatctaaacacctttatttactgagacaaagaagggcataggtaaaggcccagtcaagataagattaccagcaaaaatatcttaaacaaaagtaaggttggttttataaactttaaggcactgtttttcctgtcataaaagtttctagtagcttaggtggagcaagggagatgctcctacaaatggagatttccgttatatatgtatatttattttacaaagagtttcaaaatagccacctaaatgccagaaagtcatattttggagaccaatctagtcagaaagctggtattttcaacttagcttatgtattgattagattactaacctcagggttgagccctttaatgaatagcaaaatgaaagcatttgcagtttttggggactaatgtttacatatgtgaaaaacaggcagtgcacctagatatttaaaattgaacgatcccacttttacattgaatcccgggtcccccagaaaagagaaatgccacaagaccggggtatgcaatgtttccacaatgcacctcactgcatacattccctcaagactggtaggtgagcaatgcccatcagcccactctgtgatcagaccaccctcccacaggaggagttttatgccttgaggggaagtgtttcctccaccttcaagtgttcaaacctgtctttctatctaaacaccggaaaaaatgagtagccccgtacatttataatcattcactgtaactgatttcagctgcttcagaaaccacagtttttgccagtgacttgtcagccattgcacacacaaaattcaagttgtatctcatagtacagagtaatccctggtaccctaaaagctaaagaggtcagttactacttctaacagctcttgcaaatctttattattagactcagttatggaagtacgattgcccataatcatatttcctttttgaatgataaaaaagacccagtgagaggaattttggtcacccaagaagaatgtttagatttgtcaattgaactgagctgtgaaatctgaccaattttaaagattacaaatttttcacttaagctgtaagattacactttttcttttcagagagaaactattttttccccgaccaaaattttaaatgagataaaagattgaaaaactctttttttttttttgagacagagtctcattctgtcacccaggctacagtgcagtggcacgattttggctgactgcaacttctgcctcccaggttcaagggatcctcttgcctcagcctcccgagtagctgagattacaggcgcccaccaccatgcctaatttttgtattttaaatagaggcagggtttcaccatgttggccaggctggtccgaactcctgacctcaagtgatcctcttgcctcagcctcccaaagtgctgggatcacaggcgtgagccaccgtacatggctaaaagatgggaaaactctaagaattaattcaaaataacactagctcaaaaagaaaaagtgaaagtcacaaatctgcaatcagcagagactctagagaataacaaatggaactcctaccttacagtagagcttcatttccaaccatgttgtggcaggaatgtgtgcagtttcaaaaagtgaattggtctgaatgttcaaccaagaatggagcattcaaatctgaggagggcttacccagttgactgacctccgctgactccagtgaggtcagatgaatgaaagttatgctcatatcaggactccagctgtcagcaaagcaagggagatcactgaaagtctgtttcaggtcccacctgagtcaccaaaatgtcaaccttaaataacataagtacagagattatatgagctcaaagcttgaagatggccacccaggagcctagattcatgttgccctgaatatacagtccaattagcaatagttacaagtgggtctttaaaggaaaaaagaagagaagttgtttatcaagacttttcgttaagataacataagctattaattggttattcattgctctttgtgtcacaaatgctaggaatatgaagataatgagtgagaaagctggtcaggaacaaaaatgccttaaacaattgcccccagtcatggctactcaggggagagacagccatgactgaagccctgtacttatgtctctctgggcctgataaatgttgcatatctcacatagttgacctgctctgagctatttttcttttctcaataatatctaggaatgaaatatggctgtagctaggagattgattaaaagtggtaatgtattccagagtcattaatggtatgacttttctacacctatgcttaattttcactttatctcagattatttatttaagtttaattttctgccatttctttatgaaaattccttctagaaacattggtctggctaaaaaaatatacttagataattatgcatctatgtgagtacatagatgagtgtccctactggggataatcaggtaatccaagtgaaagaagtagtttctagatggagtataaggcaaactttatctcttacatgcttcttgaaacacacagtctttgggataatttttttactcctctgctgttgatagctttatggtgtaggcatcaagatgctggctggaagcagagtttcactccagatgattctactgaagaaaattaaggagtatttaccaaatatttacagaagcagtgttaagggaactgaggtaaaggcaaagagatgttgatgttcccagagaggagcaacagagggaaacgtttaccaccctgagagctcaaggagcaaccacaagggtgtttccagagttcattgagagccagagcctcagaggagggcctgcttggaaggactgtagacagggagagatgcaacccctgctagacagaagtgccaaagcagggagacaaagagggaaaaccactcagatttctctctactcttgccttttgaagttctttctttcaagcttccataggcagaacccaatggaaaaccagtaaacaaaagaactaagattacacagtcgatagaagggtcacttccttggggcatagagcaggacagagaggacatttaggaaaggatgagcagaaatacaccactctccctgtataaattaagttaaataatttttcttttctcctaactattaaaaataaagaatgcaagttcagtgataaacagcacctactattttgccttaggattggcaattgatacagcttggtaggaataatggcaaagtggcttcatttaaagaacaaaactgctcttttactctgttccatggttgctgtgatgtctttttttctgacaccaaatgtgtgggtttttctgacatcaaataccttatttttgcatatcgattctctaattctctgacatcaattggatgtcctacaatttaactcagttttgacacaaactacctgatcatcatgagacttcacaggtgtaagggctcagttccacaccagctgcaaatggagtgcccaggtgtattagtccatcctcatacttctatgaagaaatacctgagactgagtaatttataaagaaaaagaggtttcatggactcacagatccacatggctggtgaggcctcacaatcatagtggaaggcaaagggggagcaaaggcttgtcttacatggcagtaggcaagagagtgtgtgcaggggaactatcctttataaaaccatcagatctcatcagacttactcactatcatgagaacagcacagaaaaaaaacccacccccatgattcgattacctgccaccaggtccctcccatggcacatgagaattgtaggagctacaattcaagatgagatttggttggggacacagcaaaaccatatcaccaagctacccacatttcttcccagcaactacaaaatgtgggagtacccacaactccccaattcaggtttagtaactcactaaaatgactctcaaagcactttatgtttatcagtttattataaaggatacaactcaaatgaaagaaatgcatatggccaagcatcagggaaggagtgtgtagcttctgtagcctctctgggctcactaccctcctggcatatatcagtgtcttcaccaaactgaaaatttcctgaaccttgttgtttagggatttttatataggtttcattaggtaaaacctctgggtttgattaattaaatcattagcccttggtgtttgagctcaatctctggcccctctccagttcttggaagtcagagagggtggggatgaaagttccaacccactaatcaagtcttagtctttctggtgaccagtccccatcctgaagctacctgagtgacctcattagcataaactcagatgtggttaaaaatagtctgttctgaataacaaaacatacccctatcactcaggaaattccaagggttttagaagctgtgtgtcagcaacctgagaaaaagactaaatatattttttattatgtcatagttgccatgcagaaagcatgggttaaactgtcccatctattaaaaggaatcacagatttcaattttcatgtgaaatctcccaagtttcaaatgttgacaaccatttcaaaatttccaaaatctctttgcagtccaaataaaacatacctgtagactgggtttggcccatggtttctagtctctcatacctgacacagaacttcggaacaggagttttcaaccctggctgcacactgaaatcacctgggtagctttgaaatctttgtgcctgggcctcatgccaaaacaattaagtcagaatctcctgggctgggccccagagattggtatttttaaaagtagttttctgataattttaatgtacagtgattttaaaagcttcttattttgcaataagtttaccttcacatagaagccataatgataatatagattttctatatattgcacacccagtttcccccattaacaacaccttaaattaccatggcacatttgtcaaaattaagaaactgacattggtatattactattaactaaactccagactctatttggattttgccaacttttttattaacattttctttctgttccaggatccaatccagttactatattgtgtttagctgtcctgtctcatcagcctgctctgatctgcgataatttcttagactttgtttgttggagtagtactggccaggtattctgaatgtctctagatctgagtttgtcagctgtttttctcatgataagacccctagttttcatgggttttgggagagaataccacagaggtgaaacacccttgacatctcatatcaggttatattccatttttgaaaacaacttcttgaagtaatagtggctgggtagagtggagctagcaggacccatcctactcttgaacagattgaagtacatcagtcagtagagaaaatcaggagggatgacatgaggccagcaatggagctgcatctcttgcaaataaatagtctcaattcaaagtcatgagacaacagttctattccaggctcatccactaactagtttttagggaagccaatcacagtcttctagtgttactttcttcatctgtacaatatagaagttgatatctgagtcttgaaattatgtgactctcaaactctggaatgtgttttcattagtcaaatattgtcatccacagtttcatttcctaagaggaatgtgttgtaatgctgagcaagataccctcaaaatttctggtttctacaaaagggcatgtaagggaggcctctctgcttcactgtttggtacttaagacacttgtatcctaagaatgtcaggtgcctggcaggaagaaaacaaattgcaaaaactgagaagaaaattcatcgcattcattcatctttgtttctggaactcactattttattccttccgttacaatggattaagaaggaaatgacataatttgtttttgaaatgtcagaagcagtgcagagtttagtactttaaaaaatagtttaatgttgaccctgtgcatacgtaaatcttaccagaaatgaggatgactggcttacaacgttagatactctaagttgccaataatttgtacagagcctgtgattgcaaaaccacaaacatttcacaatactggaaacctctaattaaccataataaatgacaggatgggtttgttttaaatacatggttaataatgcttactgctttaagaccataaactgtgtgattctctatggaggtgacagaggtaggctgcaaatggttttgcaaagtacgtttctacctctgcatgttaagtctgacccagaacattctactaatattggatcagcctctcatctgacgtaatttgcctgtgggaattgtatcggctgttaaactagctcctcttagtagctgtttgaaaaaaaaaaggaagaagaagcacaattctgtggtgtgtttcaaataactgaagccagtgtcctaggtactgagacaagaaagaatgtcaaacaggacctttaatgtgtatttatatttaaacatcagacctaacagaaaaccctgaagctttatacaatgattagagccttgtaagatcctaattaatgtattgtcaggtgaatggttggcctggcactcaagctgttctgagggacgcaaggggtttcaggtaccgcctaggaagaatagatgcagttgtagtgattcagtggcccatctgaaagggacatataaaggcagctgtgtctggtgtgctgtcttttcagactcacttgataatgctagtgtcagtttcaactgaagcgtgtgccagattccagacagcttgagctggcatttcagagaggttaattgtgaaacttgagaagaaaatgggcacattcttcctaagatggctattcaaatatagtctctttcctccccccccagagctttctgggtctcagtctcacttttgttctgcttccacgtaaaatgcatgaggaacactgagccttttccccttggcagctcctatattgccatctttgctgggactgctttgccttgttaaaatgtgccccgtgtattaaaatggaattgtcactgctgggtggtgcagcgtaacatggtttgacactaagcgccggcagctacagaaaacagacttttattgcatttattctttcagagacgggagtctctaaaggctcacagcagacattcacttagttaaatctgaatgaacccaaagtgaacaatctactctgctgtctttgtgttcatagaaacagcccccatccagcttgatatggctgtaaaacagtgttaagaaaagatgatcacacttagaatgcagaagggaggacttgaggctttcaaacagaacaaaaatattttaagtgggtggagtgggttagccacttgattttcttttttagcttcctctctattccctaaaatgtattatgtagaataaacacacacacacacacatacacacacacacccctacacacacacacacacccctagtattagtcttcatttataattccatgccattttaagacaaaggatttgatttgtaggactcttgcaagcaagctttagattcttaactgccttttatccagatgagtacccagagagagattgaacagggagggggctctgaggcataaactttgcattttgtagctctcctggaataaaaattccataaagtaacatctgtagtaattaagggcttacatttcctctcccattcatgtctctgctaggagagaaggttattttcccaaagagacaatagtggatcctgtgggaagagagaaagaacagagttagaattcttttcttcctggaaatggaaattttctacttaaaaaaaaaaaaagataaaaaaattgaaagacttacagtaaaaggttccactggaaaggaaacttgaaagagttaggaaaattgtacttagctgttcctaaatatttagaatgaggaaagattccgcttgcctttcttatccaaacatcttctgatataggggaacttgtgagtgagtagtaaacaaaatgctgtttttgtttttatttttatctattaaaattgcataaagagttttctttttatttggacatcaaattgattcattctgaagactttttttttcaaaataatacttatgtggatccattgggtcacctgatgatatacatactgagcgttaatgttaagttagtttcctacactctcttgtcatagcaggatcagctacttaaattagggtgaaatatgacaatgtagatccctttgttaaaacactgttaagaagttcaaggtggcaacagcagaactttaaaccaagtgcagggttgttctaagtgtggggctgtgtgtgaagacataggcctcattcctgtaaatttagccctgcttggcggtagagatttgtcatatccatcgatacagaaagatgcactctcatcacatgcttcataagaatgtacatctgaaaacaaaactttgtcagagaataattatagctcaaaactggaactcgttcctgatattatcttcaaacttgttaaacaagtgatacagatgccctgacttcctctctcagttaatttttaagaatttcccgggcaaaccttccactgagccacatgcttgctctctctaccacattgtaataaggacgcacgccctccaagctgcccagctcagccccctgccctaattacttcgccaaaagcctctcctagattccgtgcctcttctcagcatttctctcacttctgggattcctctcacatttgaattcttatagctgtaataaatatgtataacttacttgacatttgttagcatattttttttgtatcttgtttcctttgccatgtaatatggtcctataatatggccatgtaatatggtcctgaaatggacataaaatttagatgtaggaaagttttacaacttgagttgatgggcaccattccaagaaagctcatattaataacagcagaaaatccaaaattaaactttgccttttgaacacattttacacatttcacacatttcatacacattctttcatgtgtgtgtatgctgtttcttaaatgtatttttgcctctagtatactctttggaagacttaattttcttttatcagaattaatccttaattattatcctccccatccaattttataaaataaaaaaggccagatattatccattatttggaaactgctacaaatattactgtacttaagatatggtaacattgccaaaatttaaattatgttggtatggctcaaaatgttcatgctttaggttgtatgtgagatgccaaaatttggcacaagaataccagtttaggaatattgataagatagtatgaaaaaataggatattgtccaaaattcaatattgagaaagcatagaacctaaggtttgtgtatctataccttccttcaacatgtaggaccccacctaactctttggatgtcttacataaagtggattttcaataaaaatgtcataatgctgacgactacattactataccaatcagtcctttaggctgcaagccatgcaaataaaacacatcttgtcaacctcttttgtgaaatccatcagcagtatagcttagtagctatagcacaggctttactgttgcacagatgtcagttcaaatactgacttttcctcttattggaaaggtagtttatctgtttaagcctcagtgaccttattgatatgaatgacaataaaaagacttacccatcaggtttgctaattcatcattcaacagacatttgttgaacactttcaattgccaaatattgctgggtgaattaagataatgccgcagggttacctctgaacgagtgctcagaatagagccctccacatagacacctttcaaagagtgaataatactttctaagcattaatgagtttgtgatgttctcttatcaatctggtcatcatgttcatgaaaaaagttggcaattagggtacaattctcaaatcaagtatttctatggctttcttgttttcctttacttcttaagtttctttttcttgacaaccatatatgacctctggtttacctttttttcccagaatggagtctactgaaaaatgtgaagtggtaattcaacattttaatggaaaatatctgaaaacaccaccaggcatcccaggtaagaaattcactaataagtgactgaatgatgccgaggcttaaattgctcttattagaataagtacattgtaaagcccttgttgatcactgcagagttggggggtttgcttttcttaatgtgtattttcaaataatactgtgtagcaactcatctttctcaaaagctttttggtaattcttcttttgctttttgaatctctgctgctaactttctaaagtggattagaagaaaaccatagcaaagaatagttaaagaatgatgtgctggaagtgatagaattttatgactcagcattaatattaaaattccaatttccaagttacaaaatatccaaacaatgatattcacaatgaatcccacaaattgatgccagccctgaaacatttcttaccagtccatgacaagaaaagcacagaaactgagagaaagcatttagaaactagtatagcgatttgacaatgtcatgaaatctcagtgcataattttcttttacaaaaatatcagttactgacaaattggaaattttagaaaatactgtctatttatcagagctagtttgagaagccccaatctggactatcccagggcatttcacacttcccaaggcaaaattcctaaggttttatacacattataaagtgttctaattttatgctattaagaattgcattaaacatgaaataattggatttattatgtgtatcagagctacaaatgccagaacttgaggcagtagtgtatgtggaaggttttaatattaactaagtaaagttttaaatataattccaatataaaaaattaacaatggaatgaagtattaaactaagaaaaattacgtaaagattcatctgaataaggcagtttggtttatttgttggtcttttatatacagttattctcagaggagactaaggcgacttcttccatcttacaatatgtgactttaatctttttaagcttgatttcaataccgtttgctgtataatgcatctactatttaaaacccatcagagagttcagaggttgagcattttagttccttaaaatatattgagtttatagataagaggaagcatatacaaaaagagaaatatttttgtggagggttttgtaatgacttgctttttttaaggggggatgtcaagaatgcagaaagacccttcagacagacacttgcataatctgaaaacctaaagtagctgattgctggctaatcagtgagtcaacatacagtgaagactgtgccttgatttggttagcttccatgtgtaacgttcccttgggaactgactgcattatgatccaattggagacatatggtgttgttaagaaaagagttagcagttttcatctcagcatgttagctgcccttgcattttagcagaaatactttttttttttttgtataaacagacattttaagacactttactcaaatccgtcatcgagtaaaggagttgcattgtttgtggactttcctcttgtttgtcctatttcatccaacggatacctatttatatagaagttgttcaaactaggtgtaaattatataattatataaaaataaaaatgagcacactgtgtagaaattatgaatgattcaagttttagcacaagtctcaattttttgatttgttcaaaatattggtatgtcaaaaagacgtattgaaagccttcttgccctgattgatttgaaagtattttatttggttttccccaatgaacatattgctgactaatacaatttaatgctgaagacaaagaaagtcactacaaatccccaaatgtctgggcatccttccagaatatgcaggctatgatattaacctatctaatatcatagctacacccaatggaaacattgtgaatagcaggaacttggttatgagttttctcactcatttttatctcccgggaacaagaaagacaaaataattatgttcagttataaaactcttaggagagacaactgtatgcttctgagatttccactcatcataatagaactaaatacagaatattgatcatcatcagtgcttgaatctgcttatttataaattactttgaaagttagagttgaataaaggcttcaaatgctaagtaaagacatttaatctttgatacttaaattaggtgtggaagaaaagaggatataatacaagatatgggtattttgcaaggtaaagtagtaatttgcccttgttgagtataattactaagtcataacaggtataattacaatttgggtatatgctgtctgcctttattggtcctcattacttattacctggaaatagctgaaatcttactttcagaaatgtatgtcttaaccaatatttgattccatatttaagacagggagtaggatatcactatgagctatggcatcagatatttatactttttttaagtggccaatttccgaatctttttcattactttagagagtgtgtctttgcttgtgaatatgctcaactataattggtgtgacccactgaaaactaaaatacaatttttaaaatttgaaaaatctcagtgttctgccttatcaagatttgacatatttgaattcagaagtttgtggttttatagaactgcacattgattgtttaaatacattgctttaaggtcatgtagatgagggactcacagggatccaataatgatgacctgagatcctcgggtcttaagaaagctgtggaaagattgaatatgatgtcaatcatcttcttctcatactagggccctattgtattagtttgttttcatgctgctgataaagacacatccaagactgggcaatttacgaaagaaagagatttattggacttacagttccacgtggctgaggaggcctcacaatcatggtggaaggtgaaaggcatgtctcatatgacggcagacaagagaagagagcttgtgcaggcaaacttcccattttaaaatgatcagatctcatgagacttattcacaatcacaagaacagcaccggaaagacctgcacccatgattcaattatctcccactgggtccctcccacaacacatgggaattcaagatgagatttgggtggggacacagccaaactatgttgcctacatttaatataactctaagcaagtactgagcaattggtgccatattcatacggtctacgtctctgtttaggcacagtgtggggaaaatgtgcctgtgttattgggcaaatataatggcatttggtttctgtcactgttgacaatgacaattattcttaaaggagatgcaaagctaattattttcctgagatgatcatctagtttccaagtcccctactatgtcatttctaaaaaagaacaaggaaaaaatctatttcaacctaaaatgttgacattgctctgaatttcaaattctaaaaatttcatagttaaggaaatttgcaaggacatgtaacactgaccacatttatgttgctgccccatttcgatttgagccattgttggaataatttgctaattaaatatgattcatgttggtattgggttctaattcctgacagataagtgagttggaagagaactttacagatatctttttggaacacgctttatttctctgggctcctcctatttattcataaaagatctttttttaaatgaatacatcatggatgattgatgtcttttagcatatcccagaactacctctgttcattttagattataatgttatccccagattttggttccctggatcaatgaagctaaatatacatgccaaaaatcaaattattgagtactagtatacaggaagttaacaaagatcagtcacatgtattgctgctagcagatgagaaggagagaccaaaagcatgtgttaaatagtgtcaatcgtttgagtgttgtagccatcagcagaaagagatcattcagcgttttctcccttacctagagggaaaagaaaatacagcattccataaatgttgcatgtcctacatatcgatcttgatgtttttctggacaaaatgaaggatcattagttgcttgcctgcctaaccccagacatttctttgtcccgtaatgaattacacagcaatgttgtatagccccaaagtgttccattttcaaatctctggcaaaagcaaagggttagttcccagacacttcagggatctgtggggcatggacttgaaaggctcactttcaaagagcccccagagcagaatgatacaccatgcggaaaaggttttcacatgtagggacatgtattgatgaacagaacatgcaggccggtttgtaaaaaaataaatcatgttttgctcccaaactagacatttgttttttcctgtaagcacgtgctcctatcagtggagcaatcttttcagaataaaatggaataactaacttctggtatgctttccttactctttacataattgtttctaatcttaattgaactctaagaagtaaggaaaatttgagagaaagcctaccacattatgggatctttaaaaatttaacaactcttgtgactgacagaactttgcacaagtagttatgtatcagaggaataatatttttcgaataaataaagcatggggctttttgatgctttgacatagtaattttagtgttgtgtgttgatgtaaataacaatgtgtatgactatgtatgtatatgaatactttatgggagcaagcaaggaaaaatatttacaaaatgattttttaaatgatgaacacaaatgtttgtataaacttaacattcctgccagagtaaaatatcgacaacatatttaaatgcaatttatcttaaatttatcttatgtgattcaaaaatcagaatatttaagcaatagatttacaaatttttatcagtgggaaatgttgcagagctttgcgatctgtgtttgctcaatagtaacagtctattaagtccacaaatacaactatagctgagaagaggtaacaaataaaaaatgctatggtatatagttgggcaaaaaatatgtcttgattgttctgctcaggtggcgcattgcttctctccaaatgttttatctttgtgaaactaaagcatcacttgtataacatgctttgtgaacaatgtaatccccaattgggtatcattttagatttttcactggaaaaatttttgtattcttaatgttggtgatgtcttcagattatttctatgcatcaaacatactttgttgcttcatgatgaagaaaacacctttaaaatattattagtgaacttcacagagcagctggacaacatcatggtcaatggagtctgagaatctatgtgagtcctatggaatttgatatggtcaatcagttttcaacctttctatggagccacatctgacattgtgaaggtaaaaaagctgtgtgctggtaactgattagatatataagacagagagaagaggtgattaaatttctaaatctttgtatgagaagctaaatagagaaggaaaaagtttcatcttcaaaagaatagaaataattgaaatgagttttttgacagggctacatctactctacccacctgtgatttcggctgcatatgagatgcaacctagaagcatcttaccttatgtatccacctagtttcttcacttttccacctcaggacaaaatttataaaagcttgctcaatgagacagacaaacgtcttctacaaactttgggggagttatcaccccctgggatagcctccaatcaacagggtataggagccagaagataacattgggtctctcatcctttggaaggataattctgagtcacattctacagggttccttgagaggttatctacagtggtcacaagctcaatgaggtttcctttattagcattttcccccttccctgtcttttccttttctatcatctcagcttcctgacatcagctcccaattaaactaccttgtcccttgctctgattttggggaaagtcaaattcaagttgggggttctagaaattgtgttagggaactactttttgatttaaaacctttggctataaaggaaggtattcacttcactaaaatagtaaagtgaatttcatggcccaaatgtactgtttttatgactttttgtttttttaaagagcagagattataaatcccatagtagggttaatgaaggtgaacattagaggtagtagtcaggtagcaagccagggttgaaatttagcaagagaggtatggaaaaagacaagaaggacaagaaaaagacaagaacggtggcatggccaacttgagaacaactgaggacacaaagagttagatggctgataaaaatggaaaagatttagggcagccataaagccagtaaagtgaaggtgaggtgcaggcacagaaaattatcaaacagaaggtattttttgaggttttggtcttggataaatgtagaggtggacatcaaatatgacatccaatgtgtgaatgcctacagctggctgaagtcaagtgaaaaagatctttagtcgagcagctggaggcttacgattagaaggttggaaggtctttcactattaccttaaattttattacttaatgtcatacttgccttgattgcctcttgaagttctaatcttggtaggagcaggttaagtgaatagtgacaaagagggttgttttttttctttatttatctgattttgaattttccaaaccagagtatttttcattttttgtagctcaagggctgtatgcttagctctgtacattctcactaaatactctttggagttgtatagtttcatgaattaaatgacaatcatacatatatttgcttttaatgaactttctgaaggtatggggaggatgcacagctctgggtaaacaagcatgcaaccaatttgggggaaaacattgaggaaaatcttaaaatatttttaaatgttttaattaaaaatatttccatatctaaatagagaaagaaagcaagagtgagagagagaaaaatgtttgtaagaataagaaacttatttgagaaaaatttcagttacattttggaaagcctaatttttctaagactgcttttcaaggtgtatactgaggacctaattgtagtttctttaaagaactcattcttgaacagtgcaatgatgaattctgttttctggcatggcaaatggtcttgcctaattatactggaataatgtctctaaactttttgccactggagctagttaagcacaatgattatgcagcacttttgctccccctgccacgtcttcacatagaaagataaatgtcttgagaaaaaacaaaaaagagaatttccagtctctattatatcccttttggcataatattgttgctcatttctgcctagagaaagtaccacattaacatattatttctcttataatattatataacatactctgtaatttttaatcaataagatatggttaatgctttcttgaccatattttttctatagttacatatgaagcaccaataagtagcagcataatgtgtctggagtttccatttggttccagaatttgattgattaaagtagttgtaatttcatgggatagagaaaagggatgaggaggttttctatacatctccaaaatcatgaaccaccttcataacttatttctaaaatactgactccattcaggtctgcacgaatttctggactgaaaatttcacataaaaacttacaaaataaataataaaacactaattttgcttctaagaccatgttgggctttgccttctgtcagcatcactaatgagtagctaaaccatttagtgtctgtccggatgagtcctattaggaagctgagggttgagtggcttaagaccaattaacacacaagccagggaaaccaaattgaataattaagttcttagtgcatttcagaatctagaatctcatttaataggattgatttaagaacacattctaaccaatttttgtatgaatggatagtattctgaattaaatacttgcaactctctccttgtaaccatcaaaaagcctgctatacatacacctcatcatttatgatctaatttttagaatgatctaatttttagaatgaaaagtctgcaaaacataagaaaatattttaagagaaatgtgaatgaaaacagtaggcaagctctgaactagccattatgtgtttatcttactagctgcttcctcttatttcttacgtctttcagccctgaatgatgaatcaattatttgagtaatattttagttatttttcagtacaaaaaataaatctttcataggaaattggcatgcttatgaaggttcatttgtcccattagactgtaggtttttctgagaaagaactttgatgtttatctctcccatcttccttaaacaattcaaaccctttgaaaacaaggactgcaccttactgtttcttccaaacatctagcccaatgcctggcacagaacaataccaatatcatttgttaaataaataagcaaatacctagttgtggtagacagaataatggtcctctaaagatctgtaaatcctaatccccagaacctgtaaatatgttaggttacatgaaaaagagtaattaaggttacagcaaaaattaaggttgcagctggaattaaggttgctaataaacagaccttaaaataggaaaattattgtgttagtttgttctcgcattgatataaagaactacctgaggctgggtaatttataaaaaagagaagtttagttggctcctggttccacagggtgtataggaagtgtggctggagaagactcaggaaacttacatcagggcggaatgtaaaggggaagcaggcatgacctacatggctggtgcaggaggaagagagtgaaggaggaggtgctacacactttttgacaaccagatcttgtgagaactcattatcacgagaatagcagggaggaaatctgcccccatgatccagtcacctcccactaggcccctcctccaacactgaggattacaatttgacatgagatttgggtggagacacaaatccaatccattcccattaccatggtttatctgggtgggcccagtgtaattagaagcatcctcaaaagtggaggagaacggtagaagaggaggtcagagtgatgcagtgtgcaaagaattaacccaacattgccggccttgaagacaggaggcagcctttggaagctgaaaaaggcaaagacttggatttcccccctagagcctccagaaataaacttagccttgctgacaccttgattttagcccagtgagatctgtgttagacttctgacctatacaactgtgagataataagtttatgttgttttatgcctctaagtcttagatgattttttctagcaacaacggaaagctaatatactagtatagaacttgtattcaccgactatcatccagactattcctatattacattattaaatagtctctgaaaaactctcatagtttctcctgatttttaccttctttgtgagtttttattgaagaaaaatcatattcagtgatgcttgttaaagcacagtaagagtttttttcagcaccatcacaatagttacaggcaccactgcaatggagtctcttacagtggagatgagagattgggctcacctccgaatgcagcatagacaagtggaaatttacagccgaggagcagcataggaggtcggtggttggaaaattaccaagaggaagcatcaggggtaggattctttctgaagacaggccagggtaatcagacgtcacctagaagaaagttcagtaagctgactaaagtaaggccaaataaagaatcatctcagaatcattagagttgcttgtgtgttaaatagaaaaaaaaatcttgttagttattttaacttcacagtttctttataactgctcataagcacatattactatagaagactgttcagcatctgaaacaagaagctttgggaagtccttatatcttagagcacattgttttttattcaaagaaataaaatatgaacttaaactatctgacaccataagtatgccaggaaaataatcctaattgctaatctaaattcatgtaaatgtgtatctcttgggtctcaaccttaatacttgctttcaataattcctattcttgaaaagttattagggcctagaaaaacagaatggagctcctcgaggttataatcaactttaagttttagatgattatatctcaagcatagaccatgctcacacccctactcattgtcccatgaaacggggattgtcctaaagctctaaatgccctaaatctttcatctgaaagcttagttttgagacacacattaaaaatttagaggtggtgaatatgcatacttattatatatttagaaagatagataatgcttatgataaaataattttaaaaattaagtgcattttcaaaaatgtgtttcttagccaaagttattacacattccatattattcctatagcaagattgggaggctgtacatatgaaaacataaccattttctattgaactgagtgtgagacacattttggaccagaggtttatatcaaacagttgcactagttgacccgctgagatgccctaaagaaaaagaactcaagaatttaagttgatttccagctgtttgttattagagcaaatgttagtgctcccggagtgtttgcccgtggccatcaaccagcacctgcatctctttcattaggtagactgcccttaggctgcagcagcctgttttgcctgtgagcagtgagagtcagaagtacttgggaatttacatccccattcggggccatccataaacagtgattgacagctgttggagtatcaatatcccagttcttctgcttctgatgagaataccctgtgtatgatgtatactatctctatagctttcctgaaggattcaaacagttacagtttgtggggctgtctaacaccacatccttgcttgactccttcacttcctggtcccaattcccaagtcccttactggctttccctgaaaatacttcctaagaattcatgttcacaagcaaccttgtttcaaagtctgtttctggtgaacccaaactaaggtattatattcatacagacactaaatttgttattctatgatctattattttcattaatgttttgagttttacagtctcatctgtaaaatgtactcaagttaactgaatccctcaggatagattgagggaggtttcaaaagtgaatataaaattcctcaaattccctcacttcactggaaatagacatactagacactctaagtaaggcagcacttgtttataggtagctggcttctttataaaagggatacaccatttaaatgttgataaagtgtgtgtaacagcagataaaaccgtgatcaggtctcctgtgagtgagcaatcaccggccgattatcactgagctaatcacaatatgtcttaataaaggtccattcaaaagaatgaaaattgtatccatatataagacaaaggggttttaaaataaaaaaatcttagcaaagtgtacaaaagcactgaagaaaaatattgaaactaatatgtttttacacataatcattttaagatggtatagtgagcttgatacaaagggtgttacagagaccgctggaggttcctaagatcctttctggtggtctacaaggtcaaaaatatttttatcataatacgaattcattatttgcctttttcactctgattctctcatgaatgtaaagtggagttttccaggggctacatgatttgagatgtggcaaaagctggaatatggaagcaaatgttagaatccagctgtcttttattaagccagaaattacaaagccactcttctcttttttattctgtttttgaaaatagtgtttttaaataaaagtgtatgatttatgtcaatatgtaacaggactattattattttaaaataaataaacatctaaatttttttattttatgttttaatggtgtcaataaatataacgtgtctaaacaagttttgggggatcttcaataatttttcagagtgtaaagaggccctgagacaaaaacaaaaaacaaacatagaaaacagccgatatagagtcaaattcaagcccttcatcttagaaaagatgaagaaagataaccaagataaaggcgaagtttaaaatacgctctcactttttttggtcttattttgagaacctacgtatgttctaggaagctagttttaatggagcaattaaaaaataaatttcaattaaatgagttctaccagtttttttttatttttttattttttatttattttttttttttggtaaacaagcattcaggcgcctaatctatagtgagtgttttgttttatttttttaaatgcagaggcaatggttagtcttctgaacatttgcattctcattttcattagcaaatagcatattgtttgacagaatatgtgaatgttgtattaagacaatgtatttaagcagcgtgtgtggcatgctgcaattgtgggaatggaattatgtgaatttgtgagtagcatgcgaatgagtctgcccacaatttagggagagtttaagactaatatctaagagccagaaagctaaccacagatgccacatgggagctgtgttatcatcataagaactattctgtgttgcttcttttagtcgctgctaatttcagataatgttcatcttacatctggacttcaccagtgtgagtgctattcaccatgtgggacatatcttaagtacgtacgaccttccaggtttgctagttgtagtacatgataataataaaaatgataataatatatttaaacactagcatgcaactaattgaacactgtatattattagtgttcacataaaatcttaaaaaaatttcagaaatagtaaagtctcctattgtagagtcacataatcatgatttcattaagcttattgcatctttacctaatttgaatgatctctaaggaaagtaattctctagtcatcttttgtaactagttgtaattttatctgaatgaatccatgtaatagataaaataatttaagataaaattctcatataatttatttttaaaggacgcaactcaatatttgcttacatcatttaacagccccttcatttcttgcatcccaaagacaagcattttacatctttgctacacctatatgatgttaaagaaaagagcgccattcgtccagcttatgatatgctttctatgagatcctcacggccaggatcccctttgccctttatgaatttaatttctggaagaacatatgctacagagaataccacctttgcctttggaatcagatggactttggtttgacttatgctgctgtctcttttttacgttttaacttgaacaagttatttagcgtcttgccaggttcctcatagaacctaattgttccgcacccattaactcgtcatttaacattaggtatatctcctaatgctatccctccaacatggtacatgtatacatatgtaacaagcctgcatgttgtgtacatgtaccctaaaacttaaagtatagtaaaaaaaacctaattgtcccatttgatgttaacaatatctcctttacaagtgtttctagaattaactgagagattttctatagccccacaaagaattctggcaagaaatggtagatagtattagtagcattattagtggcatctgttagcctcatgagaattatttcatcaacatccaccttctaggctagaagtataatttaatagttgacgtctctgaatgacatcattgatgagcattatctggtacatggggtatataaggtacacatcctttgcaactaggtaaggactacccttccattttgagccttatgtacagctcattctagaatggtatccattaaattatacatgtccatgttagaggttgacagttttctgagataattggaaagagtatagcatcaaagaaatatttaccttgaatttgctctggtaattctcagattcataaacagtggtcccatttattatgggaccatggcagctgtgttaatgtagtcatacacaaatttgtatgatcccaaacttcttgtaaagttttcccagcatatcattgcacctctagttcccagggcctgcattcccctcattccactcttatttcccaaagaaattctgttcaactacaatacttttcatgcagattttcctgatttccaacttccctttccttaactctcactgtacggcattaaatgcttttctcctatactgggtgtctatttgtgacatgtagcctcatttaacaactgttgtatgcttatcttatcccactggatggcagaattatgcctttgttattcttttatctcctccaatacctaccatttgaacatacgatgtttgatatagacacactaaattgaatttaaaatagtcgagcatattattctagtgtgatttcctaatattgccttaattctctcttaatgcgttttattagtaaatgcttataaagtgaatgcagaaaccatcaactatgatgattccacatagaaatatatgacataatactttttttggtacattttaaaacacttaaacctcaaaaaccttctttcaaatggaagacaatgtttaaaagcacaagaacccttttcatttttataaagattaaattatctttccattctgcttcctgctttctattgctactttctccagattaatttttttaaagagtattgacctatggacattaaacacaaaaggaatataaaataaatgcgttggaataccaaacatcctgttggttgttacaattctacaacaacaattagatttttttttctaattaaaatcatttgaaatcacagtttttgtcttctcagaggtttctcttttcccaaagtttccttcaggtcctgtccttgtagtacattggggttgtagtggcctgtgccaccaggagaatggattcattaacctttacattgatttgaagtgtcgttcaaataaatacttatactctttttctctgatggcttagtgaagtcctttatcaatagcactgatatctccccttgacctttgcctcctgttcattcagaaaatttccatcaggctgttttatttacatttgcaatctcttgctacctcagttaagtttggcacagaaatgtattagtcctggatccaacagaattattttacactctatattcttttggcttctgcagagaagaaaatttctttctttgaatttcattttttaatttcagggtttaaacatttcctgctttctgcatatgtgtctttttgtattttgtctgcctgtttctcttgttctcttgtgactctctgtatatgattatttcaatttcacttcttcacaccaatatctactaaaagatatagttagagccaggaaatgtttctgatcccctgttcccaatcttatcaataaacttttttttttttttgtgcaaggggattggggaattactatgtgccaaatgttgtatttagtattttacagatttttaaatttatttctcaaacacccttagggaaaaagaaactgttccatcttgcagatgaggaggctgcattttatattatgtgtataaattgctttgatgcatacatactagtaatgacagtagtaaatgggctgattgaccccaggatttaattctgtcaccttattagatatgtgaccatgagcagttacttaacccctttgttcctcaatttcccctttggtaaaatgggaataactatagtctcttctgtactagtgttgcaagattggctatggattaaatacattaaactacatagagcaattggaatgtttctggtaaatactaagtgttacttaggtgttaacattgtactgctatgtcataggtcttttctttgatggagaggggatacactataggagaaaatatcagcaagaaattgagtgtcacttccctccattaccaaacttggaggaccaaccttcttccctacatgatacatagaatgaatattaatatcctgtattgggttaaatacatcatttctttagtctggtcaaagattcctccttgagattcagtttcatacttcaacactcattctaattttcagaatggaaatattgggccatccctttgacccaagccatgaacttggttttaacactgatttttaataagtggttcttttgttttaaaggaaaggtagcctatttatagaaactccctttagagaaacaatctttctttgaaaactaagctgtaaaatgatgttcttttgtatgtgtgtgtgtgtatatatatgtaaacatatatatatacatacatgtatgtatataaagcataagagctatgtctagaagaaaaggcacactattaaaaagctccaattagaggaatgtcagacccatattttctccatctgtatagtatcctttctttgaatgggccaaagaagccatggacactgagtgagatctgataatgctttttattccttgaatttctgagatgctgaagagaaagtgtcttgctatcagtattgtttctagggttgaaaagtacctcttaaaaaaacaattaccacaggtatttaattcaaaagacctgaacagagttccttctgtggttacaaggaagctgcaaattttgaagtcatataaaaaagtcacatctactgggataaaaataatctcagcaatcctagattaagatgaaatatatatatatatatataaacaaccccaaattttaataacatagtagaagatacaataggttactgatcgaaggcacaaaaagattgtatactttagaccctagcttttcttatgatactttgatgtcctttacacttgtagacatttgagtaagcttttttttttaattcaataaacaaatatctttgaataactggtagacatagaaatacattttcagtgtaagggttaagcacataacggaataattataataaaggaagtaataatgggggtaaaaaggagggattgataaaccctgcatggaggaaaggaatcaaggaatattctggagaagcatccatttttactgaaattcaaagataaagatgaaaggtatttccaagcagaaataggttgatgctttttgaaacatattgatatagttcaagtttaatcctatatgcttgactttaaattgatgagaactagtttttgctgaaaataaacaggatgagggaaccagatatgcccctgagcgctttgaattgattataactagatggagctggtttggtctagttaggtttgatttgaaactgcttgagttaagttttattcagtcagataacaaaaaaaaaaaaatttgagtgaatcttatggtttgactacatgctttctatattgagaatattaaacatttgtccattgcatttgtcattcatgctttcccttgattgctctttaacttttacttctatttcttaaaaataatagtttactttttatgtgaaataaacttctccaatgtgtcttttaaaaaaatcaccttaaatgtaagagatttcattaatattcatttctgtatcttttgctttttctctaaatttaactctttagtatatttggtatcaaataactatctaaattgaatattttcccaaaaaccagtatcctatctgcacttaaaaattaatctattcttttcacattctttgatatcaccttttcctataatacatgcttataccacttacttacctgtaatatgtgtgcttgctttgtgcaagaatttacaaatccttataatacatcttatctcacagaacaagtccctgctctaaatttttcttccagtttgattttttattgtttagctgttcttgctgttttcattatccagatctacttcaaaattattttgtcactttttttccaaaatataaagatatattcttaagatactatgttaaaatatagaacagttcttgttttattttattttattttattatactttaagttttagggtacatgtgcacaatgtgcaggtttgttacatatgtatacatgtgccatgttagtgtgctgcacccattaactcgtcatttagcattaggtatgtctcctaatgctatccctcccccctcccccgagaatagttcttaaaatctccccttttcttccccattgtgttcttataatctccctttcgcttccccattgtggtcaagccctccctcccacccttaatcattggaaaccatttctttgttttctatccttgtagttttctcttttccagaatgtttatgtaaatgaaatcaaacaatgtatagccttctaagtctgccttccttcacttagcataaggtatttacaattcacccacatggttatatgtatcattagtttgttccattttattgctcagcagtatttcattaaatggttttataccgcattttattctccagctgaatattttgattgctattagtttttggaaattgaatatgataaaatgcccacttttagtgctaaatcaatgttttataaaaattttggtattattaatcagggttagctcctgaatattatgaaatacctgagaaactcattgtctaatccttgattgcttgctaatgctacctcttatataactaaattttaaaagttgaaattggatcactgctgcaggctccctgagacaccaaaaaaccgtgagtctgcttgctttctcagtggggaggctagtggtctagggcaagttatcagccctggtcactggctgcctggaaatagactcagtgctgttgtgggggcacagtgggagtgagactggcctttagtaccgtgggctgtgtgggagagggttgaggcctgtgactaccggctttcccccacttccctggtgacctgtatggctcagcataggcagccacaatccccccgggaatataactccataagattgggagccatatcctcatcccccacagcagctgcagctagtctcacccaaggaaagactgaactcagacatgcttatccctgccccccacctggtggtctttctctacccaccctcggagtcgaagacaaaggtcataatctcttgggatctctatggccctgcacactgcctgagaagcctgaatacttaaccaggtgtccctagggcaagtttgtatccttataggaccatagctgacgcgctcttgaaagctccacctcctacctggaggccaaccaacacaaaaccagtgcactaaacaaaaacacaagcaaggaccctcacagagtccacttcactcccctgctacctccaccaaagcaggtgctggtatccagagctacaagacctgaagatggatcatatcacaagactctttgcagacactccccagtactagctcagagcctgggagctccgctgggtggctagatccaggagagcaataacaatcactacatttggctctcaggaagccccattcctaggggtaggaggagaacaccacatcaagggagcatcccgtgggacaaaagaatctgaacaacagccattgaatcccagatcttacctcttacatagtctacccaaatgagaagcaaccagaaaaacaattttggtaatatgacaaaacaagcttctttaacacccccaaaagatcatgtcagttcaccagcaatgaatccaaaacaagacaaaatctctgaattgccaaaaaaagaattcagaaggttgattattaagctaatcaaggaggcaccagagaaaggtgaagtccaacttaaagaaatcaaaaacacgttacaggatatgaaagaaaattcttcagtgacacagacagcataaataaaaaccaataacaaattctggaaatcaaggacacacttagagaaatgcaaaatgcactagaaagtctcagcaatagaatcaaccaagtagaagaaagaaattcagagcttgaagactgggctttcgaattaacccaatccatcaaagacaaagaaaaaagaatttaaaaaaaagaacaaagcctttcagaagtttgggactatgttaaatgagaatatgttaaatgtccaaacctaagaataattggcgttcctgaggaagaagagaaacctaaaagttttgaaaacacatttgagggaataatccaggaaaactttctggacttgctagagatctagaccccccaaatgcaagaaactcaaagaacacctggaaaattaatcacaaaaagatcatcacctaggcacattgtcatcgggttatctaaagtcaagacaaaggaaagaatcttaagagctgagaggcaaaaacatcaggtaacctataaaggaaaacctatcagattaacagcagatttctcagcagaaatcctacccgctagaagggattggggtcctatttttagcatccttaaacaaaacaattatcagccaagaattttgtatccagcaaaattaagctttgtaaatgaaagatacagtcttttccagacaaacaaatgctgagagaatttgctactaccaagccagcactacaataactgttaaagggagctctaaatcttgaaataaacccctcaaaaatacaccaaaatagaacctccataaagcataaacctcacaggacctatataacaataacacaattaaaaaaaagtatttagtcaacaaatagtaagatgaataggatagtacctcacatcccaatactaacattgaatgtaagtggcctaaatggtccacttaaaagatacagaatggcagaatggataaagattcaccagccaagtttctactgtcttcaggagactcatctaacatataaggcctcacataaacttaaggtaaagggatggaaaattatgttccatgcaaatggacaccaaaagtgagcaggagtagctatgcttacatcagatgaaacaaactttaaagcagcagcagttaaaaaagacaaagaaggacattatataatgacagaaggactagtccaacaggaaaatatcacaattttaaatgtatatgtacctaacactaaagctcccaaatttataaaacgattactactagatctaagacatgagatagaaggcaacacaataatagtggggactttaatactccactgacagcactagacaggtcatcaagacagaaagtcaacaaagaaacaatggacttaaactataccctacaacacatggatttaacagatattttcagaacattctaccgaacaactgcagaatatacattctattcatcagcacatggagcattctccaagatagaccacaaagcaagtctcaatacatttaagaaaattgaaattatatcaagtattctctcagaccacagtggaataaagttggaaatcaactacaaaaggaacgctcaaaaccatgcaattacatggatattaaatcacctgctcctgaatgatcacggggtcaacaatgaaatcaagaggaaaatttaaaaattctttgaactgaacaataatagtaacacaacctatcaaaacctctgggatacactaaaagtggtgctaagaggaaagttcatagcattaaatgcctacatcaaaaagtctgaaggagcacaaatagacaatctaaggtcacaccttacagaactggagaaacaataacgattcaaacccacgcccaacagaagaaaatacgtaacaaagatcagagcagaactaaatgaatttgaaacaaaaaatataaaaagataaataaaacaaaaagctcattttttgaaacgataaataaaattgatagaccgttagcaaaattaaccaagaaaagaagagagcaaatccaaataacctcattaagaaacaaaatgggagatattacaactgataccaaagaaatacaaaagattattcaaggctacaggaacacctttacatgcataaactggaaaacctagaggagatggatacatttctgaaaatatacaaccctcctagattaaaccaggaagatatagaatctctgaacaagcagtgagattgaaatggtaattttaaaattgccaccaaaaaaagaccaggaccacatggattcacagctgaattttatcagacattcaaggaagaattggtgccagtcctattgacactattccaaaagataaagaggggatcttccctaaatcaatctataaagccagtatcaccctaataccaaaaccagggaagaacatagcaaaaaaagaaaactacagaccagtattcttgatgaacataaatgcaaaaatcctcaacaaaatactagtgaactgaatccaacagcttatcaaaaagataatccaccattatcaagtgggtttcataccagggatgtaaggatggtttaacgtatgcaatctaaaaattcaatgcaattcttatcttaataccatattattctttacagaactagaaaaaacaatcctaaaattcatatggaacaaaacaagagcccactagccaaagcaagactaagcaaaaagaacaaatctggaggcatcacattacgtgacttcatactgtactataaacatagtataacataacatagtatcatataaacagaattaaaagcaaaaatcacatgatcatctcaatagatgcagaaaaagcatttgacaaaatccagcatttctttatgattaaaccctcagcaaaattgtcatagagggacataccttaacataataaaagccgtctatgacaaacccacagccaacattatactgaacagagaaaagttgaaaggattcccctgagaactggaacaagagaaggactcccagtttcaccacttctgttgaacatagtactggaagtcttagccagaacaatcaaacaagagaaagaaataaaggccatcaaaatagataaataggaagtcaaactgtcactgtttgctgaagatatgatcgtatacctagaaaaccctaaagactcacccaaagagctgctagaactgataaaataattcagcaaaatttcagcatacaaaattaatgtacacaaatctgtagctctggtatacatcaacagtgagaagctgaaaatcaaatgaagaactcaacccctttcacaatagctgcaaaaaaaaaaaaaaaacttagaaatgtacctaagaacatgaaacacttctacaaggaaagctacaaaacactgctgaaagaaatcatagacaacacaaacaaatggaaatacatcccatgctcgtggatgggtagaatcagtgttgtgaaaatgaccatactgccaaaggccatgtaaaaattcagtgcaattcccatcttaataccaccattattcttcacagaaccagaaaaaaaataaaaaaatcctaaaattcatatggaaccaaaacagagcccattagctaaagcaagactaaacaaaaagaacaaatctggaggcatcacattaggtgacttcaaactatactacaaggccatagtcacaaaaacagcatggtactgggataaaaataggcgcatagaccaatggaacagaatggagaacccagaaataagccaaatacttacaaccaactgatcttcaacaaagcaatgaaaacataaaatggggaaaggccaccctattcacaaatggtgctggcataattggcaagccacatgtagaagaatgaaactggatcctcatctcttccttaatcaaaaatcaactcgagatggatcaaagacttagatataagagctgaaaccataaagattctagaagataacatcagaaaaacctttctagacattggcttaggcaagtactttatgaccaagaacccaaaagcaaatgcaacaaaaataaaaataaatagatgggatttaattaaactaaaaagcttctgcacaggaaaagaaataatgagcagagttaacagacaacccacagagtgggagaaaatcttcatacatctgaaaaaggactaatatccagaatctaaaataattcaaatcagcaagaaagaaacaaacaaccccatcaaaaagtggcctaaggacatgaatagacaattctcaaaagaagatatacaaatggccaacaagcaaatggaaaaatgctcaacatcactaattatcagtgaaatgcaaactgaaaccacaacatgataccacctcactcctacaagaatggccataatcaaaaacataaaaaaaaaaatagatgttggtgtgggtttggtaaaaagggaacacttttacattgtaggtgggaatgtaaactagtgcaaccagtatggaaaaaagtgtggagattccttaaagaactaaaagtagatgtaccatttgatttagcaatccccctactacatatttacccagaggaaaagaagtcattacacaaaaaaaatacttgcacatgcctgtttatagcagcaaaattttcaattgcaaaaatatggaaccagcccaaatgcccaccaatcaatgagtagataaagaaaatgtggtatatatacgctgtggactacaactcagccataaaaaggaatgaaataatggcatttgcagcaatgccattgcaattgcaggatggaattggagactattattctaagtaactcaggaatggaaaaccaaacattgtatattctcatatgtgggagctaagctatgaggatgcaaaggcataagaattatacattggactttggggactcagggaaaaagggttggtggtggcaagaaataaaaggccacacactgagtacagcatatgctgctagggtcatgggtgcaccaaaatctcagaaatcatcattaaagaacttattcatgtaaccaaacaccatctgttaccccaaaacctactgaaattaaaaaaaattaaaaattaaagtaaaataaaatatttagccatttatttttcctgggaaattttaaacttcattatgatggattcttctaatgtacatttgatttattttatattttgagttggtaatatgtgcagttatttaaaaattcaagaacttcacagtgaaaaatactttctctttctttcctgtgacacagtcacccaagtttctccctagaaaagctattgtcaacattccctgtgtccagaggctgctcctgaatcccaaacgtatgtttatattttcactccaacagtggcaagtacccacccttctctaaatcttgtctttttttttcacttagcaatgtactttggagttcatttttttttttttttggaaaaaaatggtaattaaaaatttgtaattttaatggtaattaaaatcccaggctggagtgcagtggcgccagcttggctcactgcaacctccgcctccctggttcaagtgattctcctgccccaccctctcgagtagctggtaatacaggcatgtgccaccacgtccggctaactttttgtatttttagtagagacggggtttcattgtgttatccaggattgtctggatctcctgaccttgtgatctgcctgcctcagcctcccaaagtgcagggattacaggcatgagccactctgccaggcctggagttcattcttaagggtacaagaaaagctgtcacattacttttgatgaccatatagtattccattgaacatatgtacaatattttttatttaaatgttcaaacgtttccttacttacagagatctaggttgtttacaatctttatttattgtgaacaatataaaaatgaaaagtaaatgtctgtatcttttttctcattgatacaagcttatctacaagaaaatatataaactgtacttgctaggtaatatagtatatgcttatttaattttgataacttttgccaaattattttcctcataggttatcctaagtcacacccacactagccagtgtgaaaagtcctgtatcccaacaccttggccaatacaatggttatgaatctttttcctagctaatataataggtgaaaagtttaccacattgtagtcttaataataataagagaaatgtgagctaagattgaacatttttgatgtgcttagacctttaatacttcctgttcttgaactctcttgttcatattctttgcccattttttcaactgaattgggccttttaaaaattaattcccaagaactttatcacatgaaagttgatgtttgtaagttatttatcttgacttcattcatgatgtattttttttgccatttagattttttaaaataatgtcctttaaaaacttgaatggcaaaagagaaacataatgaatggtgatagacgtatttatcctttttaaaaatctgaatatctcatatatatataatgcccatactgagaatattaaaatgtaactgattttttctctagtaatttttattaaaaaatattaattttttgaagccatctagaatttattttagcattagttgtaagatggagaaaccaactttaatttaaatttttaaaatttcctgatggttaattagtcagttgttctactattgaataatacattctttgcatagaatccaaatgttacattttcttccattaaatcaccatgtatattttttattttcctgaaatttcaattgtcttaattgacttactagtcaaatcatgtgttattaatgtacatctttgataattagtattttacataatgtttgactatttgagggagtcattcccaccaccacccatcattcctcttcttttaaataatatttctggcttttttgcttatctattttacaataactttaaaatttatattttacctgccccctgcatatatgggcattttatgatttgtgcatccttaattcgaagtgagaggaacatatgattttctggaggaaactttcaactttgaatgcttgtgaccaaaggaaaactatgacatcatctggcagccatttcaaattatagccagatgttctaaaatggtttcttactaccccagaagtgtggctttaagtcacttccacttcacaggcattgctatcaattttctatctctcacaactcaaaatcttaaagacaaaaggtgttatatcatcttataactttctgaatttttacaggtgattttagctaagacaatccaaacatctggagatccctctccatttttctttgatgttaaacacatttttacagaagtaaatacagctctcttctgcactgacatagagaaaatactttttgctcaatatttcaaggacgactttaaaaatctattctaaaatataggtaaaaaagtagcatatgaaatttaaaacattatattaaaacaagatataattgcactataaaggttaaatctcatatttagcgctcacatgatatcactcaattttgtgaggcgtcttttgtaaagtatagtaggccattatgagtatttggttacataattcattttcacttaatgtagatagtattaatatattttgtgtggttcggttctatgaattttcaaagagcatgattcattcatgggtaatcagtaacccatagtccttgtatagtcattagaatatcctgtcttgatggttttctgtgaatatcaacgctctcagaagtatgccattgggactaagcctacatagatgtcagagattctctaaaatgacccagccaatactccctccacctttcatttctctggtattgtgacttactaagtgttttacaggaagaaattaaacattcaggaaagtgtgttaattttcaaaaagactccttttttgtgtctgccctcattttcttgctttttgagtcagttatcgggattttgaagtttaaaatgctgagatttttaaagtttcaatcgaaaagtattcatactttgacattgaataaaatttcccagttagcatgatctttaaaatacaaatttgatttacatttacatttcaaagcttttaattctttttggtgaatgtcccctgatactgcactctgcagacccattctatttgtttagctttggcttctcccctgccttgagtgttaaatttggtgggagatgggcaaggaaatcagagtgaaccctcacatctcagctctgatagaaggtgcacctattcctctataccagtatgtttaagaagtcttgtaacacatcttgcttttagaaatccatttatttttgtttttgtttttgttttttaaagaggttctcatacataagtggggtgaacaggtgaataacattgatttctttagaagacaggtattatgtaaatactgccttgtagaaatgcatttccatttcctgcattgatctcatcttaaagccttgcagtcaatcctattttttatgtgttgctgttttaatagaaattccatgttccacaatgaaagtaactgaccaaagatgttgaaatgatgtttaaaagcctcttatctatcatctttggaatttcaggatatcattaaaaaacaaaagcaacaaatgataaaaagaacaaacagtggtgtgctttagctgatattcattattcaaatagcttctcaatgtttttttcgtctatttttctttccttctagaaaattcctttttgaaagatggctttgaactcggaccagtctataaggaatagattttactgtttatcattaggaggagaggatttttttaccttacacatagtgtggttgaaccgatcattaagtgactaaaactctcctctatccctaaactttatcctattcaactaggaaaaccaagacaggacctcttcctcttgtagaacatcctgacagcgttcactaaaagctagtttgtgtatatctcagtagagatttccatcaacaaagcagtgacaatatctgccaaaggattttgcatttgtattgcaacttcatgagcataaaataaaaaaaacttgaattgccactatcatataatggttattcttatatgtaatcattattaccaacttatttatttttctaaaatcacattttattttttaatgaaatataatgaaaaatcttaatctccaaatttgttttttaaattatattgtagtttatcacatgtttttaagttaaccagaaacatctatgatcttgacctttaaatcatttattaaaataaaaacataggtgcctgggaccagaattcatttttataaaatcacaactgttcactatataacactatgatttctttttgtgtttctgatattttcctatctaaaagtgacatagggttaaaaaggagagaaagtggatgtagaacaatatccaaacattggttccctgcttcagtccataattgtcattcattttttattgcctcaattccagttatcaaaaggtaggtactaatccaaactgcatttcacctcctagcaaaggagttaaaatatgtcttattgttctccatgttctgtatgaagttcttactttgaaatgcagggcccttcattctttggcttaatcctctgaaactcactgaattttctagccttgtcatctaccaaaatgtgcacatattgttgtaccttgggctgtcttaaaaaaagacatcatgaactctggagccagactatctagatcagaatcccacctgtaccacttactagctgtatgacctggggcaagtgacttaacctctctttgactcagcattctcatctatataataagaacaattaaagtatctgacaggagaatcaaagcctggccaaatgaaacaggaaaagagggagcaaaaatgctgtttatttttctgcttaatcatttactccttcattaaataatcatttatacctcaacaacttccagttttaacaaaaatagatttgagtttacttaatcacagataaaataaaacatatggataaatggaaccaaagcaaagcaataaagaaaaatagtgagaaggaacattaaacttttggtagagcgtggacatgacatccaagttaagacctgaaatgaactataattgaaattccttgaaggaaaagctggccaggtgtggtggctctcacctttaatcccagcgctttgggaggccaagggggtggatcacttgaggtcaggagttcaagagcagtctggccaatgtggtgaaaccctgtctctactaaaaatacaaaaaattagctgggtgtgcacctataatcccagttacttgggaggctgaggcaggagaattgcttgaacccgggaggtggaggttgcagtgagcccagattgcaccactgcacttcagtctgggcaatggagtgagactccatctcaaaaaaaaaaagaaaaaggaaaagaaaaagaaaagcagaaagagaaacctagtaagttacataattcagcctaaaagttagaatgttagcttctggggaagttaagaccgtcataatttttttttccacttctgtatactaagaacctgaatgattcttagataacaatttggatttatttaatatttattaagtgaattatgaaatcagtgaataataaaaaagcatgtcacattttctattgctaaaaaagtaattttatataacatccatttctccaaataatatcctctctaatttaagatggataatgatgcctgatcttatttaagaaatgtattctattttgaagagcttaataaaaataattttgactcattataaacatggccaactccaactctcttttagccagttgtatctttaactaagctggtaatcagatgagaatcatgtgcacattgcattctatgaagcttagcttcactgatgtggcttacacgctgtttcagagatgtatggtcattctttggtcctttctagtgtatgtggaatcccgtttgatatagtttggatatttgtatcctccaaatctctagttgaaatgtaattcccattgctggaggtggagcttggtgggaggtgtttgggtcatggaagtggctctctcatgaatcgcttggtgctaccctaacaataataaatgagttctcactctaagttggcataaatctggttggttagaaggcatctgcctcctcactctcttgctcctattcttgccatgtgacgtgcctgcttccccttcgtcttctgccatgattgtaagtttcctgaggccctcaccagaagcagttgctagaactaggctggtgcagcctggaggaccttgagccaattaaacctcttttcttataaattgcccagcctcaggtatttctttacagtaatgcataaacaacctactacaccattggaccctgagattttgctgatggactgttcctactgaggcaattcctctcaattgttccttagctctctccccagggaagcatcttaaaaccacatgatggcggggcacggtggctcacgcctgtaatcccagcactttgggaggctgaggcaggtggatcatgaggtcaggagatcgagaccatcctggctaacatggtgaaaccccgtctctactaaaaatacaaaaaattagccaggcatggtggcgggcgcctgtagtcccagctactcgggaggctgaggcaggagaatggcgtgaacccgggaggctgagcttacagtgagctgagattgcgccactgcactccagcatgggcgacagagcaagactccatctcaaaaaataaacaaacaacaacaacaacaaaaacacatgatatgggccttgaatcatgaatgtaaatgggtgttcaggcacatgactttataacaatttgagactgtaagtgaatcatggacctatgaagcactactcgtctctgaagagatctttgactgccttgaatcctcaagtttaggagattcattttgtgaatgtacacatggtcatgtgcccggtacacagctatccacaggtgataaagagcaggacacagggcaaaacaatttgctaaagggttgggagaaataacctaataaattcaatttctttctcgcaggcctccctttaaaaagcatgtatcttatggtagcataactctatgcttcccattctcaactcatcagtactattttttgaagttgtaggttgttggttgacatgggcatttttaattttgttattaccagaccccatcagattccctaggcgtcatgtgtgttatcataggaaatacttctctacttgcctcttccattatgtcagctgttgtttgatggggattaggaaagggcacaagaaggaagctgaacaaaactgcacggctggtacctttctctgtcttttgtaagtgcttgttagcaatccaggatttcctgggaaaggacagaaatcacagatgtgtatatatgctctcacagaaagtggaagccagtaaccctgggaaattcgtgctcaactttggaagtgtatcagagatatactccacctctgaaaacctccaggctgagtatatatttaaaatgtatctttgcatttttcaggttaactacatacgtgactagcaagacaaaatacagcattattttcttttcatgatataactggataactaattgatttgtttactaattaatttccatttccccacaccagagcatcaactttatgaaatccagaatgcagttttgttcattgttatatctctagcctaaaactgtatatcacacataagctcaacaaatgtttgttgaattaattaattgataaatggtagtagaattagattctaatccataatacagaaatataaccttgagtagatttcttaaaatatcttagactcatctttctcctctgtaaactgggaggaaggagggaagagggacaacaagatgacttgtaaaaaggtccattccaattccagaattctatgcattgttagcaggaaggaatattaggctgacccatcaattcactgattaattgaaaaataggaattaatggaattttaccaaagggaattaaatggatttagtagctgcaatgtaccagcctattttgaataaaacacagttcctatgctggttgattccagaggggtaggaaatggatatgaacaaatcatataattctctatgatacaagaacaaaggatgaccagtgtataaggatacctcagaggtattgtgggttcagttccagactactgcaataaagcaaatatcacaagaaagtgaatctcaataatattttggtttcccagtgcatgtaaaagctatgtgtacaccatactgtagcgtattaagtgagcaatagcattgtgcctaaaaacatgtatattgggcttcaagtaatcctcctttctctgcctcccaaagtactgagattacaggcctgagccaccgtgcccacccccatgctccacttctaattctagttctcttgctatttttaccacatcttcagagacttccttcactgaagtcttgaaccctttaatgtcatccaggagtgtttaaacaccttcctccaaactcctgttaatatggacattttgatcttctctcataaatgacaaatgttattaatggcatctagaatgatgaattccttccagaagggtttaaatgtaattttccaagatctatcagaggaatcactatctatgacagctatagcattatgaaatatatttctaaaactataagacttgaaagtagaaattactcttgatccatgggctacagaatggatgttgtgttagcaggcctgaaaacaacattaatcttcttgtacatctccatcaatgctcttgggtgacccaggtgcataatcaatgagaagtaatattttgaaaggaatctttttttttttttttttggagatggagtcttgctctgtcacccaggctggagtgaaatggcatgatctcagctcactgcaacctccacctcctgggttcaagcgattctcctgcctcggcctccagagtagctgggactataggcacaccccaccacacctggctaattttttgtacttttaatagagatgaggtttcaccatgttgaccaggatggtctcgatctcctgacctcatgatctgcccgcctcagtcacccgaagtgctgggattacaggcgtgagccaccgagcccggccacaatggcttttacttagtcaccattccattagcccctaatgagacagtcagcctgtcctttgaagttttgaggccaggcattgtcttctcctctgtctgggaaagtcctagatggcatcttcttccaatataaggatacttcatctatattgaaaatctattgtttagtgtagccaccttcataaactatcttagctagatcttccagataacttgctgcagcttctgcatcagcacttgtttcttcactttgcagttttatgttatggaaacagcttctttccttaaacctcatgaaccagactctgctagcttccaactttttttctgcagctttctctcacctctcgtagccttcatagagttgaagagagttaagatcttgctctggactaagctttggcattaagaaatgtagctagtttgatcttctatccagaccactaaaactttctccagatcagcaataaggtggttttgctttcttatcattcatgtgttcactgcagttgcattttcaattttcatcaaggacttttcttttgcattcacagcttggctaactggtaaaaaggcctagctttcagactatcccgacttttgacatgccttccagactaagccgaattatttctggctaatatttgctagagggaagtgtatatttaaagctgtgagggtatttataatgaataatgataatattattccttctaggcataatagggatggtattaggtgtgatcgataggttaatactcccagaagtgatatagtaaatgctaatacaatgtttatgtaaatagagggcatttggtaggtatgggtatcataatctaatgagttgaaatcatttatttttgcttaaactacttaccaattcagctttcaggtttcaagtgaaagacacgcaattctttctttcacctgaacaacttagaggtcattgtagggttgttaattggcctaatttcaatattgttgtatctcaggaaatggtgaggcctgaggacaaagaaagagatggggaacatctggccaggaaaagagtcagaacatacgtttatcaattcagtttgctgtcttaaatgggtgctgttcatggtgccacaaaactattaacaatagtaacatcaaagaatatagatcatagattaccatcacagataaaataataataaagcttgaaatattgtgagaatgaccaaggtatgacacagaggaaggaaggaaggacagaagaaaagggaagggaagggaagggaagggaagggaagagaagggaagggaggggaagggaggggaagggaagggaggggaggggaggggaggggaggagaggggaggggagggaatggagaggaaggaggggaagaaaggaaagaaaaggagaaaaagagaaagggagaaagaaagagaaggagaaaggggtgacaaagtggcagggagaaaggaaggaaagaagaggcagaaggctgtgtcaaaattgtcctgaaatcagttttgtctcttcttttaatttattggcaaacaaaccaacacagcaactaactctatagcatatacagaatggaataggaggtgtttcctagaattggaaatgtgctaacactgttgttgttggcatgttatgcttttcaccaaagaatttagcaaaaattttaagaaggttaagttttatagaaccctcaccttagcctatttgaaactaagctgaccagatgacatagtgatgcaatttggtgtctatatccataataaccacatctgtcaaatgtgtattgtccgatattgttgcaacagtagaatttttgatgactctctggatttaattcatgcatcatttggatcttcgagatcattttatacacccaagttctttttgcaacatcaattgtaatgatttgtaccctctggtttttttttttttttttttgtaatcacaagggattgtacaatgtaatcttaatgttgaggatatgaagttattttttcttcaacctctttaaatattagcaactatttcacagatggtcttttcttaagcgatgtcattgatttaccagtgagagcagccaaatctcacttgggaaataatggtcaatgcctctcagtcatccataaatggagttgacctaatgctaaactaagctacaaggtaagagggccattgaagaaatttctaacacagatggtcaaatcaattcaaatattacacaatcctctatcttcctccaccaaatcatcaaagtttccaaactgtcaagcctttcacttttttctgagttgtctgagtgacaggatatgcttgagatttcccacatttcaaaacttgtctttaaatgcaatttcttcatgcatgatgaataatcaaatatttacacctaataaacattccctacaacttttttttagcacaacaaaatacactatggtaatactattctccttaatgccaatggcacaacaacaaaaacgaaatcctggaaggaaagacttttactccaagtcaatttaaaacttccttattcattttaaatatttcactgcattaatttttcaaagcaacaaaacaaatattcatcaagtgaaactaagcatgacccccctcagataggtacatctgttgctttcctgctgtatccctgaataattcattttaatacatttaaagtatacacttcattaaaacaagctacagtcatttacatataaaatgtacattgatgaaaacaaaaatgaaagctgttagaaagctgatcctaaaattttgttactccttgtgatttatatctagctgtctctgtctatttcctcctacaatgatggtataaaggcatctccacatcctctggcccattgggagctttagttatatcagcaaataggtgggaaaagttagctggtatattttgatactcttttcccacagcctttgttcatcatggacaacttcatcaagatttatcgtcactgtttgtccattttagctccctctgctcacatcacataatagatgtaccatgtatactgaatggcatttaggaatcaaagccaacacagagaatactaatcagttttaacttcttgaaaattaatcaatttgtgctggtctgatacagtgcagggaaaaatattcagttttattcactccctgcccttttgaactctgttaactgattatctaaatggttttcagaaaggccttaattttttttttttaccattatagcatttccccctcctccatttttatggttatgtcttaagtcaggaagggagaggagggaaggggtggagacaaagggagggatgagaggaaagagtttagcagttaaagacacattattaagtattccctttaaataaacttgctttctataaatatgttattggaaaaaagtattcatatgtcttacagataaagtttgaatgacatagaatcaaatataaaataatttatgagatattttctacgtaatactttatcaaaatatttgacaattgtcactattgctacttattagaaaaaaggctatacatcataaaatcatcaaatttcaaaggttatgtacaagaactatgctattacacatatttttatattaataactaatcatagcaatgcaattttaaaactctgtggtatttttctttctgaggatccagaacaatttctgtttattcaatagtgcactttttttggaaaagtaaagtgtaaaaacaaagcaaaacaaaaccttttcttttaatggtgactggctgacatcttactttatagaaactagtctctgagaacacacattttttttccatatcacagtattttgctcttttataggatttctcaaattttcccagttcatgtgacccttttgtcaggagaaaaattacctgaaactacatacctagtatctcactgcttgcttccccacctgttcccttccctcacaaggacatgagctcaagtgtgcatgcgtgcacacacgcatgcacacacacacacacacacacctgtaaacggaatgaataaagtgggtcataatagttgtactactgaaagtcagtgtaagttaatatgctactataggctagtatgaagaagttttacattatttatttaaagccatatcagaagccaaaactgtaatgtttcttatgttgacacagcaatgggggtcagttccaggttactaggagactccattgtggtttaactatgttactagtaccaaacttgaagaatcattgctttttttctttttttttttttgagacaaagtcttgctctgttgcccaggctggaatgcagtggtgtgatctctgctcactgcaacctctgcctcctgggctcaagcgattctcctgcctcagcctcctgagtagctagggttacaggcacccaccaccacacctaactaatttttgtatttttagtagagatggcatttcaccatattggccaggctggtctcgaactcctgccctcaaatgatctgcccgcctcggcctcccaaagtgctgggattacaggcatgagcacctgaccagaatcattcctcttaatcttagcttcctggcttgagaaggaaaatccaaatatttcatttattttttcttcctcatttatgagctaagtttttctctgccataaaaggaaaaacattctaaggcaaattccttctcactgtattttttttatgacacacagtaaaatatggtcgccttctagaaatttctgctctttttctcatgtcttacaaagcataagtgggaagattctaggccttaaagactggcctgggttcaaattataccacttctctttaccagctctttcatcttaatttcctcatccataaaatcaggccattcatacctatattttggggttgttgtgagaattacagcatatttgtatattcaataaatgggagctgctatcatatttattgacttttaggattaaattgtccacagcttccaacatctctttttcttcctttgaaactcccaaactatcatttgagagaccatatgtattttggatatttcacatcatgaatgtttagtcctggaaagtttgcttattttctctggtgtttttgtacctgtaacactcttgctctactgttaaaacctgacagcaagcctgagtataaaccaggagcccttaggaatatcagattaaggatcagcccaggaatctactttatgggctatttgctcacgtactgctatttatctatctgaccgggcagtgacaaagtcaataccaccaaccacagcctttcttctacagattcttagaaggctttctactgttctcgtattatatgaacagcaaagttgacctttagtccaagggtatggataaatatatctattgtgtgtataacataaccccagttctcacagcagaaagaaaaatatgcccgattatttgattgttttgatagtggtgttttaaaagttctagactagcacaatacttactgaaatataacccatgatcattttaacatgcatcgtccaaagaacattgtttgctcctgacaaatagcatgtgcccacgtgtcaatgaaataaagcaatagttattttagcttatatgcccactcaatttgtttatgccctatttataacatgctacttattttacttttagtctaaagccttgcatgtcaatatctagttagaagtaagtttggctgcgggtaaaattctgacagagaagagggacaggtgattggtggcctagtagagttagggcagtctgatataaatgaaaaaattaactagcatccggtgtagttgtaacatttataaaatgggagtgtgtatattcatacattttatccttattataagaccctttctgcccttaagatgcagcactctgaatggtgaatactaaaaacacagactcttgatcgaggtgagggagttggaagaggcaggacaagaaaggacgttgactttctgaaaatgggacgaacggctttatctgaaagccctagtactatagctctctgatgggatcctatttgatactcacagcccgttaaggcaaaagagtaatgtccttcttgggcaaatgaagaagctgaggctcagggagaataaatgacatagccaagatcttggcaaatccctttcccttttcactagttatatggaatcagaaaacttaagttttagttttattctgccactttcttagggacttcaaatcagtattttcacctgcataatgtatgataataacccgcggctatgcttatatttcctgggttattttttagattgaaattaagtggtgactctgaagatgcttcatgaaaatttcaaagtactgaataaatataaaacattatctaaatggcaaaatagaatacccagcttctgcccatccccatcacagcataatataaatagtttctattaagaggagatgtgtggacaaaggggtgttaaagacaaaagctaaaattcattggaatatctatcacctaccttaatatagtcacagtttgcaaactggttgtctttagtgtttaatagaatagagccaaaagatatattttatcaacacacattttatatatgtgtaatataacactatatattatatgtatactgttatatgtaatataacattagatatgtaaaatgtatgcatataatgtgtgatgaaatatatagacacacatacacacacacatttgaacactctcaagctacagaaaaattgaaagtgaagaataagaaacatatttttaaatcacctgagagcaagttactggtatggtatattctcaagaaactgcaattattgtaattattgtcaaatgagtaattataaagaatttaatcacatttaatttggcaatattttatgcatccagagtgcaaagtaggctatttcattcttctatctgtatttttttctaaactgcttctgatattttataaaaatcatacaaaatcattagagaacacctaatccaaatccagcatcacagataaggaaatttataccaagttaagtcattttccctggactaccaggtttcatgtaaatcactttatacaagcagatttgacaaaacttggtattttaactgctgctctcaaaaaaatgtaagactgaaattatttgtgttctttttcttcaaagtggtctaggcatattcatgtttgctataaaactaaaagaaaaaaatgctgacaaatgaaatatatacataaatgtcagtgtagaagccattggtttagaagatcatttttaattgattagggaaattaacagaggaaaacagaatcacaaaataggcccaaataatttataattagctctataatatatagacttatattctatttgctttaatgttttttgaatacatgccaagtaactcagaggtaccttgagcttggcaaatggcaaaaaagaaccctttatgtattttaagatggataacagaggctaaaaattatatacactatgtgccaatcattgagattcaactctacttttttaatactcttaagaaatgataaaatctgattttatgacacaaagcctatacttctaacactctgagctctgtatgtttttaaaaaatgctgccatatcttactatttatttctggaaaccagaaataggctagtcgttcttggaaatttcactctatttctaatttcttccttgtcaaaaagtcagtttgttcacattcagagcataaatgaaacctcaatttgcataatgccttaaataaatgtcaaaatgaatctgtgattttttctgatgtataaataaagatactagttgctttaaacggtttaatcaataacacagcttaccacagtttaccatgctttctgggcaaagaatctgcgtgtacgtgtgtgtgtgtgtgtgtgtgtgtgtgtgtgtgtgtggcaaaattctgttgaaattcccagtgatatgtactgaatgagtttaattccctattctgaaactactactactagtattttttaaattatctgttctgtgtttgaataaggttagatttctaagtttaatcatgcattgcataacaacctcttggttaatgatggactgtgtatatgatggcggtctcatcgtattataatggagctgaaacatttctattgtctactaacactgaagtcatcctaatgtcctagcacaatgctctgcttacatgttattggtgatgctgggtaaacaaatctactgcacttccagtcatataaaagtatagcaatacaattatgtacagtccataatacttgatcatgataataaatgactgcattaatggtttatatattttctatactatactttttatggttatttgagagtgtactctttgtacttatagaataaaaagtaattgtaaatagcctcaggcaagtctttcaggaagtatttcagaagaagtcattgttatcataggagatgacagctctgtgtatgttactggccctgaagatcttccagttggacaagacgtggagagcaaagacagtaatgttgatgatcctgaccctgtgtaggcctagggtaatatgcatatttgtgtcttagtttttaacagaaaagtttaaacagtataaatactaattttaaaaatagaaaaccacttatggaataaggatattaagaaaatttttttgtacagctgtacaatgtgtttgtgttttaagctaaatgtgattactaaagagtcaaaatttaaaaagattaagtttataaactaaaaaagttacagtgagctaagtttattgttaaagagagaaaaatatgttttataaattaaatgcagcctaagtatacagtagtatacagtaatgttctaagccttcacattcactcaccacgcactcactgactaacctggaacaactttcagttttgcaagctgcattcctggtaagtaccctatacaggggtgccatttttaatactttgtaacatatttttgctgtactgttttgtgttttccacactaatttttgttcaaaatatttgagaagaatgaaaagtagcttgttctttttcattccagagcataattgatttttaaaaacctatttgatgcatgaaccatatttcccttctcagagaactcgaaacctacaggtaaaacaagaacctcagaaaaagaacccagacaaaaagtaaaaatagtttaaaagaacagaaatcattttgaccactcatttatttattattgtttttatgtcactatgtcactgtgcaagtatttcaaatcagctaaatgacaaaatgcttcagctatgagctctccccttgattgtctaagccaatgaaaacacagacacaggtagcctgatctgataatctaaaagttaagcacaaaactgtttttgaaatgtaccatattttgtgcaatattgtgctgcaaatttaggattattttgcacttcctattgaccatatcaactgacagagttttgatggatagtgaagaaagccagcacaatttttaaatctgcttgggtaagcctcacactcaaagacgagcacagagtctacaagtaaaatgtaaattttatgtagcaaagaaaactaggaagataaaggttgctttagtctcttcactatgtctgttcatagaatccggcctattatatcatggctcatttataattattacaaggtgatggcaggtttctggactgtggtaaattctctctcactttattcaggtatgtcatgaattctatttcttacagcacctactgaatattattcgttgagtctggaatgttgatcaaggagctatgcttttaacgtctattacttttcaccaattaactatttgcagttgctttttcaaaaaggattgggattcttttgccatatagtggcaatggattttttccaatattataaacgtctgagtcctgaacatctgtatttactttcaaatgtcacaactcatctactttgactatatgcattattaatctgtaagatggttgcctgtgaaaatatatgcttcaatttacaaatagacaattaagcaggaaatcttttagaaatagagaaaaaacatgacggggctgtaacaggttcaaaggaaaaagaaaacaagtgcaaatacctgtaacaaaatagtaagaacataaaactgtcagtatcaagattgcttttcacattgcaacatgacaaaaatgtcactgtctcactaactaagcaactgtctttttcttctctgcataaatctagcctctaagctttcccaaatctttttcagaatgaagcagaaattctcatacattaataaacaaaataaaatcaaacattgtatatgattactgccaagacagaacatcttattggaagacgattttgcactgtgtattaaaatttaaaatatgcataacctattgacccaacaatcttatatgcagggttctgtcccacagaaataatagcatgcatacatacagatatttgtacaaagatattcactgcagtattgttagtaatataaaaaactggtattataactcaagtgtctttcaatgagcaaatgatttttaaaacttttcagtgtacaatgcagtactacacagacatttaaaaagaaatgagatggcaatatggtgacttggaaagatgttccacagcacattgttatgtaaaacaagcaagtgtagatcatgagatgaagctcaatctcattgtaaaaataaaataccaaaaaaataaaaaagtactatgtgaaggggtgtgtgtgtgtgtgtgtgcaatatctaactatatttgggcaatggaaaaatagtaatttcatcttctaaattctaattgttttcttcctcttttttcctccagcttaacctgaaatttcaattttttcccttcataagtgaaattgtctttgtatatgcaaaaccaagcacagttttctaatttaatgttaacaaaatttgagtcaaagctgtggtaacccacataccacattgattgggtggattacttctccaacaccaggtttactgtagtaatccatggtttatggcatttaactctcattaaagcacagttaacaggtacccattcagttatcaccatgcttcaggatcacacgctacttgggaccatttttgttgttcatttttttttgttagctatgtcagcagataatattcgtatttcaatacctctgtagctgagcatcaaagctgcataacttctacagcctttctccttcctgctatttgctcactgaccttttacaaatttaattatttatacccaatttggcttcttctctttttctttttgcctattaatgtatctaatgtagaattgatattgtgaaccacacaatggaatgtgctgtaggaaatctctcaccttctaaagccaagtgacaaatgaaaaggaaaatgccaaaggattttgcaatttgaaacagagtgctaaaataaggatgcattgctgaggttatggtgtaacacattcatttcctccctggcgggaagaattttacacaatacctggatcagatcttctgatcagatatttagtaaagcacccaagaatgctactgatttaatccaacatcactctaagaatgggctaaataatttaacgtctgggtaatttaacgcctggttaaactcttaaaacattactatatgcttcatcctgtcacctgcttgattatcacttatacttgttcaattgttttaagaattataaattataaagagacaaaagaataggaaaagccttagaaatgcgtaggatctgtccattggataccatggcttgaaaagaattataatgataatagcaatcctgatattttaataaagtttagacttactttaaaagatattgtaggaacttctactgcattatgttcaattaaggacattaaggaaaaacagtcagtgaggaaacattgatccaaaatgtaatttgtcacagtgatggaaaagacatctaaatgtatattctccttatttttccttaaatatgaaattatccaaatatctagttagtactgatttgcgtttatttcataacagtcaatggagaaaacaaaataaaacttaaatcacaaaagattgttgtgatctcagattttaagagtttaatgacatgttataagaaattaataatttatctaaaaatcctttttcgaaagttcattggagaatttcattcttgttattttgctgtccttattataataaggactacaactacatagaaatgatttgaagtgctagttatgttttcattgacagcactatgatcagtgggaaaaaaaaaaaaagatcctgttaaaatacctaagtcttacttttgtttctttaatcatgggcaccctttatgtgtgtgcatgttaaaccagattagcatttgcgcatgcacatgtatgtatatctttttattttaggtgagacaataaatcactgatatattagtaacggggccttcaactatgtcaatacttctgccaatgccaattttcattactaatattaaattttatcatatatttgattgataaatgtttgttttttgtttgccttaatagaaggcaaacagtttatttcagagcttacatcttttgctcttgcaaggctgtcactatcttctcacagatttttttttaggaattaggagaaagtacctgtttctgagcaatcctctcaaaagtctgatgactatgatgattaacagtacagactgatatttcctgtgaaggcagcagtttaggccgaaatgctttctaatgtatgaagaaaataactttcagtttaggaattttagaggaaggaaaaaaatcacttaagcagcatctgtttcaagtaaaaattctgttgctaccaccccaccatcatggtccttaaattttcttttcattgattagatgttttcaaattttgttttacttcattttactattatattgatccggtgttttaaggaatttgcttgcattcttatcaaggaagcatcgttttcaatttaaataggtcattatggttagaaatctaaagaaatagcatagttcattatagtatacgctttgttaatagaagtaattattttcatccttattataatttgacacaatgtttcctttaaaaaacagtgatcttagaaaatactttaggtggataagaacaagagacatgatgagtaatatctaattagaggtaggtgaccttttaagctctaacaacattctctacatctccagttataaatttttatttctaacttaagaaattaaactaattatgtattatggagggaatattagatccttatatgtcagtgcagcttatttctaattaatggatggttgaaatcttcaaactaccttggacctatttggcatttgaggaatctcctttcagatgacatttcaaatgcacatataaacacacgtacacatatgcatatgtgtgcatagaattgatattgtgaaccacacaatggaatgtgctgtaggaaatctctcaccttctaaagccaagtgacaaatgaaaaggaaaatgccaaaggattttgcaatttgaaacagagtgctaaaataaggatgcattgatgaggttatggtgtaacacattcatggtgtaacacatgtatacatatatgtgtatgtgtgtttccatacatttttattctaagacaaataccatagtaataattaaagtaattatatttctcttaacactcttgaaagcttttttccaagtaacaggttcatgatatactgagctattttttgttacattttgtttttacaacatactaatattgatttatttgttagacaccaatagaaaacgcaccaaagtaataacaaagtctctcctagtagagaagcctattacttacttttgatgtatgtatattttcccaaactcatttctttggtaatgaacattgtctccataaaattgcattatcgaatagtttgtggaggactactgttgtggcatctgatcccagcataattctttctctcttttaagtctaaatttaagtctaaatcctgtggtactggtgttggggtaaaaaagaaggaagaaaggaaaatattttcagtccctgggaacatgagggcatttttttctctctcaggtggtgtaatcttcaggtaatcgctgaagactggggctctccttggggctctctagtgtggtcttttggagctgctccacttcacagttccatgacctgcaagagtcatctccagatccacctgtactggctcagctaccatcctggggcacgcctggaagcccacacggcctctggcagctgtccagtaagcagccttcttaactgctgtacagcaggacagtctagactggctctcttctgtgatgctcactacatttattctacaaatattttgaacaccttctataagctgggttctattctaggttcttgagattcattagtgcaaagccacaaaaaacccttgctctcatggagtctacattctaaggtctcataggaaacacatgtaactttaccatgctgaagagaaggcatgaggctgcttcaaaacttgttccctctcccccattattccctccagtttttttctctcctgctaaattatacattgctcagataatcaaatgcccacactaagcagatgtccaactagtgattcagatctctgtgtctgcttctcaaaggtacccctaaatcttttgtccattaggataaagatgagtgacctcaaaaatgttctttttttctcacttccccagacttcctgcattgatttggagttaggttgaggagctaaccatggttgctggtgattgctgagggtatgctctgccgtttcttaggaagttgtggaagatattggtctttttgtgaatatgtatgacactattcatttcctccccagatttgggctctacatgtcaatccctgtggaattgaaaaagtcatgatactttgttgtaagtccatatattatgatagaaatagacataagatgttaaagtgggacttcttaaagtggggtttcaagttccactgagatattgacaggacagttaggatccaaagtgagtgtgagtcagatgtcctcccctccctaacatgtggaattacagtgaaaattgttccaagaatgtgataaaatttttggatacaagccccttagataaattaaaaatataagaataggtcatagagaaaagagaagggagggattggttaaaagatatcttgggagagagccattaccctgctacaaatcgttcccctcccaccacctcccctcctacctttgaggaaaggcttagtgggaaagttttaaagagaccgtcattgagtgctttgatatgtttgttctcctgttggaagattctaggtattggtacttgacttagattcaaaaaagctaaaagcaccggtgaactaagatctaacttgctctgcccagtttcccaaaatctagagggtcaggtaagagctgaccaactgttttggttgcaaaagcaggagattgctgctgtgttgggatccagtctgcccatctaaaacttggaatggaaggcatatttaaagctaggttagattcaaaggtttgactattacttggaatttgcatttgaagtattaagatggaaaatagttttattgccaaaagtgagaaagagtttttcttttttctgagagtaatcaggaaagtctagagcatgtatttgccgatgccttctgggtgatggaaagacgatgtctcctacttcatgaataaagttcaatgagatggtagaacatataaataaattgcattgtcattatactttgcttattgatttttcagcttactaatcatatgtgcatctgtgtatgcatatcacagatgtacaacgcacacacatatgcatatataaaatattatatattatatattgctgtagtacctgttattttcatccagtagtgtatcatgaacttctttacataaatatatgcattttaatgtttcatttgtcatgatatttaactaatacccttttattagacataaatgatgtttccggttttctatattaagaataaggctgtgagaaacatacctgtggctacaccttttcataggcccttaactaattgcttaggataaatttcttaaggccattctttttttcaatattttatgggtcatcatacatgcctaagtcataatgtggtaaatattttacaaccaatcctggaacattttattcatataaaaatagcatttccataagattcttggcaaaatagctccaaaaaggcatgagttaggatgttttactaagaaagtactgatgcctgataaaactatgatgtgctgtacagagcttcaaaattggtatctcttttggcttaggattgacttggcgatgcgggctcttttttggttccatatgaactttaaagtagttttttccaattctgtgaagaaagtcattggtagcttgatggggatggcattgcatctgtaaattaccttgggcagtatggccattttcacgatattgattcttcctacccatgagcatggaatgttcttccatttgtttctatcctcttttttttcgttgagccgtggtttgtagttctccttgaagaggtccttcacatcccttataagttggattcctaggtattttactctctttgaagcaattgtgaatgggagttcactcatgatttggctctctgtttgtctgttgttggtgtataagaatgcttgtgatttttgtacattgattttgtatcctgagactttgctgaatttgcttatccgcttaaggagattttgggctgagacaatggggttttctagatatacaatcatgtcgtctgcaaacagggacaatttgacttcctcttttcctaattgaataccctttatttccttctcctgcctaattgccctggccagaacttccaacattatgttgaataggagtggtgagagagggcatccctgtcttgtgccagttttcaaagggaatgcttccagtttttgtccattcagtatgataatggctgtgggtttgtcatagatagctcttattattttgagatacatcccatcaatacctaatttattgagagtttttagcatgaagggctgttgaattttgtcaaaggccttttctgcatctattgagataatcatgtggtttttgtctttggttctgtttatatgctggattacatttattgatttgcgtgtattgaaccagccttgcatcccagggatgaagcccactcgatcatggtggataagccttttgatgtgctgctggattcggtttcccagtattttattgaggatttttgcatcgatgttcatcaaggatattggtctaaaattctcttttttggttgtgtctctgccaggctttggtatcaggatgatgctggcctcataaaatgagttagggaggattccctctttttctattgattgaaatagtttcagaaggaatggtaccagttcctccttgtacctctggtagaattcggctgtgaatccatctggtcctggactctttttggttggtaagctactgattattgccacaatttcagctcctgttattggtctattcagagattcaacttcttcctggtttagtcttgggagagtgtatgtgttgaggaatttatccacgtgcacattgtgcacatgtaccctaaaacttaaagtataataataataaatttaaaaaaaattggtatctcattttccatcttttatggaccactttctagggaacagtaagagcctggaaaataactaatgctaatttaggaagacagatatttaacacatggccctctcatctgctcttccttgccatatataaagttacagaatgagtgtttccttgaaaaatctaagaggatgcatctcttggaggaactgatgtttggaaaaagacatcctgaggaggaggggaacaacaccactgtaatgacaaagaagtctatccaggcacaattgattgaacattagcttaccttcattttctttctccctaacacactctgaagggacctggtgtctcatcttcaactgcagcacaagataagagcacatttagttgccactttactttagatgcaggaaccagcattgaccctggtcatttaagatcattcctacatttctaggtttcttatctgcactcgagcttccatgcacacccaaaaccttagatatcacccatgtcaaataccctgcagcaattattatttatagtcacctcttttagaacttcgaagacttaaaaccatagttatatctcattttattttctcttagctttcacatttcaccctaggaaacaatatactataatgtttaagagtatgggctctggagtaacatctggttagaagttgaaggcaatccctctatacctcagtttgttcttttttataatagggttaaaattaaaattaggaacagggggttgtcaacaagtgggtaaagaaaatgtggtatatatacaccatggaataatactcagtcataaaaaggaatgaaataatgtcttttgcagcaactcgaatgcagctggaggcgattattctaagtgaagtaactcaggaatggaaaaccaaatatcctttgttctcacttataagtgggagctaagctatgaggatgcaaaggcataaaaatgatataatggacttcgaggactcaaggagggagaagggtgggagggggtaagggataaaagactacacattgggtatagtgtacactgcttgggtgatgggtgcaccaaaatctcagaaatcaccactgaagaacttatccatgtaaccgaaaagcacctgtactccaaaaactattgaaataaaaataaaaaggaaaaaaaaaagaagagagggttatgagtattgaattgagtagtatattagctgttactgtagcaattattggctacttgccatatctcagtaaacattaatttttagtaatttcatagtccagtttggtggatgtatagggagtatggattctaattcacacctacatgctgaaattcagacctttctgacatatggtttgacctctttaagggcctctcagtcttttactggaccctcttctttccagttaacagacaaaggaagagacaaaacacagaagactgcccgattagcaaagccaaaaagtcatgtgcatccccctgtgcgcgcacacacagacacacacagacacacacagacacacacacacacacacacacacacacacacacacacatttcactggacagacctccatcatatgacccactcccctacatgcaggtgagctgggaaatgtaatctggttgtatgcccaagagaaacacaacacagatgttggtgaacatttcagcaagcctctgctgttattatcatttggatataaaaccaactttttttttgttaattggcacaacctctaagcattcttcctttgattgttatttgctctgttgaagttcaatgcagccaagcccagaaatcaaaggttcttctggtgcttagaaaccctttaatataaatatattattatcgaggcttataatgtgaagttctttacatttttgcataaaaagtgacccatagaaaatagtcattttcaaacacagaaaacttttgtgagtcaaaacagttggcacagagtacttaagacatgcttgatcccaactggcacctaagtagataaaaacaaataggttgggtgtggtggctcacgactgtaattccagcactttgggagacccaggagggtggatcacgaggtcaggagttcgagaccagcctggccaacatggtgataccccgtctctactaaagatacaaaaaattagccgggcatggtggtgcacacccgtaatcccagctacatgggaggctgaggcaagagaatcgcttgaaccctggaggcagaggttgccgtgagccgagatcgaaccactgcactccagcctggatgacagaaggagactccgtctcaaaaaataaataaggaaaaaagtatatataaaatgcctctaattagttatctgttattctttctaaaaattaaaatgggttgcatttccaaattttcttttctttttttttttttgaggcaaagtctcactctgtcacccaggctggagtgcaatggcacaatcttggctcactgcaaactcctctcactgcaaccaccaccacctgggttcaagcgattctcctgtctcagtgtcccgagtaactgggattacaggcgtccaccaccacgcctggctaattttttgtatttttaatagagacaggtttttaccatgttggccaggctgatctcaaactcctgacctcaggtgatctgctcgcctcagcctcccaaagtgctgggatttcaggcatgagccactgcacacagccacatttccaaattttctaaaggcacattttgaaagacataaattgaatttagtaattgcatgttttcttaaaatttgattatttctgattgaatctgaaagtagaagtcaacatgcatttgggaaagaaaatatcagaaaaaggaaatgcttttgctcagcatgcttaatatagaaagtaggtttattaatacaatgtcaccttccattttggaagattatattactagtggaaactttgcctttgtgggctgatagggaaaaatgataaaccatttgaaataatttttgaaaagaaatagaatattataaaaaaaacaagcagaaggagccattgtagtttcaacagtctacttcagtagcccttctacagttaatctattattgaaccaccaaatataatcatgcattcattcatttgttccatcgtttattgaagattgattgccacctgctatatgctatactctatgttaggtcagatgtttttataacaaattgtccttaacactatgttcaatgtttcagcaatcttctaatttagatttacatatacaaagatatataaatgaatataggtataatgagaaagatatataattaaccagtgttacattcgacattgtgttgtctaaatgacacatgagaagcttatttaatattcaaattctatatttttcactgaaaatcttaacttcaatcaataactagtaaatgacctaagaagttgtgtaacttttctcttctactgacagtataccgcattgttttttctcctttcatttagttactattttaaaatttttcttctttaataagtaaaatacaattctattttttttcaaaactgtgagacgatgtttttttacattttttgtccatgtgtgtattttttctattagttctcaataatttatataatttttttagttgtcgtttgatattgcttgaccccactgagagaatttctcaataattcaggcttgatacattgttatgaacaatgtctttataaaatgttttattgttgattatgataatctttaaacacaaatgttgtgaaaagttttatatatttatgaatactataaaacttccaatgcgaccttgatttcctccacggagactgaattgggataagaaaaacacttatttgctatgcaccatttattagtcaaccaacataccataactattggttaatttcttcaagcatcccattttattagtaaaataataatcagtatgccttttatttacttcatgtccctgaaaatatataatgtgactccttatttggcctaatgttgaataagcataaattagttatgttgaactcagtaattcaatgaaagttattatctccatggtagctgcttttgcctttctcaaaagcatgaatgctaagttttactatgaaaacccacataactaaaatgcaaagaagtggactctaaaattgcatgaaatagttcttaaaaagtagttttctagacccaggaaattttagtaaaattaagaaaaacaatacattccattgccacccaacaagataaaaaagatgtcagggacttttattatgttctagactcatgatgttaagtgaaacatcaagtgttctattcttttcatccgtcaacagaggtagccaactactctcctgaagtagtgtgtatcctgcccttgcaggttgttatttcattccatatccatagccgtgtattacagaagtctgcaaacttttacttaaagggccaactagtaaatattttaggttttgtgggtcataacctctctatgacagctactcaactcttctctggtggcaataaaaagcagccataaacaaggtgtaaataaatagaggtggctgtattccaagaaaactttatttacataaacagataacagaccagatttggaccacaagccatagtttaccaattcttcatgtgttgtattagcaagggtatttttaaattttttaaatagcatcaaaatgtattttagcaaatttttaattgaatatcatggttttgagatttacagatggatctagcctcttcatttcacatgctatgtcaaatcatttatttatctaatcttttaattatgggcagttatttaatcccccattttttcacagttatcagcaatgcagcaatggttgttcttcaacttctctttctgtgtatatatgcaaaagattctctgtggtactgtattgactgacattcagggtacttatcagattttctatgtctaaattagcaggctcaaaagacattttctagtatatgaaaatcaaggatagctgagatcagctaacttttttggtgaatatagactgaattaaagtgtcgaagccactgtttttataatctactccttatataaaacattaagtgaggccaggtgcagtggcccatttctgtaaacccagcactttggaaggccagtgcaggtggatcacttgagtccaggagtttgaggcctgcctggccaacatggcgataccctgtctctactaaaaatacaaaaattagctgggtgtggtggtgcatgcctgtagtcccagctactcaggatgctgagacatcgcttgaacctgggaggtggagattgcaatgagctgagatcgagacactgcactgcagcctgggtaacagagtgagacttcttctcaaaaaaaaaaaaaaaaaaaaaaaaaaaaaaaaaaaaaaaaaaaaaaaaaaaaaattaggtggcagaaatggtaaatttaaatactatgatctatttatttaactgaaatgttgccaaaaaatagactttatttttgaaggtgacaattgaatcctttctgattgtaaaacacaggctttttctattagaggattgatagatttgatctattaattagatcaaatcctctattagaggattgaatctatttgatagattccatgttaatttttctggtacttcaatcaaatgccattttatatgctttaactttgtttttattttcctcttgcactcaaaccagctaattcaaaggatagtgttcattttattcaaacttagctatttataaactcagaatacaagtatccccttttgccctaagatattttctgtcactaattaggttttgctttgcaagattatatcattcaaagtccttttcctgttactcaggtaaactgtcattggatagacagttcaaagtgttactttgtaaactaattaatgcacgtggtgctacaaaattccaagaatacaagaaagtccacaataaaaagtaattctccctgggcatggtagcaggtgcctaaaacccagctactccagagaccagagactgaggtggtgggaggattgcttgagcccagaagattgcgaccaacctgggcaacaaagcaagatcccgtctcaataaacaaaccaaccttgctccagtttccctcctgggaagcaaccattgttatcagattcttcaaccctctactagagatactgattgcctagaatggtcctgttttatgactggaatacactggcttcctatagaagtgcaaatgtgaatccaagttcatatatccccttgctgtttttctgcccaaatggaattcattatccaaacagccaagtatacatatctgtcaatatgatacatttttagagtaagttttcatataagcatccagatacaatttgatttttcttttatttatctaaaattttgcttgggttatgaagtttcttgatttattttctacaactttccctactttccattgtcccagcattttgtatttagctctttaattcataatcatggactctatcttgagtaagctcctggacctcctgattattttagtcttatttcaggcttatttctacacctggaaatagtctacaatgctactggacaggaatcagggttttttacatgactcccaaaacaaagtgggacagtagtcacttaatactgagttatacaagcaaagctgacaagcataggcttataaagaaaccatataaaattaggcaccatttctgccttccactaactcatgtttttgcaatcacaaactaagcaaactacctgtgaggaactacaacactttttatattatgaagccagaatattggaatggtttcctatacaattattctctggaaagtacaacgaataattccaggagatctgaatcataggaactttttaatatttaagaagccgaaatgtaggctaacaaccaagtctcattctaggtttttgatatcagagtaccagaagaaaatatgttttcagaatatcattaagttcctgcctttgtttctttgtgcttgcttctagccacatcagattctgatggaaagtgtatccattttttctttctgtcattagaaaacagaaatctgaaaagaagtgaccaggaataaaatacatctggctcttcttctcaaaattcaactaagtcactaattcctagggagcattattttttcatcatatgttcattaattgggtcattacttcaaactcaaatatatgattttaatttttcaaactgcacaaggatggtaatcctaaaacactgagctaaagctttcttgtgtgcttttcatcacagtggcaggtgcttctctttttttcacatttgctccaacacacttcatccttcagaacactctgtgtcattcaccacttcctgagtctgagtgtgtgactgcaagtatttgagaactttatttctcacttccttcagaccagtgaatgcctaattttaaacagactatttctaccagtttcccagtttaatctctgttgccatgattaagtagtccaaaacattcttcaatgatgtctaaggctttggaatttaaaagtaaattgcttctgggaaaaacaaatcaaacttgcattgcagacctaaagaaagtgcattaaaacatattacactgcactttcttggtggaataaatggatagtcacagtaatgtttcttctagcaatgtcagatttggagacacttcgattattttggctttcgattgagtttctctccaacactccactctctatttgatgtgtctacatatttcaatgtatccaatgacaatttatgccataaattattggctatatagggccaaaaattcagagtagaaaggtaaagcaatatactagagagagtgcatggagatgatatggatttgatttgatttcccattactgatttgctgtgtgacattgggcaaccttagcaggccttcattaatatcgctgttcatgtctacctatgatggtgtcatggctgccatattacatttgaggtatcttttctggtggaaggtggtagggttagtggtaagaaatattctaaaatcctccagtgtttcataagcacattgcacattctattttaaaaagtttgaaaggaatgcttagtaaaatgtgatacttggaggatttcattgtaatttgttgcttagttcaggaaagtaaatacctcactttttctagcattgaggagataatgaatatttacatttttaaattcacatttaaaatttgtgttgcagcttaactttaaaaattacttttattaaagtttaacattgtgtatagagggaaaaatctgcatactataaatatacagtaagacacattttcacaagctgaacacagtcctataccccccacccaatgacctcttcattttcttccccagtcgttacccctccaactaccatggataaccactatcttgacttttaacaaaataaatgggttttatctctttggtactttatataatttggaaaattctgtactcttttatgcctaacttatttcactcagaaatatgtttgtgagattcacccatactaattctggtagatgtagattattcattctcatagctgtgtagtatcactttgagtgaatatatcacagtctgttgaaagacatttaggtcatttctaacattcgtccattactaacaatgctactataaaacattttaaaatagcatagtgcaatagaacttcctacaatgacagaaatattcttaatatgtaccaccaaatatggtggcttttagctgcatgtggcttttgacctctggaaatgtgtggctagtgtggctgaggaaataaacttttaatttcagctaatttttattaagtagtcatatatggttagtggctactatattagacagtacagttctagcacatgtctttaggtgaacacatgtgcttatttgagaatagttattttacatgtaggaatgaaatgaaactgttgggaattgttattttatacctaggaatgaaattgcttggtcataaggtatgcaaatatacctctaatagattttaccagaaagttttctaccagaggggtttagtcatgcttatctttattcccttcagcaacacatgagagttccagtttctccacattcttgataatacttgacattttctatttaaaaaggaaatttagccattaatggctttactttttaggtgcctccataatctccccacatccattcttggttacatttaaactagttgctatggtcttaatgtttatgtccccccacccccaccccaccccacgccaaattcatgtgttgaaatcctaacctccaaggtaatggtattaagatgcagtgcctttggaaggtgaattggacatgagggtggagcatgcatgaatgggattaatgtccttatgaaagagttctgagggagcttatttgcctttcccccatgtgatgaccctgtgagatggtgccatctgtgagaaagtgggcctcatcagacactgaatctgctactgcctccatcttggacttcctagcctcaataaccacaataaataaatttctgttgtttataagccacccagcttattgttatagcagccaaaatggactaagacaatagtcttcacaaaagagtcacatcttttaaaaaatacaaatcagatcacaactcctttgtgtaaatctgttctcaacttcccattgtttttcctataaaatccagatcctaatcaaggtgagttatgttcaccaattttttctttattataaccacttcacagcaattgcagcattagaaattttatctctgatggaagttaatatcaacacatctactgatggtgagggttatatgtgtacaaacttggaaattagtttccagttgtaaacctatataacaaattccaatgaaatctagctcagaaaccatacaagaaaaaagcacactaatttaaaaaaggtaatgctttatttgttttcataaatatagctactgattgctagtgaaccaagaaactaaaaatttacatcaaataatgtatgattatttttatacagagcatttttttatcatcacttgggtttttctgaaattcaattattaatcttttattcaattggaagatagtaaatgaggacattattcattgccccaaagtcttcaaactgttcttaaaattagggtaaactatatcatcattctttttttttttttttgacagtttcgctattgttgcccaggctggagtgcagtggtgtgatctcagctcactgtaacctctacctcgcagcttcaagcaattctcctgcctcagcctcccaagtagctgggattacatgcacccaccaccacacctggctaattttttgtatttttagtagagacagggtttcaccatgttggccagaccggtcttgaactcctgacctcaggttatccacctgcctcatcctcccaatgtgctgggattacaggtgtgagccactgtgcccagcagttattcattttttatgtgttgtacatgagagatactaactggttaatattgttcagctgtttccccacccaaatctcatcttgaattttagctcccctaatccccatgtgttgtgggagggacctggtgagaggtaattgaattatgggggtgggttttcccatgctattcttgtgatagtgaataagtctcactagatctgatggttttataatggggagttcccctgcacgggctctcttgcctgccgccatgtaagacatgactttgcttctcctttgccatctgccatgcttgtgagagacttccccagccatgtggaactgtgagtcaattaaacctctttcctttataaattacccagtcttgggtatgtctttattagcagtgtgagaacagactaatacactggttaagaaattgcttccccaaaattcaaatcccagctctgccactcatttgcaagacctaggtcatttacttagctattctaagattaggcactaatgttaactaattattaatgatattaataatcaaatctatttcaaggaattctgagaataaataagaaagtgtttagaaagcactacgtcttctacatgtagtaaacatccagtgtttctttttatgttattttgcattttcttattcttatacttgtcatgataataaatgattcctttgaaagcttttgaaagataaatgctctttttccattttggtatgagtcgatagggtcattaagtctccaagtggcttgtcagtgttatatactgatggcatgtatatcaatgattagatggctatgaaaatgaattttagttttagttattactatagatattttaatttgcattaataacattacttaaaatgctgcttgcaacttatgcctttataagctgtgagtctcctatagcaattgttcactataaaatctcatgcttcctcccatgcagactttacacactgtattttttatcagaaatatccttttttatgtatttctacaagatgaaattcagtatatccttcagtgccacattaattatgcctcttccatgaagacttctcttcttatcgccatctattaggatctctccctaatttaacgtataactcttgtgttatttttaccttttgactgtatattctggttagctactgtattagtcttctattggtgtaacaaactaccacaaactgggtggcttaaaacaacataatcttaatatctgacaattccttaggttaaaagcctgaaatggctctcacagggctgtcaccagggctgcattcttttctggatgctccaggagataatctaattacttaactttttcagtttcttgaaatcacctacatttcttagatcatagccctggatcaatatttctccttggatcacctccatgttgcccattttggtggcttacttatattttaatgcttatttgagtgtgcaatcctttcacttttctaaaatttatttttctctactatacaatagaaatagtcacaagaattagaagttagtggggaaaaattgtaaatgataaaatgatgacaagacacatttctagagtaccaagatgggtcacacacacacatctttaccaagttgtttggttgtacaagccttgaaagaggggcaaagggggaactgagtgatttaagaatcacagaatttggaattagaatagacctccagtatagctacctacattccagcaagttaactattgtgtttatttatgagaggttaagtgcctgatctgagatgatacctctgctatatggtcatgggggctagaacctagctatcctttttgaattgctaaagaaccctccatacagtaacagatttcagaagcccctgtacttcccctagaagacacttatggatgcattctaatttgagctgccatcagttaggtttagcagaaataattttcagcaaagacaacaaataggttaatgaaatttttgaatgcaatggttctttcagggccatatgaatgtgaggatggtgatccctgtgtcaatggtcaatcgctttcttgtgaaaattatcgccttgttttccctcatatctatattactttgaagaaatatcctggcattataaaagtttttgatctccaggattttttcattttatctaatctttctcctttgtttcacaaagaagattaaccagttattcatatctcctgactcgtttgttgctaactgaaccagggctgaaactctgaattctgacttacaatcagagactgtccctcaattccatgttgtgttacctctattagagtaacctgagtaagcttcttagaaccagaaacacaggtaatacattatttaaatatcacactgcctcttgcatgtagcaggaacaagtaagttacctaagaaaaacaatgaatgaatccaaacagcctattgacaaggtaatccatagaactgagagtcagcaagatggcaggctacataaaacagaccaaaaagatgatagaaatgaaataataagattgtgtctctgttaaatttgtggatcacagtaaatgcttcactaatggtaacctcatagcatccagacacagtgagtcatttctctggttcccccttgtttttacccttgatttctcaagagtagctcagttcatatatttttgcttcagtaagaccattgactttgtgtgtgtgtatatgtttgtgtgtgtgtatgtgtgtgtgtgtgagagagagagagagacagagagaatggaggaacagcatagcacagaactgttcagctaccaacctaaatctattagccgtgctgtcctggaaatcacttttcagccacacaaaatttcactggccctatatcccaaggagccctgagttgccactataccgtagactcctctctccgtctggtggctctttccttccccttttttagatatataccttcaacttgaacctttttgttagtattatattattctttattttgttttaacataaaggggccactggacaatatttgttcagatcacttatgtgtactgctcagttgatatgcacatttactcttctgaaactgtttagcattaagtaacttagaacataaaaaacaatgcaacaagcatattatcttctattttttcccaaatcctttgtgatgtaagaggacagaacacatatatacatatcttttctacaaatggattatcaacattgttctcaacattacctagttccttaaataagaaatatatattttaaaatttgtatggcattcaaagagttacaattatgaatttcacatttctctagatgggtattaaacaatctttggcagatcacagactaagaaaggtaacagatgttggattggaaactgtacagtctagagatggaaaattaatttgtaaaaaagtagtgatttttttttccactgtgtgtgttttaaatggccttagcaaagcagaatggaaatatttgcattcctggcaatcaatttgcatacttaagcatttgtttttgttcccattctaaagataactgtgtgttcagtaataacccatatagtagaaagaagggtgaagaaatgtgtgtctttggcatccagcctgctgttagcgagtgactttctttctttctttctttctttctttctttctttctttctttctttctttctttctttctttctttcttttgttttgttttttgagacagagtctcactctgtcacccaggctggagtataatggcacgatcttggctcactgcaacctctgcctcccaggttcaagcgattctcctgcctttgcctcccgagtagctgagactacaggggcatgccaccatgcccagctaatttttgtaattttagtagagacagggtttcgccatattggtcaggctggtcttgaactcatgacctcaggtaatccacccgccttggcctccccaagtgctgggattacaggcgtgagccaccgcacccagcaacaagtgagtttcttagtctacaatgttcacttggaatttctttactcatgtcttgatgtaaaactcgctgaacatactgctattataaaaatagatatattttccatctctctggtggcatttcttctcttcctctcacctaacttaaatcttctatttcgcttctccagagctcccaacacaacagtcttcttttatcttcaatacgtagtggaatattgtgaaatagctgaagcagaatgggggaggagacagtggggaattttttaaaaaactgttttacccaaccattgagcatatactttttaaaatatttatattctgcctagagttgatgctgatgaaaccttgagtctgacaaagattttataaaaattcctatcacattccctatttcaatgtcaggcaataagtcagaatgcaggtatgacaatgtttttcaatggtcttacagcagactagaaagcaccatcaagaggagaatgcctctgctaagaggaattatctatttacactgcattgcagtcccatttctcatgcatagatctgtagcatatttggctaaaacttgcagaattattatgtcgcttcctgtccctctatccctactcactactttgttcaagggaattaataaaaaaaaaaattgccttattttggagctgtttgcgaaagtcttgttatttcagttaaagagaacactattttgttagcaagccattctgtttctttgggctacatttctatatacttatcagctaattatatagtgcagatatttttagtgggaggtagtcttttttttttgtccacttgtgacttctgccttgagacatttttgataaaattgtgctggggtcaagttgaaaaggaatgttttcctacattaaaaattttaattttaaagcaatttgactaaacatatcggtgatcataaaaataaagtcaaggtttaattcaaaacagaacattttagtttgtgtatagaaaaactttattttggagcagatatcaaggagacaaccaacagaataccgtcttcaactcttcgtttgttcacaaataaactcaatagattaaaacttatggtagtgaagttgcagggcaggctgttaccagcacggtaaaacaaaagaaagaaatctcaaaatacgtgcccttttgattgtggttatgcataaagctttgacagagtaaaatacatagaatgggtgtgtatgtaatatagagatacaggcctggaaagctgcctagagactttccgttgatgataattttagtacttaactaaaaaccatggttttttgactctttcatttttatttctgtaaatttaacttctactcagacagtagaagttttattctcttttattttattctggtgaatgcatcaaatacaaaagcaagttgtttagctcacaaattgcaattcagatcctttgccccttgtgcattcatttccagtgatgtttttaacaccatttgatcttaaacacccaacagaaaatagaagcacagggtgctacactgttacctcaatgagtgtggacaagtaagaattaaagtgaccttagattccagatttctgtgtccttccttaaagaagggatatacagaggtgctaagttgatttatactaagttaaagccatttcagtaatgcaatgaccttgtaccaataaatgtttaagtatctagttcttcagggatctgagaaataaatatcatatttaaaataacagatcttctttgagaacttttgactgcctgaaactttactcagggtggattttaaacaactttcatatacataggaatgaaagtatggctactatatgctttttactttaactcttattacaggttgaatagtgccaaagatgaatgagtatatttgtttgctcataatatgccaatcgaattctccttttgaggactgagtagaagttaagagtgtgagttacagccctgcttttctttttaaagttaccttggtcattgtcccacatggtggggcccatttacctctcagtgttcttggctacaaaataaaaatgaaggaaaaaataatgtgtgaagcatttttgagctctaaaaattctgaatttatgtctcaaaaataatactaaatgacccataattcaagataaatgtacacagtaagaatttttaatataaggaaatgtaaaacccaagaaaaggagaataaaataattatatgaaaactcaaccatatagttactgtaattaattattataaatcactcgatacttgctgacatggaagttaaaacaaatatttcaaaattcatcaaatacttttaccaaagaaaagcagaaatgtttggcaaatctgttataggagttttcttcataattttatgtaaggacctggtttaccaaaagctgttagattgatttttcctcttgtttttctaagattttaagttctataggatttgttaatagtgttaacacattttttattcaccctcaatttctgagggtagacatttaccttaaataaaaaaaaataacatgggagaattgatataataagatacagtttttatataagataaaggttatctcaaatcagctttggtgtgtgatcatcataagcttagtagggcttaaatgacttgttccattgtagtactgtcctcttttcctttatttctctctacactattcctttgtgttttaaaaaattattgaacctgctgtaaaatagaaatagtaacaaaatatacatcacaagatgtttgtaaagatttaatgagataatgcacataatgtatttaatacttttactagacaaatgttcttaaaaatgcaatcagtacatttatactgaaagaaagacacatacaaagagagaggtggaaggagaaaggacttgtggtccctttttgtttgatggaaactctttctcttataccaaactgatgtctaggcaataaatctataaagcactaataattagagcaagatgctggaacagaaacatactaccataatatcccacaaaagcactgattttgataagtaccaatggatgagagtacctttgtgggagcctgggcatctagcagaaaagtcccagtacactgttggagcaaaaggtatccaaggatagacgtattgaagggaataagaacggtttcactttacccatgtcacccctttaccgggcatagctcagtgacaagagaggctccctcagcctgcaatttttcccatacgtaaaaacaagcaagtagttagtaagtgtccagttcccctagctgtatgggatgctgcccaagacatccacttctttctaaccccacccaggatactgaggtaattagcatgactgagtggttggaagaaactgggaacaggaaacggaggctatagaccctactaaccactctacagactccctgaggaagtccacccatgaactacttaggaggccttgcctgtggatcctcctcaactagctcatgggcaccacaagtgtgccatgcacctcaagccccctccaagccagctcccttaatataccactatggacagcaagagcaagtgtctcactcagacaccaagcatgactctgcaagattgagagaaggcatatgaacttgagcatttctgggcacggccacagagaacacaaatgggaggttctcagaacctgtcctggctttgtgggatcgagagacagcatacagtcttaagaattcctccctaagagggaacaagtggcatggagcagatgtatccatggaaaatgtctaagagtactagctgaatctaagagagctcagaatctctggctgggttgattggtgaaggattaaaactgaaggagataactgcttcttcaaatgagaatacagtaatgtaagacttcaaagaacattaaataatcaagaaatatgataccatcaaaggagtacaataatattccaataatgagcctatcaaaaaaattaagatctataaattgcctggcaaattgccttcaaaagaattgttttaagggaacaattcattaagtgaattgaatgtgctacaagaaaacacagaaaagcaactaaatgatatcagaaaaaaatacacgagcaaaataaaaagttcaataaagatttagaaattatgagcgaaaccaacagaaattctggagctgaagaatgcatgaataaaatgaaaattgcaatagagtgtcatcagctgccttcatcaaacagaaatgatctgtgaacttgaagatatatcatttgaaaatattccatcagagataaaaaagaaaaaaacagtgaaaacaaatgaacaaaacctacaacatttatggaacaatatcaagaaagcaaacggtcactgtatgggagctccagaagaagagacagaaaaggaacagaattcttatttaaagaaataatggctgaaatatttccaaatctggcgagagatgtgaacatccaggtatatgaagatcaaaagcctccaaacggacttccccaaagaagactcactacgacacattaaaatcaaattgtcaaaaatcaaagacaaagagaattttgaaagcgccaagaaaaaaaacatgcttatcacatataagagaacctgcattagactatcagacaagaaataggtttttgtcagcaaaaaccttgcaggccagcacagggtagaatgatgtagtcaaagtgctggaaaaaaattacaaaacaaaaatagattacctggcaaagctgtccttcagaaatcgagagataaagactttcccagacaagaataaataaataaataaaagttgaggaagttcaccaccattatacttgccttacaagaaatggtaaagggagttctgcaagctgaaagcatgttaattagtaacatgaaaacaaacaaaagtataaaactcaccagtaaaagtaaatatataagcaaattcataatactctaatattgtaatggtagtgtgttaattacttatgactctagtataaaggttaaagaacaaaagtatttaaaataactatagctataataacctgttaatagatgaacaatataaaatgatgtaagtcgtaacaataaaaacttaaaatggggtgggcagcagtgtaaaatttgtgtatgcaattgtaacaataaaaacttagaattgggtgggcagcagtgtaaaatttgtgtgtgcgattaaagtaatacacgtaaaatagattgttataactaaaggatgtactatgtaagcctaaaggtaatcatgaagcaaactcttatagtagatacacaaaaaataaagagaaataaatcaaagcgtaccactatagaaaagcatcagttcacaaaggaagatagcaagaaagaagaaagaatcaaaggatctacaaaacggacagaaaacaattgacaaaagggcaatagtaagtctttacctattcataatttgtttaaaggtaactgaattaaaatttccaatcaaaatatacacagagtggccaaatggattaaaacaagatgcaactaaatactactgtccaaaaactcacttcagctttaaggaaattcgtagactgaaagtacaggggtggaaaaagatagtccatgcaagctgaaaccaaaaagagcaggagtagttatatttctatcagacaaaatggacttttaagtaaaaactggaaaaaagaaacaataaaggtcactgtataatggtaaagtagtcaattcatcaagaggacataacaattgtaaatttatatgcacccactattaaagcacctaaatgtattaagcaaatattaacagagctaaatgcagaaatagagagcaatgcaataatagtagggaacttcaatacccaactctcaataacgaatagatcgtccagacggaaatcaataagaaaacattggactttaactacattttagaacaaatgaacctagcagacatacaaaagactccatccaaaagcaactgaatgcatattcttctcaagcatacacaaagcattctcctgaatagatcatatgttaatccacaaaacaattgttaagttttaaaagattgtaatcatattaagcatatttctgacccacagtagtataaaactagagatcaataacaggaagtatactggaaaatttacaaatatgtgaaaattaaacaacacatttctgaaaaaccaatgggtcaaaaaaattaaaagataattaaaaaaatattgagccaaaagaaaatggaaacacaacatacaaaaacacatgggatgcagcaaaatcatttctaagggaaaagtttagagtgataaattcctatgtgaaaaacaaagagacatctcaaataaacaacctaactttacatttcaatgaactagaaacataacaaactaagcccaaatttagcaaaaggaaggagataataaagatcaaggaagaaataaaatttgagaagaggaaaccaatagaaaagatccacaaaactaagaattacttttttttaaaaaaaggtaaacaaaattggcaaaccttcactacactaaggaaaaaaatacagatttaaataaatatgatcagaaataaaagaggagaaattagaacagacaccacaaaaataaaagtatcataagaggctaatataaacaattatatggcaacaaattagactgcctagaatagaaaaattcctagaaacaaacaacctacaaagtctgaatcatgatgaaacagaaaatctgaatagaccaataacaattacagagattcaatcattaatgtaaaatctctcataaaagaaaaacctatgacctaatggcttcactggtgaattatatcaaacatttcaagaataattaatagctattattttcaaactctttcaaaaaattaaagaggatgatgtatgtccaaactcattttactaggctggcattactctaataaagccagacaaggacaccatgagaacagaaaatttcaggtcaatatctctgataaacatagatgtaaaactcttcaacaaaatactagtgaaccaaatttaacagcacattaaatggatcatacactatgatcaagtggtatgtatcactggggtgcaagccaaacacagaagaacatataccgcagcacctcacttaaacatggaatctagaaaagttgaactcatagaaacagagcacagaaggatcgttaccaggggtatagaaatggggaaaatgggtagatgttgatcaaagggaacaaacttgttagtataagattaataagttctggagactttatgtacatacggtgactatagttgataataatatattggatacttgaaatttgctgagaatgtagatttttcatatccttacaacacacacaataaaatgtaactatgtgagagatatgcatgttaattagcttgactgtggtaaccatttcactatatatatatatatatatatctgaaaacatcacattgtacaccttaaatatatacaatttttacttgttaattatgcctcagtaaagctggggtggggagaaaacctctaatgtttaacttaagtacaggacaaaaaactagcctatacattttggtctggacaatttgcccatctttgtcctctcatgacctccagatggtgaccttactattcagtggatgcagaagcaagatagatgacctttcaagtttagtctttgccataatgcctaacccagtctaaatggtgctgcactcaaatgatagttttgataacagtgttacatggggtcaatcatcatttttgcaaacgacttgagtaattttttttcttgatacttaaatgatagttccaacacaggtgattctcctccaaaaccataatgagtatgagtctgttgaataaatgtatacctatactttagtgagcatagaataatatttttaaactctttatattgttgtttattactatttcttaaaaccttatacgtagtctagttttactgtggattattttccttgtgtcctgggattgatatttaatttctttgcttttcttcacactttagttataattgttatacatttagaacatttaatctggatttttgtaccattcagtaaaagtagtcaaacttcccaaactttagccctgttttctccttacccataagctaggaatcaatatcagaatcagagataaaagtttgtaccccctccccgtctgtattgagctgctcatgcatttaaataattccattaattaatggtaacagtaactttggacataaagatcaaattagcagatatatataatgaacatatatatataatgaacatatatatatatatatatatatatatatatatatatatatatatgcttattagcttaactgtgaaccctgatgaggaatgtggtatgatttgttgattttatgccttaatgatcatgtgttctggctgcctgagtcattttcttttaaatgatgtatttgtgcattccttcatacttccagagttcttctaagttataaacacagaaaaatgctacagagccctggtactgcattccacatgtttccttatgatgtgtgaaaggtgtcgaattgtcattttctaagcttatgttacagagtaggtttttggtagctgtaagtctaattattccttctgaatatttaaatactgaaataggccacttaaaaaaaaataagactggggaggtgtggtgggtcatgcctgtaatcccactactttgggaggccaaaatgggaggatcactgggaggactgttgaacctgagttcacaaccagcctgggcaacatagtgagacctcatctctacaaaaaaaaaaaaaaaaaaagccagctgtgatggtgtgcacctgaaatcccacctactgaggaggccagggtgggagaattacttgagcttgagaggtggaggctgcagtgagacatgagtgtgccattgtactctagcctgggtgatagagtgagaccctgtccaaaaataaataaaataaataaataaaaccaatactttctactacaaatatattcattattcattcataacgctttgattatgatgagaacacttgtcttaagtgacaatatgttcttcaatgttatgttaatttcggcccacctgaataggatatttcaaagaaaagtattaaaatggaaaatcttaagtctaattgataataataagaaacatattaccttgtgaacgtcccactttgtcacagtgttttgatttattttatgccataagaccatctgagacatttgtcgcacatttaacgctggagggttttaagtgatggatatttgctaagtctgatttagtcaattatttacttcaaactggcaatttattaatctttcttttatgcagcaataacatttatttactggaaaaactgaatgcaaatagtgtatgtgtccattagtatcaagtttatatttctattgtcaactggaatatttttgtttagtatgacaatctggaaaacaggttgataaattctgtgagattgggtcaccgttaggtagctctcacaatatagatatgatcaaagatgagtatttgaaattcactagtttatgttaatgaacattcttatagaggctgccagggggacagcttctattggaattaccttttgtgaatcctcctcattacggggtaagttcttactaaagtgaataattatctttcattccagaactacagtgtcaggcataatgagtggattgttaatacatttttcaaggtagcgccagtcttcatctgtagccattaatttggtgacagccaataattattttaactggcccctgatgctgaaatgcacagattgttttcttcctgtgtggtgcagggaacacttctaaatttctgagaggtttctgtcacttcccaaagaatttcctgacagcagtgacatttggtctaatcatttattccctcagtttcatgacttccctgcggtggctctcatagtcaggaaagcttctgttgttttggaaccacagctacaaacatctgctgccaatattttgcttaaagtgttgcaactttccttaaaaaaggagacccccttctttttatgcttttagttattttccttaaaataatgttaaactcttaagaagtttcatagaggtggacatctaaaattattaatgaggaagcttttaaagatagaactggaatttgattatcaatagtcctcaggaaaaaaagagaaaataataataaaataataattagaataatattgaaatgtttataaaatgttatctaaaaaataataaaaatgaactcatttttactttataaatgactcagttataataaaaactactcagaacaaacacaccaaaatgataatagtcattggtctcagcagtagagatacagatttcttctttgtgttctgtactttgcaaatattataaaatagttattacttagaaaaaattgtttgaaatgctaaaataatggacatctactaaacacgaaatacaaaaaaattgccaaaacataatatcttcaaagattttcaatatataatcttactataaaaattttatctataacatttataccagttacctatcactattgaatatactttgaagattatgcaggaatatttcttaattctctatagtttccatttgtctgagggttttttccttattcctatccttctccctttctctttctcctctatatctgcacttttaatatgaaactgtaaggaaaagaaaattagattggagatctctatggggcaacagcatatcggctgagttcagcatttcaaatttttgttctcaggtctcctttacactcttatgattatcaagaacaccaaaaactttttgtttatgttggttatacacatcaacatttgtcatattagaaatttaaaatgacaattaaaagttacattaaaaatgtacttaaaagacaataaaagcattgaaaatcaattaaaacaacattttattaaaaacaaccatattttctaaacaaatgaaagtatttgtgagaagggtgggcttattttacatttttgaagatttctttaatgtttgacataataaaacacggctaaattttcttaaatccttctgcatttcctatatcacatatcatgtagactctaaaagaacttcattctacctgttaagaatgaggatttttgaaagagtaaaagaagaccaataacatcttagtagttttatggaaaaattttgactttgtgaaccactcgaaatggtctcagagatacctgaaggtcctcagaccacactttgagaactgctggcatatgatagatatattttatttttgtacctagacagcattccattttaatgaatgtaccatatttatataaactgctctgcaaatgaatgaatatttgtattgctttcaggttttttttctattacaatgttgcaatgaatgtccctataaaatatatttgctcccatgcatggatttatgtatatgatggacacttaagagtgaagtccagggttaaaagttatgcatattttaaagtatgatgtattgacctcctaagaaaaagattctgtaaatgtttaatttcaccaaaacaatacaaactcttgtttcctagctcttcaaaatactaggaaagtataaatttatatgctctgccaaggtaaaagttagacagtgtcatgatattgttttatgattttcctctttactaatgagtttgatcatttttcattcatgtattgttcaattatatctctttcatcatttacctgtggttccagtttttttattatttttctcttgggttgtgtatttttatgtattgacctgttgacactctgtatattaaccaaattagccctcgatttgttgtgtgcctcacaaatttttttcttaatcagtacatttaatattttcagtagaccattctcaatataatgacttggaatgttagtaatgtacacatttcatagactatgcctcttttctacgttttttattatttcaggaatagtaaaattagaggaattgaataaacaaaactattttaaaacttgtcaattaagtttgttcagaatacgatttgtttcccagtattaactctggacatccagatatagacaggctataagcttctgattacatgaccagtgtagctagtttagattcaccttcacagagtatgtctaccatgtactgcaccttatttgatataatttaatagctcaataggtattagctgaatgaatgaataacaataattagtagtgacattaattaaacactccttttctccacctctgtttactggaaataatgcttttagatatagagatcttttgagactattctgtggtttcaaaaagctcatcaggaaatgatgttttctataattggagtaatctatcaaaatagatgaattctaaaattataataattcctgaaattgtcctgaggcaaaatttgttctactttcataagtgtttccattttcttgttaggaagaagagacacaatctgaaaaccaagtctaattttcccataggtgtaaaagagaagaccttagtaattacttgtctttttcatccagccacttagtgtcttttcttatttttgctaatgactgcaaaaaatgaagatctccacaaggagaaaatgttctccccttagaatggctgttcttagacttgagttacacttttaccatcatctaatttttgcaatattttacatctttgcccagtaaaatgaggttcctaagttaaaagatttttgagcatattattttgaagttgctgttttcagtgcaccattcacattattgtcattattaattgcattctgggaccaaatctattttgaaaaatgtttttcttgcatcttggataaactgaataagcaaagaaagctactcctgaaacttgtcattaaagttttctttagaatacaattcattcatcagtactaactgtgagcatccagatatagacaggacataaacatttgaatatgtggccatgtaactaatttgagctcacctttttagagtgtttctaccgcacacaagaccttatatgaaacgatttaatggctcaataaacgtttattgaatgaatgaataacagtaattactattattattatctacaacaatacttgcaagtcttctgtctttttgccttttctttcatttctttttccccagtgataggctagataattgcatcccagagatgtccatgtcgtaatctccagaacgtgtgaatatcttgccttacttaggaggtgtgattaagttaagaatctttagatgggaagattaccctgattctttcagatgaaccaagtgtaattgttaggatcgttataagagggaaacaagaagatcagagttagcagtagatgtgatgatgaaaagagagattatagtgatgtgaggaaggggctgcaagccaatgaatgtaacagcttctagaacctgaaaaggcaaggaagtatatgcttgcctaaagcctccagaaggaacagggccctactgatattttaatttcagaattctgacctccacaaaagtaagagaatagatttgtattgctttaagccactgagtttgtagaaatttgttacaacagccataggaaactaatatacttcttttactccaatttctttctgtattccatgccattagatattgcctccagaatcaagcatctatgatagtgcttagcacttaaattggatgatacatttaagttcaacccttgtgtcatagtggattggattttactctttataaaatgtatattgtgaacttctattaactcaaggtcttttctgtttttgtcacgagaacgtaaatacattcaaatgaaaatatgctgcatatttttagaagacaaattttccttgaacttgatccttatagaacttaactctgtttactggaaagtaatattagagtttaaaatctagagatagcggatcatatagataagcaatgcaggatttcagtgatttctatggtcaccagtacaggtgtgatcttaaaacatcgacactattgaactgaattcataggtatgtatttagcttgcatttgtttattccagtagccactgaggtgtatttctttgtttataatctataatcaaaatcctttgctatgacatacaaaaaatgtatcgagccacggacgttgaccagggttttcttccttcattagttgaaaatgaactgtatctgctattgtttatctggggaataaagagccaaatgttaaaagttgccttcagctaggagcagtgcctcacacctgtaatcccaacactttgggaggccaggaggggtagatagcttgagcccaggggaccagcctgggcaacatagcaaaaccccatctctactaaaaatacaaaaattagccaggcattgtgatatgcatctgtagtaccagctacccgggaggctgaggcacaagaatcacttgaaccgggaagcgggcagaggttgcagtgagccgagattgctccactgcactccagcctgggagacagaatgagactctttctcaaagaaaaaaaaaaaaaggttgctttcagttagtctgttcacagtataattttacatctgggggataagaaaaactgttgactgaaacattttctacattttttctttggttcatattaaaatatgtagttttacattatttgcttttggtagaagttctgtctctatcaagaagagtggaagagtgcaaatagatgtacaaattccttggttatataaatattattctaattgtaaaataactgaacatttttactgaggtgtgctgagaaagctctttgtttttttgttgtgttttgttttgttttgttttgtttgtgcctataatctgttcccatggggacctgcacaatccatgattctgataaaatgaagagcagtggagagttacaacttataaagcagttatgactaggctagtcaataaagtctcaaaatcagctattagagtacggtatttaaggtttgttagagaacacagagtatggaaacattgccattaactaatgtgtaatttggtcacatttcctgataagataataagactttttgctttcctctaatctaaactttctccaggaagttatgcaacataaagcactatgattaatattgccactgaataatgtaaatgtattttctcaaaagaaatgaatcccattaatgggactgaacacagtcttcagtggaaggttcagatttttgattcaaacaatccagcatttccatccatttactaattatatgatttgagtaagttatttcaaatcactaagacttatttatataatccatgaaatgcaagtaatactgtacctttactgaagaagttaaggaattaaatgaggtattgtatctgcattagtctaaataagatagatcatattgtggtaataagtaattcttcaaatcttagtggcttaacacttaaaaagtgtcattctttgttcatattagaaagttaagatgttgttggctctgctgcacagttattcagaatcttgtgaaaaggagaccacaccatctatagaaattgcagcctctgaggacatgatagcaggagatcagagatgaaaggagaacaccagccttcaaggcttagctcagaagtaacacttgtcacatttggtagtttataggccatggaggctcatgtttataaggaaagactgggaacatggatattggtaagcacagtccttcctacaacatctaaaatgcttagcaagatgcctggctcataaaatacctcagtaaatgttgtctttttcaccatcgctattattattttagagggagtgcaagttggtagttaagagtctgccactaactccatgactttaggcaaacttttaaaactttctgaatctccattgtaaaaataggtctcccctcataagactgttatagtgaccaaatgaaataaagtgctgccatttagtaagccctctaaaaatatggtagtttcattgctatcatgcatttatattcattttatctatcaattggttaaacccaattaaatgcctacatatgtgtgtttttattataacagtgttgagatttcctcatttttattaatatgtataaactaataaaacattgattttcctatttgtgacaaatatattacaattattaatcattcatttgataggtatttattaggtgtctactgttttctagaggtaacagataaacaatggacaaaatacatgaggttttgctctcataatatttgaattctggagcagtgaagagtaaatgaggcaaaaatcaacaacataaaaataaactgtaatttcaggttcgaataattcctatgaatttattttaaaaaggaggatttggttaagactgactggttaagacttacattttgatagtcagaaatgccttttctgaagaagcagtgtttcagctgagatatgaatgatgtaaagatatttgagaggaaagatttcctttctggcagagggaattccaagtgcaaaggttccaaagcaagaacactgtaactagttcaaatgtaattaaagcaaaagtgagcaacagtcaagagttgttagaaatgagactgtaaagataagtagtgacctttttgtctatgaaaaaaagtttgatttttttttttcgatatttgatgtggaactattcaaggttttcaaacaggaaagggatgtgatctgatttttgctttgaaagatcattctgactatgtatggaagaatgatctttataaagaatggttcctttataaaagggaccattgcagaattccaaaaagagatggtggtaattttgaatgaattatttggtggggggatatggatagaagtggaagatttgggatatattttgaaggtagagttaatatattttgaataaggtaggtaagagtttagagctgaaagaggactagatttagggcttcagccactgggtggatggtactgtgatgaaggctggggaaagaatgggctctttatgggatatcaagagacatactttgcatctgttatttccagatacctcttaaacatttaactgactgtcagtcacatgcaaatcttttggcctttcaaataatacaataattttagtttagattatgcctatttttgaatgactgcttgttatgaatgctattcagcgatgtgatgactcaatatattttcttttaggtgctctgctgcaagaaagtttaaagcatcttagtttagaagctcataaatactctctaaaaaaatgtgatagaatttacaaagataagcttataaatctaggaagatacattttacttcagagtcaaaaacaaaacaaaaaaatttcattgacaattcatccaacgcccaaatgaattgattagccaagaacaaagaggaatttttactaataataggtttgtatagcttccttgttttaaaaagaactatgttgtgggtttttttcttcccctaatgaaataaaatattagagtgaaatttttaattagttaagtagtttgttgcattctaccacatccatgaccatctgatatagtacccaggaagaagtcaaagatgcaaggcgccatatcgcatgatacacgataacaaggtaatgaagagtaaatacatttgtcatttcagggaagttatttacatgacacagccttgggaaagcctgcttgggagacataaatgaatgaagctttttagattgatgaattaagtgtgccttttttgttttcaataatgtccaataaaatagtttatattgagcaagaggtcttcttttctgatctaagacataatgttgtacaagaggtacattgtgtggatacttaatatgatgcacatttgtttacatataacttctgcaaggagatattaactcccaagttctggaatctttctttgtgcttactagttatgactttgtaacccagggtcagagttccaatttcagcacacaaagcccttgcctttggcagctaaaggcctgttattatgggcaaagattaaaattaccctaggccaagatctataattttctatattaagtcttgagtcagtgccacaatgcaagtaaagtgaagtatcaataactcatttaaaattatttttctcatgaagcaggcagactagtcattctgttaaatccagtaaagggcataagggataaatctgggccactccaattttgtgttttatttttttttttttattttttatttttttgagacggagtctccctctgtcgcccaggctggagtgcagtggcgcgatctcggctcactgcaggctccgccttccgggttcacgccattctcctgcctcagcctcccaagtagctgggactacaggcgctcgccgtcacgcccggctaattttcttgtgtttttagtagagacggggtgtcaccgtgttaaccaggatagtctccatctcctgacctcgtgatccgcccgcctcggccttccaaagtgctgggattacaggcgtcaattttgtgttttaaatgaaacactgtgaacctatacaaggggatgtggtctttcccctttgtattttgtgtagggctggaacactcattctcaatacaaaatagagccaactctttgttcaccttttttctaggtatccccctaagtctctgaatgaaggaattgattgttgtattgtttctcagtttctgttggacatttaaagagagagggtagcagtgctcacagaagttcttcccttcaaaggcagcctatgtgaggtttcacacagcagtcagccagcgcacctggacagtcaggcatagatgcatttacaggatctttctccaatctgccataagtcatttttcttcctatgcctgtgctgtatgaactatgccatttagcggccacgtgctcccttactcctttataattcacatttagcgtcaatccagaggtctctattttgtcttttctttcacttgaagcttatgtatatagttatgatatgctttacattttgtccagggataactatagtttctagggcaactataaaacttggggaatccaacaaaaaagtccagggggttaaacaataatctaagccttttatttgtaaatctttgcatatctgtgaattgctttaaaatgcttcagccaaaaagggcagggatgctgaatcagacaatatggacaaaccatgaatgcctatggaaactacatggtgagaatatggagattcattatactattccctctgcatctgtgtgtttgaaaatttccatatagagaaattatttttaaaaaataaatatgtgaaagcaaccatccagggatgattgagcaggttttttgtttgtttttaaacagacttgtaagaggttttttttgttgttattaataagttaggctcaaaaacatatggggacaaactaaaacctacataaagagaaaaagaaaacaatgctaccatttttggacattgctcaatttcacattgtgaatgctagaatttgctccttgaagtgcaattggaatcattttctagatcttttgtaaaatcacaaaggatatttttgtgtttattaatatctttgcagccccttagagaccttgacatttttttctttaatactactaaaataatatcagatatacactcaggtctattccatttttgaatattgtctttcacacatacttatgcacatacaaatacaccactcctccccctccaccaaaggaatgtgtgtgtgtgtgtgtgtgtgtgtgtgtgtgtgtgtgtatttcacatataaaagcaggccaatgttgagcgtagtggctcccacctgtaatcccaggactttaggaggcccaggcgggtggatcataaggtcaggagttcaagaccagcctggccaaaatggtgaaaccccatctctactaaaaatataaaaattaaccgggcacagtggcaggtgcctttaatcccagctgcttgagaggctaaggcaggagaattgcttgaacttgggaggcggaggttgcagtgagccgagatcacaccactgcactccagcctgggtgacagagtgagactctgtctcaacttaaaaaagaaaaaaaaaaaaaaagcaggccaactaaaggtttgtttttgtcaactgtagtatttgggttaatcaggtaatgctgcacattctctttcaaatttagatttttatatggtaacttgtttgatatagttatcaaacaaatggggaaggtccaataatgttaaaagaacaaaatcaacaaacatcagtgaagaacttgatttgcagaaatattttaacagcaagaagcattctacagttcatttccattttgatggccattttaataacaatgctgaatgagaatgcatctcacctatgtaacagaaaatttccttgattccatttcatttaaggttttaggagtatcagctcagacactggaggagtaatcaataaacatgccaattatgtcagagaaaaattatgaatgcctgaatatttgcagccttatttctttctttctttacaaagaatatgcctacctgccttttgcacttctggtaaagatacgaggtaggcagacgtgaagatttgcaaagaactgggacagactggcaaccttcccttttggaaggcttctagcaagagattagactggatcttagaggacaaagcatgggggtacaaagacaagtttctgtggagactgagaagtaatcctggggaggaggggatacgcagaaaaagtgaaaaacacagagagaaaagagcttattaatgggaacttcttgctgttctgttagtttctttaagctcctagggtagactgaataactttttaatgcttcttaattgtttctctttatacttgacttcttgatgagacaggaccatgaaggaggccatctttattgaggttacataaccttcaatatattcaatctacttcattaatattcactgaagttacaagaaagaatgcccacaaaagaatctctttattttcctactgtcatcccttcttccactgagactctgatattttttgaaattacatgtttttttagttttttgggctcctttgagtataattgaaggaaatttctatcctgttctccattttcgctaggaaattgggagctacatgtgtaaggataatgtttattgattcttagaatgaaggatcttagattatctctcctccaacatcctcttttaaatatgaaaacatgtagggatttgctatctttacaaacaaataaaacccagatctttaggtttggtaatggaagtacctctgtttgattaggaacagctagaccttgaattctgattctcatcccttgagttgcacctttctcctcaggcatcctgctagcctttagaggtcgctgtcactctagcaggaaagggatcgagaaaggatccctactagttcactggtctcctctcccatcaccctccccctttttcattcattgccatttttccaaagagctgagtacacactaacctcaagacattttgtacttctaaccttttgcctacaacacttttcttcctcatatttccaaagattgctccctcctttcttttagaacttcactgagatctttccagattactgcatctattacttcctcttctgtcagtctctgctccttacattaccttatctttttttagcacttcacaattgaagttttatttatatgtttacttgtcttttggctgtcccttttactaaagtataatttccatgacagcaacattccttagtctagttatatgggatttagaataatgcctggaacatagtaagtgctcaatagttgtgaatgaatgaatgttcttctgttactgttgagcacaggctgcaatcactgaagattctggtaaataaggaggtggggatcgtttgatccaggaaacagtatggaatgaactatggaatatcaagacccgggattatatactggttctgacacttattagctgggtatacttaatttacttaaactctctcatctttaggactttttccatctcaaaaggggtttcaactcaaaaacaggtagtttggtggaataaaagtgaacacattaaagcatctaccacaatatcaaacatgaaggaagcttcatttaaaaattgataactatgcaatttgccttttaaaagttaatctgcttcttagaatttataattcatatcagatcttaaattgcaatttactttctatttttatatataccaagcagggccacattctggtaaatctgttctaatattttgaaaaaggcaggggattctccctcctgaccacataaagccagtttccttagaattaaattttcctgtgaggaacagaactagaaaaaactattttaagatgcatgtgtaactaaaaaagaacacgaatagccaagacaatcctaagcaaaaagaacaaagtggaggaatcatactacctgacttcaaactatactacatagctacagtaaccaaaacagcatggtactggtacaaaaacagacacataggccaatgggacagaacagagtccagaaataaggccacacacttacaactatctaatcttcaacaaagctgacaaaaacaagcaatgggaaaaggactccctattcaataaatgatgttttgataactagcttagccgtatgcagaaaattgaaactgaaccccttccttacaccatatacaaaaattaactccagatggattaaagacttaaaggtacaacctcgaagacaacctaggaaatgccattgtggaaataggaatgggcaaagatttcatgatgaagatgctaaaagcaattgcaacaaaagcaaaagttgacaaatgggatctaatttaaaattaagagcttctgcccagcaaaagagacaatcaacagagtaaacagacaacctacagaataggagaaaatattataaactgtgcatctgacaaaggtctaatattgagcatctttaagaaacttaaacaaatttacaagactaaaacaaccccattaacaagtgggcaaaggacatgaatagatccttttcaaaagaagacatacatctagccaattcaaacatatgaaaaaaagctcatcatcactgatctttagagaaatgcaaattaaaaccacaatgagatattatctcacaccagtcagaatggccattactaaaaagtcaaaatacagcagatgctggcaaggtggcagagaaaagggaacacataaactgttggtaggagtgtaagttagttcaactattgtggaaaacagtgtggcaattcttcaaagacctacgaatagaaataccattcaacccagcaatcccattcctaggtatatacccaaaggagtataaattgttctattataaagaagcatgaatttgtatgttcattgcagcactattcaaaatagcaaagtcatggaatcaacctaaatgcccatcaatgacagattagataacaaaaatgtggtacagatacatcatggaatactatgcagccataaacaagaaaagatcatgtccttttcaggaacatggatggagctggaggttattatccttagaaaagtaatgcaggaacagaaaatcaaataccacatgttctcacttataagtgggggctaaatgataagaacacatggacacatagagaggaacaacacactgtggcctctcagagagtggagggtgggaggagggagaggattaggaaaaataactaatggctactaggcttaatacctggatgatgaaataatctgcacaaccaacccccatgacacaagtttacctatgtaacaaagctgcacatgtacccctgaccttaaaataaaaattaaatttaaaaaacttaaaattggtaactatgtaattttcctttaacaagttcatctgctttttagaaattaaaattcatattgtatcttaagctacaatttactttcttttttttttttttttttttttgcagttgcaagatttaatagagtgaaaacagagctcccatacaaagggagaggacccaaagtgggtagccgttgccagctggaatgactgggtttatatcctgatcattgtccctccccctgtgctctcaggcgacagatgattggctacttctttacttcctgtttttccctaattagcattttaatgagctctctttactacctgattggtcgggtgtaagctaagttacaagccccgtgtttagaggtggatgtggtcaccttcccagccaggcttagggattcttagtcagcctaggaaatccagctagtcctgtctctcatcacctgggagctttggctctttgggtggttctaaacagcatcaaggttgagaccaaggttatctttggggtctccaccccctgaaacctgcccctacttgctagttcctgccagggagacctgggtgatcagcttccctcaaagcccagggcagaagcattctggtagccccaggtgcctagagactggcagaagggagacacttatgagtcactcctccacttcttccagagaccatactgttttgtttgtttgtttgttttttgaaagtgtcaaaaagtcgtgagaacaaagcatcccctctgtgctgtgagtctgggaatctggaatagaaacagaagttctcatccccagggacacctttcctggcactgctccccagcctcctcccagctccaggctgagaagggcgtccctccccgcgtccctgcagcagccagcactgaggtcggcctccaccccagccacagtgtgctgccatgttgtgtttccgggcctgtccccgatgtcaaatcctagaggctaggcctcttacaatttactttctaactatttgtatatataacaagcaggggcaaatctggcacatctgttctcaaattttgaaaaaggaaaggggttcttcctcctgtccacataaagccagtttcttcagaatcaaattctcatgtgaggaaccaggtaattaattctagatttgagacaccttcaggagaccttctctctactccgctaaaggtctcaggatatgtccgttactaaattaggaacagttcaccaactctggttggagaattgtttcatttcatggtcgtagagaaaggaaggttgacttgattgttagctaactttcttcgagataatccaaaatggaaaaagtaaagaatggttttactttgccctttgtattacctggcaaatttgacagggtctctcatgggcattgtctacaagagtgaaacaaatgagagagctttatagtaatgtagcatatttaggtcctttcacaaagtcaacccttgttaaacagatcataattcatataaaaagaaagctctccttcttaccagtttaagttttatagtccaaaatagagcctttgaactctcttcaattctaaaatgcatcactgtgatgcctgcaattgactgtactatttctatgctggaaataaaatgagaggcatagctccaggaaaatggccctaaaaataataatttttgcatgtgcctcaataatgttaataatatctaacatttgttttgtgtctttccatggttcataaaagttattcccctgtttaccttacataatgctgcaagttactcccaatcttttattcattcaacagatatttactacatgctactctatgccagatttgggattgagtgttcagtgtaaggtcatataattctgttagttagggaaattttacattgctggtccgcttttacaatgagtaagtggtgaaactgagttgtgaaaattaagtctattatcagtaaaaagatcatatatatcaaatccttgactatccttaatttgtgaaaactacatcaaatatgactttttcctataaggaaagcttttacagattcctagatggttaaatttaattgcttctacatgttttatatctaatcattatatgccaaaaatacacattatgttcaatacaaaatatttacttctttgattatgattatttttaggtaaaaaaatgaatatgctgccaagctgcaattactatatttagaatatgtacaacttgtgactagccaaatttgcaatgatcttttagaaaataggggaaagatttccagtgcctattttaggtaagaaagccttcctgagagacttattaaatattaaatgctttattaagaaatttagagactctttatgcagatattttaaaagcctgacagatatatccaatgtcggactgaattaagttcaatcttggcttattcagctgagagggtgctttgctgttgtggagccataggacagttgtcagggtgccttccacgctggaaaatacataagcttgctaaaattgtgcaggtgcatgcatgtgtgcatgtatgtgtataatctactgcattctaggaactacattatacttgggggatacaaagataaataatgcagagaccctatactcgagagacatttaaattgttaaaaaaaggcatataaataaatgagtgagctgaggtgttccacagataccaaattagaagtgtatataatagactcacacaagaataaatgaaattgatttataatttaaaaaatatttaatgtctgctttgctatcagaaagaatattctttaagaactaggactttttctattttattcattacttagtctttcatgaatagcacaacacctgatatatagccccatgttcccaatgaattttgaatgaatttcaggcaagggtgaataaataagttgaatgaatgtattaaaaattaattaataataagttattttatgggaatttggtggggtgggaaaagcggtcaggaaatattttatgaaagtgattaagcaggaaaagagagaagccagttcagaaagaaggagcagcgtaagcagatctgggagattgtgaaaggtctcagccctttttgagaagtactgtatgtggaaagtgagatgcacacatttagatcatgacattggatggccttttgtgttaaggagtttggacgttatccgataggtgggcatgtgggtgattaaagtaaaatttacactttagaaaggtctattgacaatttgaatccatataagatacctttagtgctcactcccagtggaaaaattggtacctatctaagaaaaatatgaatttctggacagctattcaaccttctcctggggtagtctagcactaaactagtttatcactttgtttctatagcacagaagggtgggtattgtattttatagtcatttctatgcattgtttttacactaaacatcttcataggcgacgtcgttgccaagttatttatttatttttatgattgcttagattgatttatccatagatgtttacagcacaaatggtctttaacatctccttgaaaaactcagtttctaggacctggattaaatttatattgtattgattagtatgtgattcaacttacatgacagcactcttcaaattgtcacaatttcagtaccttgactcttgaattagaaaaaataccatctcaggtcattacacctgtaaatcttttacctactgaaagcaaggttttcattctagctgatgcctccagccttgttaactcatacctgcattgtaacatagagctttcactttgaaaccagaattgtatttatttctactaactgagttcactgcatcctgggaattctttcagcctctagcacaggaaatatatgcttaggaacagcatgaaggaaattgagatgtgttttcttgacctgagttggagttcagtctaagggtgcgtatgtatttgcttccttgttggagaatcctaagtgaatgctctactagaaaggatcctgatgttttacattaaaagattcctccctatctacccccacccccacccccacggggccccgatttgttttttcctagggtggttaacatgagtttcacttgaaatcagagttacacctgggattatgacttggaattctttcttgttattacttttttttctttttcaagtaggttggctaattatatttacttgtggaaatgtggggactctatgctttttttgttaaaaaaaaaaaaaaaaaggttgtgcccctgctctccaactacatttcattatagaagtaatattaagaagttattttgtctgtctacatttatttaataatttgatcacaggatattgacatgtgtattaccctcagccactctgcaggaccagtgaggtagacactaggcaatggtgaatagggcccagctcctgacctcaatcagacgagatcgggcgcgttcagggtggtatggctgtagacatcctgacctcaatcaaatcaaattctcatagtagtggagaggaacatgggaatgcattatggaaagttaatgacatttagctcatcccctattgatgaacatctataaattatgatacatcataattatgccacaatactaagcagcatttcatttatgtgtgctaatatggaaaattcttcatatataattaaggtaaacaaacaaaaccaacatactaagcaaaactaccatctttgaaattaagaaaaagaactaaataaacaaattggtagatgtatatagttatgcatttttgaaagaaatcataaaaagtggtggatttaaaagaggtatttttatttttaacctttctatagtttgaatttactaattttttacatgtcctttttccattttttaattcatttttaatatcaaaggggtatctgcactgtaagattatagtgatatttttcttccttgtacctctttctaataaaaaatttcatcttatatgtagtacatagtaatctataaatataaaatacagtatgcaaagagctgtctcagaggaaagtgcaatactctggagccaaggaggagggaggaatgaggcaggatcagaaacagttcatcctggtcaataaataagattcttctaatttcaaaggtgcttcatcttagtaactttttccttggtgctttgccttttagccacacaagtttcgctagtctgttgctacatcaaccaactgatatttcttggaagtgctggtactttccaatttcttggtgtcaaaacattgccttcattcagcaccaataatgttccagccttttccccaaaaagtgaactaaatttaactgtcagtgaaaactttatgtcccgtctacttgaaacattaactttttccacttgaaacaatagcgttacattattccccttatggggcatggttgttccttttagaaccatctttttatatagggaaggaattatcagagaattgttacaatttttttaaatgatggtgttttaatctttaaaacagagaggagatcttgagatcactatttaggccgtaatacaatttgtcaaaaggtgatttcctctatgttgtttctagtcaaatagctgttctctgcttttatcgtcactgtggggcattttctttcttgtaaggctatttcacatagcacagaattatatataaaaccaaatataagcagtaatccattactgagggataaaattaggcatgtgcatgaaaattacattttttcaacgtatgctattttttatttatttcctctttttagtgtatattccctcaccagtttttggcctaaaggataggcgtaaacatgagcctgacacttataaatataatccaggtgatttgtttattattttaaaacaagccattattagaggggcagcatacattcttttaggagaactaactggtttcctagctttcggttttaattctaacctggcccagagaaccactgtaattatatttttgtgagtactcaatctttttgccccattccaaaatgataaagtcagtcataagaactgctcaaacttcattccctattcctgctgatggtaaagagggtagaaagtaagcagttggagaaagcgttcacttagatatcaaaagaactgattgtaactttgccaccaactaccacaaattagcaagcaattcgttaaacttttatttttattttccttactgacaaaatcaagagtttgaattaagaaaattgtatagttatatggcagacaggatctatacgccattcagcatgggattttattacaactaagaattacatacctagctacgccttgcttgttattgtacacaaaacataattaaatactaaacaggatgctaagagtcaaaagaaaatgtaaccaaatagcttcctttgccatatgcaggttttctaactccaaaatataataattctgtgttgtaaccttcaagtaatttttgccatgtaaattgtggttgaaattgaaagcttgccagctctatatctagaaatacatacatacatacacacatatgcatgggggcacacacacacacacatacacacatacacactctggtaggcatcagaagtctatcatgcatagggcacatgtggaaaagaaagtggacgtttcctaacaaaaccttttgcaaacatttcagaggacttattctgcaagaccttcctggatatgacaaacaaaatagtgttttgggataagtgaaaatgattaaaggcatgggttccagcatacagttagcttcagacacttatttctagcatttttccataaatattttttgttccaaatcagtataaactacttctgtctgcatttggaaggactgtggagtgttggagcaagtacaaaagcagttctaagtttttgttgcaaggctaccagttctcaacatcaggtctagatggccccagacgttcttaaagcattttgactaaatcttagcattgcatccactttcctaatttatattttcatttaacaaacatttgattaaaacttgtttttatccagagtaagtgaccgttgacttgttttccatgtgctagttcataatttggcagttggcatggggtgggaggtggggcatatatgcaaaccattgttttaaaactctgtggaattggatgtgatttctaagctaaaggacattctatgactgtagtgctggaggttgacatccattccatgctctacgaatgcctatctatgtctctattatagcagccattgtaatcttgagttttccttttacttggctttctccccttctagactgtgaccactttgccaggagcaaagtttagagtagtgccagtattagttggtattgaatacatgtgggtcaaaaaataaataaaagatggactgtgttaaaatgctcctgagtttcattatcatccttctattagtatcatgttttcatccattagtatgaacagctttttaatgtacaagtcacccagaatatcacacgaatagtttaggaaggaggtttcatttgtttcttttcttttctttttttgaggcagagcctcgctctgttgcccaggctggaatgcagtgagctctcttgcagtgagctccgcctccccggttcacgccattctcctgcctcagcctcccgagtagctgcaactacaggcgcccgccaccacgcccggctaattttttgtatttttagtagagacggggtttcaccgtgttagccaggatgttctcgatcttctgacctcgtgatcatttgtttcattttttcaattgagaaataatttacaacctcaaaatttttctttaaaggtagctcctggatcaaaaatttataacattttaacttttagtttttgagattcttttttaaagtcctttattttgtctactcttatactaagattttataaactcaccttgaataaactgcttctgttgtcgttagcttttcttctccatccagctcctcccactcttattttttcctgaagatttggaacctatctgaaatgaggaatttttaaatttaagagttaaagtaccagaccagtaatgttatagcaataaagaaatatttaaaaccatcaccacagtccaatacaaacactagaataacttaaataaattgaatgttaaaattaaaagtggtcagcttctgtaaggaaagcaggaattctgctgtcgatatcttagatgtcaatatcttctcatcaatagcatattaaagaacattttagtgacttatcaaactgcacgtattttaaattgtaaacagaaaatcaaaatacattctcataccttaattttgataagcaaaatctttgtcattgttttgtttgcttgcttaaaacaccaaatcctataagccatctgatcattatatcagtttatgcattgtatgttgcatgtttaatacaaagtttggaagactagaaatactccactaagcaagcaaacagtaattactcctttataattactgtgcaactttattgccatgtgttgttataattatattttaaatactccccatttgcatcatagaccataatgtcttctagcacattaaagtctgtggcttataatggcatcccacttccacaaagacctcttcttcatttagtctctattttaactactgttaaaagagactacatgaaagtaattggcaccataatcctacagtaaggaaattgtaagcaatatactatttctgtgctactgaagtctctaattattcagagtatttcatgtttaacatttaatatgcattcctctttcagttatggagccagtcataaccaaaacagttcttctcaaatcttaacatacacagaaatcacctggggatctggttaaaatatagattttgatatagttggtctggaaacgggcccaagagtctacatttctaacaagctcccaggtgatgagtccagtgctgctgggttcattgaccttactgtgagtaacatcactttcatgtattatctataactaagtgcaaaatgctgttaagtgtgcacacacacatacacattgcacacatacatacacacggcaaacttcactccaacctctcctatgatcagtttctaccctcagacctagaaataaattaatcctgtcaaaggatttatttaacacaaagagaaacagcattcaacctgtgaaagctggccaaatacacactagataatatcactctgagctgggagtcaaagagggcttccttgtcatttgccagatggaggggtgtgtgtgtgcatgtgtggtgggggcagttcggaaaagaaattccaggcagggaggaactgcccttagaagtgacgagagtgaaattagctaagtgtggcggcgtgtgcctatagtcccagatactcaggaggatgaggcaggagaatcacttgaacccaggaggcgcaggctgaagtgagctgagatccaagatcaagccactgcactccagcctgggagacagagcaagtctctgtctcaaaaaagaaaaaagaaaaaaaaaaaaaaggaagtgacagagtgtaaactattcagggatggaaggatactaataaagatatgatgaaggggaaaaattcttattttctaatcaaagaatttggattttatcttaaaggtatttaggaattacctaagaacaagacgattatgtgaattttagttcacctattctactaatgttttctctgccactctcaatgaaatatttctctttaggaaattaatctgaatttgactcctgaaatttaaggataatatggaaatatattcattgtttttgaaatagcacatttgaaaatgtacttggacacaggaaggggaacatcaaacaccggagcctgttgtggggtggggggagagggggagggatagcattaggagatacacctaatgtaaatgacgagttaatgggtgcagcacaccaacatggcacatgtatacatatgtatacatatgtaacaaacctgcacattgtgcacatgtaccctagaacttaaagtataataataaaaagaaaatgtatttctggaatttttttaaatgtatctagtaaaacattgtggctgtatctgtcttccattataatcatcttaaaattaacagtatataatcatcttaaaattaatagaatcagatgttttaacttagcaatgtcagtaaatataaataggtcattatcaatattcatagcctaactgcttatacagatcccccaaatatcagggtggctaaatttttagacctttaaaaaaattgtaaaatttatgaagacagtgcacaaagagatcttagttgaaagctaagaaaatctcaccctatgacttttaaattttctcttagtgttaaaaacaactatttgaaagttctctttacaataagggaaaatgttaaggtaggcttaaaatccagaatctcatactctttatatatttgatccttggcaatctagaacattgttatttggtaatatttgtttaagggatacctctgctaaatgtttttatgccagtcggtagaagaaatattagtgtaaataactcatttagagaattttattttatttatttaatacaaatgtttaaataagggaattgggaaagacctgcctttttggaatgtaattatagatacgtaattgttttagggagaggtaacaaaaggtagagatggtctcttttaatgaggaaagattttctggaacttagctttagcaacagtaattatttaacattttaatatgggatctggaaaagggaaaccccagtgaaatctattactatgtagatggctcaatagtttttctagtagtaaaatacaaccctgatggatttaaactgccagcagaacttttgcaattgagtggcaaggtaatagtaatagtactaatgatcagaaacaacagcaaaggaacagagagcattcatcataggcaattggaggttaacgcagataataataacataacatgcatcatacctaggagataatgaaagccaaattctggcaatgactcaggaaagggacctagtgctgtagtggccagatgacccaatgacaagctatagcaaacaagaaccattttagaaacacagatcttttccatcaacacatctttttgttgttgttgttgttgaagatagttgcaagttctgtatgttgacgaagcctctatggagttaaaatggaacagaactgatgaaaataaagcttaaacgttccaaactctctgacactgacacatgaccgggtttcacagttgggaactgggaagtggctgacagagattctaatcagtaataatctttgcagcaaacagattcagtatttatttagatataatacattctttaaaaaaaactttcacaatagctctatgaagtatttaacattatttccccattttatacataagaaaaatgagtcacagaaatgtaaaagaaaggaaggaaggaagggaagggaagggaagggaagggaaagggaaggggaaggggaagagaaggagggagggaggaaggagggaaggaaggaggaagagagagagaggaaggaaggaagagagagagaggaaggagggaaggaaggaagaaaggaaggaagggagggagggaggaaggaaggaagggaagggaaaggaaggggaaggggaaggagaaggagggagggaggaaggagggaaggaaggaaggaagagagagacgaaggaaggaagaaaggaagggagggagggagggaggaaggaaggaaggaaggaaggaaggaaatttgcctagtattttgtagctagcaagtaagggagccagacttcaaacccaggaagctggcacccttaacaattaagtgcccccaaagtatgtgttaaagcctatggaaatatgagcctatagaaactacctaaagagaagtcatactctagactattagaaccagggactatcctataaaccttataagaaccattgttaggggaccataaacaaccctgcttcaaagagtagaaatatgtttcataaaagccattacccaaagacgtataaaaggtaaaacttaaataaaaatagattaccatttacaacttggaaaagaaacccagaattttctgtagccactggtcaatgtgttcttacagccgtaaggcagaataaaaatctggaaattatcagagaaggttttaagaacaaaataagcaagttggtctctttttaaatataaatctgacattaacagaagccttatgatattaagggaaaactggtatgggaactaaggaagggagtgaaaacatgctcctcacctatgaattagacatccaagaggacaatcaagttcgatctcatgccatattgggtcactgatggcccatcatgcatggactgtaggactcacaaataaatctggacacaaaagttcttatgtatgggccaattctgcttatatggacacagtgcaaacaggtacgacaagatattttcttcctcaaggatgatacctagcagataaagactgatttctaattcagtattgttacaactgcaggtgtgtgacccgtagcgagccactaaaccattctgaatctcacttccttcactggtaaaatagggaaaaatattagttgcctcatagagttgtagtaaagattaaatgaatgatctatgtaaaatggaagtgcttgataaactttagtctattattaacaccaaatactaaaaaaaaaaaaaaaaaaaaaattcctcttcttggataacattccttggttaaaaaaagactatatttgagtagaaagaagcttctgactgttaagggtgatggatatgttcattatcttgacaatggtgatggtcacataggcatatgcatatatcaacactgacaaattgtatattgggaatatgtacagtttattttatgtcagttgactcaataaagctgttaaaaacaaacaacaaaaacttacctgtgggtgtaatgtgtgtgtctgtgaatgtagttgctaggaaaatttcttacctaacagaggcacacaaagctgccatccctcctcacaagaaattggaaccagtttctttacagcaagaaatgtaaggtgcttctagatttaccttttgtgagaaatttgtaccactgacagtgatgaactcatatgtcagcatgaccatcccattttaatacctgtatgtacctgaatctttaaaatggcaagagagaaaatatagagcaggatgagtttacatgtgatataaatacatagttttggaatctcacaggaaattatgttactcagagaatattgggatgcaatgattgcatttagcatttaggtttttcatctggaatcagaatttacagtacttataacataaagaattaggaatcagaatttacagtacttctaacataaaggcagtgactatctacagatattccatgatgcagtctctcttgtgtgattttcctggcttcacccaagtcactgaagtcagaggctcatcagagcagtcagtgtgaaaaaccacttgtgttcagtgaggcaatgatatttattgaatgctctctctatacagaactgtgtgctctgtatagggcagaaatgacattttgtttcttatttctcttggtcaatggtgacccctgtctctttgagtcattccctccagtactgataaacagagttgctgctaatagtgagctaaaaggatttgacaaaatatgactcccccttagagccaaatgattttcaaatatttatttttaggtacctgtttgattgtactctttttccactgttgattttggaaacaattttgaaattctcattaattccttaaaaatgtttaactttacccagataagtaaatgcaaggaatctagctggggtgggaatgggggagaatgggtgttggggaagttgtcagttatctattaagacaataatgccacatatcaattgtaacatcttagtggcatgaaacaataaagatttctttagcttacacattggtgtggtgggctcagtttatatcacctaggcttatatatttttttctgttgtgaactgcaagttaactctgtaccactaccgatcttggatgtgcgggttcacatgtctgggtggtggctggcattggatgatctagtatggccttggctggaatgttagcatgttaaggatgacgtacctttattcgcatctcatcctccagcaggctaacctgggcatgttcacatatccatgcagaggagcaaaagaagcaactctcaatacttaaacccatttcaagctcctggtcatgtctcatttgctaacatcccattggccaaagcaatcacatggggtcagacctagagtcagaatgagagggctccacaatattatatagcaagaggcaaggacacaggaattggtcaagaattagggcctttagtatcattaatctttagtaaaacatacttttcctaatgagtaacagttgtgcagggtggtcattttggttttcagactgtaaactgacaaattaatatttggttaattcaagcagataaactaagaaattaaccttcccagccatattaatgtattaaaaaagtttgtcaggccactttggctttcattttattcattcatttaaaaatatatttattgtgataacaagcagcaattttccagtcaagcagggatgtgaaggagaacatcagttctcaaagaataattttgccctgttgggttttaaaagattgtcattttccaatgtaattgttggaagagaagttcagacatcagttttggtcactttctcttgggaaatacatttacctgagtcatgtaggaccacatcaagcaatctgggactcacaagttatagccatatcctttggctatatttttatcatgtgggttcacttaacattataataattgttctccctgggattctgactagattttactggaaaattggagtgaagagtgttgggtggagcatcagcttctagccatttagaaattacaggggactaattttttaaaagctaatttgattgcagttagcaaaatgtctctcttttgagaaagaagctcctaatcatctttccaaaattgaatccttcagtttctacagtgcaaacacggttgctttgaggaagaaatatttatccacatataaataccgattatgaacacgtttctgacattactggaagggtcggtgcttgcctctttacttctaaaacaaattcacattctgcttcaactgattattttttcaacaatatttgttatattcttttatgatctgccagtacttttttgaagcccagttagttagaacagcggccaacagagctgagactaaaagggggccaaatatctcttcagaagcaagatgttacttcaaaagatactcattacaaagcactactgtgactcacataatcacttagtttttaagggggagttgttaatgtagaattggtttcttatcttcccagcccccagtgagcctttgctgtgcaaattcgctgatggaggacaaaagaagcgacagaatcaaagcaaatatacccagaatgggaggccttggcccagggaaggagaggtgagtcctgactgataacatttgctctgaaatttggcagtagatatccctcagaaggtggcaaggcagacgtatggtgccatgatgaaattgggtcccatggaacacccaatgtcttcaaaggggcaaatgagcagacccatgttaatgtgttctagatgaaattattgaggagtagaggatttcaaatttaacctcagttctgcactacagcaagtcttctgtctttaaccaaactcaaacctgaaaggaactcactgaaatacttatctacaaagaattgatttctatttgtgtaatagctataaaatgagggtataattacttaacaaaatattttcagtgaaatcaatagggaaagttgaatgtttgtgttttgaaacaggcagacaaaatttggctgtttttcattctgttattgagatgatttacttgcacatgtatgtatatttatgcatattcccatatgttcataaatgttttgatatctgtttatatatgtatatacacacacacacacacatatataaaataagatattgtcttggtcaaaaaagagggagaaaagttgatacatacagcattttgcttttcacaaggagaaggaaaagcactgaacagctcactatccatttaccctcaatacaaactggtaaaaaagccagtttatggatccagtgccacttaggaatgggttctttttgttacttttttgtaagaagacaaggaaaaggtgactgagcttccatgaggtcttttcattatttgtgaaatggaatagagttgtttgaatgacttgaaaaaatgctattttgtaccaaggccatactttcaagagaagagctttatttagtatttcattcaaagcacctacttcatccatttatcatttaagaagcattgtacttgatgtagcattttacactttcaatactgacagaacagtggtaaagaagaaaggaagctggaatttttctcagcaaatcctttagccttttttcagtttctgtttctaagaccattgtttgctttgagtgtttccatgcaggtctcaaaacccctcttaaaggttatagttatgttcaagtactatataaactgtaactcattacattaagacatgaaaaacagaatcatcactgagcatcaaaagctaataaaaaagataaagagttttaatattctcaactttagaaaggcagtgggtattacgttctaaaaaggaggtggagggggtgatccatgtgtttttagcatggagtccagtgcatcagcagataaccctattggcctcagaagacaactgatgcctgatagcactcattatcacatgtcccctaccaaacacccattatctaaaaagactcatttgacattttaaaatttggttggataaaatgcctgctgattagagatatctttgggtcacagactatcatcacaaagccccaagactcaattagcaacttggcattaatgacagaagattcagtttctgtctccttaaggaactataatattaccttcatacaatagatggcaattgcagcaagacacttcctctcactgtacatttcttgaaaatggaatcaataaagacaaaatgtagagagttacagctgccacctggctactgtatatagaatctaagactttgcttcaaagcatgaaaaatgctatatgtactatgatgtggaagcactgtggagttgagtttaggacccagagcaccttataatttaaacgtaggttttaaaggtatattcctaatctttgttttcaaaagttgatttttaagagctataaattttcctgttgatctatgaaaatcaagggaccatgataaaatttatctgtgaccaataaaatatatttcaaatatatatacacattgagagaagatagattaggcagagagatagcatgccctagaaatatgcttatcaaattttttggtttggggatgcacatattaatttgtacactttgattgtggtcttagaagtaaatacccaaagaatgttggataactgtgtgcccatcactttatattttttgcttccatttcccccttgcattttacttgctaaagtatattagcaagttgataaagttgtcatgatacacattaatcctatataagcaatatttaattaattttatatgccaggaaattctggttactgtatttgattctaagacacatgtttttgttgttgctgttttccacactttaaagcttctgaaattggttctcttagactaagtggtattttacaagataatatgcattttctcctgttaatcacttgagggcactacctacattgtcgggttaaggtctttgaccacactggtttcataaataaaagcactaaccaaagccaggatctgggtcagattcttaagggagggttttttgtttgtttgtttgtttgtttgaccccttccttcattcagtgtcatgactgagacaagtaactttctttggtgtctgtttttaatgtgtagttttgtttttcatttaccattatactaaggttggcaaaccaactttataaagagatcatttggggtgtttgtttttgcttgtttgtttgttttgatatatgaaacaatggtacacctttgaatccttttcttagataaaatgaaagatggtagtttagattatgctgctgtggaattgaagataatagcacagactgaggctaatgtttacttttcctctctcctaaaagatgagtaaaaatggtcatgtgaaagggatttctgacgaaattcttaggatacaaaaccaatagattacaagtattttagaagtaccatgcgcatgccaattgatagactaattaaaattttaatttactgtttaaagctgttttttcctcatggcattttgataaaaattttattagcaaagtttggctaaatgcacttctttatgaaaaaatctaatacagaaaacttcatacacagaaattagtataaattagcaagattttgaaatataaatatatgctagtggccatgttctacataagtgaaaaatgcaggaatattttaaaattattaactaatctttcaagagacaattggaactctgaataaaatgatcgagggatgggggctattaggctcttcttccttggtgttctacagttcttattgttttatttccttaagtagctgttctcaaactcttggtctctggatccctttatactcttaaaaattattacttacaacaaaataaataataacagaaattaactcatcatgtgctaataaaaacagtatattttattaaaatatattttttaaaacaaaggcaattttttgagaaaagtggtggacttttctatttttacaaatcgctttaatgtctggctcagtaaaaaatggccagatttgtgcatgtacttcagcattctctctttttctatactctgtcttgctttaaacatgtagagaaaaatctaccttcatctagataagtcatttaaaaagggagaaccctatagatcttctaatacgatcttaggaattcttggtcttcaggccacactttgagaaccactgtcctaaagaagctgaagccaagggcaaggctgatgttcacttccatatactagaaggaccatgcaacttgttggtatattaaaatatatcttatcatttggtaaatagacactgcccctaggccatcagtgcaactccacttccccttcctccccggtgcctcctccaggagcatcatgatccagcaagaatggggtactggctggcacagcaggatttttatacatgatgtaagggaggggtccagcttcaattttctgcatatggtgagccagttatcccaacaccatttattgaatagggggtcttttccccattgcttttgtcagttttgttgaagatcaaatagtcataggtatgcaaccttgtttctgggctctctattctgttccgttggtctatgtgcctatgtgtttttgtagcagcaccatgctcttttggttactatagccccgtggtatagtttgaagtcaggtaacatgatgcctccaactttgttctttctgcttaggattgccttggctattcaggctctttttttgttccatatgaattttaaaatagtttttttctagttctgtgaataatgtcattagtagtttgataggaatagcattgaaattgctttgggcagtatgaccattttaatgatattgagtcttcctatccatgaatatgggatatttttctatctgtttgtgtcttctgtgatttctttgcatagtgttttgtaattctcatcatagagacctttcacctccctagttagctgtatttctaggtattttattctttttgtggcaatcgtgaatgggattgccttcctgatttggctctcgacttggctgcagttggtctataggaatgctagtgatttttgtacgttgattttgtatcctgaaactctgctgaggttgtttatcagctgaaggagcttttgggctgagactatgggatttttttagatgtagaatcatgttgtctgcaaacagggatagtttgacttatcttcctatttggatgccctttatttctttctcttgcctgattgctctggctaggacttccaatactgtgttgaatagaagtgttgagagagggcatccttgtctggtactggtttttgagacgaatgcttctggcttttgcccattcagtatgatgttgactatgggtttttcataaatggctcttattattttgagctatgttccttcaaaaccttgtttattgagagtttttaagatgaagcaatgttgaaatttattgaaattcttttctgtatcatttgagataatcaagtgttttttgtctttagttctgtttatgtgattaattgcatttattaattgtcatgtgttgaaccaaccctgcatgccagtgatgaagcctacttgatcatggccttttttacagcatttggctgtcactagctgttattaatgctaatgtaaagtatgtgcttttgggcattcttagaagtgagggacagaagacacactccgtaaaatagcccccttgtctttagttgaatctgctcttaatggtgcatccagctcattaaacatttgaccagtcaccagtcagcatacttataaatatgaaaacttgacaatgcagtctgggaacacaacatttctattagctttgaaggcatatggggtgcaattgaattttataatactgaagagtggaaacttgacatttcagagacatagaattaaaccactggagataaaaataaggagaaactgaagcacaattcctagaaaatagtatatctaaagaattatttggaaaacctggtaataccgtctaggcttagaatatcttagatcattttccaaggtaagggcatcatctacatagtttatcactattttctttgtttataccacagtgcttggcaattcgttgtccaaatttttatgtttaagatgaccttgaaaaaaattaagatatgtctaccaacactgccaggttctgcaaatagtctttttaaccttaaactgaaggagattatttacatatgtgatcttgaaaagagtttttggccattatgatgcatgttagcacttgcaagttggttttcgtaattagcacaccagatatggttgtatttattttatgtgctttatctgcaatttagagagcaagctcaaggttaatggaacttctagtcttaaaataaaccttttttttggcacaagaatttgaattctcaataattcagcatgaaaactttcttatttagttaagtgttctattttaaaggtactaagcccaatatttactaacctatgatcactaaggataaaaggtaagtcatgtaaatccctgtactagtgtaagtttggattaatgtaattggtgatgagcttcagtcctctgcctagcctatgttctcaaggaatagggcagtataacatacttaggttcttagggcggggttggcagtgggaaatttaggaagggcttaaggctgggaagattacagcaagtaattacaagtggaaaagttggcaggaaatatccatgtaccatgattgggtctcctgacccattctccatggatcaagacaactatatgtggcacctaccaactgggagatttctggagttgttggtagtgtcctggccatcccagcctgccacaagattcagaattacccccactaatgtttaagcaacagtttacaacctccaggtaacatcaaactataactggaacctgaaagaatatgggtcaattagccaaattcctggaactctcctctatctagctgcccaggctcatcttagtagcaatctcaaagttgtatatttttcatcctacttaaccatgttatggtggggtttaacagtataggtactacatcattgactataagacaccattgattaaagatgaaatattactttaaacaccactaataaaagaaaaggaacttgacatactataaaatgctatcaattatcatttaaatcccaatttcacagatattaaaatgtgaaaaaaaaaacctgcatcttggaatctatgaaattcagccatttaaattgagataaaaacagatgaacctacataaaatatggtaacactgttttgtcttttttatggtatcaattaaggattaatttaactttggttttaatgacaaactcagattaaaacttttttttccaagattttgagatctttagatagctatattatattatacttttcttctgcttctcgtttagcctagcattttctgtgccatagtctttctcaggcttccagtcttagttctgatggcatctttctatcttgtccttctttattgccatatagggaaaaattctgcctgatagcactacgttagcaaaagccaaaaagaagaaagactgtgacgatatagtgcatgtaaataacaatattaagacccctttgatgttcttttctcaaacataaagaagttaattttctctgttctctgaccatttagctacatttaaaggataaatcccctgcatgttattggcttgatttttgaaaaacttcttgaagctgtcaaaaggacttttaatagtttttctcttatcctgattctaggccagtaatttcatgaagaagggcctccaggttttcagcttattctaattcctcctaggttcctgcctgtaatttggtttgagcccacatcatcaggaaggtctcttagcaatctcagtaataagcttgcttccctctatctctttgaccaatcaaaggctaaaaaaaattatctttagaagttcagctaagtcaagctgcagcttttccaaagtaaattttactaacaaaataggaaaaaaaaagcttcaaaatattttcaaataaaaattaaaagttcaaattcaaacatttctttaggtgaattattcatgtattaattcatttagctaacatttatagagcctctgcaatgtcccaaacactgggctagaaagaggcgatatcaagatgagcatgactagctgggagacacacatggcaaagcatggtcatattagcttccaccatgggtcatgggaggaggacaaaggcaatagttaatgccttcagtggcacctggagaaagagctggctttaagaggctatgacatcttatctgaggctgaaagaatagaatagaaatattcccacagaaagtaatggagaatttccagccaaaaaccacccctgcgaaggcccaggggtaatgctccagggcaaggcgagtgtatgtctgagtttggtaaagggtgaagtctagaggtgaaaaaaaaaagatgtggagaccaacaggtacaaaggcacttgatcatgagatttctatgggccagattttatcttaaggtaacaggatgctgctgaaaggaggaccataatgtggtcagatttgcctctcacaagagcaatcctcataacacaatggtgtgactgatggattggaaagaggttttgagcaaatataggagaagatattataccaacatatactcataaacaccgaaacaagagatgataacttgtaagaaggcagtaatcatgcattgaacttactagttaaacttgatgatatgtgtctggaattcaggatacaaacttgactttgagacaaacatttgggaatcaccaggaaataaataatagttgggataagaaagtgaatgtcaccactgtattgcagtaaaggagagagataaaaccctggccccctgagcactctggcatctcataggcagttgggtcaagtaacactaaagaagaaattgctttctgagaggtcagaacaaaaataaggggagaggatcacagaaaccaaagaagaaaaatacactggtcaaatgatgcaaatgaatgtaattattatttggaatcaaagtattccttggattcagaaattatgaaaatttaaagagtatagtgaggaccatttcacaggttgcttgcagccttttgtagaaccattagcccagattttactgtcttatctcagactgcatagaccttgggaatttccctatttatgatcttatttgtagttcatcttctcttcaagagagcaaataactgcacagtagcctaaggagcatccctttagcaggtgagagcagataactactgtacagggttgactgcctctcctggtagaaacaaaccattcagtagtctcctgactgtgccggagttgttccccggtaaaattctaccacttgactcttatgaaggtcagaaggtgatctgctcatatcccctttcagcaagtgaactaataaattgccctcagttttgctctaggcatattttttccgagaatagtttctcccttgacaggaagaaggttaaaaactctttctctggccaaaatattggcttaatgttggccatctagtaccgtggtcctcatcattcttggcattaggaactggttttgtagaagataagttttccgttgacaggggtgttggggagggggttggtttcagggtgaagctcttccacctcagatcgtcaggcattagttagattctcaaaaggagtgtgcaacctagatccctgtaatgtgcagttcacaatagggttcccaatccaatgagaatcgaatgcccctctgaaatgacaggaagcggatctcaggcggtagtgctcgcttgcctgctgctcacctcctgctgtgcagcccggttcctaacaggccatggatggctactggtttgcggccccagggttggagacccctgatctagtaggtttctgatcattgatgatttttattggtttctctgaatatcttagttatatacacttttagtatcacataggagaccctcaatttctcagccagggtgtagccatttgaatttctgaattcttagtggtttccactactagaaacactatatcatttcccctgaattttctttctttattactgacctcctgcccattctcaccttgacccttctggttgtagcaatcccattctgtcctacttttgtattctactgacccagcaaagctaaatgcaccctgacattttcaagcttacttctgaatcaggcctctgacctacattactttcataaatgatatgcccttttttccctcttaaaaattttaagacaagtcatagaagacataatatgctttataaattaaaggatcccctcaccccacattatggaaatagtattacaaagaacttttaaaactcaaaagtcatgcctgtaattccagtgctttgggaggcaaaagcaggaggatcacttgaggccaggagtttgaaaacaacttgggtaacacagtgagaccccatctctacaaaaaaaaatttaaataaaattagctgggcttaatggtgcacaccagtagtcccagctactgaggaggctgaggcaggaggattgctagagcccaggagtttgaagttacagtgagctatactgtactccaacctgggcaacagagtgagaacctgtgtctaaaatatttaaagtaaaaataaaaataagtcaaaacaatgcatgaaaggcaaaaaaaaaagttattgttatactacgccagtattttaacattttgttgaaattcatttttagttttatttccagtcagagatatttaaaatatttgctttcaacacatattgtacacataattttgtatcgtgacttgttcactaaaggtttctaagtagaaatactagcaaataaatatgagcaaagttaagtgaaattttacttcagtagcagtacctagatgtttatgtcatcataattttaagcccctttttatacataatttttaattaacttattttttattgaatttttaatcttaacaagtgaacagttgtaaatattgttaaaattggctgcaagaaataaacactttaaatataacatccagaaaacaatattatatttgtgtgtattagcttcttggactcaacttgtgctaattcagtatacaatatttaataaaatattcaacattttctatacatttattaaagtgttgttttaattatgattgtagaagactataaatctttataattatttgtttgtaatttacccaattatgtatcaggccagacctcaagaaaaggagaaatattaggctaaaatatcaatgttttatttgtccaggaacttcagtctgtatcagtttgtataaattttgctgcccccaattttttgatccccatttatcttgcagtctaaaaatactttcaacaatggttaaaaaaaaaaaataattcaggccatcatcattttggctttgttacagtcaatgattctctgctcctcaactaagaccaagcattgcagtctaggtaatctttctgaagtagcaatgcctggttcctaatgtgtactctttaagcagtatttccacaattattacctcttgatataatgtaatcatttacagttaagaatatcaaataactatctcctaagtcaactgatttgtctcaatgaatttattaaaaataaagatgcatttgttaataataaaaatcccctaattattccaatataccattgaaaatcttttcttctaaaatatttagctcctatagtaaaaatcctgtctggaagatctaaagtgtcctattttggctgaaatactaaattaaaacttaactgttgttgaaaaatgacaaaaataccccactttattttaaataaactatgaatgtctctattacacaaacaatggaaacctgaaaaatggaaaatatttctgaatctaataactcctttttgaaaataagtgacaattaaacatcacttttctacatacatggtgtgacattttcattttgttccaaggtattttactttttgtgtgattcttgagtttgtaaacatgccataatatttagtgattgtataatgatgatttcatggtcctagcttagtataaaggtagctcaacagagcagcaaaatcaatttccttttttcctttgtggaaagagacaaaaggaaattgaatgcaaagtttgcattaagaccatattagaattatgactcaacaatctattacacatgaagtggaaaccaggtgtatccaagtgttagttattgtgctattatattcagccaatgggttaagttcaaacaaccctttgcttaacccatgccatgttgttacccacaatgttccaaatgcatatgacctgacactatctcttgttgtctcctcttgccaaaggtactcagaggcaggactgtccctaggcaaaatcgtgaagtaggtgaatcttgtattcattcccgacccttttgcaatgaaaatctcaccttagattctctccacctccctctcccaaggtacctactctagttactcattcctctggatttaccctctgttttccagggagctcatgctaactcctgttccccaatcactctttaagtatataatgtccccgctctgaaatactcagtagctcccccaagaggagctgggcaatcaagatcctccatccttaccttttgagtcttatttcccactctcccctttacatgttctactgaaaacagctcactcacctttccatttttatttacacacctttttccatagtactcctttttgcctgagctggccttgacctctcatctccatctgtggaaattctcctcatctttcagggctctgctcagctgtacttccctacatgccttatctgatcacccccagcctctctcatctgcaccccatccataccactcatatggcacttaacacatattgctttgtattataatatttatgtatgtgtcttgtctccaggcactgtgctgggcgctttacaaacgtaatctcttttaaatttcacaacaatctgatgaggtaggtattattaaaccatttaaaaattgaggaaactcaggctcaaataggttaaataatttgcccaaagtcacactgctacaaagtaacagagctagaacttgaactcaggtctgtcttatttcaaaacatgatttccactgtaccctactgatgtcaattcctttccatcttctgaaagataggatgggggtttaagatgaagaaggaggtcaacatagattttttccttaacaaatgtgtgttgaagaaagacagtttattgataattactgtattcctagctagaattgattggttagctagaatctatgaggaattcaagtaaaatgcaagaaaaaattcttaagtggccagaacaaacaagcatggcataaaaagaatgttcaagacagtttgtaattcaggaggggctagatagcattggtctctttgagcaccgtaggaaaataagtacaaggaaaaagaaataaatgtgcagttgactagggaaggcttcctataagtccccaggacttaaacaatttgagataattagtagactgaatatatgactatcatcctaaatctctcatgcactaataatatctcgattgaatgtaaagcccacctgttttattctgcctgcagtgccgcatcttggataaattaggggagagaagcttagtgttcctaagagggaaatctaattccaaatggacagcttttacgactgccctttcctgtgcctgagaccagagagtttcagctaagtcctagacagctccattctgtgttcagcctaaggccaacctccagccagtcatgtggcagagccttcatcctgggaagaatttaaacttagaatctttgttcatcttgacaccactatcttcttgcctctcccatggcaaaaaaacaaaaaccttttttcttttctgctgtcgtattctattctcatttctcagtcccccagcttgtcatattatcagttgcatatttctttaacatgaatgagattcataaatttaaagaggtcatgcagttatcattaaacatgtgttctcagtgcacctctgttaacttctgacagtcatttcaattctgtttgcaaactccgtttcaatttatgtatgctccctttataccaattccattcacatgtgactctacacttttgttcctcataccaatcttcataataatttaaaatttagtatttatggaaatactgcatgcaatctaagcttgaaagcagcaggctatactgtacatcaggccctctgttagaagattgagaattttcatgtcaattataagctaaatttgaggatttcaatgagcccaacaagaaaaccatcctcaaccacaatggaaaaataaaaaaactcaaacaggcaaggtattttgttttctttaaaatgtctatggtttcttatcctttacaaaactcttcatagctcatccactttttttctaactttttattttgaagaatttatagactcacaggaagttacaaaataaatgtacagtgatgtcctgtttaccttttactaagtttctcccaattgttatattttaagtaattatagtacactatcaaagccaggacattgatgttgatctaattcagttttaaattcgaaaaaagaaaaaaaaatctaccctaaagataacttacttgaacagttttaaattccattcaacattgtaagcattgtaagtattaaccatgctgacagtcctggtaaacaaaggatggtatgcccatatggccacagagaaactttccccatattgttggatattgatactcaggtctaatttaattcttgggccaatgtcatagctgaggaatggaaaggagcccatatcagaagacttgggttgaaatctggttctgcctccaaatgtgtgaccttgagcaagtcacttgacctttccaagcttcagtgtcttcatctataaaatggagaaaatactcctcctgcctacttcataggattgttgtgaggatcaaatgtgatgatgtacatgaaggaacaaggtagactgtgaatcagcactcatgaagtttatattcttttcagaaactatatccagttatagagaagtgtactttttcagaggtggtcttattcctaaaaacaaaacataactacctccttattagccatgtgttctagaattttcttcatatgtaaatgacctcccctttctatcactcttgttaagataagaaatagcaatatatcaaacaagcactctggactcattacctacaaaccccttaggcatatggtctatttttaaataaatacttttttaaacattttcttctttaagattgaatgcatttttagtagcttttatttttatcctaactgcaggattcgttcttacttttttatcatgccatgagatgtacaataggtgttcttgacaatagtgtgaaattataacaatgtgaggttagacagtggatgttttaagaagtaaaaatggaaatcatccaagctgcattgtttcttggtatgtctgaatatataatataaactcccaactcactggtatattctggtttgtggatagtaaaaatgctagtcttggcagtaagcatagagatatacataggagaaaataaacttagatcatggaaagtaatgataagagtctttgtgtgtactaaatgttttgggcaccacaataaaaacgttaagatttgttttcttccctcttcatcctatatacaggctggcatggctttgacctatgaccccacagctgccatacagaatgggtaagtagatcacattttctctattttaattgtgaatagatctttgagctctgaatcaacatcaaagaaaaatgttaaaatttgttttgcttttgttttacatccttaaacacaaagtttaaaccaagcatttttcatcattatagtttttttcatcctataaattattctgacctcccattctcacaatgcctctgcccacattaaaccctgttctctctctctctctctctctctctctctctctctctctctctctctccccccccgctccctccctccctccctctttctctgtctttggagaacaggtaaagctaggctgagagaataataactctagagttagctttcaaacactttttggtgtgtgcccaagtcaatttattctttctttctggtgatcaggggaatggtaatggaggaaagtcaagttggtaactcaggtgattgcatcttcattttcataagcatctggaaatttgtatccacctacttagaacaagtcatatagcttaaacttcctcctctgaaaaacaagtgtgaaactacatggtgtggcaactctaaaattctgtgacttctaaatatctttcattgaaactttcttcttacttcctaatgtctttgcttaggctgtcttgtaattgacaataattattctttggttggttgcttatttcctgtcactgtcttttattttggaattctccaaggctttcagttgtctgtctttcagtctcattataaaagcctcattgaagatcaacatagagggtagaatgaattaaacttcattttctattttgtcagttgcctctaaagaaaatctgtgggatattgaaagtatttaaataattacctcttattcttatattattcattcaggcagtcatatagtcagtcattcaacaaacatccagtaagtatcccaggcacaatgctatgttctatagatttaaaaaaacaatgtatgatatgagaccctttccttcaagaggctcacaatctactcgtccatgaaaaagtaaacattaatggtagactagggtaggagtatagtcctttgtccttgggttgattaaaatttccctctagaagtgaaaattaaggatatcttttcatatatccaataggcatttacttatttccaacaaaattctataaactgggtgtgtagaaagaagtaaagatatggagaagaaagtcctctagaattatattacgtagttggagataaataattaactcacaaaggaaaaaataaggcattatatattaagtgatagtgactgaaaatagatgttataatggaaaggaatgacatttattgaacacatattttgtgcaaagtactttgtaatttagtggcacatggtttcaaatgaatacatgtgattacaattataaatttatattggaaatttatacaaaggaaaatagaaacaatagttcaaaaaatacctgtatgtccagtaattggattcaataaatattcatattttataatattttacatgcatgcatatgtatgcacatgtgtgtaatatatacatatgtatctacctatctagagtatgtattatgtatgtatatacatatctacctgtctatagtatttatctatgtatctacttgtgaaaagtaccttgttgcccaaggctctatgccaaggattggggatgcagcagtgacccagacataacttgtttttgcatttatgaaacttacattgttaaggatagaaataaaataaaaattagcttttatatataattatgtagtcaattattaaaattgtgtttagcatttttaattaaaaagatagtttttgctggaccatatcaaagtaaaatttaaacatcataatatttctaacttcttacatcttcgaaaataaagacattagtcacatgataaaaatgtcatcacaaaaaataaaatcagtagtaatttcaaaatatcatctactatccagattatttttcaactttgctcagttgccccaaaatgtattttacagctggatgattccgaagcaaaatcaaaaagtcatatcaaaatagcttatatggattatttcatttatttattatattcttttgggtgagtgttaatatcccatttacagataagaaaatgaggccatgtagtccgaggtagagctgggaatcgaatgccagtctgtaacactaaatagagcctgctgtctttgtccagctaggacaaagggaaggctatatggaagcaatgagatttggcatagattatccaggatgacttagtttatcaaggatagacatagggaaagatgcttatggagaaagtggactgctatgaatggaagtggaatttgtagagattaacaagccaacaagttttactggggtgaaagtttcttgtgaaggaattttataagtttaaaaagtttttttgttgtcagatttggaagttcaagtatttggtttttacttcataagcctggggagtaattattatttttttttttagcaacagagtggtgtaatataaataatgaagactatattggagcaggaaaatcctcttagtaggaagcatcattaagaggatattaaaatagtacagttatagaagtgtgagagtttgttctggagtggccaatgtatgaatggaagaaagaaaccaaaaggagagacaacctgaagaaacttttcaatcatgcattaagcaagtggccatcaaagaatcctacattcagggttctccatcaagggctggggacatactggtgaataagacacacccagtctttactcatctacatagtagcaaaggaaatcaacattaaaagtattttattacttatataccataagcacccattggtgaactgcagggtgttatgaattgtctagtcttgcttgagtggttaaaacttctctaaacaagcgattccttgagctgagctctgacaacatgtaatgaccgaccgaaactggatgttatatttgatggcaaaagagagaaacaaaagtgaccctgtaccatcagcagaaagacaaggaaataaagtgaagaaagatgatgatatggttaggctttgtgtccccacccaaatctcatctctaattgtcatcctcataatccccatgtgtcaagagagaaaccaggtggaggtaatagaatcatgagggtggtttcccccatgctattctcatgatagtgagttctcacaagatctgatggttttataagaggctcatccccctttgcttggcactgattccttcctgctgccttgtggagaaggtatcttgcttccccttcaccttctgccatgactgtacatttcctgaggcctccccaaccgtgctgaactgtgagtcaattaaacctctattcctttataaattacccagtttcaggcagttctttatagtggtatgaaaacagactaatgtagatgatatgctcaatttcaaacatgcctgattaatgtctcactaagactcactaagtctcactaaaacaaactaagactcattaagacaaaaaaagatcaagagtcagtggtaaatgtggaactgaagttagggaatgataacttgttatgcatgattttaatcagtcattctctaatgcgcaatttaaaattctacaaagacataatttcccaaatactcacccttaattgttacaaatcgacatagaaaataaatcgaggtttcaactgctaatctgagaaatcaaaggtgaactttgggcagtgcaattttcaaggcagtgaggacagcctagaacacagtgagcatttctctttttttctcaaaatctccacctcatatttcaggttaccactcctggaccctattggagttgctgcaggtacatccgttaaccttaaatcacctgaaatatgaaatgtctttatttataccttatattaacaatataacattgtatcctttaaactatttgaacagttgcaaaaatggttcaccctctgccactacccacttagacatttacaacaatgaatattttcctcaagaaacacattttagttaagaagctaaagatatccaaatcaagagattttatatactattatattatctcatattatattatctaatctcatatctctaatatcatgtaataaataattttagtccattgaaattgggcatattatctttcctcactttattttcttgtcttgctgctaatggtagcaccagtccctctcttcagtacttcctgtgcaccaaataatcctacccacttttactaatcttactctggtcttttctcactttctttcttctctctagttgctctcgtctacctctcttgctttctggaaagtaagactcccaagtctatacttcaagtgtgtaactagcttcagagatcaatgacctgtggttctagcttactaggtactgctactatgtcattgtcccaaactgaggtcattatcctcatcaatattttgtaatacaaactacacaaattcaaacaaaacgcacatatcaaattttgttttcctctgttttaaattctctaaatccatttaggttatgatctccactcctcaggactctttcttatcctacattcttcacaataaaactagtcattaagatgtgcaatctgtatccgatgtatatcttcaacctagcccttcctccgtgccactggttgaatttattcattaccatttcctacctacactaagctttttactccctttaatatacctccccccacgaacaattttcacattaatttttgaataatttttaagcaaatgtaactacagaaatcacctacctacctggtttaaagtattacgtggcctttactaactacagaacaacactcaaacttccccagatagtacgaacagaacttcataatttggttactgcaactgaactggaccgtctgtgattcttggaacatcccatgctactttgtacttctgtgtcttgttgaacgtggaattctgtctgcctgagttcccatatggtaaaactcactccccatggccccaccaccacacacatacacatgcacacacaccatatagatatgggtatcagtaactacgtaataatatactttttaaaaatattgttttcatttcaagaacatcattaaatcataccaggcagagctagttatgctattagtcataagaaaaacagtttaagcaatggttaagagtgaaaacttcagaatcatcctgcccagggatgcatccaaactctgtcatttaccagatgtgcaattatggacccattgtccatactttagtttcttcctctgtgaaataaagataataatatcagtacctttcataagactttgtaaagattaaaggaacctggtgtggtacaagataatcatcagtgtaaatgttgacattattgttgccctatgtttggcctttccatgataagtttgacaattagtcttttttattgtgtacttcttgatacccatatctataatagttccctgctagaatataactcaatgaagacaggcaccatatcttattcattttcatagactgtttaacccagtattgtgaatgctaaatcaggactaggaaatgtgacagatgacatctgcttggctccagcaagttgacatcagggaaaccatcctcctccccagccatcaagtcagtctgtccccatgtaacatcttaacctaattctcctaaaatattacctctagtttcacccaaagcagccaaactacccatgagtttctctgtcctgagtgaaagatggaattttggaaggcttggactatgcattgtgttgttggcaacaaggagatagaaattttacattcagaaattaaagaaataggaggattatagctaattgatcttatttatttgatacttctttatagaaattatgtttaaactgttttgcttatctttggtttcattacctttatatggtaacattcccagtagtaggacaccagtagaacaaccatttctatgcatgtgagatgtcacacaaatatatactgtttcttgagttaacattgggacatgccttttagaggtgtggaagctgatttaaacaacttactcaacataccaaggagcctaacataagtgtccataataaagtatattattcctcattcgcattgctctatgcaatttagccgtcaaatataactcagagataagtaacctaacagaaagataaatattactgtagagaagagcctggtcccattttacatagaacacagggtatccaaagatgtagttgcagcttactccaatccagttattattgttcaacgttgcttaatgctgattcacttgaggtcaataagcttaacaatttttttcaactttctatctatagtacagtctaaaattagaaaaaagaaaatgctcacgtcatattaggaacaatggacatatatacaattgtaataggagatagaatacaaaactattgcgattaaaccacaaagtactataagatatatgtatatattaacttttatatgtataaaatgtttctgaaggagtacacaagaaagcatgatggtgattctctgggaagggccaacacagtagtgggaaatagggtgagacggaaacttatctttcaccgtttacgtttttatttatttttttttcaaaaagaaaaataaagcaaattatttccataggaccgtggaggagaggcagttgtgttctgatgaggaattgggaaggcttcttgctagtgcagtgacatgagcttttcctcttggagaggtgccacatcctagctaaatgacatattttgtgatcctatggaatcctgtaacagtaaactaagccatagggcttttttagtatcttaagcaagtatgtgtctgagttgtagctagtaggttaaattgtgtaaagagttaaacggtctgtatctcataaccttcacattaatacagaaacatgacactgaaataaaggcccccgaagttagcttgattgttagctaaggaagaacaaacagttcataactacaccatggtgaatctgtgctgtttgcatttaggcagtagaaaatgtcagttctgtcatctgcctgaatctatccaagttatcacttaaaaattagatcaatatcacttttctctaggactctgaagggtagagagaagaagcatctgtgtcacaacagaaaagtaaaaatcgtagtactttttactgtaggctaacttacaagaataaaaatgtccattctcttagagctatgtggtaaaactctaatttgtttttactattgccctattgctcttttagcaatccaatatgaaattccatccctttgaaagatgagcaggggaggtgggaaatattccctcccatattcaaaatctcatctttcctgtgcccttttcattgggagttgctgtataaaagcctcttggattgtttttatttgaataaaatatattcttgggggagacgtgaaaaagaatgttttctatagcattggtttgctggctgctttatgtgggcatttggtattaagcaatatggaaaccttatcttattacactaggaaaggaatctaatgtgaaggatacgttggtattacaataaaaatgaccaataccttattaatcttgtactattgttttaccctgaggatagtatttatggttccagccctaacaatattgcctgtggacatgaaacacaagccagtgctgtttatttcaatatgtaaataggatttgctttttgtacagtaaaaaaaattaaaccctggggttattgatatattaatgttatttttattgtcagtgaaataagattttaccatattactactgaccgccaaatcccctgaagatgacttttctgcaggcaaaataatgtcctattagtgacctagatttgcattttctggatttctggaggacggttgcctttaatgccaaagaaccaagtgattctttgcatttcttgaaaatactaagtgtttcaaaggctagcttagacttccgtggatcacacttagttaacgtctcttagccactttgcatttaatattttgttcatgtgaaagaaaccccagaagtaactagctcatgtgcttcagcaaggtgtctcaatcttcatgctactaccgttcaggactcgataatgtttgtataggagctgttctatgcattgtagcatgtttagcagcatcccaggcctttatccactagatgccggtagctcccccctctcctccagttgcgataacaaaaaatgtctccagacattgccaaatgtctgctggagagcaaaatcacctgtggcttagaaccactgggttcagtgtaaaagaggcacttggtatatacataatgctgtgaatcttggtgaagaagtaaacttttttaacaggaaaataacttgttaagcaactcattcccattttctgtaacaacatttgcaaggcataatgcataatgcatatattaccaaatacaaaaaacataaattcatatgtttagaattaccttattttgttattctgcctagaaagttccccagtagcatgacatctctgcttgaagtatgtatgtatgtatgtatgtatgtatgtatgtatgtatgtatttatttatttatttatttatttttaatgtgatgcctgtgtgaaaatgttttcaaaccctgaccatggcagggactgaaaaaaagctaagagatttggaaacacattctgcagttccctccttggagtctggccttgtgtattttctttagataggtacctctaagcctcagatgcaacagtagcctctcctgtcatggtttaagcaggggtttcctgtaaattcatctggtgtatgtttggacttgagaagagcttatttcagaataccagaattaggagatcaagacggtatgccgattctgttcttcccagaacattttcagttctaaatgactctctgacttgagtggcagtattggaatttgctgggaagtatgaaatgtaattcttgtttgatggataggattagagcagataggacaaaaatgcattaaattttcccccaagggttccttttgctagtatccgtttacttggctgctttctttatgtttctgttctctgttttccccatagaatttcctgtaaactttgcctgtcaatccaatctttattgctttcatttttaatactccaattggcgcattttacaaagtcgaccagccacgctaaaatgtaatgtgtggtttgctttgtctgtataagaggctgaacctggatttctaccagaagttaaaccactgcatggcatatgaggaagactgtttattgagtggccttgggtgcctcacgtgtcattatgagccccaaatactgttcactgccttacaaataagatctgtcaaatataagacctagaaggaattttcaaatgcaaaccttgatttttcatagaaaaggactgtcttttttctagtttctaatgcccctgcatgcttagaaatttggtatattatttaagcttccacttagcatttaatatgtgatattggaccatcttctctgggctctcattcctcagcttcctacctctttcagggacccttctcctatggtcctgccaccctggtattgatcttcctgtatggtaatcactactgaattccataagctgctctgcatttattcattcattcattcaacatagagttatcaagtatctactatctcccaggctctgttctaggcaacaatactgatatacactcaacccccttggagctgacattctagaatgagaaatgtcaataaatacattgtattcgtcagttcaggctgccataacaaagtggcttgattgatttggtggcttaaacacaaaaatttatctttcctcagttctgaatggtagaaattcaagatcaatgtagccgattctggtaaaggctctcttcccctgattgtagatggctgccatctttttcatttgtttgtttgtttgtttgttttttgagaaaaggtctcactcttgcccaggctggagtgcagtagcacattcatggctcactgtagcctcaatctcctggacttaaatgatcttcccacttcacctcccaagtagaagggaatacagacatgcaccaccatgcccagctaatttttgtatttttgtagagatggggtctcaccatgttgttcagactggtctcaaactcctggggctaccatcttgttatgtccttatatggcctttcctcagtgtgtgcgtgtgagagagcctgagtgagctgtctgaagtatcttcttaaaagaacactaatcctatttcattaaggccccacgcttatgtcctcatttaaccccaattacttccttagacaccccatctccaaagacaaccacagtaggggttagagcttcagcaggtaaatttagggggtcacaaacattcagtccataacatataaaaataattttttaaattaccacttcagatagtgataagagaactatacaaatatatcaagagaaaaggatagaaaacaattgggacagacatggcagttgctaatttagctacaatcctctctgaaaaagggacagttgagtgagaccagaaatgaagaagagacagccttattaaactttggagaagtgagcattttaggtagagagaatttcaagttcagtgtagagatgagagtgagaatgatgagatcaggacagaagaaagtcagtttggttcaatcctagtcagctatggagaaagggttaagaaaacagtatcacagaagtaggcaatagcctgattgtgctagccagtgcaaagagtgaacatttgttcacattgcaatggaaagcctatggagagctttaggctgattaatacacaaatacagtacaatttaagtgactaaatagagaaactcaaaggggtattttagagtgttattcgtctttgttagacaaagtaaatgttcaataattttttaaaatggaaagatgaatgttttcttacatagtaattatcttttttaaaaaaatcagatttattagatgtaatttacatacagtatattcactctctttagtgtacagttctatgattctgacaaacacatacaatcatgtaaccaccaccacaatcaagatgtagaacaggtatctcccctcctcaaattccctcgtgctcatttggaatcaaccccttcctccaccccgctatagttttgccttttccctagtgtgatataaatgaaattatatagtacatacccttttgagtctgacgtcttccatttagcaaaatttacttgagattcatcatgttgaatgtttcagtagttattttctttttattgctaagttgtgttccattgtattgatgtgccacagtttattaattcagaggaaggacatttgggttgtttccagtttggggcaagcatgaataaagtctgtataaacatttggattaaagtttttccataaacaaaagtttttatttaattttggttagtatggagcattgctgggccatagggaaagtgtatgtttaactttaaaagaaactgcaaagctgttttccaaaatgggtgtaatgttttgctttcccactaacattgaatgagaattccactttctctgcatccttgtcagctgttagtattgtctttaaaaaaaaaaacaactttgtattttctctttttgtcattatatcaggtgtatagtcagtggcttcttttaaacgtcacaactataaatttaagggtctggtgagtatggatagtaagaatgtaatgtatgatgggataatttttttcatccacactatttttttttacccaaaagagtatgatcttatcaaatcattgttaagagttaaagtacatttaagactataatttaagtacatttaagactatatttttgcttgaagacttttacagaaaataagcttaaagaatttattccttgaatcctgacaaccttgaattctagtcctcccatatttaatgggagtctcatgggatgctttcttagaaagacaactcatgaaaatctctatttaaaatatcactgacccctgaggttggatgaagtctttgtcccataaattccaagctcagtcatactattaaaaaaaaaacaaaacatagtaattgagttttgctaaaaatccaataaagcaaaagaattataccattatttctcacatgcatttttccaacctatcctcacatcgctgacatactccatctcaggcaacctggttttgtctgttctgtggctcgccactctaaccttttgcttaccagtaagacataggggaaacacaatttaaattctgctgaaggatttgagcattcagtaactcatcgactctacagtatagtctgagcagaaatggacatttcactgattttcacatccagaagctaccctttaatagatctccaggagaatcatccctcctctgatttgtgaattcctgatcttgtagcattctacagttgttcaatgagaggctctggaggactagaaaattcagtgctttttacagagtctataggagcctatcacataggttcagtgtctctgccagtgccttgacttaatccagaaaacattcccattccaacctcgatacaaattgtcctgttgcttctcttttcatggagaaagtattttctgcatgagggcatggacctatgcctaacacaaaatatccataactttctaggaactggtctttatttcctgacagaagacatagatgcaattcctgtatttgtaacatcagtcacttttgtaaagcttggtgctttcattttgtctttctttcaaagccttttaaacaacactcatggcttttctcctcctgctagtgggaggcagtattaaacttatctggcataagaaagattttgtgcagctaattttatcagatgactccaagtcatttcattcggagctacttatttctcttagtggaatcaaataatgtaaatctcctagacgttcttgttaatggttggtggaaaaacgtgcgggtggaaatatgtctttcccataggtacttgatagcatttgattagaggccaggcatgtagcagcttcgtgaatcttcctttttgttttctgtttgcagattttattcttcaccgtacagtattgcaaccaaccgcatgattccacagacatctatcacgccattcattgctgcttcccctgtctccacataccaggtatgtccaatttacctgcaccttaggagatatctttcttgcagtaatacagtatttagaggcaaaaaggacacagtagaatgaaaagaaaaaaattctcatacactttaatcacatcttaatgtaataatactcaagttatgagttagcctatactttcaagagcctgtttgcatcaattcactggataataaaatccactatgcttttcattcttcctgctgagttttcatgattatgctactgtccaaccaaccttaatacagctctctcaccactgggaaattattttgtttgttgtctgttactttgtttgttcatgttccctattgtgtcttttctaaaagcacatttctagcaattccttcactcactccaggatattttatcactgtcatctcattttgtcatggttgtcctggtaaagctacacagatagatgttaaatcatacttcccaagaaacagaagaaattatcaaagtggtaaaaagttgttcgtattccctgctcttatttcattctcagttccagagagaccaaaagagacctcaggggttccgcatgttggaatgctggaaagtctgagactcaatgtgtgtcctcaactagatattatagccagttaattccaagtacataggtcgattaaaatagtcacacttctccctcaaacaatactccttgttttattcctctgagttattacgtatgtgatattaatctcctctctacctaatattgttcttcaaacagttcttccaattctaattagaaaacgcctatatatatgctgcacgtagaaagtgtctagtgtcatttcttaaaagtttggagggagaaagagaaagagagaatgcaagcgtgtgtatgcatgtgcttcttgaattttgcagctggtgggggtggatgttatataatgagtaaaactgtaatgatactgatactattaattcagtgaagttttgccttgttcagtcactatatacttcatttcaggatatcccagctgtcagagaatcaaacttaagactatgtgcacttttccttaactgattccccccaaagcagatcattttctttctttttctgcactcagattcttgaaacatatccgtgggcaaatggaatagattttcatttgaattacattagagggtctctgaatggctgatttcttaattgcctttccttggcatgaggctatgtgcaggttctgttcagtttttgttcttcctgcaggcctgcctggttgtaatgtgcgtgtgtgtgtgtgtgtgtgtgtgtgtgtgtgtttcctttttttttctaatcttggcctctgttccagccaagaccacccattaagccacagtgtagagcactttggtgacatgaataaaatattcactgaagagtgattttacttgggagggctcataagtggaatttaactctagctcccttttctcaaaagaagagattacagcaatgatcgatgttgttgattctcacctttcaccaggttttttcaatccaaagtgttttggcaattctgtgtgtgtgagtatataaaaaaaatcttctgagttctccacgtgacattcagcttatacaggctgactttttcatttgtctgacacatggtacatttaagaatagttggctggctgacatactcatttttatgtgttataccaattaccatgagcgaaaataattacaaacttgcttaacttgggttaaacctaaataactgccccaaatttttggtttatctctttagctcttaccacaacttttaccacttggacatatttctaaaatgggatcacttgagcatttgaagttacaactgatgacagaaaaagagaaagtcttagcagtcaactcttgcttccttcattacttgccaggacatccctgaaagctgatcttcaaatggtctctgaggcctcctaaaactttagcgttcaacatcaacctcaaaatatgctccaagacccagcctgggccatgtgggcactgaagtcagctccactgataggggaagttgctttaccttttaccttgtttcagggaccaatttaatcaagtccaagaattccctttttacccttggttttgagcacgaattaactgtaaagtcaggtggactccactttcttatgacctagtgtgactccactgaacacaagaaccaagttctctctatgattgctttgtgctaataaatgctgtttgatgcataggtccagagtacttcatggatgcctcatccgccatacgttatgcaaccaacagtaagtgttctcagtcacctgaggctaatatttctattatccaagtacaagcttttggaatgcatagaagctttggggtaaagcttttgttataatatgtaactcgttcaggcagccatattctccagataaaaagctgttcctgaaattctacaaaagcatgtacaatagatagctagagatcaacatagacatagaatcagataaagagagagggtgaaaaagcaagagagtgagagagagagagagagtgcctggaaactttattagaagaaatagcaatcaaccattcaagctgagtctaccatttcttatgcatgaggaatttctgctttatgcaggaactcagaactccggacaattaaatttattctacaaggaaactctttgtttcccttctctttctgatatgcttttctttctttggccacagtctgatatgccttagggacaatttggagtatcatagacaagttttgacttgaagcaatatatttcaaatatgaaggtagttgtctgctaatagatgaatttatatagatagatggcaaggtgtgtaaatattttcatgttaattaactatagcagttttctttttctatagtggaaattttctctctgcaaaatattcaaattctcttttttacttgctagatttcccattttatggcacaatattacatcaattccaagtgaaaagtatgacgtattacattagaatctagactgaaggctaatgattgcatttatctttgcctaagtcttccagggtttctagctctatagaagtgcgagatagagatttcaatagcaacacactcatgagggtgtgaggcaggggaaagagccctagactggaagttgtgtgacaaggtctctggtgactcttctgggtatgctctctgtgcatttgtttccttttctgacactatatacttaatagtgcttttgtgaggatcaaatgagagatcacatgtaaaagacaatgtaaaaaagtatacatgctatgcattattattatcattgtcctcattattattgaatgtgttcattatacaaggaagaagcagtgctaaattttaacccctttagaagataaatgtaagtaagttagtatacattaaacaccagggagctaaatacgcagacatccatttcctgaactcagaaaattagagaatctggctttcatatctgagcagggtccattttatttttttaaataaggaacttttcatgttgctccaaacattttgatagttttttatttaaagaataaaatatatgtagtttaccacagcagaactttgtaccatattttgcaaatccctttatttactattatttacacaccttgagggctttctgagttcatctagtctatgttctataaatcataccactatgcaacaaatccaggctacacttttctgtccaagtcataaggtaaaattcagtttgtgctgccaaagcaatacatagcatagcaaagactgagccaacggaggaaaaggaaagaagtcctgccaagttctcaaaaggagactttctggaaggaaacaaccaccttctaaaaaatgtgttcatccgtaaagcactaatactaacttagtcctcatactgagttttaacaccatctctttgtggccaaaaggagtgcacatctggcaaaatctgaatattttaccagatgtcaaactatgtaagattcttcagtacttccagatctattaggggcagggaagatggttgtatgggactttatttcagctgtcactcaggacttttacaaagcttttcacacacctccttttccaccccagtacagcttcagcctcgtgttcgcatgtattatttctgtgtgtgtattattagtgtgtgtgtacatgtgtgtgtgtactttaatttgtccttttagattttccttgctgtggctactactcagagctgatatcgtatcacctcccatgactaaattatgcatcgtgcttgagcttaggccactaggtttaaatgtaatgtttatggctggggtggattcctggaaaaatagaagtggctgggccacacaccactttgctatcttttagatggagaaaagggcaaaacagtatcatggaaacacagagtttgtaccatcaatcatttccctgtaataatcttgttggctgtccatattacataagtaactttacccaactggctttaattttatcatcaaagtgaggttaagtcaccctatgatactaaaatataaaaatattcaagccatcttagacaacaaatcaaaaaacctgaatctgagaagaattaatgaggaacttgatgattaacaacatggattcttggttgagctcattaggacaggaaacccattttagcaagggggtattgagctatttacataaactttctgagccacagtttctcatctgtaacatggacataataatacccaaataattatgttttgttcattaaatgaaataaggcattaaagctcttaaaataatttctggaaaagagcactcaataaattattattatttaattatattagtagacttctcattatgctttaaattatcccagttttatcaaatgagtgttgttataagcagaaagttgaaagtaagcaactttgttgagaatcatctatttctaccacattcatagtgctaattaccttactttgctaatgagtttggtggagaaactctgtggctataaacaagacaaattgcttacattggtacttatttcacttactttctaaacattcaacacctaaaacttaaaaaaaaatgcccattgagaatctccttttttcagtaactggagactaccttacaaataaattcaaggtgtcaaaatctatgtctcaaatatattgcccataattccaatttgcttgcaacttttcttctctgtcacattttctctttcctcactttatgataatttcatgcatgaggtttcattgtacaggaatatacctcccctatcaccaagcgtgtacactgattcctgagttggagccagatgtattgcctaggctagaagcccttcgggttctctctcaggcttgacttaaagggctctaatgtctcaatctggtttgtatctgaaaacagtgcttccgtaaagttctaaagtagagcgcaatgaccttgatctctttgctaaggaggatgaatgggtaaactggaggggcaacaactggtaagagagaaatgaaatggcacagagaactaaagggaacagtaaaggcatgaaagaagaatagaaaacataagcatataatttctaaagtttgccatttaagtttgtttctttgtacatttaattttctaagtaatgtgcttgtagatttagaaaaaaaatactctgggaagaaaggatagatgtctctttgcatggattataattctgatgttttggaaagaaaagagatttctgttactggaccctgggaacttattggatctcctggaaagctgtcaaaccccacgtagagaatcaagagcatttctgtttgccttttgttattgttcacctgaatagactctgagaagacagcactgttagactaaattaggaattcccttttttctgagaagtaaaaatgctgactttgtcaatgtagttggttatttgcttctgcttctcagcacagacgtctatactgcatgctgaaatctcaccattgcactaacagaattttaatagttgatggattgcaccaaatacctactctacagagcagtatgttacattgcaatgtcatatgaatacacagttgaaattgctgtgttccaatacattggatattttgttacatctgttattactgacaaggagaaaagatgataattttcaagaggaagcagagttccactttcttaaactttatttaagctcatttgaagcataaatcttctgttcttgatatgggtagtgttatatcatctcaaggagaaaggtcagctttcattttgacttaattacaaattggttatctaattacagtattctaagaaatgcaagatgcccttattgaatcaatacatgatttgttgccatggcaacaaatggcaaaaaagttgcaagcaaataaaaaattataatcgttatgattaatgaaccctgagttttcagctaaagagaaaatataaacttcttctttacaaccaggctgtttaagaagccccagaatacttaatttggtcattctttgcccttaaacatgtaaggcctaaggcctagttttagagttgtgtccttcaattttgtaggtgtgtgttttgagaaggcattatcaccaaatttgccctaattactgtagaaaatagtcctggctttgctaccgttaaatataacttcaaaattttacggtaatttttcaaatataatctcagcaactttagtaaaataactttaaacaatgaaatgcaaggcttataattcaaaagaagtgtatagagtataaaagattttccacctaggatcccttcattcatcatttctattctccggaaatacacattgtaaacaaaatcagatatttctatccagtcaattttatatgcatatgaaattatatatttgcatgtgtgtaaatgtgtatttttaatatagaaacaatattactctacaaatgttgtattatgatttgctttatttttcctcaataataaaatgttctggatgtcaataaatatgagccatatatagatctatatcaattttgctaacagctccattgtcactactgtataaatgcaccaaaaggtgtactttcttgaaaactcaagacagtaatattacaccctagtgagaaaacgtctgtcagataagttgctgacacaaaagatatttacattttaaaatttgatatacattattttcaaattgccttttagatagcagtttttctttctccataacctcaattaaaagcaggtaatctcaagttttaaatattttgttaatgtggtaaatgtctcactcatattttattttcatttctgaatcctatgagttgagttgattttcacgtgtttattgactaattttgttttctttatctctgaacttcaagttggtttgctttgcttagttttcttttgaggtactgatcttttcttatttataaaagatcttattacagttagtaagtttatagtgtcatagataatttaaatattatctcagttgactttaaattttaattgtatatttgtcatgcagatttttggtatttatgtattcaaatgtatcagtctttcttttagaacaagggtcagcaaactttttccgtaaaaagccaaacagtaaatattttctgttttgtgagctatatggtctgtgtcacacctactcaattctatggtttattgtgaaagcatccatagacaatacataatgaatgggtgtgccttgagttccaataaaactatatttacagaaataggtatggccacatttgactcacagcctatattttgacaaccccagctttagagcatctgtattccatgcaaaataccttaatcactatagatttaaaatgccatatgttttcttactatgcttatagtaaattttgtttaaaaatgttgttacctttgaagtttattttatagcatgagatgagattaagattcaaaatttcatttttttgattttttttcccccaaacatggaaccaattgccataacaaattttaccaaagaaaccctctatatttcgtcctctggcataaattttatgccaatatttatcacataataaaatctttttatctttgtatctgttttccaaatgctcttctgtcctgcttctctatttcctttgagcattgctctattttgactactataactgacaataccttaatcagaggtgtccaatattttggcttccctgggccacattggaagaaaaattgtcttaggccacacataacatacactaaaactaatgatagctgatgagctaaaataaataaataagtcttataatattttaagaaagatcgtgaatttgtgtggggtcacattcaaagccgttgtgggctgcatgcagccagtgggccacatgttggggaaacttgccttataaactgataggaaatgtccacaatatttttttcattgtttctcaaaaatttttctagctattttacattttcagatgaactttaatgcattttatgaagttaaaaatgtactaaaatttcaaattatatattgacttatgggaaatttaagaatatgacatatttacaacattgaatttttctatacaagaaaaagaacttttcgtctacccaagaattcttttatgtattttggatcacttaatagagtatcaggtttccgccatatgtattctatacattgcttaatgttttcctggcatcttagtatttttgttattatatgttttagttttttgctgtggctataacaaagtagcacagactgtgtaatttataaagaaaataagtctatatagctcacaattctggaggatggaaagtccaagagcttgatacaggcagctggtgagggccatcttgttatgtcataacatggcagaagacatcacctggcaagaaggcaaaaacaagagagccagagagagcttccttttctaacaaagctattcccacaaatctaattccatggcaacattaatccattcatgaggacacagctgacattaatccattcatgaggacacaacacttatttctaatgtgtaagttttgtaacacatgaaataaatattcttcggcattgcaattataaaaattttattatattttctcattgatcactttggtgtataaaaatgtatatactaattttattcatttaattttaaaaatctattaattgttcaaaagtattgctgaaatttagaatatatacataagttaaaatatgcatataaaatacccatttcctcttacccaaagattagtacagttaatatctaatgttacatgtttccagatgtttttctgtatttatatcaatatctaccaacttatctacatctacaaacatgcatgcatacaatatacccattatatatatcatatgtatgtgtatataccatttaccaaaatgatatcagtcaaatgacatcacacaatatgtgctattttcagtgaatattttccatttttcccagttgagaaattttttatcatctctcatcaaattttcccaattgagcaaaaatgttatttacactggtttacccaatccaggaagcaatcagtgaccacatattatatttggttattgggtcatttaaggctcttttaatctggcagtcttttttcccttcctgttcatggttagctgtcctgccatgtatcccactcttgcaaaatgtttggttgattcttcatgatgctgtttagccttttcttctatctcatatatgaaacaatttttgtaaccagctatctttctgaattccctcattgttttcaatcgaatatttaattcattctcagcttttccaggtcatcaaaaataatataattttccacctgattttaaatctttatatttcataattcattttctggccaaatggctttggaatgtatcctttgacttatttcttatcataatggatatgccactatgaattattttttaatttaggtgtagatgttgaacttaatcaaagtttttttgaaactattgatattattttccttttgccaattttattgtattaatatatttgtaattaattgtatcataatttttaatattttcctaaggtagaatcattctgccatcaactccatttggttatgatatatccctgttaaaaatatacttccggattatacttgtgaatagtttattatcttggcatcagtttttattaataaaattagtaagctatttttgtcaggtttgaatattcaattaacaaaggctttataaagttaatttggaataattcctttttctctaattgcagaaacaattttaaatagcattaaaaaaatctctttttggagattataaaatcttcatacccaagactatcttagttttggggaagagatgcatttattttaccaaatccagtttaaaaaataatctattactccagtcagacatgttctcaggaggctaaaactttataatctatttaagaatttgttaaggttggcccggtgtggtgactcaagcctgtaaccccagcacttggagaggccaaggcaggcagattgcttgaactcgggagtttgagaccagcctggggcaacatggcaaaaccttgtccctacaaaaaatacaaaaaaattagccaggcatggtggtgcatgcctatagtcccagctacttgggaagctgaggtgggaggattgtttgaggatagaagctcaaggctacagtaagccaagatcacaccactgtactccagcctgagcaacaaaacaagaccttgtctcaaaaaaaaaaacaaacaaacagaatttgttaataccatgtatgatcatgatcatgaagaactctgactgttgcatagttgatagtcatgttgctgaatgatcaaatcaattggattgtgaaatgccacggtcttaacaaaattagcattatcttttgctccatgactagttgttgataattagatcataggccatatagttcttaagttaaatgtagtacaaagtaaaaataatcagttgccaactgcctaataaggaatttttaggtatgagcaagttgtaaatcaataatttgtaatttttaagaatgtatagagtttttaatgcccttgattgtcataaaacttgaggaatattttcctcacatgctcgcttgattcagtctttctttcccttagcccttagctataccaatcattgactcctcgtcttataacattgagaaacttgggttcaatgaaaaaaatcaacaaataataaaaacaaatattcttgagcatcaaatatgtgcatgatatttttctagatattattggaaatggaggagagaaaataagaaataatttgtcctcaagacttgaaatataattgtagaaaaacattatatgctcaggataatttaattgaaaaggtacagttgaaaatttgtcaaaattttagtaattatataacctaaaaaataaagaagcctctgtgaacagttaaggacagagaagaacaatgacataaagatgaccttaaaggatgggtgatgtttgtggggctaaaatgaaaaaagagaacattttaagtgaaaataatacacaaaaagtatgggaggagagtctcaagttatttcaaaggggactacggggggagcaaatagcctgccttaagtgaaatgtttatattagagaacgagggaaatatttggttggaaagttaaattgctacgtattgaagtacaactttcacgcagtcaaatctggcagactttcctacacattttttattagcttgacaatcccagtactattgttcagaatttaagtttactttgaaaaatgtaaaacagaaagagtaagttatgtcactgatgtgtgcgtaaaagtaataatatgcagtggagtaatgtatgaatcaattataaatagaaaaaaataaattctgctacattatgaaatgccattgtgcaaagtctttgtatataaagtcattttatattcctaaataattttggaggtaatgtttatcttccaagtagagttcctgaaggcttcctgctgtctgagatccctgcctcctaagcacaggagtgtctaggggcagtggtgagtctagaatcttttgaaatacaaaaaatatgctttaatacattttttaaattctcagataatggtggttggaagctgccaagtgctaggcaccaacacatctccagagtacatagggatgcatctattaatagatggccactgtttctatacccagtaacgtaaaaattgtcccaactgaagtattctagctctgttactgtgggagtatgcggggcatgtgtgtggtatgtgtgcatgtggcctacctttctgcatgtggttttctgttattttactaacaacctttaaaatgaaagactagctcaagacataatgtatcactttttagaacagcaggcacagcattctggacatgacacaattgacagctgctaagaagaaaaatttcaatcatacatgatctccagtgtgtccttggatagtatttagaatttcttcattacttcatcattagtaaagcagagtatcacagctttgccagttccttcataaagatgtagatgatgttacttccttaatagctatttaacatattaaatataattcaaatagaaataatgttaaatatccaatctattaaattcttatttcctaaagaaagaaaatatgcagctaaaataaagtccttgtcagactttctagaaaacagcaagttaccagggcgacaatcatatagaggtagggtagatcatttactttataaatgttaccagggtaacagaaactactcgtggaaatcactgaaggatttaggatgagagtacagatagaccatggaactatttgttctttcatagcacattggaacaaaatgtccaaacatatttaaaacttttaacacttatgtgaagtatttgggtattcattaaatagatgatcagaaacgggttcacatattgagagtattctcaaatgtgaagagtacatctcaaatgtaaatcaaaagatattatttttgatttcttactgctcagtatgtcattgggatactttattttactctgaattttgactttgctagattagttctagagaacctagttatttctacctaggtgctatgtctgcaatttaggatcatggttaatggtgttgattagcatgaggcttgagttttataggtcaaccaattagggtgtaggagggagggaagtggttaatggagagaaagggaaaaactatacatatacatatatatgtatacgtatatgtatataattttcatgtgtgtgtttgtgtatggcgtgtacggattaatcaggtttgcttaaagaattatggagtttagagttagatttttcaaaatgataacacaaatacaagtaaaatgcctttaaacttttctactgcctaagaagaagcttaccaaagataggaattaaacgtacatttttctccctgttttagaacaattggtttccctcccaataagactctgtcagaaaacaaataattctaatatgttcatctatggttaacagttaaggtatgtgcaaagtctataagcagtaaagaggaggaagttactcactgtggagggagtagaggaataagaacaaggcttcacagaggaggtaactcctgaacttggttttgaaaactaaaaggagttttttagaccaacaagtgttgggtgtcaggcaggaagggtgctctgagcaaagtgatcagtagattgtaggcagggttttggtcctattcaccatgtgctgcagctggtgaacatctaagagaaagcaaggtatttttacaggctaccaggtgcctctaacactggggcatatgcatgacatttgtgtgcccttcaacagttctgccacagaaggtatcacttaatcatgattagggctgttgtcctatattccattaaacatggcatcttctcctagagttccgtttgcatttctaggcaaagcctcctcaccaatatccgatgtgccctttcacaagttctccactcagagttgagtgtaatatgcagagaatgttattgatattacttgggtatcataaagtaatcattatagcctctgcacaaggctaattagtcctaattatctgaataccccaggtgaaagtgagatttctactcccctcagaaccccaagaatgcgtagtgtctcatcatttgactgtcaacaaatgcttcgttgctaagttattcaaacaataaagtaagatgatagagattctaagaaaaaataccagaacttatatgtctacatgagtttcttttttctatgtgatgaaattactttgggaggccttttccattgatgccatcttagactaggacattttaaaaatttattctttgggaataattttcagagataatttattaatcatacaagtaaaacaagttcatcaggttatattcacatgatagaaaaatggagaaacacatacataatagctagatagatagatagatagataaatagatgatagaatgggtggatagatgatgaatgaatggatggagggaaggatggatgcagggatgcggatggatgaatggatggatgggtggtcagacagacagaatataggtaatagatatcctgggacatgacactagttcttctttcccaactacagtataattttattatttgagagtttattccatatagttcgcaatatttctcccgttctattttgttctaaataaatatttgataataagttacactttatagactatttctgcattggcaaatattaagacacaagcttccaggtgccgttagacaaggatactgacaaaggtttctgagaaaattaaagacgtgcatcttctctgaaatcaaacccaacttattagggaaaatgatgctaatattaaatttgtctttgtaagtttgatcattaaatattgtcattgtcagtaaggaggtgtgttaaaaacaatttaggaaaatttctcttatgttcataatgtagtattctaattccttttcagttgcagatttgtttatatcagctgaaacaactgtgttattcagcgtagtgtcttaattggcagttacatctgtagagagaaacattttcttgtggacatttcttttattaactctcaataaaagccaagcacatgttaactttcaattttctgaagaaatgtatagggcaactacattaatattcttcaggtatgtaagtttcttataacctatcttgatataagaatgactcagtaaatccaattggctgacatgtggcttatttggtgtttatttagtctgagccaggatgttattaaatttataccatctgatttatagtttcacctaggtacaggctattttacctctcatggaaaagatggcaagattgttcagtttgtgccagaattttccttaataaatgtcttcaaagctctcacaggagcccaagcatgtacacagttgggatctagtagttctgtgctgttgagtgcttgagaggcaaatttcatctaaaatattgagggcaggcataagacctcttggctatcatcactaggtggctcataaagtactcatgattttaacagtactagactctgatgcacttgccaagatgaatcaggtgtaaaatgtactccgtggcagcaaacggaactgatagaatagaactatttgatgtggaccatgagaatttaaaagtatctgcataaattgatgatttggcatcagataaagctgatatcaaaccattctatcttacaataattactcaatatgttcagcagactctgaaatctgcacttgagaaatgacagaaaaactatatcatcagcagagaaaacatcttcttgctgacctaggaaggcatacaaatagttcagttggcgtcacactgtttatgcataatattttacaaattagggtggtacttgttcccttttatatcacttaacataagtataatttcattgcacataactgaggagaaatagtagaaacaagctgagaaaactgaaagcaaattccaagaaagaggattagtcctcatctatgttaaaaagaacattgtgctcttggctttattttcttatttagcatagagaaaatcaagctaattatcaacttgggttctgaataataaccttaaaacttctattgagaagagaaaccttttatcaaagagttattcttaaacggttcttaatcaatacacattagaaccatttctgcataacaatgttgtatattaaaaatcaattcttactttccgataaaggcttttatcttgtcttgtatctctaagtattttcaatcaatactgaaaaaatcattatgcttccaagtttgtgttacatgatacatgtctaaatactcagattctgatatcacactccaaaataatctaactttctgagatgcatatatgaaatttatttcaaggaagtgtttatattatacatggcatgaactgatgaatgattgatggatactacatacacattactgtccatatatgctgaaagctgacctccattatagatattatttaaccaaaagactgacatatacatataatacaaatgtgtgtttatatgaggttattcagagttacatttaaagactgaacactgttgagatttgtggtattaattagtaaggaagagaatatggtggatgcatgggtcaaaactgactcaggaaatttcagcctaggtggctaggtagaaagtggggtccttaaactgaattaggatgtgtaagagaaggcataagttgaggatcagggatatatagttccttttgggcatgttgacttttcaaggccagataaagattttcaatatgtacctccaaatacaggtttgccacccaagaagggtagtaataaacttatgagtcatttattcctgctggagagaatagatgagatttctagcaattcgctcacttttcatagtaattaccatgcttgatctatgcaatagctagtgttgtgcatacgctgaggttaccttaaatttactagtcttatatgtactaaattaaatgcttgcatatgccccttacaagcaagattgtttagcaacccaattatgctttttcttatacctatactgttatggctaattatgtattgtattacatatgtctttttgaattaatcaaatgtatatgcacttgatgtttcctcttagggaactgaccacagtgataagttaggaaaatagagatacttcaaattagaagaaatcttaggagcccccaatgaagtctagcagttgatgtaaaggtttcagaaattgtcctgtgtatccatgaaaagctgtttcatttccattttgcaaacatttcaggaaacttttttttattaaattgtatttcttccatagccactagcccagctagtggaagaacaacaaaattggaaaagcacagcaacaagcctctgcctagtaaaaaccaagaaagcaataaacctttgccaagcctataagaaaaatttaaaagtccaccgtttatttatcttgttgtttagatatatctgtctcattgttaagtcattgtgaatgcagggatttataaaccctacactattatcactggagggttcccactgcttttagaatagagtgttcctaaaaaaaaaaaaatccatttcttttactttattgacaagaatagattatttcaggctttgctggataatcccatctttggcctttggggctttaaaccgtgtttttctctaacgttctggttgatgctggtaatgagaaccagttttactgatcatagaagtatgagctcagagtgactcactaattccaatgtgtttccaatggccaacttgaaaaagctacatagggggatgtgagagctaaattactgaagaccatcatgttttcctgtggggtttttccatgccctgaatatgttatacatgctttttgttggtgttttcttctctgttctatttgacattttaaagagcagaagtttaaagtaagtttcttaagaatccgtaacagtatgcccgtatctccagacaaatgtttacaaattggattgtggctcaaagatttaactttccttcatgtctttttctaaatacaaagttcaaaccgaaattgtcaagagtgaggattcattgacagacaatcagcaggaggtccttttagtggaatattacctgtgatacaaaaggattaaacatttcaaatataaacctttaatctgtgctatctaattactgacatctgaaccagtatcaaggaatttgtcactttttcacttttgtaattctaacaaagaaaagaagcaagaaacgtaattctgcatctggaaaaaacttctaatgcaaaagcatgtagctttagtcttttctcttgagatggactaggatatgttccctgtatttctgatttgtaaagattcagcaaggcagctctgttactgcaatcacccttgcttatgaagttatgtagacagtcccatgtaaatcagaatggtccaaccatttgatcctgtccatttctattacacatggtcaggcatatgatgagaaatgttctggctaacacaatttcatcttataactgtcctagaaaatgaaataaattgttacagcattggtttcctagcagagccaaaattatgcaaggaggaaagcccttctacttttcctcatatccctgtactctctctgataaatctttctctctttccccctctccatttacttttggtgctatacagattcaatttattagacaattactaaattacctcatattattgcttaaagtgtatcttctcttctttaatttgttaagtttaataatctccagtgaatatccattaaagagcatatgctttttcccccattttgaattgttaaaagtcattagaactaggattttgagccaatctgaaatcagctagatattccttgtattgctttttttagaaaacttacttattgactgttcaggggaaggacatatttgtcctaaagcaggctgttaattatcatgaaaacttacctattggctgttcaggggaagcacatatttgtcctaaagcaggctcttaattatcacatcagtctagccaatattgtgatggaatactgaaagtaaaggagaaccaaaaatatgtgggttgtatttccagaaaaatatatgttataagagaatacgaaacatgtggattgtatttccagaaaaaaatgtatgtgtatttgaaaattaaagattccttaggggaagaaaaacttgttttaaattttattaatctcaaggtatttaaaaatcctctgaaagaattttaaaggctgcaaattataattatcatgtaattaattaattcctgaaatgtttttagcagaatcaagaacatttctgttgcctggaccttggaagaatgacagcaatgaaaaagttcatattatttgccagtgtttttcccttaacactgaaaatgttaaattgctctatagttagtgacttattggaaaaacgaaaccagagtcattcattcctctattcattcaacatacattttttgggtgtctgctatgtgccaggcactgccattctatattcagttagaatacaaaaccaaaccaaaaaaagatcctctcttcatggaatgtatcttccagcaggggaaaaataatttaaaaactaaaaatgctatggcaaatgatgttaaatatttggagccagattttggtaaaaatagcaagcaggtgtaatttgtcttttagaaccccagccattattttcaacatcttttcttcccacttggcgatgtccttccttcaagacgcttagatgttccaaaaggtcattctttctctcttttgctttttcatttaaacaacatttaaagagaacccactatgtaccagatatgtgctgcaccatattcagagatttaatgcagtataaattatgtatagtccctgtctttatgaaacttccagtgtattggggaagagagaaatcaaatcagtattttaaggaataagaaattaaactggccatacattctattaaagaaagattcatgggactctaatctcatgcatgtgtgtgtgtgtgcatgcatttggtgggattctcttagagagggtcatgggaggcagaaaacaaccgtcaactcccactaaactaatagtggatgcttctcccaaaacctctcctgaaaaatttgatctggttattagcatcttggggtaaatgaagttatcagtagacttaagtgtgtgcaatatttttcctattactttgtaacaaaacgtttgtgaaccttctagaaaattccaggcatcagcaagaagttcattggtcttttaggtttggagtcttctatgctttggaataatgtcctccttattcagattacagagaagtccttcactctgcattttcatgaggcaattatataatattgtatatactatcacaaaagattaacctgaatataacaggataatgtatttatggatgaaggaagtgaagctcagagaggttaattgtcatcactaatatcacacaagttggtggcagagctgggacaggtatgtttcaattcagttaacaccaactctatttcattatatctggcttgatttttttcattaaattttgatatgtcaggttatataatttaacctagagtaaatcaagttggcagattaataaaaaattattattggattcttctgtatatgaaagacaaaatattagtatgttatctatgtcctttaatgccaatcacattagcatatgaagtaagatattttttaatattttagcaatcctatcattatatcttaagtggaaaggagttttatgatttagctaaaagctttgattttgacagacttgttcatccaaatactatcataatttaattctttgtgtcctaaggttagttaaaacctttgatctgacaggcacatgcatccaaatgtaccgtaatttaattctttttgtctcaaagttatgttatgttgggtgatatgtctgaggtaaatatgccttatttttaatgttcataatcactgaataagacccaccttaatgttataaatattgtagcgctatttcaggttatcagattaatgatactgtttgcactttataaaaagtagattagataactatgagaaaattctatgtaagtatctaaaactatatgctaacattcttttcaatttctacacgtaagatagtttattgttgcagcatataattaattttgagcattatacaacatttttatttaattttttaagatgagactttttttcaaaaccctacatattaagtctaaaagatcaaagaactctgaatcaaacccaaattgaatagtttcttctaaagtaataatattttgtcattttccttatattagatattatctacttgtaaaactaaaaagttataaaaacaagcaaaaagctttatcttttttctttttatatatgcttgaattatttttaaaatgagaaaacaatttttaataaaggtggaacatttcctactcttttaaagagtttttcctgattaaattttaaaactacttaggaaattttgcttataatcctgcatttatgtaatggcattgagaataatttgccaaacacagaccttataatactacagaaacaaatccagagagctttactgaccagctactgactcactaaatgaaagaaaaagaccattcccattgaaaaataatatcaatattgaattatccatccatggcatgggggaatacagcatctcttccaggaagtcagagatggacaggtaaaatgaagagccagaaaaagaatttctcataaaagaaagtagagaaattaagctttcctggaggagaaatgcagctgttcgagctgtggaatttcaatgcatgcagacctcacatctatctcatatataggtgtgtatacactcgcttcatgtgaactttgtgaagtcaatcattgctccatttgctaatcccagtttcaatttttgtcagctgtccctctatattttcagtgtaaatccctgtctctttgtaattataaccaaaacatacatgtgtttaatcacctctctatcttggacaatttttgttttaatacttgggatgccttcatggtgtaggcctagggaatcctgccttgaactacattcaaggggcaggaattctagctgcggattccatttccctgtaaaattatgcagccctggctgcataatgctgtcactgcctgaagcagctgctcctgctgctttcagcattgtacattgtcaacttttctgtcacttcattcacaaactttgctcccacattgttcacataatcatctctttgcttcttcctacacccagattttaaggaaaataattatgaaataatttggtagatataatatgattttagagtagtaactccagaactctttagaaaagccagttgttcccttattgatctctctactttttttttaacgtacttaggaaaaaattgtcgcatgactatttaccgcaggtctgactcaagggaaaggtcatgcatggcagtaataagaagcaagatcctcacagacatgctgaaaattagccacatggggttataatcaaaccagatcaagaaaggtgactgagaccaaataaaatgaaatgtgaattgtcattcacttttgctggtaagttttgaaatttgaaattgaccagcaaatttcctactcctcttgtgtctataaactgaaaaactgggaagttcatttattctttgactactagtaattttgtagtatgagtaaattggaaagtatgattactgttcttcacaatgtaaaggtttaaaagaatgccaaactaagcactgcattttattgttgttttccaaagccacaggtaaataaaaagttttctgtttttctgaaatttttgcatactactactttcatccaaaaaacaatgtcctaaatagatgatttaaccatgtgagttcacactatagctgtgtcactaggatggggtgaaatcatcatttcatatttggatatatccttggaatataattttttttaactttgacaactaatttcctgattcgttaaagtccctaatgaatatacataaaatagttaacttaaatacctcagataggcaggtcatggtggctgatgcctgtaatcccagcactttggaaggtggaggcaggcagatctcgaggtcaggagatcgagaccatcctggctaacatggcgaaaccccgtctctactaaaaatacaaaaaattagccaggtgtggtggcacgtggtctcaaaaaaaaaaaaaaaaaaacctcagatatgattataaaccagtgaagctttaatatttttaattaagtttgaattgtgtacatttgggggtgccgtgtaaaaaatacattttaaaaggaaggtcttataccgaggccattggatattaatatttgttgggtctagcctatgaagaaatcatggaattataatttgactttttgttttggtttgctgttgttgttttgagatggagtttcactcttgttgctcaggctggagtgcagtggcgtgatctcagctcactgtaacctctccctcccaggttcaagtgattctcctgcctcagcctcccaagtagctgggattacaggcgcccgccaccacgcctggctaattttttgtttttttaatagagacagggtttctccatgttgaccaggctggtcaggaactcctgacctcaagtgatctgcctgcctcagcctcccaaactgctgggattacagacatcgagccgcagcacctggtttagttttttttaaccctttataaaatacccactatagtcagaatagccactcagaatatgtgggttagctgaatttgctatcccattgccatacaaattctaaaagctatcaactgacagactgtttggcaggggggtgggggggctgggggtgcagcaaaaatagtcaggaggaatgacacaataaaatattaccaatcaattaaccagtgagttgacaactggccttgatcagagctaaggagaaagagggctctccctataatgagctgtgattaacaacaggaattaccgaaatgtaattatagccaactcttcagagatgagccatccatgccttgagacttcagggtctcagtaaagatagaggtatttttgttcttgattactaagataacaattgagccatgtttttagatgcaatccggtgtgtctacaagccttcatcatattttagagttatttccttcctacagtatgtttttcagcttgatactcagtgatctcaggcttattcctggggacccagagcctcctgctgaagcaaaacatccaggcttgctcaacatagacagtcccttaacttacagtgggagatgcaagtcttgtggctcaactgtgactctaggagttgagtggtagtagcatcacccagtgaaaatttcagactaaaaaaaagacagaaaatgacatggcatctccaataatgtttacttttgtggaaaattgtaatctccttgattactttatattgcatttgtgaaacttactctattatagcttgttaaagttatttaactgtaatttatctctcagttatttcacagcaagatataacagaggccgggcacggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccgggaagcggagctttcagtgagccgagattgcgccactgcagtccgcagtccggcctgggcgacagagcgagactccgtctcaaaaaaaaaaaaaaaaaaaaagaaaaaagatagaaactcagcattcgtgaatggatgaattaatgaatattctttattctaaacactgtacagtaccaaaatatcttttaaaaagttatgaaggctctaacattgcagacggtttggcatatatactataatttgagtaccccctcagtatttcaagttgacacaattcttactactaaaagtattgctttatcaatttcaagccagctaagatagacttctttaaaaacagatcaatttttgtttctaaaaatatatcctaatatcagggtattattctaccacagagaattcacattgattgtctatccatttaaaacaatatagttatagtcttttcacagtatttcaaagacttggataagctggcggtgtaaacatttcctcgtgggaactttataaaatgaaaagaaaataaatgattgatgcatactcaaactaattgaagtggtactgagtcaaccagatgttttcacctgaatcatgcccacagatgctattgcttcattatcccttaatctagggattacctccattggctaactcgatgacctgtgagggtttcaaataagattgcctctcccttgtaacatacatcataaagagagcttgtttagaggcagcctacctccgccctgaacatgttttcaaggaagtgatcagggctgtttgtttttcttgctgttggatgtggtcttcagtgaagtcacaggaatggaatgagagtggccacagttgacaatggagctatttccacagctggctgcaaagagtgggcagtccatcacagataaactagcacatggggatagatgatataaaacatctgtcacaatagggataagcaaaaacaacgtgcctttgaagattgtgttttaatgatgaggtggggggttctgtctctataataggaatgaaagatgtgttgttggtgggcagatggcttcaggcttgctcttgcatgaaataaagcaaaagtatgtgttaaaaatctctgacagttgtcaagtcacctgattttgctgaccgttcatttccttgcctatcccatgtgtaatctatgagaaaagaaagggagtgctaggaaaaaataatggcagaaaaaaaaaactggttctgaataattttcttttggataactttaatacatcagtataattttaactggaggctgagaggtcagaaaacgtgtttttgcaataagtttctttaatatatttgcatccccatgtttttttttatagaagttttgtaaggtaatataaaaatgctatgtcaccaaggccacataatgataaatatttcaaatgtgaataccaattagtagacataaagtcctatttgttcctgttaaaggagcagtgaggaaaaataaagacatcttaataaactatttttgatgtaattataatagtttggtttcccaccccatctgcctttgaaaataaattaaaaacaataaaattcacatacagttttatttcatatagttgctatagaaaaagaaatctttgcaacagacaaactgattgcaaataaatgccgaatattcttgcacaatacaattctatatataccctgttacatgaccaaagggtaccactgtcactgctgtcccccaaaccattccactctgctctggtaaggaaatggttgccattgctgcacactgaaattttgctacttttgccacaaccccaccggaaaaatggatgtcacattccttgctcatttattattttaatctgtctttcaactctaattcccttgcaggtgcttttgattagcagaagtcacaaatctatatctagcagcaaaagggtgtaggaaatgtttttagaagggttttcttttcttttttcttttttcttttttttcaattctacattgaagaggtaggattcacactgggggaaactaatgacatctgaagagagtattaaaaaataaatttctacatccatgaatggcagaggtacaccacaagaagcaactggactggtcaaaataagagatcttaaagaaagagcagtgccaggcatggtggctcacgcctgtaatcccagcactttgggaggccagggggcggatcacctgaggtcgggagttcaagaccatcctgatcaacatggaaaaactccgtctctactaaaaatgcaaaattagccaggtgtggtggtgcatgcctataatcccagctactcaagaggctgaggcaggagaatcgcttgaacctgggaggcggagattgcagtgagccaagatcacatcattgcattccagcctgggcaacaagagcgaaactccatctcaggaaaaaaagaaaaaaaaaaaaagagagagagagagaacagatttaaaggaatttgtgatgttctgacaagacttgactcctgactgagttttatggctgatgagggagaaggaaacgatcaagatgacttaggagtttctttgttattctgagaatcgagcagagaagaaagaatactctgagaatgaaagaggaagacagcattcagagcgggacatagtagttttgaggtacatgggattcggtcagtagttggaaatttggatcatgaattcagaagaaacaccaaggcaagaaagacttttttaaaactttaatttttaaactaattatagcacttttgattaatcaagtcttaacaagcgggaatattttggaattttacttctaacaccttatttttatggtatgtatattgagctaaccaaaatatttcgctgctgtctcttactattctatgcggcatataccatctcttctaatgcttggctgtcatagctatttctaactcactggttaagcagatgacgttatttggaaagaatggaggtttcagtgtgaaggttgccatgaaaatatgtcataggaaaagaaagggaatttttttgttaaaggagattttatgggtaaaggcagaaatcgtatggagatgattgaggaactatactaaatatcagtggctgtcatttataacaaggagttatattaatattactaatattattccaagctatctggctctcaagcaagaacaaacaaaggacttaacaaaatgattgagagtcaaaccaagaatctttttagaagcaatgtaatagaaaattcactcagagccctggcagaccaaatgcagagctaagctttccaaagtttatcgtgaatataactcacctggggcaggctctaatttagtggggctggggttcacctgagattctgtactaagctccctgatgatagtatccagtcccaggccatacgttaagaaacaaggtagtagagtttaagaacattctattaaactaaaaaaaatgttaaaattaatcatatagtattactgcttaggagaaatggcaataaaatctaagcggaataaaacatgtaactaagtttcttgcacaaatcctgaaacaaataggacactgaaggataacaagataaagctgtcttttatctcatctggacagttttaaatatattaattgaaatcttgaaggcctcagaatgtaacttgtttggatgctaatatataagttttaaccttagaatatgtctgttacaccaggacatattttatctcagcattagaccacagaacatgtcatcaatagggtatatactgagtttgaagcatgttagcaataataatactaatagaaagtgtgctttaaaaggagtaaattagttctttaatagggtcgtgacttcacacctgtatccttagatctagttaagtttccagccctaaccaggcaaattcctaaaaatatcttaaaggagaaaaatattctctgagggaccacaaaataaagtgctttttgcagcaaattgcaggacaaggaatagctactttcttagtaatagccaaaaattgaggtgccttgtgacatatttaggcaacttgcactataaacaatggccataagtaagataacaggcagctatttctcttgatcgcccctgtggtttgagcaatgattttccaggcccatttgccaataggatcttacaagaccttgaaaaggatttgcaagcaggtctttcagtctatttgtcagtaaggagaagtttttaatgagaagttttatgacagctcacagtcctgagtcctagttaaacccagataaacattttaccagacaaaagatgaggtccataaatattcagacgtcttctgggaaccctgtttgccttatcatttggaagaaggctggcctgagtactgcatccgatgtgtgcttgaaacttctgtaagttgaaaatgtgtttggaggtatacaaagtgattgctgtacaaatgaataaagcatttcttatcacatgacaaggtttgacaagaatctcaggcagatatatggctactaaaacagttcatggcatagcaaagtcctaatttaaaaaaccttaacctacatttgtggcagtacacattggctgtaatatgtacagaacatcttgcagcatttaactgagcataaataattcttccatagaatggaaatcatgtcgtgaactccaatgttaaacttccttgggtggggtgtggctctcagaagccctgggattttcatactaaataatgagaaggtcaagctggcagtggtcagactgagatactgtcaaagaaaagcagaggaagtgtatgaatggatcttttacgtccatctttttggccagagaatgcttctggtatttccattgaatcttcttgtccagtttgagcaaggagctgctgttattgtttcacataccattaaagtcatcagagacctgctggtgagcaagtgccattcactcactcagtccattagcaccactaactaagcatctgttttatgacagacactgtgctgggctcagaaccattaaaaaagaaatatataaggtattgctaatgataccagtgaacttaggattcagggaagaaataaagtttgatcatgatcaaagtgtgtgcaaaatgttatgggagaagagaggagcaagtgaccggtagcctgggtcagtcataggagttattccccagaatttagtatttgataagaattttagaagacacatataaactgctgtagaagcctagcgttgcaggccaagacagcaagggtaagaggtaagacggacaagagaatgatgaggaatacagtgtggtggaaagagaggcttcatgtgcatgggctggggatcaggctagaaaggtaaattgaaagctgtgtgatcctcgtagattatgtgtgctatgctaacaaggccatcccagacctacctgtagaagcctctttttgacagagataatgctgaaacagagtagaaagcacatgctcttgggcagccctacaactcattcactctaactggtttctgaataagacaagcaggaatagaaaaatgtcttgtcctgtcactgaactgtcctatctactcttacactcctccaacacatttaatgtagaatagccattgacttaacagtaccagtgtcttaaaaaggacatttccactatgaaaaactaacgcagctctaggttgcactttgggaaaggaggtcatttaacactgtttcccttataaccccacttagaacaaaaaataaggagaaactggtctgctcctcttcaaattttatatatatatatatatatatatatatatatacacacacacacacacacacacacatatatatgtatatatgcatacatatacatattgtttttaaggtagaaaaaattaggaactaatctcaatatttcaaatataattttttattatgaaatatatttggtgggtagagatcaatggttttctttctaaaaaaagtatagaaggagctgaaatatatttgattaatcaattcatttttaagtgtcatagctttatagtcttttgtctttgattttttttgtcttgtgctgtttttgattcctttaaataaattttggagtgtgcaatacatctgtataggaaagctatataccatgggggccctgcaaagcaaagactaaggactatggttatgccactaattttttcacacaaatagtctcattttttcacattatctacaccacaacacatgtatttttatgtaaactacagcagtttacatgtgtcctctaaaattcttatcaaataccacattctggggaataactcctatgaatgaaccagactactggtcacttgctcctctcttctcccataacatatttgaaccaggctactggtcacttgctcctctcttctctcataacatatttgaaccaggctactggtcacttgctcctctcttctcccataacatatttgtgagtggtagacacccccagctgaaagctactcattagttatgcgattggaatcagaagctgatgaacacaagttcaccctttgtcattgaagctctaaggtccttctgaagtggcctgggatctttctctaaacaattaatatttccattgactcagcagttatgatctccttaagtagaaaaataagaggaaaaaatatagtaacccatctgtgtaagaaatttataatcttaagatcaattctgtaatcaagtgtacaagtttaatgacaaaataattaagtgtcctattgcatattcagtcaacaaaatccctttgaccgtagagtcctcaaaatctcaaattttcaactctccctcaataatgcaatatatttaaaagccactttgctctattaggattctaaagaagctactgaaaacaccaaaagctactgataaacttgtttctgtagttttaggcacaaacgtctaaaggattaaaataaagcattattgagaatcctaattatctatgtacctgctttggtaagaaatacttcaatatgacatatttactttatattctcattcaaaatgacactattatattaataggtacttaaccaataattgaaaccattattcacagttgaataggcgtagtacataattaggattcttttaaagggatttccatggctaaaactaatttggctttagtgtctattaatattataactttaaaaaaaaatacttccagttactagttactgaatcaaaaatcaacttgaaattaaaagtgtgattaagagtacaaggaaaaaaatgctatgtttataattaatagatattctgttattgggaaatctatgtacatgtacatatctcttctacctttatcatatagcagtggaaaatgtcttacttctaaacattatacccctagcccatagctatatatctccatatagtagtccaaatatcatgccaattagtctaatcctgtccaagcataggaaagagaaacccagctctagtttgccccatttccaaaataaatagcaaaataagttagcactcaaaaataatgataaagccattggaagtcatgtaatagtcctgttttctttcattgcacaattatggaatttgggaaattggtgtatattataaccataatcttgccatagatctaaaatgtgctattagttgtcgggaacagactgtagatgaatactttgtgtcacttttctttctttcttttttttttttttttttttgagatggagtctcgctctgtctcccaggctggagtgcagtggcatgatcttggctcactgcaagctccgcctcccgggttcacgccattctcctgcctcagcctccgaagtagctgggactacaggcgcctaccaccacgcctggctaattttttctattttttagtagagacggggtttcaccgtgttagccaggatggtctcgatctcctgacctcgtgatccgcccgcctcggcctcccaaagtgctgggattacaggcgtgagccactgcgcccggcctactttgtgtcatttttctagttactgcctttcaaattcttcctcactttgtataaatggagcttatggatatatgtatatatggaccagggtttctgaaccctagcactaatcctgggtttgctggataattatttgtcgtggggaactgttctctgtgttgcaggatgtatagcaacatcaataaccactaccccctaggtgctaatagcacacctcggcagttatgataaccaaaaatgttaccagacattgcaaaatcactcctggttgagaacaaatgaaatatgtacatatacaaatactttttattctaatatatatatatatatttatatgtctcatatagcattagtcaaacttttttcatcaagcaaatcttggatttcatctttaaggggatggtggttgaagatgtcattaatgcgcatgtgtgagttgaactatggttttaaaactgaactgccccttgggagaacaagttttctcaagaattttgtaatgatccattttaacgagcaatctcaaaataacatttctaactaactactttttgattagaagttttattctttcatcattctttcggtgaactcttataaagcatatattatatacctcacactataaacagcactatagacactagacagtggtgaacaaaacaacataatttcaaccctttcagaataaacaatcaaaatgagaaatattagtaaatatttacagtttgtcattgaactgaaaaatgagtggtactgatatataaaattaatttacaaaaactgttttgagtacttactgcatgcaattcctatttatagagattacaaaagttgtataaacataatgtcttccctcttgaaagatgtaacgtggaaagaaacaagtagacaataataaaggggaaggaggtattaagtgctaaagtgaagttctaggggcagtgtggcttctggcttaccatgtaattcatcatttcccatacctccagcatttgtcaaatccttccaaaatgcttacaaagttaaaggctaccacctttgccacatcttttgaatttcaaacataattttttaaagttggactgcactactacgttggttggaaatttatcaaggtagataaggattaatgattgtttctaagaattagagacatttcttactccttttgtttcttctccccacaaaagcctttcttaaaccctgaaccctcatcaaaacaaaacaaaacaaaacaaaacagttgacatcaacaaatgaaagaaattagacatccctacatatactacaagacaaggaatgttgcatgctaatactgcagaacactgcatttggacagctattcctcaagctaccttcatgccatttatattatgagatctctgttgctattaggtatttgttctaggaatattaaaaactggcaaaaatcagacatgaataaaagaataatgaaatagtgacttaaaaccacctttttaaaattcatatatagttttgtgtgaataactataggcaatcgtataatacaaatcacagacattttgacttgaggcatttagataagacagcagaaaaaaagggatgctgtttttttaattttcacttatccaaataattttatttttgtttttccatttctatgagttcaaatgcaaggctactaagattccaaatatgaaggattcccaatgtgttataatagaagccaaactgatcaaattgaagcatgtcaggtcatcacacttattcagtgattatatggtgtgattattcagataatatttctaggtcagcccatcaaaaatgcaggcttagcccctttgaatgtttttaacaagatataatgtgattatcacataaaagaccatggcctgtaaaaagactggattcaaacaaataaatgagaaacagcgtacataaaataaagccacttgtttgcctgtaagaactgtaacactggctttatacgatagcagtttttagacagagcatacttcttaaactttagagtatatcagaatcacctggagagcttgttaaaatacagatttcaaggcctaatcccagagagtctaatttttgtctactgctgctactgatccacaaaccatagttggggtggcactgacctagaatactatcacaggaatattaatgcagctagttcttcttattgtggttcatcttctgggattaatataggtgctaaaacagctatgtgtgctctagatggtagagaagccacacatgcttttccctgatttgccaatggttttgtatttcagttgggaaattaaaatattgaactttcaaagacttcaaatttctttcaaacattggcagaaggttaacaacacagatgcttttctggccttaggtcagatatatttacgccacacatgatgatctttggaaactttacccaaattactgttgaaaattgtttatttcagaactagggcaaccagatccaccctttgtctcttgagtgggagcagctttgttttgcaaaggcagtggctaaaaaggaccagacctttccatcagctgtttggtcattgtattttttagtggaattatagcattgtacaatatttttctttgcagcccaaacattgagcaaagccagacatccagagatgctaaaatgaaaaatctgtttcttcttgctttgccacttgccaggtgaactctgtcagacaccacatcctatacatctcaagtaaacaaaattatgcttaatgtgttggcaacatctgtcacaaacactcttcagcctatggcttaaatatattaagttggagtggatttgacagtgtatttaataagtcaaagttacggttgtggatactggctttgccatgctaaccataaggcttttcttttcttcttttgtatttatttatttatgtcatatacaatacaaaagagattctgtagttttaaataagcaaagtggctggcaaactccccctttgctgtaggtaaccaacactaaacctctctaagttgtctgtcccagacaaagtatcattaagaaaattcatttctcccaggagttcctattagttacttccagtttactccctgactgtacatttcttccattcccttaagattaaaaaatttgtattcttaataatttgtaggattgttttcactgaatgtttttattgaatgcaaacaagactctagattcttacatatccttccccaagaatccttattttattttttatttatgtgcaataactgatctgcttagaaagaactgttcatttatgtgcagtaactggtctccttacattattttccactctgtgcctagtgttgctatttacaattccaattaatgataaatcccttcttacttttccctttgattgtcaggtttctggtttatacacagaagcaacactcactctatgacatctgtaatcaaatgagtccccaaatactgctttcaatgaaaagattctgaaagagaccagacaattcttccaaaattaattccaagtgcaggcattcgatccttctcatcatgcatgaattttgattgttctgtcacatgctcacctacctcatctgcatattgcctttaaaaaaaacacacccctggggaatgagacaacctccagggtattgagaagaaagtatccttaccaaacgcagtttggtttttatctctgatttacatgaatgatcctttttgtggctagagcaagctgtttagaattgaggggtttctgggattgtgacagtttagctgcatgttggaatgtctaagggcaaatattctaaaaagataacctgtcttgagttcaagaagagaatcgaagtcttgcagctgctaagcattagaatgttgtcaaagtaccactttttggttgaaaaaaaaaaatgcttcaggacttccatcttaactctgaggttattctataatttatccctaggtgatttaagaagaacccttgttcttcttaaagtgtttacttctggtctggcacaacaaatacctgaaatgaaggccagtaagtattttttaaaaaaggaaaacaataaagatggttttgttaaaaagattcaggcagcagaaagaaaagtgatgtgtctctgaattataattaagtaaaagcttatcttatgtttctcatttaagaggcatcctgatgaatgacaatgcacagaagcatcgagaaattcaaacaacacaaatgcacaattgtgtatatttacaagctacagacctttaaaataacagacatgttttctgattgattcctactgaaaagcctaaatgtctttgtgaacaaagctggccctgtatatcaagcatttccaaatatttggctcaatttctattatctctgaaaattaatggggaggagcccacagagaaggcagagtgatagcctgatctttttcacagatatagtcaggaagttgaatttcgataataccaggaagaattgcttagtttgagcaaaagcattttaggaaacgcgcagtgggtaattagtttgggtgccgagatctggccatctacatgcatctgtccagtgagaaaaataatgtttagggaaataatttattcagatacataatcatttgatcataactgagtatttaaatgggttgttataaaatatgtttctacttttatcacaatctttaaataaacattgaaattatatactctcaaagattccatccaattcaagctttttaagtttgttttttaaaaatatttttccttctccaagttaattactgcaaggaaagtagcagggtagagaaagagaaatggaaggataaaatgacttagctccattcttcactcaccatatgacactttgcatatggatggaagttttttaaaatgtctgtaatttcttttatccccaacaatgataataaatcaaaagacatattctagacatccacttttcttaacatctgatttaaaagttgacacttttatttttaaaaaaaaattgtggatggacataaaaatttgaccagctctaacagagtttggtattctgtcttgtgtctaaaatatagatagatagaaaacaggtcaaaaggttaggaggaaaacaaatgggaaatagtaatttcgatttttagattatcaatgatagattttaatatgtccttcaaagagatccagttcagaaacccatgtgggccagcattatccctcttagtggtagattgtattggggtgactaagaattatgtatgtattaataagtaatagataaatgacataaaccaagtcttatcaaataacaagaaaattagagaatttccactaatgttcatatgtttcagtcagagaagtttatatttagaacagtgggcaagaggatatagatgattttcaatacattctacctcaaaaaatgaaaatgtaagtgacatattttagacacatcacaggtaaattacctcagaagaaaggaagatgttaatgccatctattcagacaagcacaaaatgacatgaatggacataaaaattatatacagttgaatttagcctttttagtaaaaaagtaaaaacatttgatgttcacacatttacaatttacagtgtttatttgtaagaagtctccttccttgtaggatatattttcaaatggacattgtatatgcttgtagggtgctgtgattacaccaaccatggaccatcccatgtcaatgcagccagccaacatgatgggcccactgacacagcagatgaatcacctttcgttgggcacaacaggaacggtgagttgaagagattgttttgtttccttgaacttttttgatcagatgtgatattctccatttttactggcattatcagtgaaactgtgtctgtaccatattcgttgactaacacatctttcaggtttcagtatgaataagctgcattctgcatgtatgttcagttccagggcacatgtactcacagtggcaaggctaaagttctattgtgtcattcagttacttcttgttttttatggtacaatgtaccagatgtaatgtctgtttttggaaaggtgtcctttttgtatgcacctgcaaatctagaccctttgacttaatatactcaatcctggttttctcttcccagctgcttaccagctcagctactatattattagcaggttatacacaactgaggggccagatctatgactgatactattaaatcaataaagagtaattgaggtataatcgagttcttttaatccttctttctgatatgttgatatggatgatgttgaaaagaaggaagggaacctaatgtgcttgattttttcttataggttgtgatatttttgactagtcatctttctcctcagagaacaaaagtgtgctgaaaaatgcctattgcagcctggattttgtatcaatgaggcattttaaatcataagaaaaactttgtttgatttttttaaaagataattccccaaatgttcaaggaggcaaaagcctaatacaatctagaatactgaaacttcattagttgccattacagagaacaatgaaaccatgaaacctaaccactcatgtgacaccttcagtaacagttttattttcgtaaatgttagtgcagataatcttgtcatttaacaaaacatagaaataaaaatatgttttcttttgactgaggcagcttaaatattgaagaaagagcactggactaggagtcagaaatcctagatataaaacttgcgtaagccctgtagtttctgtcaatttttgggaaaataatatctctagtctgaattttttctctatctagttgaagtattaaacttgatcatatatgggtccctttgaatattcaattctgtatttttaagcctatatgtcttacagttaccacctctgtgattcttcaattatgctgactcattctccaaatatctatgtacaatatgcacactagttgtgtatcaggaattttaccctatagcaatggcttgcttgccaaataaatcttgttgactcatgggcttttaagaatataagaagttactggcatgtccactgagaactcactaatctgtcctaaataggaagaaagtcaatataatttaatggaaagagccacattctttcaataaagaaattttagttttagtaacataaacaaagtgcctatcactaagatctcagttgcagaacctgtaaaaagcagtcgatggtaacttacctgtctgaatgcttgggctggatcaaatgatctcttaggtttctcacctacacttttagaaatcgtgtctaagatatatttaactatatgctgtggtacagctaattttcatcatggagatagagcttgaagacaatattttattgcttttatcaaagaattatttgtaattattttgtgcgttactaataagcaggtcctaggaatagtatcagaaggcctgcagtttcttatttttattaatatattgtagatttccctccatatcagccttcgtgtccttcagtgatcataaattctgaataagtgatgtaatgtaattttaccgtattgaataacaatctggaatctgattaaagagacaattataatgcaaaacatagaaactctttaaaatttttactcatttggttcaaaagtaaagccaactgacttgctaaaatttaagtttgcaaactagtagaaatataagagctagttaactaagcatatgactgaatcctttagggaattaaaaaaataagctaaaagacacagaacagactcagaattaaaatagttattgattcaataacatatattatgattttgtatttgagcattccaacaagaacacatttgtaagggaccatgacttttaggcagctggtgatagccaaatgattcagtaataatatataacattctctttcttagagagtaaaagttttaagcatatgatttattattaataccaaatttccactagcttttttcttttcaccctttacatttgttctaaataatgcttagatacattataagatttgcattacctgatgttatggaaaagtgtaaaatttagtaaggtttagaagaggtagagagaaaacagaattactttgttgattcgtttaacaaaatataattaagtgtggttggtgtccagaatattgttatattgttttcttagactgtcactctaattcttcgatatgccttcatagattcattttatctgaattttgattggcatttggagtgactattatccagttgaggttgattttggaaaatcagatttttctaccttattgcatctttccaacattttcattgatggggaaggaatcctggcatcatggaaagatcagttggctttgtttttaaacttgagttcaaaacctgactttgttcccttattagctctgcatgtttaggcaggttacttaacctctcagaactttctcattttacaaagtgggaaaaataatgcttacatcccagagatgttgtgagtgttaatgaaatgacaatatgcagcatatcttatacagtgtgatacccagtatgtgcttctcaaatgagctgctcatacccttcacctccagtggcttctaactggtgggagtctagtttaggtagccagaagtgatgtaacacacagtaaaatccatggtataaatcacttacctgcactatttcacttgatataaataatttctttaacgtctccatttctttggctgctaacattctcttttaaggtagcaaattcaaaagcctgtagagtccagccaagtcatattaatgaatgaagtggatcaagttcaaacaaaaacccttggaaatatataatcaatttttaaatatttgcctatatcataaacatactcatactatataaacatatatgacattggagattatattttagagaagatgtattttccatgcaataataatactatctctgcctgagttttgggcaaatagaagtgagaggtggtgcctttggcagcctgaaatatggatgccttgtctgaagaggacagccactattccattggtagtacagctgttgtgatggctattgccacatggacatacagacccagggtggtctcactttccaacttttaaagataagctgaattcttgaattttgatttgaaatttctccatatttaaatattgggtccagtttgtcccaagaactcccagtttgtgactcctgcccaaggtttttctggttctcctcagacctctctggccattccttcttctcttcctgcacagattggtaagccagagcttcatttttaacatacttatgccacatgattttcgtaagcaatctcattcagtctcatggttttaaaccctggcttccacgttgactcctaaatctcagtccccaatactaacctcatctaataatttcagactcatttatccaactacttgctacatatctccatggaaatctccctcagacatctcaaagtcaccatgacccaaactaatctcatgagctttccagaactttcttctaactgaaacctgttcctcttgtgtgtttctgctccctgtttccctgcaagctaatgacatgaccattttccctgtagtcaaaccatacatctaagacccaatcaagaccctttccttctccctcaccaccatacacaattacttttcaagtcccactgattttctctcatagacattggtcaaatacattctttcttctacatttctggagtctctgccctgggactcatttgataaactgtaatagtttcctaaccgttcttcctgctttcaatttcaatttgctccaatccattctctaccctgttgtcacaggtagtcaatctaaaactatctgacgtctctctcctaactgaaacatttcagaggatttcagacatctgagcccacagaaattctgcaaaacaaggtgtgaacagtgacaagtcaagattaagattaagataggattctaaactctagaaacagatgggttccaagggcagagcagagagctatccagtgaataatctagagtaggaagtgatcagggctgacggaagttgtagctatattggaatttgccatttttagaagggggatcttgaacactggcttagtcccactcttccttttaaagtccctggctaaaggaattgtattgggccaaaacctctttttccttttcatgaaagaagatatattcatctcccatgacctcaaattttgaaatgaatgccatgtagtttaattaacctttctctacaatttgccacctcaaatgtttattgttcaattctctattttaagctagacagaatctgcaggcctcaaaaaaaaaaaaagtgcatcttatgcaagcagtgtaactgttttatttcaggggtctgctgaccctgaaggattttcctagcttttctacttttgtttatttttttgtcacagcattcccttgatggaaccaaagccccattatccataacttcttatcactttattgtaagctttagcagaaaccactggagattttactgtgttatgagaacctccaagttgcatgacaatcttgttttacaagtttcttatctccttttcatttgttcagttgctggtcaccagtggcttacaatgtcaccagaatctgttggaagaaataaaaagtttttgttctgcaggttttgtatctgcagtttggtttgtgttctccaagccactgatgatttgtgatatcatcgatttccacagtgtaaccatagtcactcacaaaaataaccttgtaattgtactccatttgtccccacagttctctagcatttttcagtcacaccactccttcactgctctgaaattttgatagtatcaggtgaaaatcctcaattattcagtttgtttagacattgttcttttttctgttattaggtatgaatataaatattaagacagagttttaaaaagctaacaggatgttaaatggactctgattcaggaagcagtatcataaatggtaatgggtacatctaaaatagttttttaggaaaaaatattaattaaaacactcaaatacaaaacagaaaatatatctaaaaaggtaatagtttaaaaaaattggtttagtcttactttaaaatgaaagacctttgaagggagtcttataaacaataaatgagctggcattaagtgtaagtctagtagtacgagtgtgtatttgtaaatattacacttttgttgtttaaaaaaatgaattctgaattcaaataaattaccgacatagtaaaaaagcctcaatagataaaatgccaaagaacatgaacagatagttgataaaagagtaaatagaatgccaaggaacatgtacaaaaattgtaatgaaagaaacagaaacagtaattaaatatacatgtacatatatcccatcaaataaagctatcaaaatgcagtacaaattgctaatgaaggtgtaggaaaataagcattctctagcactgattgcttgatgataggaatctaaatttgtataagtaccagttggatagcaaggtagtcagtcgagatacttcaaaacatttatactgactgaccaagaagttatagttttgagaagctggtctatggaaatattctaaaataacagaaaaataattatacctcaaaaatatttgacacggtgttctttataatgtctaacaaagaagaataattaaatatgccataatccatccataaaccagaatgtaatgcagcatgaaatcgtaagagaaataattgggaaaaagtttatttataatgtcaaatttgaaaaaatggaagtaaggcaggctgtagtggttcatgcctgttatcacagcactttgggaagctgaggcaggaggattgcttgaggtcaggagttggagaccagcctagataacataacaagaccccatcacaataaaaaaaattgaaaattagctaggcattacattattgtgtgccctgtagtccaactactgaggaggcagaagcaggaagatcaactaagcccaggagtttgaggttacagtgagctatgattgtgccactgcacttcagcctgaatgatggagtgaaaccctgtcgaaagagaaagagagagaaagagaaagaaaaaaggaaggaaagatgtaaatttgcatgtgtggagttcagtatcaactctaaagaagtattataaggctaaagagaaatataaaacaagtgtggctatttccaggtgatgggattaggagtaatgtctattttaatcattatgcttttctacattatccagctattcagcaataaacattattggcttttattatttattttaaaatgtcataagtatattcttggaaaatgtctagtagcatggtccaataattaacttttttttttttttttggtttggagtggaaatgtgtgattgcaatttttcaaaaggtactaggagttactactattatttaaaaaattggaaaaacttttaaaatgattctaattattctagatttggggattataatcaactcagtagttcaggtatctgttgcaagaaacaaaataactcatgtgtctggtttatttgcatttgaatcttttgatcatgtttgcttttgttgctcaaagtgccttgcaatgttcaagttctaatctgtcttctcacatgccatttactcaggagagagtgattaaaattgaccttttgtggcaaggagatgaaagtgagaaatacgtgatagtccaaaagttgtcacatgggtggaaaaagaaaatttgggatttttgcttttaataaaggtcatataaatggaataagagtcacacaagaggacctatttaaccatgtgttggcagttgatttgaatctaaacaatatcaagtttcttttagagtttacccctccaaggggagtggggacaaaattagaattttccatttttagaaggggaccctaggcctatgccatattccaatctcctttttaagatccctggctaaagaaattgcagtgagccaaaagctcttttttcatctttaaaaaatcagatatattttgtgccatgtaacccctaattttgaaatgattgccatgtagtttaattaagctttatctagaatttgacaccttcaatgctaggagacttgggataaagataaccgtcacgttcaatagattctgttctgtgtatctctgctcccacagttacaacacataaagctttttggccttgaggtgaaagcaccttccgctctgcctcactgacaaccactgggatcagagctagagctgagtaataaataatgaaattttgccttcaaaatgtgttagcctccatagaatatgagaatgtacaaattttttatttttctcttttaaattttagttctttcttttgttctccaggactttgtttcgtatcatgctctgggccccctctaaatgggctgccttgtagaactcttttgtcagccagagagggcaaaaattttatattgattccctaagggaggtaccaaacaggctgtggaagatgacagtgtttcaggaaaaactgtactgtcccagcaagtctaatgggacctaataacatgtacagtattgtggtaatagggaccatggtatcaaatgcaaatgaggaatcctaatgcctttactgctctaaggcagggtgggtcaggcaaccatatgacacacagcggactcttccacgtgttagggctgattctattttattttcttttgtacttcattgcattctttctcatgctcttttcattcaaagattcaatcccaagacaggattatgatactccaccagctgttgtgtcaggtaggaaaattctaattcttttaagactggattggaggggagagatggaggttgcctggttttttcccaaactctttaaagcagtgattctcaacagaggtgggtgcaggaaatttgaattccagtttgcaagggggcatgtgtagttcagaaacataaacttaatattataattcagttatatatctggaaaataaatgtgttgcattttaaatagaaagtaaaaactcaaaaccattttatctgtcaaggatacacagaagatagagtctgtgttctgtgtatcagtgattctcagtgttagacacagtcatcaaattcctgaaaagtgggaaaataattttatgtatagcaaaagacggcacagattaataaaaaatagtttgagaagcactgctttagagaccagaattcttctaaattggaaaatcatcccatttgcttgctcagcaccctgcatagggtctgacacatagtaggtactcaatataattgtttgttgaatgaatctaaacttcaaatttgttcccaaaacgattcttttggatattgaaagaaaagctgccattattctatttatacaaaaaagtggcagaggttgatttgaaaatatgttagtgtcttgagggttttaactagcaatatttcagttgtttcataaaatttagtagtgcagtttgtaataggatatgtctatgtaaagaggtggatttttattttgaactgcacagatcttcttgtgctttcattttgattttgaattttgatttattgcaaagagaaaaatgggcacaattttttatttcagttaattttttaattaaataaaatactggcaatctgaagaggaggaattctttgattctttgacatgtcagacagcaaggtcataaaatacaaagagaaacatgcattagaaagacagaagaagaaacaaaggtcagaaatagactcaaagaccccatggagcagttgaatctgtcaacctgctggtggttttcaagcaggggaaatcttgcttttggccacccgtttgcttgacccagcatctgaagggtaattcttttttaatttcttatagccttgtttagttatgttcctggctgaatactcatctttaaagttcaattaataatgtcccattgaggaagaatacgttagcatttggccgcgaagtcatttcggtcctctttaaggtctctacaataaattgccactactgaaaatatcacttagtttttcccaaagtgtatttcctgtcatatcttaacatgccaatttcatttaggatttagggcccctgggaagagactatatttcatacatggtacttttgtttaacaagatacatctactcttggtaatttaccaatattcataaaaataaaagacacaaactagaacttaccttcaactgggtttcctgattttactttcaagaacataatgaagaaagcaagcaaatcattaaaagtacttatcagatatcagtcataggtcaggctctacgtaagtcaattgaggcagaagatctggctgacaatctaggctcaggagttctcacctgattgcatacacagggccactgaaagttctagagcagataaattacttgataaaagcaatgctttaagaaactgaatctgaaagttttgtgtggtcttgagcaagaagacataaaaatcacatggaacagttaaaaagattagatatgacatattgtatttataataaaaagtagtcctaggttcccagcagtggagtatgaaggaagggacccaatatagagttaatatgaaaaataacattttgggagatttcacagttattttccccttgtaagatttaattggtagtttgacataagtttcacagacttctttggtctacgtctaaatagaaatagacttgcctttccaaaatgcttgttaattggctggtaggacaacttcaatgacttttgagaaattgaatctgcttttctcaatccttggccacatcaggaaagtgaaacaggcaatagcattgtaatatctccttcccaaatcttccaatatgtcaatattggacaaaacaaataactctttgccagtgtagaatccaactaaattgttttaattgattgtagtcgagatatctgcttgacaatttacagatacataacttaatttcattcaatcaatatttcaacatttattgaacaacttctgagtggtagacactacacaaaagtactggggatacaaagatgagcagaaaatagacccctgattaaaatattatggtataatattagaccattataacattaatagcaacatttatttgtgttgtcgtgatgtgaaatgcataaagtatagagaatcaagaatctagaaagaatatttgaaatcctcaggaagacaaatactgtttggttttctgtgtaatattaagtgacatcatcttctgagagtgagtgagagaaggcacatagtaaggatttaagaagaacagagatttggaaaactatggcatgagaaggcctatgaacaatccatagaattttgaggggtagtagtgggggttcatttgaagctatggactatgtatttgtgtgattaatctgtgagaatgtttgattttctgcggtcatgattagtagccaagaaggcagacaggcaaattaatgcagggttaatatttactaggtgaagtgaggaaaaggatagtgtgcaattatgatattggcaagaaagtagttgagtggcaaactgtgggtttaaggaagaataaagaaggaagaaaaaagaaggcagtggtggatgagagatagaaaacaaaatatacagattagcagtttcaatgagatgtactaactacaatgtattttactaactacaatgtagttagcaaaatacttggatttaagattttggataatgaactatttcttggcaaagtttgaatcatgggagcaggtggccacagtggacttgaggtgaaagtgacagaagttaagggagttcattaatgtgaacataaaaagtgactaatgaagtgggggtatcttgcatattttagttttgttttcttcgttctttgccattaataaattatacatggctcaagaatattttacttaggaagagtctgagttacatatttaagcttcaacaatgaatatgtcttaaaaataataataatctgggaagaaagagttaaagcagaaatggtgatgttcaaaagaaagaaggaagcttgggaaacaaaagcatctctgatttatttccctggagtcacctcttgttgcctacatctctgctaggccttacctagctcatttcaaggagggaagacagaaggctgaaactgccctctacattttcacaccaaagcaggaatctattctccttttagtatttcttttccataacaactataactcctttaaaaatcctcctctcttaagcaaatgttaatgaaaaaatatgtaaaggcatagtaaaatgccattttctatacatggttgggttttatgaaacacctatgaaaaccgaagataatttgtagtcaaatttttatttcagttgttttgagcttaatttccttgaatgacatcagcatgaaatcaagcagaagactactatcactagagaactaaagtagaatcaaaatctgtcctctttttctaaaaagctttgagttcagaatttgaacctaggtttgaaaaaaatttttttttaaaaaagaaaagaaaaacggggcctgaaaaatacactgaaaagaacctgtagaacttgtggagcatattttcattctttgctctaaccttttatgcaccagctgaaacaggctgaaataataagtgttatcagtacaacttcatgatgagatttcacagaaaaagtttgcataaatcacaatatactggtccaataagaaatttttaaatgtctgatttctaaccatggagttgtgctctacgaataaagttcttcattggagtacatgatgcaattaagacaaaattcactgttataaacagcatgcactttctcacattgtttttgtttcagcaatctaagtttgcattggaaagcctcattaatttggaatttgtgatgtccaagcaaagatttaattgaagcctatttcttatgctgcatcttaggtgagaattgctgtgtgaaactatcctctatcatccagaggagggaaaggcagagtattttagctgcttcaaagaacaaggagaacaagaccatctttcaagctctaagcaacatttgttttcatagataccatgagctaattacaaataatttccatcttttaattaaaaattaagttcattagtacctccaattagcaacaattagccattaaattgtttttattgtaaaagacctgacacattgttatgtgttcccacaagccacacgtgaaaatcagtttcattttttggctcaaataccgtgcatttatgttgactacaaaactatctttctttacatgagttaattgattttttctttgtaataagttcttagagactttgctttacttattcttcatttattcaactaatatttacagagtacctacagtgctacaaaaaactaagggtaggtccatttcttgcccccaaagaacaaagattctaacagagtaaaaggttataaagaaatgtcatgtaacatagtatatgacagacatcacaggagtggtctgcagagcaggactctgtacatgatatgtgcgcaagtatttgacaaaaataggcatgtgaatgctgagttattgtgttcctgctggtgcatttattttgttcgctaaattataaaaattgaatcattaagaattttcctatgggaccataattgttatttatgtattaaaataggcaactagattggactagtatataaatatcactgttatttagcccaggttgttttttggtttttgttttgttttgttttcagaggatgggataggtgggtgtaaaattctatgcctcatcttctaatccagcaagcatttcctgtaaagttccagatagtaaatattttaggctttgcaagccatacagtctgtgtcataactattcaactctgccactgtagcatgaaagcagacacaagccacgtgcaaataagtgagcatggctatatttcattaaagctttatatgcaaaaataggcagcaagcagaatttggtctgtgtgctatagtttgcctacccctgctctctctaatcaatttatttttataggtattccaaactaaatactgtcactgatattctttataatacatctgaagtgaccttcccttaaaattcgcatttttgagcttttttatttcataaaagacagaaatatcagaaaatctgagatggtagacattgagatggaggttgagaaaaacatgtattagtgttttagtgtgtacagaataattgattataatagtgatatattaaaaccctttaagaatatttttattttttatatatttttttaatattttcattatatattggtcttttaggacttatagcagcaacaggggatcatcaaaaccaggaaaatcaaacatatattctgtttattatcctcttggcagcctttagaatcctatacttttagaaatttagagaaaagatgagaaatatatcatcccaaaagatttgtagtaaaatatatttgacatctttgtcacaccacctgcagcggtttctgttactgttgtgattgttgattagtgtccactgatattactcttgacctgccagtattttagctattctatttccccctgggtaactgcttccctgagtactgtgtgctgctttgccatccgattataagggaaagctttcctggtcttgtctaaaagccgaacactacacagggtaagcctgggatggctggagatatgactaccctctgtggcaaggacagagaaaaacgacgcttagtgatgcagcacacacatcaaatcaaaaggcagcctctcaaaatgctttctgcagtagaatttttcagtgagtggcagcaactgacttaaagcatcccgcagcagcagcacacagcatcacttagtgcctcagtcatctacaaaagggcagagcctacataatacgcagcagagcactttcaagacaacaatggactttaaagtaagctaattgcgtgtgcaggaatcagcacatctggtactgaaatcacttggttccgtttttaaatcaacagcacaaagtgggcacttgaggcgcctgtcagagaatatagtcaggaattgactatgtatgattcagcccttgccagaggcatgcgagagacatctgattctggagagatactgcctaataaacatgttaacagttctctagaccctatgttaaattagttaatcagaatgcaaaatgcccgaaccataaaattggacatccctattgaaatgttttctctcagttaaaattttaacattttaacctcttctttgagaagcaatatattacacgaacatttaaacaatgttaccagccttttgagatgccacagcaaaccaaattgtctgttattttacccaatgtcttttatataaagaagcaaatgattaatagatccttgagttcagtgtctcagcaagtatctctctccagatgaatgaatatacttatttttaactaacaatgtaaaatacccagcttaatctattttcccttagccttggttatcaggatagttggaattagatggagtacattgcaaatgttcctggtagcatgttctctctattgctcttaactgtttgttgatttgctggtatttttaattgtgcttcttaatgcagtgcttaattttgtaaatcttccacaaattcaacttggaagtacaaagcttctaattcctttattaaaaaataaatgaagaaatactattgggctaatgggaagtttgtgtgctaaacatcttaggagaaggacaaaatgaaagacgattttgattgtgtgttgatcttatctaaaaatttaccaccagacactgtttgttttcattctcacacatgcagttttaaacaggaaaaagtatggtagaaaaaatcaaaatgatttttagaattcacaggatgtatgtgatttctgagtcatattatttaataattatttaacaattagagttacttaaattttctgaagcttagcttttctctccttaagagtagagagtatataatctattcattaccctttatatatacacaacaataaaaggattaattgaaaggatatgtccaaagtacctagtaagggcgtgactcatgatcgatattaaataattgaagcttcctttctgcttcctttctttggattcaggaaagtgtgttaggactttttgaagtatcattaatcttatatttgctatgttagattaacttatccaaagaaaggagtctttttaaatagtttccaaactcaatatctaaaaataaaagaaatagtaagagagttaattatattatctttcttattggccaaactattatgatattactaggtgaattaatataaatataaatatttaataacatgaaaaagaatgttcataatgcacagtgaaaagatgacaaaagtgaacaatcattatgattttgaggcctaaaacatacacatgaaaaaatctagaaaagaatgcataaaattattatcatatgtgttttcaatttctatttctaaacttcttgaaatgttgctttgctacacttataacttattaaaactttaataacagtctttgaaatggcaacagttttaaggagacatttatgtaccagaaaaacatgactgtgtgaaaatgaaaataaagatgatgataatgagtgtggtgattatatgcatgatagcagtagcaggggtaacctctaacattttccccacctctactcatcacatctcaacgttatggcatttagagcaagattaaaagagacattatatctctatatagaattggcagaatttttgagtgattctataacctaaattcattaaattttatgtaaatccattttccacctaccagaagatcaatatttccataaccaatagttaatgccacttttcgtattgaaatcacatttcaaatgatatattatgtttcttgcatgcagcagttggaacaacctaaaatcttcccagtttatattatgtgagacatcaaggctcttgtggtttacagaactgatatgacatatttgaaaggggacggtatataatacacttttaattacatattatgtctaacttctgcaacttagactactactatatacacattttttttacttttctgcttaaaatgaaatctgctgttgatttgtttccctgagctgtaattacaaaatacttatacttacccaatcaagctgatataacttctaagtgcttttgccacccaagatattgtttattcttccttcctttctaccactaagttttatttattttgatcatgtggaatatatcagtatattattttttatcagggaactttatgtgcctgctctgagtctagcagtttgcccaagagactcagatacgggaatgcacaggactccagatccaggaaatatgaattttattcataattgagcagttacattagcaaataaaatatgaagatttggtaaaaattattgagattcttgagatacttgttctggagggttgaagcctactagccaaagaaaaccaaggatcaactatagtcaaacatagttaagttcattagcttgctgaaacaagggaaaatatataccagttgaactgtggagcatctcagaaaaggaagtctggaagggcttattacagaattagagcttgtgcaatatgactttgggaagggtgtgaagaagtgaccatttattccacattgagtgatacctggaaatgaggggcaattgaatgattgtgtgtcttaagtgttatttagtagttgggaagaagaaagaagggctcgagctgtcattggcaaagatgcagccgtcattaatgttagacagaaaaaggagatgtttgattgtttaggtttgcagaatgtacctgtctctcttttgtccaccacagtccttgagtggccttgtctgaaaattgttgataatcttcgaaaattgtttagttgggaatgctatgaccttgcaaatagcttccagctaattaaaggttatttgaaagatttccataaattctttccttatctcaagggcaattataatattgcctaacaaaaatatagcagaatattaaatgtccttggtgaaatataaatgcaaacatgagagagggtaaatagtgttttattcatcacatagtatgtattcatcacatacatactatgttctaggcactgttcttagtgctctacgtgaattgatttgtaacatttgattgtcacaatcattccgcagggagtttctttgtcctctgcaaattcgttctttataagctcagctggacccacactcatatttatgctccttcagctgttttaacctttttcacctttttaagttccaaacacgagtcttcccatttatgctaaaaaatgactctttctttatgagaagatcagtaccacattttatccgatcttcaaatgtttgtttcttcatttttcccttcttcctatcttcctcttttgtcaagccatagtcctctttttgtcaatgttaacccctccttgtatgttcttgatttcatctgcctcaatttgtttttatggtcttatagcattgattgccctctatcccagatgcaccttattcaatatatatttattcaatgatgatttttcctatgcttaatgaaatgtgtagatccttcttgcctcaagattctcatggtgctggtcttatgacaccttgcttttcttcatttttttctcagtggcatcatgtgcttcctcacttttaactgttatatagatgacctccaaatctatattgctaaatcctatcatctattttgcttttcatgccaaagtttccaactacttcctagatatcccctatccactcttacctggcccatttatagttcaaacttcttgttcacaatttcaaatgtctcataatcttgcttctcaatccagtttcttctgcagacttccctagggttcaagcaaacctctataagcattctttatctaagccaagatgttttaagtgtagctacaagtttaagattgttagagtctttgacagtagcttagagtatagctcttctctttggggtgagaaccatatgatttaatattatactaagcttagagtaggacaggaaatcttttaccaattggtgagttatttttctttcagccaatggtgcttaaaacctcagaggtgttttggtgcactctatgccacatgcaatcttcctttttcatgtagatcctatttctacaatgtattttgaatctgctatacccattccattctattacccaggtccaggctgggttcttattacattctagttttattatttgagtgttgttttggtgtcaacacctagcacttctctttcctattcatccttcacacacattcttgaataaattttgagattaacatttaaaaaattttatcttcaagaatatgttaatagaacaattaggagttaccttagtagataattatccctaccatctgatcactgccagaaagtaggatacagatcagatttctgaatctaaagtcatcttttctaacagcagccctctaactcataaccagtatataccagaaatgttacactacttaaagctgtagttagcttatggagattgttctacaaggaggcaggtataacaactatgtcataccacagaaccacagtatggtgatagctgctcactggcctctgcttgagaggagacctaaaatttctctgacagaaatattgcccttcctgcagctaacatcgaagtgaaggggtatgtgtcttgaaaggagtcagcgggttctcattcttcttcgcttcttccatttgagtctatcatccaatgccgatttcagctgatagtttaaacatatggtcctgtgtgtaaccagcagcaaagaaagctacattccaagtactttttaagaaacataacaatttcaaagtcactgccactcatacctttcagaaccttgactaagagaaatgatatttttggagaaatatttggatcttatgcagtatatccattttccttggatattctaagttagatccttggattaagctaaaaaaaagctgttttacctggatgactgcattccactggacccgtgaaacagctcttcatgaagtatgccttggcacagtaccatttgtttatgtgtgaaggacactataataaatagaccttggaaacttgctttgctatattaaggctgttgttcattagaccacacagtgtctgctcctttcagactcacaggagaaacatctgtcttccttccatattgggaatcattcttcaatgcacctagcttattttcttacctaatggacacagtgacttgtataaatcattgctaactaactctggtaacattttaatagcatttatttaattagcctgtttgctcacttcatcttactctctttcccttcacctgatttttctcacttatttgacactgcaatattttatacaaccttgaaagctgccttaaatagttttgggaagcaaggtggactataattaaataaattctggaaatggaaatgactagtgtattatttttatctgtcaagagccacaactcaaatactacaagaattgagaagaacttatcaaccttgtgttcaaggcctgccacagtataatcttcaagctactttcccaactagttttctttctgtctgcttcacgactcttctttcactagtcacagttctttgtaagatgtgtttaatggtgagtgcttgctttctttgctcatgctcactttccacctggaatttcttccctgccacacctgccatctctgtggatcaaatcttgtgagtttttctgattttcacactttattttgaaaactctcaaagttttctgttaccacctgatgaattccaccttctatgagatatttgcacattcctcgctatcttctctccaacctacctttagattataagttcctggaggtttggagatcaagggctctgccattccttttatcccttgtggtattaaagctcaaatttttgatctaaataagtctttaagtaagaactctccctcaattatatacttcaatgttggcttttactcttaataaatgtggagagaaaaagtgggggaggtaatactaggctagtcagatgcctgaattttctctcacagttctaaaatttaaaagtatctcttccagaaagttactctaggtaactgccatcctttggcaggactagcacaatatccatctaactggtcggactgattcaagccttctttccattcaattcattttctctacagccccagagccacgtttctgaaacaaacaggacatgtttgaaatccttttgcagctttcaggacataatcctcagtccttagcctgtgcaacaaggcccttcatgatcctgatgcctcctttttcacattcatctgttactacttctgttctcccgccataatgaactgctttcagtttctgggatgggccaagcctgcagggtctttgcataagtgggagtagataaacatgagcaaatcctcatctagaatgtgtttcctttactcttcaacctgctaatgctggcttgtttcacagcaattgtctcaaatgttttcttcttcttggaaggttgccttatccttttgtcttgtcttagagttttctctccccttaggtgtctgggaatacctttattgtaacatttagcacactgaatcaccatttccagtttaattatcatttctcccctctagagtaaaggctataaactcttagagcagagactattcatatttaccttatttctccataatccagcaacatctggcccatggtaggtgtttattaaatattcattgattgaataaatgatacctatatgtaaaaatgctgattcgttagacacacattctacataatcctaactttctcctcaaaagattaaaatagcaagaggaaaacagactcagaattcccaagaagtctggaaatgtgaatgaacaactaagtgcagagagctttctgaaggggataggaaagactcatgacaagaaaatggagttgggaggatgtcaaaggatttggagacagtagaataattggaaaatgatgcttatatgaaataatttaagatattggtggaaatgtacaatgtgtctattagaaatatgaatgcccttcagcaatgttgcttatctgaaaggtttcattttcttattttccctagatagccatcatattcatttatcttactaacatcctcataattgattccccagtgtcaccttgtaaaagtacttttatactcttttcatcgccaagatacctcacacgtacaccattgcaaacatacactggtcccaatgacatcgcatctttgctttatttttatttttttaaatagattcttcaatagcctatgttatgccttttacagattctctggacacacatcaggtgcctcaccatcattgttaatggcaatcagagcaagtaatgtcttttagttctttttcattaatgaaatggaatagcaccatattcagtctgttagtgatacactattacatcgagagcttactgaagaaatgcagccagcctgtgtacatagggctggttttccttagatgtgattttcagccatgaacaaacaaggcaccctttcatctagcagaaaagtttgctgtcttcccctctttctttctcatttgttttgtcctatttttttcctgacagtctgcaagaaatataatgttttctaaatgacattgaaaattcttgcagattaggtattcaaagggataaaatatcaattaatcttttgaaagcctttcttttttgttgttcctgtctttggatttcagtttcttgaattccttactctcaaagaaatgtttttcctcttgatttttctcattataaaactggatataaatgtaaagtaagcagtcattctaggtattttttaaattcctttagcattcatgcagaaaaaaaaactctgctgttattttaatccctttaggaaagtatgtttgattgatgccctcgaacttggctagttgaggcaaaatctgagagtttttttttaatcctctaaactcaattgaattatattgccttagcttatactttataaggtgcccgttagctttaaaactcacactaccggcatttgtgcttgtcaaccaagccatttagactttaagttcatttgaagaattaaattaatgtgatgctaaagcgtctatttgtgtataggtcccagttcctaaaataacttttcttagcagtctcaccaagagtgaaatgctgttagtgggctaaaggaaagtatatcaacttcacaggccttattctagaatcagtaatttgtgtgttaaaaaatgagtattaaagtaggcagtacagctgatgcattcttgttaaataaagcatgaaagttcagcttttgtgttcatttctgcagtgagttccctttactacccctttttcaccatagttcattcctgaatggccagacataatgagaagatacaagaattcgactgctcaatagaagtacctcatcccatcttaatgctgagcaggcagcatatggtgaaagaatgaatacaagttttgaacaagatgagcatttaaatcccagctcttgcatggactgtatgtatgggttctctgaagctgtcttaccatctgtaaagaagataatgacaatactcacagagatatactatgagagttagatgagatattggcatagtcataatagatactcaatctttcccacatcacaggattccaagcttttgacttagcatgttcaattttttaaagcaatagttctcaaactgtgatcccagtctagcagcacagcatctcctgagagcttgttagacatacagattctcaggccttgacccagatctactgaacccaaaagggttgggcagggggtgagggtggaggtggaaccatcttatttttaaaaagcctccaggtgactctggtgcatgattctgatggtgagtttgagaaccacttaagccaatcagcaaatcacaaacattggctgtgtgtgaatggggaaaggataaaatgattaaaacagtgggaggtatataagttcattttcatgatgctgcgaagaattactcaagactgagtaatgtgtaaaggaaagaggtttaattgacttacagttctgcagggctcgggaggcctcaggaaacttacaatcgtggtggaaggggaagcaaacacatccttattcacatggcagcagcaaggagaagtgccaagcaaagtgggaaaagccccttataaaaccatcagatctcctgagaactcactatcacaagaacagcatagaggaactgccccatgattcaattgtctcccaccagatccttcctgcaacatgggattatgggaactacaattcaagatgagatttgggtggggacatacccaaaccatattatttcaccccggcccctcccaaatctcatgtccttacctttcaaaacacaatcatgcctttccaacagtcctccaaagtcttagctcattccagcgttaacccaaaagtccaaatccaaagtctcatcagagacaagggaaattccttccacctatgagcctgtaaaatcaaaggcaagttagttacttcctagatacaatgtgagtacaggaattggataaatatacttattccaaatgggagaaattagccaaaccaaagggactacagaccccatgaaagttcaaaatccagtggggcagtcaaatctcaaagctccaaaatgatctcctttgactccatgtctcacatccagggatgtggtacaagaggtgggctcccatggccttgggcagctttgcccctgtggctttgcagggaacagctcccctcccaattgctttcacaggctggaattgagtgcctgtggcttttccaggtacacagtgcaagctgttggtggatctaccattctgggatctggaagacagtgtccctcttttcacagctccagtaggcagtgccccaggggggactctgtgtgggaactcgcaccccacatttcccttccacactgccctagcagaagttctccatgagagttctctgtccctgcagcaaacttctgcttggacatccagatttttccatacatcctctgaaatctaggcagagattctcaaacctcaattcttgacttgtgtgcacctgcaggctcaacaccacgtggaagctgccaaggcttggggcttgcactctctgaagccatagcccaagccgtaccttggcccctttctagccatggctggagcagctaacacagaagtcactaagtcctaggctgcacacagtgaagggaccctgggcctggttcaggagactatttttcctccttagcctctggtcctgtgatgagaggggctgctatgtagacctctgacatgccctggagacatttttcccattgtcttggtgattaacagttggctcctcattacttatgcaattttctgcagccagcttgaatttctccctgaaaatgggtttttctttcctatagcattgtcaagatgcaaattttccaaacttttatgctgtgtcacctcttgaatattttgtggcctagaaatttcttccaccagataccgtaaatcatctctcttaagttcaaagttccacagatctctagggcgggggcaaaatgcctccagtctctttgctaaagcatggcaagagtcacctttgttctagttcccaagaaatttcttatctccgtctgagaccacctcagcctggacttcattgtccatatcactatcagcattttggtaaaaaccatccaacaagtctctaggaagtttcaaagtttcccacatcttcctgtcttcttctgaaccctccaaactgttccaacctctacgtgttacccagttccagagttgcttccacattttcaggtatctttacagcagcaccccactacacagtaccaatttactatactagtctgttctcatgctgctatgaagaacttcatgagactgggtaatttataaaggaaaaaggtttaattcactcacagttctgcaggactggggaggcctcgggaaacttacaacaatcatggtggaaggtgaaggaaatatatccttcttcacatggtggaaggaagaagtgccaagcaaagaaggaaataaccccttataaaaccattagatctcatgagaactcactcactatcctgagaacagcatggaggtagctgcccccatgattcaattacttcccaccaggtccttcccacaacatgtgaggattatgggaactacaattcaagatgagatttgggtggggacacagcaaaatctaatcaggagggagttaaactgacagtagacattttagtcttgtgtagaatgttaatttttctttatcagtcaaactccttccttccagaattatacatatatatgtataatatatattaatatatataatatatatattatatatttttatatatattttgtatgtataatatattatatatgtgtatatataatatattattatatattgtatatataataagatatatatacatatctttcttttatgatttccttccttttgcatgactttttttgaagactgacataatttcacttaggttggaaatgagtgtattggtccccttggagaaaaataaataaatccctatttgagtttatccagtacaataaaaactatcaggataaaatgatataagtaggaagtcctagaaaaaatgaaatccaatgatcagtaccttcgcatagtatgtgtatccgctatggaatagttggttataacttttagaattctagaggtctaaaaccagcatgatagctcattcctcatctcttggtctgaagaggagggaggcacaattgtttataaacataacggcactgaggtggggtgtatgggtatgaaatcctagtgtttctacatggttactttatataggttttactgagttaaagctctgtttttaatatgggtcaagactcatatatatatatatataataccataccaacaagccctgcatccctagcatgatcctttgaacctctagtaattagggcagtaactaaattggccctttttattttccactggtgtcaataccagctaagaggattacatcttgcttggatattaagactcttttcataactgaaagcatctaatcctgattattcactgtttgtatttataaaatatataaaactagaaataaatctctcaactgaggcccaaatgtcacagtcaaattaaccttccttgactactgattcactttgactcacagctaatgaggacagctccttttttttttcttctatttttctctcagtgcctgtagaataaatcctacatagaactggaaatagattttattgtgcatatatttacttatctcctgtgcccttcacattgcttccagttctgtatcccctgtgcccttcacaattgcttccagttactttggagatttttttttttttctgttttactttcctgttcagaatgcaagataaaatcccatggaaaaatgatcaaaatgcaaagtactcaacacaaaattataacttaaatttgatttatcttttggtcatatagatttccttagggaacatatttaaacatcatttcccaaacattccctagagtaagagatctgaaattttgtagcctagtaaaatcaccatgtgagcattaaatgcccgaatgcccaggttacagtccaggccaattaaatcagcatatccgtgggtggatccaagcatcagtagtttattaaatcttcccaggtgattacaatgtaaagccaagtttgaaagtttgaaaggatcctaaaggattcctctcagtcttatgagatattagtgttgtacttaaacaaaaaacgtataagatttaccacctttgggaaatgtagcagactgtttttgtcttcttacaaacacttaagagaatcacaatgaacattttcacattggctaagctcggtgtctcatgcctgtaatcccagcactgtgggaggccaaggcaggtggatcacttgaagtcaggagtttgagaccagcctgggtaacatggtgaacccccatctccactaaaaatacaaaaattaattgggtgtggtggcgcgtgcttataatcccagctacttggaggctgaggtgggagaatcatctgaaccctggaggcagatgttgcagtgagccaagatcccaccaccgtactccaggctaggtgacagaaccaggctgccccctccaaaaaaaaaaaaaaaaagtgtattaaaggctgagtacataaaggaagaaaatggatgtaaagaatgaaggaggacaagagaaaaagtaactcacacctccaagaaaaactgaaaacctatttagcttggcttatttcatcatatttcaaatttgtttgctcagatttcattgtatgtagaacacctgtaaaaattttattggaacacatcttccatagaatataattcagaaaatatggattaaaaggaatccaccacgaagtgtgtttctgaaatgcttattaaaaacccagttatatcagatcttcctatactttgttgtcatttttgatatttaaaatagtgtgtgaagtataacataagacttcagaaattatgtgaagtatctaatagaaatagggtatttggatcacaagcaccatgtgaaatttagttttaaaaagtcagtctccaaaaattaacagaagaattaaatgaatggtatgtagaggactccaacgtttattaacactggaaagggaaatccaatcaggtaagaaagtagagtggtatgatagcagaaatacagtgccaggatacattagatctagtggcatgtgcaggataagcttaaacaaactggttagtctgggactatccaatatcccatttctattatactcattcaccattttatattctcttctcccgggcttttctaaaaactttctttttctgaactttatacctctggaggctatctaatcagttgttgtctacagtttcttctttccttcatgaaaactaactggtaacctttcctcgggagtctcccaactccttcttgggggccaattgtatggtaaaatactaatttctgaatgcattaacatttctttttaattttcttaattttattttatttttccataagttattggagtacaggtggtatttggttacatgagtaagttctttagtggtgatttgtgaaattttggtgcacccatcaccctagcagtatacactgcaccatatttgtagtcttttattcctcactcccctcccactcttccccctttgtccccaaagtcaattatatcattcttatgcctttttgtcctcatagcttagctcccacacatcagtgagaacataacatgtttgattttccattcctgagtacctcacttagaataatagtctccaatctcatccaggtcactgcaaatgctgttaattcattcatttttatggttgagtagtattctatcatatatacataccacagtttttttatccgctttgttgattgatgggcatttgggttggttccatgattttgcagttgtgaattgtgctgctataaacaagcatatgcaagtatattttttgaataataataattatttttttcctctgggtagataaccagtagtgggattgctggatcaaatggtagttctacttttagttcttcaaggaatatccacactgttttccatagcagctttactagtttacattcccaccagcagtttagaagtgttccctgattactgcacccataccaacagctactggttttttttattttttgattatggccattcttgcaagagtaaggtggtatcgcattgtggttttgatttgcatttccctgatcattagtgattttgagcattttttcacatgtttgttggccatttgtatatcttcttttgagaattgtctattcacgtccttggcccactttttgatgggattgtttggttttttcttactgatttgtctgagttaactgtagattctggatatcggtcctttgtcagatgtatagattgtgaagattttctcccgttctgtgggttttctgtttactctgctgactgttcctttttctgtacaaaagcatcttagtttaattaagcccaaaaaactttatctttgtttttattgcatttgcttttgggttgttggtcatgaaatccttgcctaagccaatgtctcgaagggtttttccaatattcttccagaatttttataatttcaggtcttaggtttaagtgcttaatgcatcttgagttgatttttgtataaggtgagagatgaggatccagtttcattctcctacatgtggctaccaattatcccagcaccatttgttgaaaagggtgtcctttttccacttttatgtttttgtttgctttgtcaaagatcagttggctgtaagtatttgggtttattttttgagttctctattctgttccattggtctatgtgcctatttttatatcagtaccatgctgttttgatgactacggccttatagtttaaaatcaggtggtgcgatacctccagatttgttatttttgctttggctatatgggctctttcttggttccatatgaattttagaattgttttttctaactctgtgaaaatgatggtggtattctgatggggattttgtggaatttgaatactgcttttggcagtatggtcattttcacaatattgattctacccatccatgagcatgggatgtgtttccatttgtgtcgtctatgattactttcagaaatattttgtagttttgcttgtagaggtctttcaactcctttgttaggtatattcctaagtattttttttcagctaggggttgagttctcgatttgattctccacttggtcactgttggtgtatagaagagctactgatttttgtacattaaccttgtatccagaaactgctgaattctttgatcagttctaggagttttctggaggagtccttagggttttcaaggtaaataatcatattctcagcaaacggacagtttgacttcttctttactgatttggatgccctttatttatttctcttgtctgattgctctggctaggacttccagtactatgttaaagaggagtggtgacagtgggcatccttgtcttgttccagttctcagagggaatgctttcagcttttccccattcagtgttatgttggctctgggtttgtcatatatggcttttattacattaaggtatgtcccttgtatgccaattttgctgagggttttaatcataaagggatgctggattttgtcaaatgctttttctgcatctattcagatgaccacgatttttgtttttagttctgtttatgtggtgtatcacacttattgacttgtgtatgttaaaccatccctgcatctctggtaggaaacccacttgatcatggtggattatcttctcattttgttgttggatttggttagctattattttgctaaggattttagcatctatgttcatcaaggatatcagtctgtagttgtctttttggcttgtgtcctttcctggttttggtattagcgggtgatgctgtcttcatggaatgaattagggaggttccttctttctctatcttgtggaatagtgtcaaaaggattggtaccaattcttctttgaatgtctagtagaaatcttctatgaatccgtctggtcctggatttgtttttgtttttatttttgtttttgagacagtctctggcctcactgcaacctctgcctcccgagttcaagtgcttctcctgcctcagcctcctgagtagcttggaatacaggtgtgtgtcaccatgtccggctaattttttgtatttttagtagagacgggatttcaccatgttagccaggatggtcttgatctcctgacctcgtgatttgcctgcctcagcctcccaaagtgctgggattacaggcgtgagccactgtgcccggcctggactttttgttgttgttggtaattttttaattactgtttcaatcttgctgcttgttatcggtctgttcagggcatctaattcttcctgatttaagctaggagggttgtatttttccagaaatttatccgtcttttctaggttttctagtttatgtgtgtaaatgtgttcacagtagccttgaattatcttttgtatttcagtggtgtcagttgtaatactgtttcatttcttagtgaggttatttggattttctctcttcttttcttggttaatcttactaatgtcctgttaattttatttatcttttcaaagaaccagatttttgtttcatttatcttgtgtatttttgtgttttgttttaatttcatttagttctgctctgatcttggttattttctttcttctgctaggtttgggtttagtttgttcttgtttctctagttctgtaaagtgtgaccatagaatgtcagtttgtgctatttcagactctttgatgtaggcatttagggcttgatctttcctcttagcaccaccttagctgtatcccagaggttttgatatcccagagggcaggactcactcccacggctgcccacccggcctgcccccgtaacagtctgtttccaggtggagggcgagacaggcttgaaaacttgcccgaggctttctgcctcccagctgcaaaggaaaagggctttagatcttcccctgcctgtgaagtccgctagccagattcatgccctcccctgagttctggccgggggtttctctccccattcaaattgttacaaatttcagatagagaattccttctcccagtggagttttagctcctgcccctctggccaccctcctgctggatccctgtggtgccaggcaggaatgggctgcttgaggacccggtgagctcccagggcctttctgctgcttcctctatccctgtatttcactcagctcggctctcttaacttgactcagctccaggtaaagtcggaaacttctcccacaaacagaccttcagcttctccagtgggggtgtgtgctcaggagaggagggtgtcccgttcccacttcctcagttggggcactcacagtatttagggtgcttcctgggtcctgcaggagcagtccgcttccttcagagggtctgtggatcctctcaggattgctggtttgttcttgcagtcgatctagagctaaaattcacagtgcaagcctccgcatgctgctctgtccggagctgcaatctagttctgccttccgtccaccatgatacctgaatgcgttaacatttgaccctagtgatggaatttcacacgctgtgatggatatttaattgtaagacagacgcagagtgatggtggtcattctccatatagctgtcctaagagatctcaaaaacttctgcttaattagagtctcttaatcatgaaaagttttgagttatcatagacagtggtgaaaataattaaagtaattaggcaaattggatttggataaacattttaaatggatagtcaaatatcaatgttggagaaggttctattggcaactgagtctgattgacaggaaaaaggaagattaaatgcctaatagacaaggctctaagattatccctggtctgataacgattttggataattctaccagagttgacaatgttgtgtatttctttttaactgatttcgtctcttgcttaatttacccttctaaattcatatgatctccccaaccacaaagaacagttaaacacccagcacaaaatggtttaattttaaaagaaattgattgattcatgtatataaaaagccaatagcaagagctgcctcaaatgatatcactacatgtttttttctttatattcatttgcatttgtcttcacattccatattctcacatctgacaaatctatgtcctctctatcatggtaacagagtcgctgacccataagcttacactacaccatgctagggaagagaataggtcatttccaggtgtctctgtatggaaaagagaatgttttcctttccagtagcttaagtaaacatcaagtttcattggctctgttagggctattttcatttatttctgaacaaatgatcaggatacactaactgtagagccaatcacattgtaactacatggtagtgaaatgggggtcataggattttcaaaagaaatgtggattatcatcaagaataggaaatgaatgctgagttgtaagaaaaaaatgcaaatagaagttcacccttgtcatcattcttcatatccttctgtctatagtgtacaacttttgattgatttttacttttgaccttaagtcattgatccctcttttaaaaatctgtcttgttttataaatatccttgagacaagacttaagagtatttttaggaaattcaaacctacatatttttattttctataagtgtgtatgaaattcattaaagaggatgttcgtttatatccaccactttaaaacttacagcagtttaaatataattggttttcagtaaaaattgtatataatgtaggaaacatgacttcattgggcaaaactctagaaaaatatgtagttaacatttttgggaaaaactgtccgtagtagcctgtgagttagtgaaggagtgtccccaggccctaaacagaaactaatgttttctaggatatagcattcaaggaccaagaaactaggtgagaccagatcaagaaaattaggagataaaaatgaagagtaatatgatatctgtattgctttttctttttgtttgattttggctgccttcttctttgctaccacccaataatgagcacttctggtttgcttatctatttatttcattagttttattttttttcgaagctaattcttacacgcctctcttaatgttcagaccctttatatcttattttttccagtgaatgggagatattaagatttgtccttttgagttgattatatccaatttattttctttgtttgagaatgtaactgagatatcactgggtctctcaatattttgaaaccagatgattgtctaaaatcctcaatcccataccctttagaagtccaaagctttatgcaacatgtatttgagttttcaagggcattaataatcacttttatttgctctctttattctaggttgattttgatgtaaaatttaatcttttttcaattttctcataaaaatcccactcagagtcacattaatgaagatttgggatgtgttcaggaatcgaaacatattgttcgttccaataacttcaacttgaatataaagctacatctctgtggtttaaatgccttttaatagcttcaccaaagtggaatttcaggcccataccactcatgggctcctctctcctccgtcttcccgccagcttcttcaggttttctctcttcccatctttcttagaaacacaagatgctcccattccccgctttataactgcctcctctcttggactcacttctccagctcctccagtgtcttctctcttcccatctttcttagaaagacaagattatcccattccccgctttataactgcctcctctcttggactcacttgtccaccctggcccactactcatctcttctcacctcctcaaaactacattatttcattaccaatgatttcagccttggcctcacttcagaatgccttttaacagagtactccacagccccatgttgtcaagagcttcctatgatggaagatcttacttatacatttggtatcctgcttctttttgtcctaatacacttgtttgtttgtttgtttgtttttcattttaagttgtttcataagtggctccagtttcttctcaaatatgttaggtataggggaatttttttactggttcagaattccttttctcttaattttaatatttttcctttaattctcacccttaattattcaatttaaaaaaagaagcctgcttttttaacggactttattctcctttaattttttatgttctccttgaaaaccttaagctttttacccagagtgcttaattattcattcactcactcattcattcattcactcaacaaatatatattaactaccaaccataacgaattaggcatggtctttctagtttacctggtttgactgctaagagctttagcagaggtacagagaaaaagctgttagatgtcataagaggtagttaccatttcccaatgggggactgaagcaaggcaacatacaggaatttagcatttggactcagattgagagacaggttttggatttgtgttgtaggtggattaaaaaaaaagtttgaacacagtggaaacaaaaaaggccagaaggaggaggttagcaagaaaatgctcttaactgtgagcaagtggattttggaatagccaaacataattgagatgatgtaggtcacaatgattttaagaattgaatgggagtggaataaaatttaccccacaattacatactttgcttcttcattgcttgacggttatcatcaaactaactattcttcaattcctttggcaaggagtggaatctggactctggcaccagagggtcgatttccttccagttctcctttctattttttttttgcttttgtttctttactttgaactcctcacagtcttggaaaaaagagggcttgcagagactttttcattttgtttttatattgcccaaattgtactcacatggatagagtagtaccatttaattgtttccctctaaatatgcacagttcccagaggtattttaatcagatagctttatgccctgttgtttgcagtttccaactttttgttttctattactttctgtttatttagaatgttgctgcctcttcttttcttctctccattttctccctgtcttcatttgctcaccacccatcttggatcaacctctaatatgaatattcaaaatagttgagtaagtcaagttctgtctctgaaaatctcttgactaaaaaaacagattaaaaaataatatcactgacccttttagaggctgagctctgtttcagaaaacattaaggaatgccttcaacattttctcttgtttagttgcatcatttacttgagtccactgggatgattggcattcacgatgtgtgggctggagaccatcaaaaggaaatgttttgtgtggaaatggaatttactctgtgtgtggcagtttgaataagttccctttctctttggctaaagcatctttaccaagcccaatctaatgcattagtcacagaacttaaatagaaaacaacaaagcttccaggcacattgaggatttcttcgttcctttgtctttttgatgaagtccctcagttctttcatttccaaaataaagaagcaagcctagtcgacagacaaaattaaatgaacctaaagaggctaaggacattagttgtttatgtgttcatattagtttctggaagaactaactagataatagatcagtcaggccagttaaactaatttcttgattatttcaaatttaaagactgataataaatgttggtttgaccttaacagactctcttatttaaggaggtcaccactttacaggcacttttaaattctttattatttacaaaccagactaatatggcaaaaagaaaacagaatgttaaggaacactgaagagggtatgagcagacaagaaattcaaatgtgaaatagaaacactaagaagaaagtagtaacaatacgaaagatccaatttgcaggaatttgattatctacttggttcctgggtactatggtgaatgtaatattggcaatgataaataatacctaaaattaaatagctttatatatgtaagattaacaaggagaaatgagttctccaggatacccaatgtattagtaactcaaccagttttttctgggttttatcatgtcctattacccagtctatgctttattgccatagtatatggcttctcaacataatacttggcatataatagggatttaaacgtttctgactgaatgttcctagtaagtgaattaggtgtgtgtatcctttattggaatttaacaaaacaacactttggcctctcaatttcctgagctcctcacttctggtgacctttctctattctatcctagaatttatctttagcaattactgtgctcactctaaatctcaattttaagcactcagtttcacacatatcacattctgatgaccacctccttctttccacacacttctttcatgaccctatggcaacagttctttgacactgctaagcctgcttttctgtttattgttgccccctctttcagtacttttccctcttcattttctcacatccatctctaacttagattccatagtaaaagatagtaatcactgtctttcctgtgcttcacctaccctggctaactcttcttccatcatcttcttccagtaaaacttggatctcacttgtattccattctcagactgctccattcttttgaacagctggatatggctagagtaaaatgccactatgttgacggtctttaccttgattttgtaaccataagacttaaatgttacctcaacacttcctagaaatcttattacataaccctggtccattcactctcctgctcttcaagacaaccattttataccttctttctcactgccaagcccaccacctttcattttcacctcacatcttgcttcatatatagaaatgatgaaaagagaacgttggtaccttacaaatctcccaatcttttcacatctgaatctattaattgtatccttttgaatgaataaattgcccctgttcttatctaaagtcattattttttgttttctgtcagttttttaaaagctcttttattgaagtataacacatgtacagaaaaaatacacaattcacaaatttacagctcaataaattttacaaagtgtaaacattcatggatccatcatccacatcaacatataaaagggtcttatcacagaaacctcccttatattcctgccccttttataatccccacaaaagtataaaaaaatcctaatttccattgccataaatttgtcttatttttaagctttaagaaaaatggaataatacagtgtaaaaccttttatgtctgccttctttaattcaacattgtatctgtgagacccatccatatttatagagcactttgtttctcattgttttatattttatatataaaatacgtttatatattttatatataaaatacgtttatatatttatatttttatatataaaatacgtttctatatttatatattttatatataaaatacgtttctatatttatatattttatatataaaatacgtttctatatttatatattttatatataaaatacgtttctatatttatatattttatatataaaatacgtttctatatttattttatatataaaatacgtttctatatttatatattttatatataaaatatgtttctatatatattttatatataaaatacatttctatatttatatattttatatataaaatacgtttatatatttatatattttatatatgctttatattttatatactttactgtagatgaaatttaggtgacttccagcttagaatcattataaataattttactttaaatatgttatacttatcttttggtgtatatttgtaagaatttctgttgatacatacataggagtgtgattgcttggtcatgagttctgcaaatgttctgcttaattgacaatgccaaacaattttacaatttaaactcccactagcagtatataggagttcctattgtccacatccttaccaacacttggtattgtgagcctttttcatttttgccagtctggttggagtagggtgttatatcataatatttttaacttgcatttttctaatgaccagtgagtgagatcaatcatgttttaatatgcatattatcgtttacatcaactatatatataaatttttcattgtcttgttttttaataaaatttttagagatcattgaatattcacatgcagttctaagaaatcatatagtgagatcccttgtagtctctctattctgttccattagtctatttttctattcttgcaatatgacactaagcacactatcttaattactgtgacttttcagtaactattgatatctagtagtatacatgcttcaactttgattttttgcctgcagaaatttcttccacattctaagtcctttgtatttccatataaattttagaatgggcttgtttatttctactaagaaatctgcttgaatttcaatggggattgcaatttgtaaggaaaatttacactttaagaggactgagtcttctaattgaggaatgtggcatatctctgaatatatttaggtcttatttaatttctttcatcaagattttctaatttgtaatatagaagttttcattgccttctctcatatttctagttattttggtttttgatgatatatatatatgtagtatttaattttcattttaattttctcttgttgacttatagagatacaattttgtatgccactagcaaatgaccctcactcccgaatacaataattctctgtatttcttttttaatagtttaatgcacagttatctgtgggttatgtttagtgatattctgggagactgaatggaataatatacctgtcaagcccactaactggccttcttccttctttaagtactttcactcccagtagaagtatatcctgctctgtattcacctcctggatgatcatttcatcatttataactgtctactttgttatttctatattagtaccttaagcaaatagcctcctttatatactaaaactaatataaagcattatgaatgcatacactgttactagtctggatagagatctagttcattatccattatacattccactgacagaagtagaaagaatataggaagaactgaacagtaggggtccaggtaggagtccatcctttccatgccctagtagggacactcgacgctcaaggaaaatatctcaagatctcctcctctctgtgcatggtctctcatcccttgagtgacatgatgacatataaaacattcttagaatttcacttgaggcagatattactaattaattaatcaaagcaagcatgtgaaatggtatcaatttgccaaaccaggttcagacattgtgcctcaattcagaaataatagaattatgcaaatctaaaaatgtgaccctcaaaagtgtggaatacctctgcttgaggtaataccgctcctctccttcagctactcactcaactctgacaaatcgtaactcagtttactccctatatccccaagctttctttgttaaaagaaattttgaactacttgcttttgaaagtaactcacatggcatgctcttagcatcatctagcacaagctttgttttcttctgttcaacttcctttcagaggtgcatttttacaacttccctctattgttctcattgactttccgggtttgatgcgacctgaaaaactctcctttctgaaattcgttaaccagcttcatcagttttatagcaaggactggaagcaccaatttaaaatttaaatggtacaatgataacttcaaattagtttgatcaattattttaggaaattccaaaaactgaaatttcaaatattgaaatgcaggaacttccttgcccctccctggctctataaataattaaaataaaaagtttcctcacaggaaatatataaaatatgtttgttttgttttgctttagtggaggaaaagagtgtaaatctagaactaataatttggggttttctttgtttgtttccacagaaataatcaatgattccacactaatagaaaccatttgtcccaactgaaataggcaaaaacacggttctgttccaattttacaatttttttttgtttcttcacacaacaccgtggtgatgcagtgtctagactttttggaacaaggcatggagtctggaatttattctgtgggtttgaaaatggttattcagtgctcctacacattcacatgtgaaaatctaatgatttcataataggtaaaaaccatcaagctgtttaccaaatacatatatattcattaatgctataagttcaagctgctacttatagcattggtgaatatacaaggaaatattgtatggattaatatatgtcatctcattgtgccgtggtccccattaacccctatatctgaaatatgcaaaataaaaaacttgtgttcatgaaataattattgcagatattttctagcttttgtgaggctctagtaaaaaaaaaaaagcttaagaatatacatctattcttgtggtttcaataagtaatctgtgagaatttatcaagttaaaagggcagaattgatatcacaggtcgttctcttagtcctctgccatttattagctggataaaatgaaagcagtctctgaggcacccagatttaaccagtgtttgtgcaggctgtattattaagtctgactgtagttcatctgtgctctgaagaaaatcaaactatgtgcttgcagagaaagttcagagttatttgtcaccaattacctaaagctgggagttgagcttacacatagctatggccaattcctgtaaatacttgttcctaatttcacaagactgtcacttcctgaggatttaccttagaaagtgtatgtctaccacagaagaactgtaatacaaaaatgtttacccagagataatagtcttaagggacataaaactccatagcattgattagtttaaaataacctgttcttaattttcaaacaagtatttcaagttctgttaggttttctgtgacaaaaaaaaagcaagcagaaagattttttttcattaaaagatacacacacatacaacacattgaactgagctaatctcaattatactattaaatctctactggttattttaagaaaagaaacataaaagtaagttaccaagtatttaaggtagctcgcctggaagaaaattaggttgtctgaatataaagtgaaggttaaaaaaaatggaaaaaacaaaaaaaaactaaaattatcaatcaatggcatgtttctatatttcttacttaaattattaaaggccattaaaacaagttaatacctatattacataaaaatgatcagaaggaagatcttaagaccttatttacttcaaaaataatgaagtagactgaaaagtgtgctgaatactaggtcagaagaactgggggctgggcgtgggggctcacacctgtaatctcagcattttgggaggcagaggccagaggatacttgaggccagaagttcaagaccagtctgggcaagaccctgtctctacaaaaataaaagtaaaaaagcatatctaggcatggtggtgcatgcatgtagtcccagctacttgggagggtgaggcgggaggatcacttgagcccaggagtttgaggttacagtgagctatgattgtaccactgtactccagcctgggccacatgagcaagactgcctctaaaacaaaaagaaacgagaaggaaagaaacaacaacaacaacaacaacaacaatgacaaaactggagtttatcctcgttatataagaacctatatttctccatctgtaaaataggtaaagcattttgcttgactcagtgttgctctgaagagaagttgattgtgaattgcatgacaggcagttcagttttggtcatgttgacaactttattgaatgtcatgaaagaagtaaagatactctgattcagttttactaaaacaaaatgcagatggagttttaaataagtgtcatttgaagaagtttagctaagattcacctaaaatgctactttattattaagttctgggatacatgtgcaggtttgttacataggtatacacgtgccatggtggtttgctgcatccatcaacccgtcatctacattaggtatttctcctaatgctatcccttccctagccccccaccacctgacaggctgcagtgtgtgatgttcccctccctgggctcatgtgttctcattgttcaactcccacttatgagtgagaatatgcagtgtttggttttctgttcctgtgttagtttgctgagaatgatggtttccagctttatccatgtccctgcaaaggacatgaactcattctttttatggctgcatagtattccatggtgtatatgtgccacattttctttatccagtctatcattgaagggcgtttgggttggttccaagtctttgctattgtgaacagtgctgcaataaacatatgtgtgcatgtgtctttacagtagaaagatttataatcctttaggtatatacccagtaatgggattgctgggtcaaattgtatttctggttctagatccctgaggaattgccacactgtcttccgcaatggtagaactaatttacacttccatcaacagtgtaaagtgttcctatttctccacatcctctctagcatctgttgtttcatgagttgttaatgatccccagtctaactggtgtgagatggtatgtcactgtggttttgatttgcatttctctaatgatcagtgatgatgagcttttttttcatatgtttgttggccacacaaatgtcttcttttgagaagtgtctgttcatatccttcacccactttttgataaggttgtctttctcttgtaaatgtgtgtaagttacttgtagattctggatattagccctttgtcagatggatagactgcaaaaatttgctcgcattctgtaggtcgcgtgttcactctgatgatagtttcttttgctgtgcagaaactctttagtttaattagattccatttgtcaattttggcttttgttgccattgcttttggtgttttagtcttgaagtctttgcctatgcctatgtcctggatgatactgcctaggttttcttctaaggtttttaaggttttatgtcttacatttaagtctttaatccatcttgagttaatttttgtataaggtgtaaggagggggtccagtttcagttttctgcctatggctagccagttttcctaacaccacttattaaatagggaatcctttccccattgcttgtttttgtcaggtttgtcgaagatagatggttgtagatgtatggcatatttctgaggcctctgttcttttcccttggtctatgtatctgttttggtaccagtactgtgctgttttggttactgtagccttatagtatagtttgaagtcaggtattgtgatgcctccagctttgttctttttgcttaggattgtcttggctatgcaggctctttttttgttctatatgaaatttaaagtagttttttctaattctgtgaagaaagtcagtggtagcttaatgggaatagcattgaatctataaattactttgggcaatatggctattttcatgatattgattcttcctatccatgagcatggaatgtttttttccatttgtttttgtcctctcttatttccttgagcagtggttcatagttctccttgaaatgatccttcacatcccttgtcagttgtattcctaggtattttattctctttgtagcaattgtgaataggagttcactcatgatttggctctctgtctattattggtgtatagaaatgcttgtgattttttcacattgattttgtatcctgagactgtgctgaagttgctcaacagcttaaggagattttgggctgagacggtggggttttctaaatatacaatcatgtcatctgcaaacagagacaattggacttcctctcttcctatttgaatgccatttatttctttctcttgcctgattgacctggccagaacttccaatactatgttgaataggagtggtgagagagggcatccttgtcttgtgcttgttttcaaagggagtgcttccagcttttgcccattcagtatgacattgagtgtaggtttgtcataaatagctcttattattttgatacgttccatcaatatctagtttattgagggtttttagcatgaagggctattgaattttgttgaaggccttttctgcatctatcgagataatcatgtggtttttgtcattggtcctgtttatgtgatggactacatttattgatttctatatgttgaagcagccttgcatcccagggatgtagctgatttgatcataatgataagctttttgatgtgctgctggattcagtttgccagtattttattgaggatttttgcattgatgttcatcagggatattggcctgaaattttctttgtgtgtgtctctgccaggttttggtatcggggtgatgccggcctcataaaatgagttagggaggattccctctttttctattgtttggaatagtttcagaaggaatggtaccagctcctctttgtacctctggtagaattcggccatgaatccatctgctcctgggctttttttgttggtaggctatcaattactgcctcagtttcagaacttgttattggtctattcagggattcgacttcttcctggtttagtcttgggagggtgtatgtgtccagtagtttatccatttcttctagattttctagtttatttgcatagaggtgtttatagtattatctgattgtagtttgtgtttctgtgagatcagtggtgatatcccctttattattttttatggtgtctatatgattcttctctgttttcttattagtctggctaatagtctattttgttaatcttttcaaaaaaccagctcctggattcattgattttttgaagggtttttaatgtctctatctccttcagttctgctctcatcttatttatttcttgtcttctgctagctttttaatttgtttgctcttgcttctctagttctttcaattgtgacgttagggtgtcgattttagatctttcctgctttctccagtgggcatttagtgctatcaatttccctctaaacactgctttagctgtgtcccagagattctggtacgttgtgtctgttctcattggttcaaagaagttacttatttctgccttcatttcattatttacccagtagtcattcaggagaaggttgttcattttccacgtagttgtgcagttttgagtgagtttcttcatcctgagttctaatttgattgcactgtggtctgagagactgtttgttttgatttccattcttttgcatttgctgaggagtgttccaattatgtggtcaattttagagtaagtgagatgtggtgctgagaagaatgtatattctgttgatttggtgtggagagttctgtagatgtctattaggtctacttggtccagagctgagttcaagtcctgaatatccttgttaattttctgtctcattgatctgtctaatattgacagtggagtattaaagtgtcccgctattatggtgtgggagtctaagtctctttgtaggtctctaagaacttgctttagtaatctgggtgctcatgtattgggtgcatatatatttaggataattagctcttcttgttgtattgatccctttaccactatgtaatgcccttctttgtctttttttatctttgttgttttaaagtctgttttatcagagactaggattgcaacccccgcccccttttttttttttgctttctatttgcttggtaaacattcctccattcctttattttgagcctatgtgtgtctttgcatgtgagatgggtctcctgaatacagcacaccaatgggtcttactctttatccaatttgccagtctgtgtcttttaattggggcatttagctcatttacatttaaggttaatatggttatgtgtgaatttgatcctgtcattatgatgctagctggttattttgcccattagttgatgcagttttttcatagtgtccatggtctttacaatttgatatatttttgcagtggctggtgccagtttttcctttccatatttagtatttccttcaggagctcttgtaaggcaggctcggtggtgatgaaatctctcagcatttgcttgtctgtaaaggattttatttctcctttgcttatgaagcttagtttggctggatatgaaattctgggtagaaaattcttttaagaacgttgaatatttgccaccattctcttctggcttgtagggtttcttcagagagatccactgttagtctgatgggcttccctttgtggataacatgacctttctttctggctgcccttaacattttttctttcatttcaaccttggtgaatctgatgaatatgtgtcttggggttgctcttcttgaggagtatattgtggtgttctctgtatttcctgaatttgaatgttggcctgtcttgctaggttggggaagttctcctggataatatcctgaagagcgttttccaacttggttccattctccctgtcactttccagtacaccagtcaaacgtaggtttggtcttttcacatactcccatatttcttggaggctttgttcattctttttcattcttttttctctaatcttgtcttcatgctttatttcattaagttgatcttcaatctctcatatcctttcttccacttgatcaatttggctaatgatacttgtctatgcttcatgaagttctcatgctgtgtttttcagctccatcaggtcatatatgttcttttttaaacgggttattctagtcagcaattcctctagccttttttcaagtttcttagcttcctttcattgggttagaacatgctcctttagctcagaggagtttgctattactcaccttctgaagcccacttctgtcaattcatcaaactcattctctgtccagttttgttctctcactggcgagaagttgtgatcctttcaaggagaagaggcattctggtttttggaattttcagcctttttgcactggttttttctcatcttcatggatttatctacctttagtctttgatgctggtgaccttcagatgggttttttgtatggatgtcctttttgttgatgttgacgctattcctttctgttagttttccttctaacagtcaagcccctctgctgcaggtctgctggagtttgctggaggtccactccagaccctctttgcctgggtatgaccagcagaggctgcagaacagcaaatattgctgcctgttccttcctctggaagcttcgtcccagaggggcacccaccagatgcctgtatgaggtgtctgccagtcaggaggcatgagggtcaggggcccacttgaggaggcagtctgtcagggacccacttgagggacccacttgaggaggcaaagctcaagcgctgtgctggaagatctgctgctctcttcagagccagcaggcaggaacatttgtctgctgaagctgcgcccacagccactcatacccacaggtgctctgtcccagggagatgggtgttttatctacaacccctaactggggctgctgcctttctttcagagatgccctgcccagagatgaggaatctagaaaggcagtctgactatagtggctttgccacccagtttgaacatctcagcagctttgtttacactgtgaggggaaaacagcctgctcaagcctcagtaagggcagacacccctccccacaccaagcgccagcatcccaagtggacttcagactgctgtgctggcagcaagaatttcatgccagtggatcttagcttgctgggctccgtagaggtggcaccctggcttcagccccttttccaagggagtgaatggtttgtctcactggcattccaggtgccactggggtatgaaaaaaaaaagctgcatctagcagcccaaatagctgcccggttttgtgcttgaaacccagggccctagtggtgtaggcacccaagagaatctcctgttttgccagttgtgaagactgtgagaaaaggcatagtatctgggccagaatgcatgttccttaccgcacagtccctcacggcttcccttggctaggagagggagttatccaaccccttgtgcttcccaggtgaggcgataccctacgctgcttcggctcaccctccttgggctgcacccactatctaaccaatcccaatgagatgagccaggtacctcagttggaaatgcagaagtcacccgccttctgcattgatcttgctgggagatgcagaccagagctgttcctattcatccgtcttgccaactacccccaatgcttattaaccatactacctaggaactccagtttggcaaggaaagtctaaataatggaatagatactcatgtgaactagtgaacattgctgtatatggccacaagtcatgtttctaatgacctctaattcacagaatttcttcttagagatgtagagagtggagtggggatggaccagagtagtattctacagagggtgccagtgacatcctcttatgcaaaggatacacatactaacttactgggcaagttgcaaagtttagaattactaactttagaataggaaatactcaaataggtaaggatttgtccttttactagtatatagtaaaccttggaaacccatgaccaaagggcagaacatgagccacaaatctatcaattctgaacttaattaaattcatggttgataaaaatatattctcacttgctataaatctgctagatttttgagattcaattaaagaaacattttccagaatatatttcttagagtagtagttttaagcaaaactaattaatgataccaaaatcaaaacaaaagttttagaaatactagtttatcacctttaataggcttcttctgtaaaacacgatttctcagtttaatcatatgtcaatatcaagaagaggatatatcaggcagcattgctgaaatacattggaacacagaaagctttactctcagtatagctagtgttccaaggaatatattgtaaaaagggctaaattaaaggatatttagaacctatatagcagaggcaaattacctatctgaaatgtccagggaactgttatctacaacatactctatagagtaatcttgttgaaaaggcagatgctggctgggcacagtagctcacacctgtaatcctagcactctgggaggctgaggcaggtggatcacttgaggccaagagttcaggaccagcttggccaatatggcaaaaccctgtctctactaaaaatacaaaaattaaccaggtgtggtggcacacacctgtactctcagctactggggaagctgaggcatgagaatcgcttgaaccctggaggcagagcttgcagtgagccaagatcacgcccctgcactccattctgggcaacagaatgaaacccagtttgaaaagaggaggaaaacaacaacaacaaagaaaaagaaaagatggactagtgttcagatgctttccttgattcagaatcagcatgcctcttaaatactgaatatactaagatacacaaaacagtaatttagctttttcatattgatacatgaacttagtatttgatctcagcaaatttagtaaaataatcaggagcttttgatttgccacaaaaaatcattcctctaaactttatgaattgagaaaacttgtctttatttgatgattccagttttgatgttttgtgttattggtgaagttcagaaactcagaaacatagttgattccatagaaaattcaattcttgaagagtagaactttgaaggtgcaggatgaatatgtgtgttatgaatatgggtcatactttatgcttatgtaactgaacatgtagttttactggggctccctttcttcattgcaaaaatacaacttatcctcaatacataatttattgactactacaacttagcaaaaaatgatttggcttcattattcatcccgataagaaaaatctggtgaattaaaggtattggaaaggaaattttaacactgatatgagaatgaaatgggagaagggaacaatagagacttcaatattatctgtaatactccatttttttatatttaaaaaagtgatgcaaaaatgaaaaaatgacatttgccaataatgccaatgtatcacataactattacattactttgctgcttttttaaattcaaaaaataaatattactaaccatttatatgatcattcattcaacaagtacttgttgagagcctactatgtgataggtgctagcaataaaagagagtaaaaaagagacatcatccccaactctcctggagtttgtgtttagatgtgaaatgtgaaatgtttgagatcttatttagaatagaatgtgtaaaaggacaaagtgaggaaatgggggtgaattaactcatattgataattaagaggtagggctactgtgggtacttaatcagcaagcaaaggcctttcaatacagagaggagctgccttatttttagtgaaaattgagctgggaaaaaatacacactggctatgggccccatagctaaagcagtctcctgtggtatttaataattttctcactggttgcagctcaaagttcacatgcatttttctttgattctctctagtatatgactgctgctgctcctatgcaagggacctacattcctcagtacacgcctgtgcctccgacagctgtttctattgaagtaagtctacccctgtctaataaagaggttagaagaaataaatctcagtcacatatactgtagtcccccataaccataggaatcctcacttgcaatttttgtgctactctaaaatatgacattgtaaattcagtgtatgaaagtataaacatttacttgaatgtggctgtgttttgctttgcacatgaaatgagctcatctgctatggaggcacgacgggagtctctttcatatttagagaaaattccagaggccaaatcacaactccatcaaattttaatcacaaatacttcttataaaaggaaaaaagtttgcaactatgtgaatgaactaattctctaatgccttgttcctcaaagagtggttcctagaccagcatcattggtatcccttgagagcttgttagaaatgcagacttgctgggcatgatggcatgcacctgtaatccttgctacttgagatgctgagacaggaggatctcttgagaccagaagttcgagaccagcctgggtcaaacagtcaaacagtgagaccctgtcagaaggaagatcagaaggaagaaaaggaaaaaaaaagaaatgtagacttttaggtactatccagacctactgcatctgaatttgcattttaagatgatcactcagtgatccaaatgcacattaaaatttgagagacactggactaatgcactggttctcaaattttctgcacatttgaattattttgagagctttaaaaatattgattcctgagtcctatccccagagattatgatttatttgtctggagtatagactgaacatcatatttttaaaagatcttagatgattctaatacgtaccaaagactagaaaccattgctctaggccatgaacctgcacaggtttacagcttcttacagacaagaaagaagttgtacaactcttattgctgtagatatcatgaatgatgatgtcagcttgtccttaatggaagctttgctgctttcattctctctttccattgggataaatctatgccctctacacatcattttactggacagggccataaactacatagaaatggagagggcatagagctatgcagatggtggtaaaacacttaggtacctatattcttctttctggttctagccattactgttttattgcccttctttcccctctcctgatgcacaggtgcattatggtcaccgtgcattccttctcagcagctgggaatcccctgcagctgatgtctttgctactccatttgttggcaagcaactactgtgttggtaccactccacataaaaattcaccaagactcccaatctctgagattgagggaaacctttacggactaaattggatcttctaaaatgtttcctggttttggtgtgtgacaaatgtttgttcataccaaggtttaggaaatccagatgtttaacagggcactgatggaaatcaaggagttccaatgtttaaatctttcatgtgttctagacctataggtctcaaagaatgtgtcatcttaaacagttttaattgtcttttcagaattgcaagaatatatgattaaatttcatgttctttggtatatttagctttcaaaaagcacctatgcgataagaaaattaaaaatctggacattctaggcagtttaagtgtaaacttctgccacatattttcatttctctgtgtacaccaaagacaaatacttatctacaaaatttgaccattttgatgattattatgagacatttgacagcgtggcttattggaaacagtctaattatatttagggattaaaagaaatatttcattgataaaaatataaatatactctgatatattgccttgaaccagtgattataaggaaaagcattaattcattctctatgtgaaaacactcattgaacatttatcaatatctataaaggtgggaggtttcaaaaaataaataataccaaatagtaaattaggaaagaaaagattgaatagagagacttttcaaattctaaagaagaaatttagggaatttcagcgacagaattaaccaagaacttctgaaatttgacatcactgcaggtatccaggactacaaataaaaccaggaaaatttatcaggataggtgctcttcttaggcctactaacaaccaaataaaatcacctatgcctctctggattccaaaaatatattcctgattgtgaccaattccggaaatccactcttgccagcatctgtgagaaacaaaaaaaaaaaaaaaaaaaaaaatagggtgaaggaaaagcaaaccaaaattaaggacaagttttgttgttgttttcttaaaacttcttgatgactttcagttcatataccagaaaacaaaacaaatcaaatcaaattactggagagaaaaatctacttaatagcatcctttaaaagatttccaaactttgatgtatatttttattaaggtcactttccattgttatcccaaatggtatagacatgatacagtgaaatatgccaggaaaatgtttggacatacaagtttgtataggaatcctgaatgaggataaattggcatttattgtggataaatgtgcaaacctggtttaaaagttccaagtataggcaaaattattttctgaccacttaactactccaacaacttctaatggcaaggcttcttggtgtcacattaggatgaattacttagcccttatctaaatgtgctctctgggtttcctctgagtacttattgtgacttcatgtagctgagggtatctctacttaagccaaatagaagaggggtacttacagcctatctagagagggcccttcactgaagcaagtaaggcttttatgttcttatttgcctccttagggtgttgttgctgatacctctccccagacagtggcaccttcatcccaggacaccagtggtcagcagcaacagatagcagtggacacatccaacgaacatgcacctgcatattcttaccaacagtctaagtaagtctgggctgtgctaagctcttttcctcaagatcagccatcttgacatcactctctcatgttgtatgtgttagcttttgctgaaatataaaccatcccaaacttagcaacaggcatttatttagctcatgattatgtgggtttgaaatttgggctaactttgggtggatggttcttctgatcttgacaggaatcaaacatctaggaacagctgctgattatctatgcatctctgcttctgggtgttgctagctgttggatgtgtgatggaagtgactaggccatatgtttctgatcctccagcaggctaattcacatggaagtctcagaatttcaagaatagtaaagagcaagcccaaatgtacaagcactcttaattctgtttattactaattttctactgtctcattagccaaagcaagtcacttggccaaacagtcaatgtagcagttcactttgaaaaagcttgatatagagagaggcactgcagccattaaaaaaaaaagctaccatatttattattggaaaaattataatattcctacctgaaactgaatagagtctcagtctcctcactcttaaaggaagacagtaacactcccccttgtagggttactttgaatacacagttaaatgtcgatgaaaaagggtattgtaagatatgaagcaatataaaatatggtcttattcaggaataaaatggcaaggattttcagaattactcttgaaaatccttaaatcactcataatgcaaagtacatttggctttgtgttgagtaaacatttggcaaactttggtaaagtttgagggctgtttattgaaaccaaaagaatttagaaaagtaaagtcttcatacaagtgtcttggcatgcaaactattcaactttgtagatagcaataaaatccctgatgaatagagaatcccccgacaatcctgcctgtctacagagtgctgctccgttatttaaaataatttttcttattaaagaaaaaaaatattctgatatttgttaaaacattaagaaataatttatttattaggttggtacaaaagtaattgcggtttttgccattaaaaaccataggtattaggccgggcgcagtggctcacgcctgtaatcccagcactatgggaggccgaggcgggcggatcacgaggtcaggagatagagaccatcctggctaacacggtgaaaccccgtctctactaaaaatacaaaaaacttagctgggcatggtggcgggtgcctgtagtcccacctactctggggtcggggtggggggctgaggcaggagaatggcgtgaacccgggaggcggagcagcttgcggtgagcagagattgtgccactgcactccagcctgggtgacagagcaagactccgtctcaaaaaaaaagaactataggtattaaaattattgcaataggggaagagagagcatgctcagttcagaacacagcaaagacagctggggatctgtagccaacaagccgagtgagggggtcagtgagtggggaattactgctaacctaaattgacaggatttttgctgaaggcagatcaaggaatgataagatcaaatgtaggggatgagaaaattgatcagatattgagggtggtcatatcaacgataggctattctctttaaactgacttagcaagattcttgctaaaactaggctataaagaactggcaagaatgggggcaaaagtctacgcctactcaagaaggggactcagtagcctgactaaaagttgagcaagaagagaatctgtcactttttaacttcagtatacattaagagatttgtttgttagattcatcaaagcagtaaactctattatgtgtggtttaggtctaaagtcagttttacaaattaaatttgctcagaatatgacttaaacttacaaatgtaaggtattattatgattgccattattaatagcaataatgactttcagaaaagattgttactgagtaaagccatatgttattgttaatttaattgacatagcctgtgtgaatcacttttatgtgcaaaactaatactgtggtagactctgaaactccagtccaagcatattgaaattttttttcagcctggtcaacgggttatatgtggggaaaggagcagatattggctatgtataaagcatagcaagagacattgattggtgggagatgagaaatactgtgggtaatgggaaattttatgtgaccatttgactgagccacagggtacccatatatttggcaaaacaatatttctgggtatgtctgtgagggtgattttggatgaggttaatatttgaatcagttaaagcagattccaccccccactgtgggaggcttccatccaatcagttagttgaacccctgaatagagcaaaaagattgaacctctcatgaatgaagaagaaggaactcctgttacttgactgctagagctaggacattggtcttttcctgcctttgaacttaaacaaaaatattggttcttcttagatcttgagcctgccagctatagaactagaatttacatcaactctttcagttctcagactttcagactcaaactagaattacactgttggctctcctgggtctccagtctgccagctgcagatcattgtagatcatgggacttctcaatcttaataattgtgcaagtcaatttcttattttaaaaaatctctgtatcggggggaggaaccaagatggccgaataggaacagctccagtctacagctcccagtgtgagcgacgcagaagatgggtgatttctgcatttccatctgatgtaccgggttcatctcactagggagtgccagactgggcgcaggtcagtgggtgcatgcaccgtgcgcaagccgaagcagggcgaggcattgcctcacttgggaagcgcaaggggtcagggagttccctttctgagtcaaagaaaggggtgacggacggcacctggaaaatcgggtcactcccacccaaatactgcacttttcccacgggcttaaaaaatggcgcaccacaagattatatcccgcacctggctcggagggtcctacccccacggagtctcgctgattgctagcacagcagtctgagatcaaactgcaaggcggcagtgaggctgggggaggggcacccgccattgcccaggcttgattaggtaaacaaagcatcccggaagctccaactgggtggagcccaccacagctcaaggaggcctgcctgcctctgtaggctccacctctggggacagggcacagacaaacaaaaagacagcagtaacctctgcagacttaaatgtctctgtctgacagctttgaagagagcagtggttctcccagcacgcagctggagatctgagaatgggcagactgcctcctcaagtgggtccctgacccccgagcagcctaactgggaggcaccccccagcaggggcacactgacacctcacacggcagggtattccaacagacctgcagctgaggatcctctctgttagaaggaaaactaacaaacagaaaggacatccacaccaaaaacccatctgtacatcaccatcatcaaagaccaaaagtagataaaaccacaaagatggggaaaaaacagaacaggaaaactggaaactctaaaacgcagagtgcctctcctcctccaaaggaacgcagttcctcaccagcaacggaacaaagctggatggagaatgactttgacgagctgagagaagaaggcttcagaagatcaaattactctgagctatgggaggacattcaaaccaaaggcaaagaagtcaaaaactttgaaacaaatttagaagaatgtataactagaataaccaatacagggaagtgcttaaaggagctgatggagctgaaaaccaaggctcaagaactacgtgaagaatgcagaagcctcaggagccgatgcgatcaactggaagaaaggggatcagcaatggaagatgaaatgaagcgagaagggaagtttagagaaaaaagaataaaaagaaatgagcaaagcctccaagaaatatgggactatgtgaaaagaccaaatctacatctgattggtgtacctgaaagtgatggggagaatggaaccaagttggaaaacactctgcaggatattatccaggagaacttcccccatctagcaaggcaggccaacgttcagattcaggaaatacagagaacgccacaaagatactcctcgagaagagcaactccaagacacataattgtcagattcaccaaagttgaaatgaagggaaaaatgttaagggcagccagagagaaaggtcgggttaccctcaaagggaagcccatcagactaacagcggatctctcagcagaaactctactacaagccagaagagagtgggggccaatattcaacattcttaaagaaaagaattttcaatccagaatttcatatccagccaaactaagcttcataagtgaaggagaaataaaatcctttacaaacaagcaagtgttgagagattttgtcaccaccaggcctgccttacaagagctcctaaaggaagcactaaacatggaaaggaacaaccggtaccagccactgcaaaatcatgccaaaatgtaaagaccatcaagactaggaagaaactgcatcaactaatgagcaaaataaccagctaacatcataatgacaggatcaaattcacacataacaatattaactttaaatgtaaatggactaaatgctccaattaaaagacacagactggcaaattggatcaagagtcaagacccatcagtgtgctgtattcaggaaacccatctcacttgcagagacacacataggctcaaaataaaaggatggaagaagatctaccaagccaatggaaaacaaaaaaaggcaggggttgcaatcctagtctctgataaaacagactttaaaccaacaaagatcaaaagagacaaagaaggccattacataatggtaaagggatcaattcaacaagaagagctaactatcctaaatatatatgcacccaatacaggagcaccaagattcataaagcaagtccttagtgacctacaaagagacttagactcccacacattaataatgggagactttaacaccccactgtcaacattagacagatcaacgagacagaaagtcaacaaggatacccaggaattgaactcagctctgcaccaagcggacctaatagacacctacagaactctccaccccaaatcaacagaatatacatttttttcagcaccacaccacacctattccaaaattgaccacatacttggaagtaaagctctcctcagcaaatgtaaaagaacagaaattataacaaactatctctcagaccacagtgcaatcaaactagaactcaggattaagaatctcactcaaaactgctcaactacatggaaactgaacaacctgctcctgaatgactactgggtacataacgaaatgaaggcagaaataaagatgttctttgaaccaacaagaacaaagacacaacataccagaatctctgggacacattcaaagcagtgtgtagagggaaatttatagcactaaatgcccacaagagaaagcaggaaagatctaaaattgacaccctaatatcacaattaaaagaactagaaaagcaagagcaaacacattcaaaagctagcagaaggcaagaaataactaaaatcagagcagaactgagggaaatagagacacaaaaaacccttcaaaaaattaatgaatccaggagctggttttttgaaaagatcaaaaaaattgatagaccgctagcaagactaataaagaaaaaaagagagaagaatcaaatagacgcaataaaaaatgataaaggggatatcaccaccgatcccacagaaatacaaactaccatcagagaatactacaaacacctctacgcaaataaactagaaaatctagaagaaatggataaattcctggacacatacactctctcaagactaaaccaggaagaagttgaatctctgaatagaccaataacaggaactgaaattgtggcaataatcaatagcttaccaaccaaaaagagtccaggatcacatggattcacagccgaattctaccagaggtacaaggaggaactggtaccattccttctgaaactattccaatcaacagaaaaagagggaatcctccctaactcattttatgagggcagcatcattctgataccaaagccgggcagagacacaacaaaaaaagagaatttgagaccgatatccttgatgaacattgatgcaaaaatcctcaataaaatactggcaaaacgaatccagcagcacatcaaaaagcttatccaccatgatcaagtgggcttcatccctgggaggcaaggctggttcaatatacgcaaatcaataaatgtaatccagcatataaacagagccaaagacaaaaaccacatgattatctcaatagatgcagaaaaagcctttgacaaaattcaacaacccttcatgctaaaaactcttaataaattaggtatcgatgggacgtatttcaaaataataagagctatctatgacaaacccacagccaatatcatactgaatgggcaaaaactggaagcattccctttgaaaactggcacaagacagggatgccctctctcaccactcctattcaacattgtgttggaagttctggccagggcaatcagccaggagaaagaaataaagggtattcaattaggaaaagaggaagtcaaattgtccctgtttgcagatgacatgattgtatatctagaaaaccccatcatctcagccccaaatctccttaagctgataagcaacttcagcaaagtctcaggatacaaaatcaatgtacaaaaatcacaagaactcttatacaccaataacagacaaacagccaaatcatgagtgaactcccattcacaattgcttcaaagagaataaaatacctaggaatccaacttacaagagatgtgaaggacctcttcaaggagaactacaaaccactgctcaatgaaataaaagaggatacaaacaaatggaagaacattccatgctcatgggtaggaagaatcaatatcgtgaaattggccatactgcccaaggtaattgatagattcaatgccatccccatcaagctaccaatgactttcttcacagaattggaaaaaactactttaaagttcatatggaaccaaaaaagagcccacatcgccaagtcaatcctaagccaaaagaacaaagctggaggcatcacgctacctgacttcaaactatactacaaggttacagtaaccaaagcagcatggtactggtaccaaaacagagatacagaccaatggaacagaacagagccctcagaaataatgccgcatatctacaactatctaatctttgacaaacctgacaaaaacaagcaatggggaaaggattccctattgaataaatggtgctgggaaaactggctagccatatgtagaaagctgaaactggatcccttccttacaccttatacaaaaattaattcaagatggatggattaaagacttaaatgttagacctaaaaccataaaaactctagaagaaaacctgggcaataccattcaggacataggcatgggcaaggacttcatgtctaaaacaccaaaagcaatggcaacaaaagccaaaattgacaaatgggatctaattaaactaaagagcttctgcacagcaaaagaaactaccatcagagtgaacaggcaacctacagaatgggagaaaattttcgcaacctactcatctgacaaagggctaatatccagaatctacaatgaactcaaactagaaaaaaacaaaaaaccccatcaaaaagtgggcaaagaatatgatcagacacttctcaaaagaagacatttatgcagccacaagacacatgaaaaaatgctcatcatcactggccatcagagaaatgcaaatcaaaaccacaatgagatatcatgttacaccagttagaatggcaatcattaaaaagtcaggaaacaacaggtgctggagaggatgtggagaaataggaacactttgacactgttggtgggactgtaaactagttcaaacattgtagaagtcagtgtggtgattcctcagggatctagaactagaaataccatttgacccagccatcccattactgggtatatacccaaaggattataaatcatgctgctataaaggcacatgcacatgtatgtttatagcggcactattcacaatagcaaagacttggaaccaacctaaatgtccaaatagtctggattaagaaaatgtggcacatatacaccatggaatactatgcagccacaaaaaatgatgagttcatgtcctttgtagggacatggatgaaactggaaaccatcattcccagcaaactatcacaaggacaaaaaaccaaatactgcatgttctcactcataggtgggaattgaacaatgagaacacatggacacaggaaggggaacatcacacaccggggactgttgtggggtggggggagtggggagggataacattaggagatatacctaatgctaaatgatgagttaatgggtgcagcacaccaacatggcacatgtgtacatatgtaacaaacctgcacattgtgcacctgtaccctaaaacttaaagtataataataataaaataataatttaaaaaaagacctaaaaccataaaaaccctagaagaaaatcaggacataggcatgggcaaagacttcatgcctaaaacaccaaaagcaacagcaaaaagaagccaaactagacaaatgggatctaattaaactaaagaacttctgcacagcaaaagaaactatcatcagggtgaacaggcaacgtacagaatgggagaaaatgtttgcaatctacccatctgacaaaggtctaatatccagaatctacaaagaacttgaacaaatttacaagaaaaaaacaaccccatcaaaaagtaaacaaaggatatgaacagacacttctcaaaagaagacatttatgcagccaacaaacatgaaaaaaagctcatcaccactgattatcagagaaatgcaaatcaaaaccacaatgagataccatttcatgccagttagaatggcaatcattaaaaagtcaggaaacaacagatgctggagaggatatggagaaataggaatacttttacactgttggtgggagtgtaaattagttcaaccattgtggaagacagtgtggtgattcctcaaggatctagaaccagaaataccatttgacccagcaatcccattactgggtatatacccaaaggattataaatcattctactataaagacacatgcccacgaatgtttactgtggcactgttcacaatagcaaagagttggaaccaacccaaatgcccattaatgatagacttgataaagaaaatgtggcatatatacaccatggaataccatgcagtcataaaaaggatgagttcatgtcctttgtagggacatggatgaaactggaaaccatcattctcagcaaactaacacaagaacagaaaaccaaacactgcatattctcactcataagtgggagttgaacagtgagaacatggacatcgggggtgggcgcatcacatactggggcctgtcagggagtgggggactaaggaagggataatattaggataaatacctaatgtagttgatgggttgatgggtacagcaaatcaccatggcatgtgtgtatacctatgtaacaaacctgcacgttctgcatatgtatcccagaacttaaagtataataaaaaaaagaaaagaaaaattaaattattaaagaagtctaacagtttcatctacaatttgtaatttagatacctatgtaattctttcaaggacaatttttttaaatattcatggctttctttatgggttccctaaccacttctttaagtttacctgtgagtaatccagtagagggaatatactgtgacatttttccacactctggatcacagaatcccactttttacatagcattacatgaagctagtctgtcaggaattattctggaaaatattgcttcatttggctatctctgagacttcctcctcctctaaaatagatttctaagattatcgtttgttacgttccaatatattcactgtgccttttttttgagggtggaggagtgaggagaggattcaaaatgactctgtattcttaaattcagtgaaattcctactctaccatatttactctgactttagaaggccctcatctcaaccctggtattgcaagttctttttatacttcaaatcttctctggctaactgaactgccatgaataccaaatttctatacattgtcagtatatcaatgatgagcaaattatgtccttcacatttgtgagtaatacaacattctatgtattataatatattgtaataatacattgtatgtgcactgttttaccgtttgcaattgatttccatactcattatttcttcacatgaattcctgttttcaagttatttctttttattttatttcttattttattatttattttatttatttattttatttctaaaatgtccaacttaaaatgttcttgttgccaaagatcccagcctaaaaaaaattaaaacccttctgtttttaggaatttcagtgcaatccataagtattatgtaaatgtgcacattcacatttattctaggacagaggagatcggcaggagtgaattcagttctttgaaatggcaagatcctttttacttcaaacttcagccagcaaatatgaagttgtaaagtactaccatctatttgccatcatttgttttcatgtggcaatgggaccattttaaagaccaagcaaattatgggagagggctattggaaacatttgtgtacagttataaaacctaaagtagttccagcctagctcataaatatatcaatgcttttgagaccagtgaatatcaagtacttgagcttgatgggtcaggtattctatgcactgtagtccactgaataagacatcattcactgagcagctgctaaagagattcatggtgttttaggcatttttggttcagtacacaataataccagagtagaagatgggagtgagaacaaagaacagactctcccccaacacacacacacatacacacacaactatataaccaagaaaaaaaattgttcccttagtaatatagatttttagacataaatggagtaagtctatagtttgcaaagctagagacagttaaaatataaaccatggttcccatgactaccactaataaaattttttcttattgttgctactgtatgaaaattgtaattgctttacttcttagaagatatctcactttctcatataacacagtaatatatttttagggacttaacctattgataaaaattgaatattcgatctctcaactagttgctttcctcacatgattttaggaagaaattaatcaggttcctaattgccgtagctggctcacatgatggctttttgcaaatcaggaaactatgtcctttccaggccatctcaagctaaacaatacacagtttaaaacactgtgaattggggttacagctttcctgcagggtacataccttggggagcagacgatgggctgaaatttagcccccactccctcaatcatacatcttatatagtaaacaatctgtaaaactatacatagtaacactgagtcaaatttactaaattaagcaactgtgcatcagaagaacttgcataactttttgctggcatccaataccctgagcaaagaggccttcagctaaatgtaacttacagagataatatagaggtccttctttctatagcaccactctgaagttattttacaaacttctaatctgtgggcaaaaaagctaagagtaaagtcatcctgctggaaggttaaccttgcaacatagaaggggcagtagcagaagtctttatttgacatgagctaagcaaagtggcatatagtaaaatgatatttttctagttaaacacctattgtgtatataccactctgcctaaagggtaaagggtagaagtaaaatatagttcctgctctcacaaatttataatcttgacagggggaatgaacaagaaagtagagaaggggaagaggaaaagagaataaaactgcattggcctcttaactgtctcacttatttcctcaggcaataagccttatgtaaatgtacgtgatgaataccatgagataacatacaacccagttattttgggtgcatagtaaagaatctcatatttgttgctggaattagtgatgattcctatagtagttttgaaggaacagaattactcaaaggatctgtaaggagctataacataagctattacccttgatttttaatgtaaacaaactctctggcccaaatctgtatttaaatgaaagtggcagaatttgacaatctcatagactcagtatgattttatgatgcttttgtgactatgttacattgaaagcttggtatcttttaaagctgcctcattggaaaagggcacagaaggtgatttcaaagttactttaatttaatgaccactcttattcaattgttttcacagaccataaacaggactgaagaatgtctgtctgaatctttgccttgaatgaagaaacttcattgaacaagaagttggcttccagtttgcacagacgtcaatggaatgcatttttttgttgttgttgttgttttttttttagtgttataccttacccaatgaaagcaaagtttttatgtgctgtgcaaatggtcttcatgtggtctgacaatttatttttgccatcatttttttaattaaagaaaaaatttccagaagaggaaaaaaaaactacaaaaaacaaaacattgaaggttgatattttatgtggaagaacatttgaattgaattcagaatttttctgaaggtgtagatactttttttttttttttaacagaaaacctgatgtcaagaggtgggcaatagaaatggaaacaaattgtcttcctcaataattaagctactttctctttttcccttcttgttttaatctagtgggttttttattttattttttcttagaaatatgtaggtaaggtttatcttgaatcttaattgccttaattttaaggacgtcaaaggctctcgaggcaagctgtcaacgtcttgttgaaaacaaaaatcaagaaagaattgaaatactgtgccggctttcactggcacagaagtttaagactatgagtttttagggtgaagaaaaaactgtacagtttaaatgaaaatgtttttcttcatttgaagaaaatttgttgataaaccatggcaactgcaagaattggaaaaatgctgggacttttcatgaactttgtcttaagtgttgacatgaatcattctaaaaggctaaaacattttacagtaaagttattaaggttggtttaaaaacaactgcattagaaataatgcgtgtttggggggcagaatgcagatttttttaatttacaaagcgtgatcgctagcaaaagcattagtgctttttatctgcagtcttttttatgagctttacaaagtttttagtcagctttgcttgtcacattgcaaaacctagcttaagagcattaaaaaaaaaaacttaagtagataggagcttatggtcaaaaagtgcaaaaaaaaaaacaaaaaaaaagcaatagatagagaaattgttgacaatttctgtagtctttcctagttgtgatcaaattcagcctatggatggcctattttataccaaagatgaagtgacaccctattacagtccagaagatagaggttgttttcgtttcttttctttttaaaaaaaaaaaaatttatttgaccgacatggccggaccagttctttctttgttgtttgtttaaactaccttccactggtgttttacatagtgcaaaaaaaaaaagagggtggggggagttgtctctcttttctttaaatgtgtattcattgatagcagaagcttgtacctgctgtgtttagcagtttcagcatgaagagttctggatatgaactgattcatagagccaagtggctttaaattctgtgagcttttctggtttctcactagctgtcttgaatagtgaaacctgtattgatggccactagtaaaccaagatgcttatttaacaggtggaatattctttatatgaaatttcagctaaagacactttctggacctggtctgaaaggtcatttgtcaaaaaagcttagggatattctgtgaaatggtgagtggtctcctggaaaggtctcattgtatttgaacaatagtcttccctctaaattacaacacctctgggttttgtctttacacctctgtctttgtcatcacctaccatgaatagtcaccttggttttgcaaatggggagggggtatcatctttttgcctgttttcactgtatttttgtatattggtgttgccgaaagaactttttctttcagtttaattctttgaggcatgtaggaccaataagattgagaattctattggtggaatttagggaagtccttaaaatgctagttgacaatcaaggaacagtatgatttatatcaataagaaccaaaagaattaggtttgatcaatcatttaagccaaggaggaatacttgcatttagaacaatgcaaaactttgtctaaaatgaattaaattgacccacctgtaaaatatatctacatttttaattcatgagatgatatgtgttcaacctttacagttttacctgaaattaaggacaatggaatagaatttgttaagtgaaccattcactagattgctttctgaatgaatcctttgaatcaaataggtgaaactcttttcaaaaactaagtcagtcacaggagcctgtcttagtccaaaagaagcagggaaatgtatttaagtgtactataaaacagggtaggctttttaaaaactaaaaagttttaaaggtaaatcatattcccattaggtcaacatgagtaataaggttgactcatgtgaaattgtcaatattctactatttctgtaaactctggttctcttatttgcaaccccatgcactggaagcccaaatcagagaatgactccatatatttatggtcacattggagacaaaagtgtatccaagaaaatgtagtgtgcgttatagagaaattccaactggtcacactcaccattatggtttttcatgctttagagaaaatgctagatttatactgtcttttgttccatccttcagcttcccatgcattataaaggtggcacttaagtttttatctttgaaaagtgggccccaaagttttttggggtacaaaaagacatgtatgagaaccatattttctgtttctctttttcactctctaaactctttttgtataaataaggattatcctgggcataattcatttgaatatgaaaccaacatactttctttcatttttgtgaaaaaataaccaaaaacatgtattaatgtgatacaaagaaagtctcattcacacaatcaacaatgaggctaagaggtagctaccatgtggctaatgaatgtgcctaggtaacttcctgtttctattcaaaactgctgctttatttgtacattcagaaatatttttttcaactatgaaatttcaatatcaattttttaagccagtttctgcaaaaggaaatgacctgtcatttgatgtgttcatgtgtgttttgtgtttggatagtttatatcatgccattctataaaatgtatgttttcaaaccaaaaagaaaaaaaatagaaggaaaacaacggcacatactcaaatttgccctgctttgtctgttgtcttacctaagacttgttttgaagagccaagtctgggagagaaaaaaaagcatcaacaggtaagcagcattacattgtgtggtaataaaccaaaataagttttcaatatatacagacaacagaattcaaatttaatcaacaaaatatattgtagtgatttgtttgtttgtttgtttgagacggagtctcgctctgtcgcccatcctaactaggactataatctttttttttttctttaagttgaagttaattttctgtgcattctggtccaccagattttcaagcatttatttggatgtttccatttttccttttgactttaatagccaagacttagcttaaacatcaggaaacaaactaaagccacaatccaaatgagagaaacactgtctcgtctaaactctagtttcatggtcagtgcaacagtgagttttcttttaataatggtatggtattgtcaagggaggcaaagtgttcatggtaacttggagctccccaatacatggccatgtcttctaaagacaacgtaatgagcccaagtgaactgaaggtcatactggcaggtgctgatgacagtttgtccttgaatgctgacatgtcttgaatattgcaaatgtcataatactcttttaaaacagtcctctacctgactctagttttgcgaggattagtttgtttccttggtagatttcaacatttcagaatgttacctccaaatttcacttgaattacttcctcctgtgaccttagcagatctgtcacatttgaaagcatatgactcacttccacccccttctaatgaaaaactgcatggtgttaaaagcactctcattagaaatataaggctgagaactgaagaaggctgtttaaagcaggaatttcactttattttactatgcctaaaaatacatctttggaccccttgcaaagtgctttaaaagtactttcaatttatgcatgactccaaaaaagtaatttttttttcccaaaaaaacctctttatttaaataattgggatatttgctaaatacctatttttttttacagtggcctaaaacccctattaatgaaaagtgaaatttgatttaattaggactcttgcagtcatcttcacgactgaggagaagtttcaataggctgtctagacattatgatgttaataggagattaaaatacatttggcaattcattttcattcttaatttgagtgcatgaaccactgcagatgagctgataagcagaaattctcaagtgggtttcactaataaatgtttttttatatgatttgaaatcaagtaaagggacaatgtttatgtacgtgtataacaacattcagcacatttgaggaatcacacactataataaagcttaaacctgtcatagaaccttgatctatattactttgtcttcagtaaaaagtgaaggatgagattttgtctttcatgttattgtagctggcatgcttcaaaattttgagcttactgggactgacagcctctcacttcaatctgagggattgacagaatttaaacaggctcattgattctgtacactctacccttcctgtggcaagtgataatgggatttcattaatgaatcaatttgttttacaaatgacatccactgtggcattggaagacagttgggtctgactcaagtttaacatttcttaccaaacattcttaagtatgaaattggtcctttaatccaaatgctcttggtcatggctgtcctttgcggattacatagcattcaggaaagtacaaaaactaaacactaaatccccaactggccccaaagaccttttatgatgtgagagacaagagttcaccccagattaatttcttttatcattggctttatactctaacatatagatactctctatagcaaaaaagggatgaatggctttcaatattcatttctgtttatttttgtgagggaaaataatatatcaagaaaattttcttccacttagaaagctttaaagctgaagtagaggtgcagtcaagcttggatctgcaggaagaaccactaggccactgagtcatacttgagcttttcttactactgccccaatttctaaattgtgcataaatacaatcactctcaatttttgaagggctaattatctactttgtgggtgtgttttgttttttcttttcagcgtgtagggcttgggctctgtttccttttattagcatgtcacctgagggtggaacaaacaattggaaataaaatttgattattttatttcttataaagtattaatttcttaagggggtttgaaatcattggtaaaattaatatcagtacattatatgtcataaattttgattatctataatgtcttttcttatctaccacaaataattgagagttggctaaattcttgcagaatatatgggaaaaaaatcatagcaaagaattcagcttccctcaaaagaaagctatttttgtttccttcactccactaaatttgaaccagtagcacggatcaacacgacttctgcaatgagagtataacggtagctcttggtacagtcatattcatatttttaaatctttctttgaccaaaactattgcattgttttcattacattttgactgcgttacttattaaggccgaatgactttgacacccccgtggattatttttatgatcacatcaaatttaaacaatgtccaaagtgtaactttaatgttatattttgtttcaaaccctctggtctaagattattgagaaagatgttttttcctcctccctcaaatatgttatctcttcatatataaaaaaataagttattccatgcttttcaggaactgtaaaaattatttcaaaaagatatttgaaaaagttttctctattctggacacaaatgcttccatttatttcaaaagaagaagaagaaaaatggaatcttaatttaaaaaaatatatgtagtagtatctgctatgagatattcagtctctataaaaaaaaaaagggacacagcttcttttaaaacccttgtttcagtccatattcaacttcatggaacttctgaaacatcattcaattttgaactttatttaagagcatttttgtactgctgtctctgactgtcatggaaagttctgtaattctaaggtgtttctggttttatttttaatttcttcatctgtaccacagtcaaattagcaaccatctcccccatcccttgggctttctgtagatcagtggatgttaggtttaaacttctgttttctttgatgaagctttcaataaaaaatgaaaataaaatcaattgaatagg

SEQ ID NO: 1202 - DNA, 729084 bp, Homo sapiens; identical to SEQ ID NO: 1201

SEQ ID NO: 1203 - DNA, 729084 bp, Homo sapiens; identical to SEQ ID NO: 1201

SEQ ID NO: 1204 - DNA, 710007 bp, Homo sapiens
tttttttccccctttacgaacgctggcaattgacatcactacagacagcctggttagagaacaaactgcctcatcccaagtggaccccggcagctgggggaagccaggcaagatctgggaaggctgtgtgtgggtgttttttctacagatctcactcctcgccctttttttttttcctttggtgtgtgttttttgttttgttttgttttttaaaaaaattcttgctgtgttggaactagcgagtggtggagtctctgaagcctcatcagtcaccgggactgtcaggaatagtggtttaagaggaagctcggcctggggcactataccctgtcatccagttccctgcctcggagataaagattccagctacatgggcaaacgcctggatcagccacaaatgtacccccagtacacttactactatcctcattatctccaaaccaaggtatggcttgacccacggtctggcgatcagcgtggtatcgttctgcacttgggatgggaaacagacaggcgtgtgaattattagttaacccccacccccatcacttcttcctgcttctttgaaattagtgacataccaatggagttaatgaggcagaggaagacataagaagaaagcagcaaacccggaattgtagctttctctttaaggagagataatagtttcacttgagttcagtttctttgttgttatttggcagcataaatggtcctgatatcaggaacgtcttttgcagatgggcacggtttttagaaagcagatcacaacagtgattaccaggcacaagaatataatttcaggggcttttctggtgagctgttctttgattgtggctctaaaagggtttttcccactggataggacgtgcaacggtgggggtaactcaaacttttaatcgcagggtatagaatgaaagaagggtgtgagaaggtatagggctcctaccagagtctctgagagtttatttttatttttaatttgccttgcctattttattttatgttgaggatgatcagcatgctacagactgctttacaatagatgttctttacttttagaagatctatttttctgtgtagctgccatgaggaggcctgagtcttgaaaaggaatgaaatgtaactgatcataattggacttgaattggttaaatactttaggctttatgtgtgtgtgtcaaatgaccattaggggcccagaggcaagcccacgtaagtaagcagtgggcagtacctaccctgaactttatcctgcagttaagacatgaaagactctcaggtgtgaaatcactgctccgatttgtcaattaaattggacttgattagggggaaaacatgttagcggagtgaccacctcgagtgtacgggtgatattattttgtattgcattagcattagccagactccaccgtctccttaataaataaatatgccgagagtgaacaaggcgtgcctgaatgatctatgctgtcaccaggactcggtgatgtgattagggttaggtaattcatgctgtagttatctgtcatttattttgtctcgtccagcaacgcctatttgtaaaccagactgggaagcagactttcagtattatacaaaagattattgctttgtttttttctttttcaattgctttgtaatccaccctgcccctccaaggtcgactcacactgctatttgcctttgtgagcatttagtttgtgctgctgatgcttaaatagactagccctcctgctcggtgccttaagttttaactctttgggggtgttaggttgagaatgctgcctgccattcctcaaggaaatggcagagcaaggacaagttaaaaggggaaaatttacagtcatttctcatgcctcaacaaaacaaaaacaataaactcaaaggttgcatgaaaaatatcagacattccatcccttttactcatttggctacatttttccaagtgtttcaaaaattacactttgtttcgggtccttgttttctactatggtatatattcagaaaagaaactttagattgaaatgaataacataattgtttttctgtttgagacttcttttaacctattactaacaggaaatagtgaatgttatgcacattttttcaaagacacaggctgctggatgagctatactagtagaaagtgtgtgcgagagagagaaagatggggggtaaagagagagagtggagtagtgagggaaaagagaggagcctgaaaaatagggagattgtagatatctgttttggagttctatgtagtttagtgttgtatagacaggcggcatctggatcttgttactctcaagctagccaacaccttgaacttctggaacatttttaaagaagttagatccattaggcgtcctatgttgatatttggataatcagatcaggatagtagggaatataagatcagctattttgcctatcatggtagttcacattgattattatgttgtaaaatgttgacaatgctttgaagttgtcctgtattgttatggtggctctgaaatgacagacattaatagcattcctggaagctgaagatgagaaaatgtgccctgttttgaaacttgcatagagaggaaatgagatgaagagtcaatgtgcaatcatattttaaaatgtgggtactggggattttctgacagggttaatactatacaatgaagtaccatcatgtttcagtgtaacaggaaaacaactgggttatttccacatcactttttgttccttctacacttatacctcaaaatataatttataatcattttaaatgaagtacatgctgcttatatttatttggtaagcctgggtggaattcataaaatccactctttgtagccttggcttggagttataatccaatttgaaattcatagctatttaaaatgatgctgatatgtcaataatacttatgtttgatgaaaatagagtctacggtaggtaaaaatcgtattctggtgataacatatcttaaatttttctctaaattgaggtaggttttcttcctgccaatccacaagggctatttactatcattagttttttggggaaaatcttcatgggattttaaaggattgaaatgtttattactacattatttcagaaaatgcacacatgctgaactctctttttctacttgtgtaatgataaatacctttgctattttttaatgataaaacaaaatgaaaatgagatttaagaaataaatgcagatgtttccattccctggaatacatagtaaagttttagaagaacttgcgacacttccctgccttctctgctcctattattttccattgcattggaatgaatctctcaactttgtttctttaaaagtaaatgtttatgctccttcaaataatttttcaaatccttaaaatgttatatattagaaaaatatacatgtaagttaagatgaaaacccagtggctgactcatatctataatgtgtaacaatgttgtcatcctgtgctccctctttcacacctcacgtctttaaaaagttgtcatttgtcaattttctttttgatgaatttttctttttttttttttttttttttaccaaaagaagcaatttcaaggaggaacattacttcgcttaaggaataatgaagaaatcttagtgatatgttgtaatatttaaataagaaacaaccggatgaaaaaatagtttatcaaggcaaatttgctgtttggaagggacacccagaataatcagcaagttttagagaaaaagggctcaaaaaatagttcattagcttaatgacaaaatacaaaatgtttgattagttgtaatccaacattttttaagtattttatcaccctttccaaaaaaaaaacaacctgttgctgttgacttatgagatcccagctgaatttcattctgaatttttgaggtacttgccggggtggggtgggggtgggggtggtggtggggagtaggtgggggtggatggggggttcttgaaaaaaaattagtcaagctaggtaagctaaaaagaagaaaacctggttacagcccggtgaattgatttttttccagccgagaaatagatatttctctcacatatatttggaaaactttagtcatcttcataaaacttaaaaagttacctaagcacacacagcaagtttctcctttcttccttttccacacccttaccagttcactatgtttctaccaatccagtgcccagttgccaatgatgttgctctcacatgaatttactgcattcccttctggttccccagaaggtcttgaagaaagaggttcagactagtggacccaaacagaatttcttggctggtgatactcagattgtgttcagagcctggtatgaagaaggggccaggtgtaagaagtagttaatcaactgcacgttgatttcaggctgaatattcaaccatctgcagccacccgtctctaaaagtctagctgaagcacaattgattgtgccatagaatgagcaaacgcttgaaaacacaagtaggtgaaggaagagaggcttccacggagcaaaggatattcttaaagatgtgaatgtacagatccttcaaaagcaaaacaaaacaaccctgtaacaccctccttacacatgaaaatgtagaaaatcttgcagagggagggaatgagtttagaatttccttagtacttcctgcctcagatttgcattgatatccagttggtaacttgccagttgttttaaaacagccttgaaaactccaaagttctgttttcctttgaaagcctgaaacatacaaaactagttttctaaaatcttccagcgatagaatttttaggtacaactccaaatattttctttcgcttcggggggtaatataatagcatgaaactatgatagcatgaaactatgataaatcctgtttgtctcactttagactgtatagaatttttaattggtttcaaataagaggaaaatagaaggaaggggccatccttgtttcttagttttgtttttttttcttaactcccccaagccttcattatcagtgggattgaacacaatcccagtgcatgttttgctattttttttccatgatatagacattgtttttgcaacactgagtttggtgcctacttaaaaggagtagaaacgtaaaaagttcatggtattttcttttctccagaatggattcaaacttaaggaaaatatcatgtatatttaacagcatctttctaaagcattttcctttcactttctttcaatttggaaaaaaaatagcacaaaattatagcacaaaattatttccatgaagtaataaaatgtatctgagggctgggggtagggataatttgcagggagggacacaatatagaagggaggatgcaagttcattctaggtctttctggcttcaggaattctggaaagcttcatttttgcactagtatgattttacacaacctttttgacattatcagtcttttggcagagagagttcagtcacaattatgcccatgtcaaattctaaaatcaaaccaaaacaacaaaaaaagtattttcttttaaaataaaacttttttaatgtcaaacattttattcagagtaaatggttgatgtttattcaaaattggcttcaagtactacattgaaattgttttgtaacagtctcataagccacagctgtatgtgattaaatagtgtaatatcaaaagcatgtgagaatagacgtttttatgctatagctattgcacagcaagagtgcagatggaactgaagggagaccaaaagcgaaaatgtattcatgtggtgtaatacgtgtgttgaggatatgtgttgctattttttgcagtagtgggaaaatgttgaactattttggatgtgcttagaaaatatcctctcggaaaacggaaacagacatataataccatttttaaaatgtggagtggatcatgccatttaattagaaaacacataggtgctgaatagatctgaaaccaattcaagtggaagaatgaaaattattcccattgagtacacattcaaaaagcaaaagtgactttctcatttctgttttgaaattataaatttttttttactactttaatttatggaactattgtaagaaaaccttcatcccattgatacctaaagaaaagtattaggcaataagaatcagcaacttacagatggcaaaataggtggcagtatattgctttttaaagatatttggaaatatgatgctcttcagtgttgtataaatattgctcttttcttaccagtgttaaaaattacaaagatacacaaggacatacaacttttgcttccatttctgtaacagagatgttatcgtaaagaggtgtctagttttaatgaggtgatttaatacagtgtttttgaaataatatttgttaataaaaattaataacctctagcttcctagagataataaatctataggattaatcatactaatcatcactaccattcatatgtgattgttttcagggccttgagaaagcttatagaattggctatttttagatttcagattttagacagaagtaattttaaaaagaaaaagagagtggcagactgagatgagttaaattttgcttggttttgtttttatttttttttattttaagttgatattggcagataatctggtcttattaaaaatgttttgttttatccatgtaggtttattactcagggagtatgtattatgtggaatcacgaataaaattttaataattcaaaaccaattcctaataaatatcaaatttcaaaagtaaggataataaaagaaagataatagatcctatcattttgtgggggaattctctgatttgtatgtcaatgcattggtttctaggttgggttccttcactaggatcccttccattgtgagatagctgagcctgctttagtatcttagtggtatcttcaggtgacctcggttttgtgtcattcatgagtttttcttttgttcccagatgctttccacagggcagatcaaatgctgctttactggctctctggtgatttgaaaaatttaactgtcttcatcctttcacacatctaaatccagtgcactgagagaaacacgtccatcacttgggagtgggtggatagaagttcccaggagtggaacaaaatgacagccattctttaatcatgaccttttccagctttattgtggtggttacaatttttcttctgagtgggtaaaattaaggtgtatccaaaaacttaattgtgatagtatgatgctttacttttcctcatttaacttcctctctacaggtggtgcagagctaaatggttatgcatgtttggctaaaccagttgagttaatgaaggagactagaattgccacattaaaatactgacaactttagtttcatgaatgattataaggagtcagtgtaactataacaattaatgaaatattatttcgactgaatccaaaacctacaaatccgcaaaacctacaatctctgaatctcagaatagtagcctagaaaacgtgggaactgaatactgtggttacctcagctatactgtagtattgtaggagggaaataactccccaagggcatataaacaagaacattatcttttctactttttcttttgagattcccttcttgtttttcaaaaagcccctgttagctgaattaatgaaagcaaatgacatatgctattttaaattattatttaagctttgaaaaatcatacattattttcatataacttagtccataagttcctattatgcttgcttctctgagtatatttggagtataaaacaaggaagataatcctttgggaaagttggtttctgttcatatcagtctgtgtgttcatttattcatttgtgaaatgggtgaaataaccctgacctcaacaatatattatagtggcctctgctatggaaggtatgaagttactgaactgttaagagaagggtggtccatacataagtagcaatgttatcatttctgaagcccaactgcatatttttatttactttattacagactcagctctgaggtgggtagcctgtctttaacacagaaaagagtttaggaactcctcaaatgtgtaaaggccatttctatttgctgaagcatagctcttcaccacttaatcattgaaaattatgttgtagaatatttagtgatgggggaatgtttataatacatcaaatggttaaaacagttaactatgttcctaatattataaaagcataaagaatccaaatatagacatataaaaaggcttaaagaaaatatatcaaattctcaaggaaaataaaaagtaaatggaacccggaattttgtttcatgaatgataaatacaaaagtgagactcgactacatgccttattagtcaagggaaccctaatagtgccctttcctgttgtgtggaaagtaaggtataataggagaaaagtaaatctaacaatattttaagttttaggagctgacatttaaatttgttttagacttaactttcctatcattatattgtgaggttaagaaattggcatatattacattcaatatgctagatgcaaatgatcttctggtcatcccactcttagctgataattttcaagctgaatatagatcatgcatagaatttaatatggatttttttagagacagcttattgttttttaatcctgtgtactactacttagtcattttccctgactgatgacaatttaatgaaaagtgaaataaaaaacaatactaactatctggttttctggaactggttaaaatatattgaaagtttttcttatgtatgtgagtcatatttgaggctattgtcgatgtctgtaaattctcatgttgcttcttttaacacttgtcaatcatataaatggtattctgacacccaatatataacttaaaattaaataacttagaattcaagcaaatatattttttaactagttttgagtaggtgaagtatttgaagtatttaagagacttggaatgattttggtgacattatttgctaataattaatctcatctccatctttatgtaaaatttcagattgttttccgggatactcaacagataaatatgtgacagacctatggcctttaatttcttcttgaaagatgagaaaacaacatttcattttctttgacttggtgggaactacccttggagggtggtgacagttcatggattaaccctggtatcctgtccattaccaatgtacaccaattctgactgcatctttagaaataagaatattgcatttttagtctaaggtaggtagggaatcctggaaaggataaaattctgatgtccttttctcaatgtatttcaaaaaaattaaccactgcttttaaactttattatttacctgtttaggacaatttggcttcatgttagcaatggaagtttctctttctgactcgtgtttaactttgttgttgagctggaaaaacacaagaaaaggccagtgggaatagatgaaagaacatgcaggaatttctcttcaagttttgctatttcctgtaacaatagacgctttttgaggcctccattccacatccaaagacacatattaaagtgcactaacattcaacaccaaatttaattatttcacaataatatgttgaaaaagcttttataattttgctcctgaaactctgtgtccaagtaaatttaactgatatgtatctgtgaatttggagacatcttgcatacatgaatattcttgcgaagtgaaaaaaacctaatctacaaatctttttcaggtacaaagagattattagaagactaagtggaacaatgaataaagttgacaatgtattatgttttttagatatgcatataaatgttaattgatttgggttttgcagtttttcttttcagagtttggagttaatgcatttgtttccttgcaccagtgtttttgtaggtctttaagatggtcagagcatctaaaaagctggccatatctttcactattgtggccttttggcactcaaaatatctctgtattttagtaatcccaaatttccggggagggacatgtggtagaacagcacagtgtattggaaaatgtcattaacattctttggctaaaatatttcaaaagcagacacattggattgacctttggcactgagagcaactgggagttccagatctgggtgccaggttcacagaattttttattgcgtaattggtgaaattgtttactagagacagagcttaaatgtaacaggtgtttccctagggcaccctcttaggggagtaggcaagaggcaaatcaatggcacaatacttattctatggcataatttttctcaattcttctgtctcaaaatagggtcataggttttttatatgtattaaaactgacatttcttccttttccccagttcccacggttatttacctaggataataacatctcttggtgtctagaagtctctctcagccctagagaatctacgtgccttttaaagaacacatgtctctacaggtatgcacactgcagctagacccactatcactctcacaagtggttgggcaacctgaagatactgctactccagccataagccaagtgtgatggtttccttcattttcattcttatcccagtgttacaggaaaatcaagatcccaagcctagacatagccatcttctccaatcttattcaggaaataattttttctctctgtagccccatatatatcctcagacctgaaaattcacaccatcccccaatgctggagggcgaattctctcataatcaccctatgttttgattctctatctaattactcaatttttcttcccagccctctagacagatctcactgaatttcatcagcagatgcaatgaatcagctttgattgtctctcttacacataaaacaacaacacacacgcacacatacattcctgaaaaccttaacgattattttaatggttcagattttctctgaggctttacaaccacagagaaatatggaggtgcaaagtggtcctaagaagacacattcctgttctttccagttataatttatttaattttattttactttgctgctagttggtagcacaaaggggtgagtcttaccaaaatagaaataactactatttttttactttctttcacaaatattgtggtaccttctcatgatctgagatacattgacagtatattacgcaagttagctatctactctcttttttatgtcattcttgatagcatcttttggaaatcttattgattaattctaattcatcccaaataatttcataatagtcgtttaaactgtgaagagtctgatgaacctcaaagcttttagtgatgaggctgtcaatagcagcctagtaaaaaaagaaaaaaagatgacagttctacaacctcaaccggttatttataagaaacaggaagaaagataaaataaagagaagaaagagaaaatgaactaaagagaaagattaagggtatcagggctcaatgtacttttgaacatttctggaatttgacaacttgttttcctttccaaaggcaatagataagagctgtttagcaaggaaaaggtcatttacaaacagaagaaacatgtttggggaaaatacgtcaatgtaaattcataatttgatgtggaggggtcctgtagttgagacttttggtctcttaggaagaaaattaatggttatgtagacaattagtgctttattttgtttttgcacttgttgcagcattcagtaatagccagcatttgcttttgttgttttgacttactcatcactagttctcaagggagaacctgtataaaagccttcttgatgcttttgattggaaagagggatgtttttcagaaagagtcattggaatcaagttttaaagtgtatttttgattttctgtatctaacatattcatatacgatctgtatgtgctcacaaatataaccaggagcaatgttgttgttgttctgtgtggaaagaatctcattctgagaaggaaaaagcaacattagttgtgaacccagcaaagccgtattgccatgagaaccacacagtaccaactgcttattaaacaagagtgaagtttgaggccactaatgtgcctgaggacccaaggagcaggtcagttgagggtatgggtgcagtcatgcttacttactctgggctaacataagcctttgttagaggggaggagcctggtaaaaagagtgtctagatttcaacatggcccataaaaggctagctgctattgttattattcgtggtccatcttttctgccaaattcattgtatgcatttctccatccttgttttatttaggatggctgtctgatgcaaccttgctttaacattgtgtcttctccatctccctgtctttcccagattgtccttcctagggctaatattttttttttctttgttgtagcttctactcctgtagccctttcttgctcgccctttcttcttctattctcaagttttctgctatggatttgccttctttgtctctctgccctctgatccttaaattctgcttccttctttttgttctctcagctttcagtcttttctttttttttttaattattgctttttatatgtttctctcttttttttacaaggtacagtgggattgggttttaatttatctttttttgcttagttgtaaatttatttttggcttttcaaacataactgtactcttccagatcatatttgtgtcagagttagtctgtaaacagtctgagaactgggaccacagttttgatctctgaatgccctgcaatgtatagtatggtgtatgatgcagattaaggtcataagaaaaggttttcagaaggtattagtctatcttgttttgtgtgtcttgtacattggtccattgctgaaggcagtgcttttttgaaccagagttgcttaatgtcatcttcacctctgtgatgctttatgtcaaaagacatcttttttacatgtccacatggatacaatctcttggggtcctatctttttcacattaagcacatgggtcacttggctagtaccctgaggctgttggcttgagttgggttacattcctaactaatgggaaaaaccataaaacacaagatgagttaagtcagaaactaatagaaaaaaagaaaaaaaaaacatagtactgcattataagttgctggcaagaaagtcaatacacgtgccaactcagtgaggggcagaagtggatttcaaagacaaactaagtagctaggatttggaactgggggatgaaagtaagcaaatatgtcaggattaaatggtagtggtggtggtctggagaagactggagaggcaattcctcagcaattgccaagaatatcagcccttatatgtggcttccttttatgggttggcagaaagttggacatatcaggaaactaacttagcttgaagaactaggagatggtctgagttttcggtccatctttttgtcaattttgtttattcaaaatccagggtcttgactacaatagttcttataataatattgaactgttaaccaattttggactatagtccaggagtaaccagccatgccatatacctatccaaagcaatacccagatgggttttttaactcagaattttgaaaagacttcaagtatcaggtaaaaatgacaaaatacccattttagaaagaaaacaaaacacaatttccctgtacaattacctacgtgggtataaagacatatctaaactaatgcaagataacgttagatgaaattctgatgtaaacttcaaagcttttctcactaaggaatatctgaaaacaataaccctgttgtggctaagagtacaaactgtgattttggtttggacttctcttggtttttccaagttgtgctgaatctcctatgtttgttctgcagtgttctcctctgtcatacttttttttattgcattgaggtccttattcccaattgcagaaaattatatatatatatatatatatacatatatatctatatatatacatatatatatacacacacatatatatatacatatatatatacacacacatatatatatatacacatatatatatgtttcatgaaattttagggaattttttaatttcaaagtaatgcatattttgcatatctagggaaataattcaagatacagcgggaaaatgttaataatctccctcaatacactacacaggtcttcaagagctctctgaaataactaatattaatagtaaggtgtgtgtcttttacagaattctatatgctcttgcaaatagcaatctgacatatgttatatgagatcaaattgaacaggttaactactttttcaatgacaaatgtaatttagatattcttaccaagtttttagatatttctggttttttattgtcatattaattgttcctactttatttgtaccacgttttatgcaagtgttgcccataggtggacatgcattttattgccatcattttgccaatatgaataattctaaaatatatattcagggtacttatataaatactaaaaattaaatctttcatcttctaattaagtttgcttcctttaaaacactgaaaattgccatgatgagtttcgtattacacaaggattaacatctctctttggcccaaaaattctgtgccctgcaaggttgtcctgcccctctgtgttttgatgacaggattgtactcttcctttggtaagaagatggacttcctgatggaagtacaagctgaaagggaaccctcacatttggcagaaacaggaatatcttccttcctttgtgacactatcacagatcccaacaagcgcttggggtcagcaattctaggatctcattacttgggggctgctcttttgtgaaaggtcagcttcctttgtctgccaccttatatacaaagtaaaaagggcagcagcagtcaaggacaatgttaagcagcccaactcttcctaataaatttcaaagcccactgaaatatttttgtgctagaacacatatttttttccaaaggctttggaaatcagaatttttatttttacattattatcttgggaatgtgtacaactgtatttcttaacaaccctcatctgttgaacttgtttggcgctgcttaatcagtgtcaagtaatgtcatggtttatcaattgagctggaaaaagtgactctgtaaatctaatggacctaggttaaatctattgttatttcctttttctagcctgtacttgatatgtttctcactttgaattcaaatgttaagatcagagcatgacaataaaaagaataatacaaaagttaacctatttaatatgtgatgctgggatgacacagaactatttgctacctaaaatatgtctagaagatgggagatcataaagtctcaacagtttcttctcctagaagaaaagttagaccaagaatgtgtatttctgatagtagttaatcctctttacatagtcatatttcacagaacttaatcacatctttccaagtttgatggccaaatctcacatgctttggaaactcagggagtttttccttcccaaggacctgaaaagatgacctttttttttttaaacactttagtcaaattagcatttttttttaactgctggaagactcaccattttttaacccacacttaaaaatcattaatatatattatacttaatatacatttagtgagagcagaaacattttaacaaagtctggaaaaggaatttagtaatcagaaacgaaaacagtgtggttaggtgaaaggactctgagtgtgctagtagagtaatagttgtgggaggtccaatttttgattctacaacttgctttaatacgatttccccagagtttctttactttttaatatttcagcttcttgtcacttcttcccattacaagaatatttagttatttggtaaaaatgtcttgaggatcaatattagactaatagtaatgtgtttcagtgttcggtgaagaatgccaatatattaacatattatgaaggtgataaaatataaataagaaccattaactcaaagagattgttattagtgataatggtaaggagagggcaattgaaaagcttggaattgacttgatacgtgaatataatggagcacaaatccttaagatggctccgatcaatgctattcattgaaacatttctttgcacttccattatgcttctccacatccatctctgcaatcagctggattgaaatcatatagagatttgctctcagtatttcttatacttcttacatgaattttctttattgttattttgttttggaaaggagtgcaagtctgtctcagcactctattcaaaactcaccatatagtctgagatgaatatattggaaagttgtctggttcttacattgctatatttcacaatacttgtactttcctcatttaaggttccaggataccttttgtcccctagagtaaataaattagaggggagaaaaggtgtcattttcttgcagccagcttacagagtgccagcccttgcctccctagagtgaaatctcatgtttaaaaatgctgtgagtgaggccagcactggctttgggtgtggtattgggttttaactagataattcttcagactattcactgggaaatgaaggaatggagttttgttttagtttttttcagcttagcattgagctttcaaatatcttcaaacttgctcacatttagcattgctaaactttaattttacccttttgttaatcttcctccaattaccatgattgcctttaccaagctcttcatgctcaaaacccaagggcaatctcaaaggtcttcaagctatgtgatccccaccccctgcatgtggtaggtgtttaataagtgtcaattgactgaatgattggtctacatgaaagtggctgttccacatcctgtactcgaataatactcactgagcaatatattttgggcacttaaccatttttgccttccttttggtatatcctattagctctcagaatggagaatcctccacttcatctttcttctgccctcagatcttacaacagtgctagtcagtatctattgaataaagagtgtatggtttaattccctaccctagatgtcctttaattgattttataatcttcaggaaacttaataaaacctctttgatacttacctttgcttcccttatagtttgctttcttcctttttaataattcaaaataatgtttcactttcaattataaagatactaaagctaagacaaaaatattaaggtaaaattctcctcaaggtgtttggcattttttttttccgggaaatatttggtttctttttgcttactcacatgtttactctcaatataagacgtttatctcaatacatctaccttctcccacccttttatgtacgtttggtctcatgacgttttgtgaaaaagggaaataagatttttcagtgtttgtgcaatgttcaattttaagatcttctagtccagtactgtatctactcattatgtatcctatagttactaatatttgagtttggtacttggaatattagaatgtgaaataaaatgctgtatcaatcaatacatgtttctggagctctccctattgccaccactgcttgggggtggtttggacaagacaggagttataacacgattcttgcccctcagaagttgataatttatttgagaaaacagggaggactcatgaacaaaggagggtaatcaaatgctaagtcatgcgacattgacttaaattgaggagaaagggcaaggactgttggagcaagtagacccttaaagggagaagacagtcttgggccaggtttgaggtgggcatatagttgggcatttggtatattgcttaagtaacagcaggaagggaaagtattcttgctagaataaaagtagaaacataatacaggcacgagattggaattgagaagggacaatataatgacaaaacagacttagatgaaacaatgcatcagagaggcacaaggttagaaagagcacagcaatgacagaaaggctttaagagggcagatgagaaaaagttaatagtggtttaattttggggtagggagtggttttgtaagtttcatttttaaggcataaccatgaatgaaaacaatgatagatttttaattctttattgttttaataaaatgcctacattttgactaaaataatatgattggccctccacatctgtgggctccaccaagcgtgatttctaccaactgcgggttccatcaagtgggggtagaaattatttgaaaaaaaattaaaaataacaaagcaatagtaaaaataatacaaataaaaatatagtatagcaactatttatatagcatttacactgttttaggtattataagtaacctagagataatttaaattatatgggaggatatgcataagttatatacaaacactacaccatgatatataaggaatcaaagcatctgcaaattttagtatgggggtgggggttcctggaatcaatcccccacagataatgagggacaactgtacttacaaatcttcatatagcagaaaacctactacaatgaaacataaaaagctaacaaatagtcttataaaagaaggcctgcagtatatatgacaaaagtttaatatcctagatataaaatttgcttgtacgactcaataggaaaaaaagggagaaaatattctaataataaaagacacaaaaaagcataaatgaagaaacagaaatagctaccaagcactcaaaaatatatgtcactaataatcaaagaaataataaccacgagggagatactatttttgcctacttggtttttaaagagttaaacatttcctaacaaccagagtagacggagatgttggaagacagtcactttcactcattgttcatccttaggggaatattactgaataggtgaattttggatctttatttgagagataatgtatcaaaagctttaaaaacatacatgcccggttatatagcaaaaccaattctagaaatttttgaaaagagattaaagtgtatatctacaaagatgcttattgtcgcactgcttttaacagagaagattataagcaatctaactgtccatcaataaaggaatagattaaatgaatgacgttttatctttacaaagaactactatgcagccatgaaatcaatgaatatggatataatgactgaggaaaataccatactgttagaatttaaaatgtgacaaagcagttttataatatgattccaaatctttctttgaaatctgtgtatgtgtgtacacatttatgtttgtatctgtatttatttgttcctataaaaaatataggaaaagttttgcgtgagttttggagttgcaggcattgttaaatgcttttgaatatgcattgattatcactgcaaaaattaatattgaaaattaagttgtttccaaaaaatgataagaaattaagaggaaaccaagcaaagaagtaaggattttgatgcaattcgtagaaggaagccattgcaagttggttagtagagagagaagtaacatatatagaaagtgctttgattgattgctagtattttacaaaaggcaatgaaacagaaagttaacatttaggaaatcaaggtaaccctgagtaagtatagatagggaagcacaaaacatgtgggaccagagaaaggccaaaaggtggtagatgatatgaagattggaaaaatggagtctgtgatgactctaaaaataaagacattaatccaggtttaaatatattaattatgtaacaatgaggtatccagatgaagatgtgctctagacaaacagaaaactgaagcatgatctaaatccaatgctaaaaaagagacttaagttttgtcaccatggaggcgacatttgaagttaataagtatgaatgagattaccaaaagtgaggatatcaagctacaattatagagagtgataatttatcagaaaagtctaacaagagagctttattcttcttctattctatctgtgctatgctctacttatggtttcagattgtcttcaacatcatgaggattgtattaaggaaataattcgtaactaacaagaatatttgagtgacaagtctcagaaagtttaggaaacttgtttagcagaaatttaacccctcttaacgtctaaaatgttattttccaggttttagtttgacgcttatgtgcagttggcccctgacatccacttcctgttttgctctaatgatcctttagtgtgggtctacccagttttgaggagtttttgtcagaaagaatgagacaattgggcgtattttctttgtttgcttgcttgaattacctttttgtttgtttctttgtgtttgcttttttgaatgaccgactgactgttttatctgggatttgtttctgaagttgtattttagggcatttgttctcaaactttagcatgcttaagaagcctctgaaagacttgttaaaactgatttatgtttctttcttctggaaattctgactcagtaggtttgggatggggcctgagaactagtttgcatgatctcctaagagatgctgatgttgtgggtctgcaaaccagaggtgaaattgcattgttggaagaaacatgattttgaagcccaattttattttcacgtaacgctttttcacacaaagacatatccatctctatcaccaagtacaatattaaattttttttaaaaagtttttttgaagacagtcttactctgttgcccaggctgtagtgcagtggtatggtcatggctcactgcagccttgagcttctgggttcaagtgatcttcctgcctcaacctcccgaatagctgggactacaggtgcatgccaccacattcatccaatttttaaaaattttctgtagagatgaattatcactatattgtccaagctggtccagacctcctgggctcaagtaaccctcccacctcggcctcccaaagtgctgggattacaggcgtgagctacagtgcctgacctgttgaaatttatcactggtggtactttctgattattgttgtatacaaaatagccatttacctagattttaatttgcccataatttaaataataaaaattgttgtttatgttttaccctccctggctctggtgacttcagactttcatcatgtgattggaaagaaaatttcagggagaacacagtggattgtccccacaatcttggaaaaaaaatatatatgtatagtttgtcttctgagagttaaaatgaattgattttatcaatagatgctgaaataatatttatccaggtatatgtaaatatctaacttaatcagtaattttaaaatatatctaaaggaagactacgccacagaaggtactgacagtaggacagatgtgtattgccttggcacagggagaagaaatttcaatcccagagtccaaactcccttgccaatagagagaagttctgtgctatgtggctgggatgcattatcacttgttaatctggtctgggggagaaaatgcttcttgcctgtctatttctttatctcttaattacattttatcagcaaacttcctatgcttttatttctacaaaatgtaaatctgttgatcataaagggatgttttatgttgtgtatcgacaaattagtctcctgggttataccttagtctcatatgaattaaggtgactctgcctccaggattctaatgatctcagtgtgtgctaaaaggtctatttcctaaggcctcagagctagagaacaacatgacagccaagtggtggacccctgaacagccaacagccacacctcaatggagactcatctacttttctgagcactttacctgctgtttatttgttcattcactaggaagcagagctatagaattttataaaactgaaaggagctttgaagtcatcagggccagccctttcattgtgaagttgaggtcacaaccttccattggtgtctgactcttatgaacctggtaattgaaataattcaaaggctaggttcactgctcagaaatatttcacagtgttgtgaggtgtttctcttttgtattatcttagtctgaagtgtggtgcttggcatcaggttcaggtgctaatgtagagtgagaatccattcaaccttaacctctaggccccttccttactttaatttgagagtcacatatctgcattataaaacctgcctattttgcttaccttttcaagtgaactttcattgaatttccctttttaacttttatagcctaggatggcacttcttgataaaaactgcaaagaataagtcctgttgagaggaatacattattaagaacatatcaagagaaaaatacatatcaaagcatcaaataagttaaatggattgtgtacttaccgcaataacagacacaaaacatgctttcaaatattcattaattaataaaggggaatagagaaactcttttcatagcatattagtccgttttcacactgttgatacagagataaccgacactgggaagaaaaagaggtttaattggacttacagtcccacgtggctggggaggcctcagaatcatggtgggaggtgaaaggcacttcttacatggcggtggcaagagaaaaatgaggaagatgcaaaagcggaaacccctgttaaaaccatcagctctcatgagacttattcactaccatgagaacagtatgggggaaactgcccccatgattcaaattatctcccaccaggtccctcccacaacatatgggaactgtaggagtacaattcaagatgagatttcagtggggacacagagccaaaccatatcacatagagaactcagtatttgtttgcttttgtatatagtctgttataatagaaaaaaagatcataaaaacatgattctaatcatgtgctgtcatttttgggtttcagtctttttctctaggagattagttacaaggactagggataacgtatgcaacttgcccagtggatggtactttgtacatattaaagtaatggtaattatatttatgctatatattctaagttaaactgatatttggaatgagtggtaaaactctgagcaaagatagatttaaaagcactaggagactatatctgtactcgccactttttaatgcttcctctgccttctttagattctcacagctggatcaattgataacacaatcatgctgacgaagtcctgtgcccatattgactgacgtaaggaaggctgttacagttttaatctcaccacatagaagatcccagaaataaattactcgtccatgtatgggaatgttgtaatctggtcacaagtaccagcaataccgcagcactctccacaagaacacccctaggaaaccatgttgcccttgagttttcatagaattgtagttctctcctagtccttactcattaactggttattccaccggatattaccacccactttgtgttatgtgctgtgtttcatagtggggtctggatcccctgcattgttcatagccatcttcctcctgaatgcaatctagtcccttgctgaacctttcctttttcactcctcaaattctcagatatggctcttcaccaacttgactgtgtgttcttgatttctctaccataacaatatatatcctcagtgactgcttcttgaaacaccaagtttgctcttaccaactatcttctctgcccctgcccagctctatgacctctcctcctcctcactctttcatattccagtcacgatggccttctttctgttgctccaatatgcccagacctttcaagccccaggaccttggcaagagctcttccctcttcgtcagtggccccctctcccagcccaatcttaacatagatgattcttgtttttcagaccccagcttaaatgactttgctgaccacctagtttaaaagaattccccaatctccattgttttaccatattttaatttcttgcaatgcaatttcctattgttactggatatttttctgtttattttcttacttgtttgctaattgccttcctattaaaatgtaaggtctacaagagcagatatctgatctattacattctttgttgtatcccaagagctgagaacaatggcttgttctcaacacaatggtaggtgctcaatacatactccttgagtgaataaccagctgcccctcaggtttatgcctagacctggttctgttctcccagttcctacgccaaattgtatgccagggtagtaatccctttgtctctgacaacaaaaatggatctacccaacttagatacgttgaccagcctcacccacacacatactgtagccagggtgacattgataattgatggttattatgcccaccacaattttgggattttcctagtgttccaggaggcaccttgagtttacctgagcatgaaatcaaaatagcttgcctattgttgatccttgaagttgtttccagatttccattttaccagaattgaactgatgatacttatgcacatgctctttaagcaaagtgattttccagaggaaattgcttagggaaagtttgtgctttattttaaaactacctgaaggaagttatcaaaatagtaaactgcatagattcagagtttgggtcccactgactcagctgtcacagaatagtcagaaggaagaatgaacatcaacagaccagggagcattcgttacttgttctaaaaacacatgaagaaacaatggcacatgtgtcttcacactcccatgcccatctgttgcttgacatatcttttcttttagacctttagaaaatctctgttctgaaaatcgcacagtatggatatttgattttgcatgtacggcatctagtgttccttgttttcataattgcataccaattttcatgttggaaaactaatctcccattggatatggttttggttcaattgcttatcaaagggtaaggcacctggacccaaggtggactcttgactcaatctaggaatagcagctgttcttttccaagaagatacatgtggatttatccatgttatctttagtatttcaaagagactattggcttcttcagcttagatcctcagaccttctcttgctccttctcagaagcttgcctcttcagattttcctttgctttagttaacctagttggcttttgttttattttgttttgttttgactaataagaatcaattagtgccacttgcaaccataaaaccttaattcacagaaagtaagtaatgttggacaataataagataaagaagtgatatttagtgttatggagaaatacagcagagcctcagatttttcctcccttccttctacatttctgccagaaccagaactatgtcatatccatatacataaggaagaaacactaattacttccaaagaatgtagagtgtccctatagaagagcctccctgcagaggctcccttcagttgatcaagctgaggctctatctgcttgactttgcttatgttctcccgtttgactggagtctttctcagttctttttgccctgtttctaccttccatgttctcctcatacactacctcctataactaagtcttctgatattaaaattaacctttttcctcttcttcactgagtcttattcattttgtggaccccatagcacataaccaaaagccttgcatcttgtttctatggcaaagccacatttaaatttattcgttagattaatgaaaaaacacacaattaaaagaaaacgcactgttttaaaattatattcactgcttaatttattgaccttgtttaaaattgctgctagttctatgcctactatttccatttcagtcttcaaactcaggcagctttaattctgtcctctcaatcattacttccctccactgaccaaatgtttccacctgcattggtgttctttccacagctggtcatagagctcatcaaagcattgtactttagctacagaaattgtaagttgagggttggaggaagatccaactttctccaatgtaaatatttctgcattgcttataagcaattacatttgtatgttagtcctattttaagtagctcacttacagctggtactgagcaatgagtaagcatgtggttctctatttataaagtagcccctaatctctcaccatgataggccagctatacatagtggtctgttttgagagaggggttttctagaggtcaggattatgtggctaaagagcagggaaacccaggaaaatgtaagtgattcaccacagtgtgctattggtgtttccttgggaccatgatgttgttcagtgcaaggtgaaagcctgagaagaacagatgagagacgctgtttagagtgacagacatgtagtaagtggctgcctttgattgtaggatttcaagaaaaaataaaagaaaaacatgttatttatgggttcgaataatattacaataatccaaaggtagttttattctagcagtgtggaaaataaaagcctttgtaaattaattgcttgtctatgatatgagaaagcacagagcaagcgctgttgaacataaatcaacttgatttataaacaatttgttattcatctaagatatttaatagtatatattaaattcattttgttatataaaaattaatgagtgaatgattggtaaatgcataaatgggtaaattacataaatcaagaaaattacccctcacacttttgcttttgagttaaatttatgaaaaatgcactagattcctcaccactaaaactttctatatattggaaacccaagttgttttttgttttaactagcattttgtaagcccattaagtagtataaatttctgttatttttaaatacttgtcagcagtatgttttgcaattggaatgaatacttagacaaataaatgttgagtttaacttctcatagagttacaaacttctcatagagagttcaggaagtgtttgaattcatggtggctttacttcattcacctgtatggttggggacaattccattctaaatacatttattcagcacctgccatatatcaggcactctgttaggttgaaagtgttggctcattggagaagacagagttatttttacattacatttccagagtatatcacagtgtttggtacatagaaagcacttagtcaacaatgaacgtataagggagctaaatcactaaatggttttaagaagagaaaataaatgcttactatgtgatgcagaatatggttagtgttatatttgatataggaacctgccagggctaaaaaaaaatttagagattatgtaagtccgaaatattggtgaaaatttcatggaggatgtgcgatttgatatgaattttaaataatttatagaattacatgtaaatgtctaaaggaatggtatggccaaaggtctggagttggaaatatatgtgcctgaaagaaatatagcatagtgattaaaaaaaaacaaaaaaaaacaaaaaaaaaaacgggaaagtaaaactgggaaagaaaattttgtcaaaaaaaaaaaaaaagaagaaagcttgattttggaagcttggaaaaccttgaatgccatggtaaggatgctgatatattttatctggaagatgatgagctctaatcttttttttaagtgcaggtgatattatctaacaatgatttcaagctgttaccctaacattggttaagacagtagagctaagtagagaacttggagacaagtcagaattgaatttatagaaataacacaggtaacagaacattaatatctggcttaggacagttctgttgaaagtgaaaaggaactgtggaggcagcattggcagaggttgaccagtactttgattcatgggcatgaaggatacagagctttcaaaagtgagtccaaacgcatcctgctggaatgacactgaaaatggggtatttccacctgaaaaaaagaggagatataggagaaagaacaggtttttggagacatgacggagagttaagttttgggcatgtgaatttggaagtgtgtgttagtctgtcagcaatctgtagctgcctagaagtctgctagaaatttatcttgaagtttaaaataaatatttagatttaataatattaagaaaacaataacaccaacaacaaaccctttgggcgtatttgtatcataatgtactgacacgttaaattcttacaataacttataaggtgggcactatgatgtattttgtcattttgctggtatttggcagtgatcatcacagcacaaacaagattaagagggaaattatagaaataaaagaattgaaagatagaatcctagggaatatgcagtggtggggggggcggtggtggcggtggtgagaatttgtcacagagatggaagaagcagaaatgagtattattatagcaaagggaatatgaaatttcatgccaaaaggaattgttagggatttcatatattggaaagagtttaaggtgtctgaagactgagggaaaaaatgcattgcatttaataatttgaggtcattgttgatcttcaggaaaatagtttcagctggagggcaggtgaagaagggggtgaaaactcagaagtgagaactagaggcattagtagtgcagccaacttttttaaaaaagtttgagatttaaaattagaaaaggggcagctactaatgtgggataacataattaagggaatgggtttgtgaaagagggaggcttgagcatatttgtgatctgagtcgaaggaggaggtggcagtgaagaataggagatgtgagaacgtgagtaaaaaaatgccattaaaggtaaatcctgggtcgagggggcagatattgaacagatcaagggcacaggtggagcaattggccttagaaaacctaatccataatcacttctttctttaagagaggaagaaagagatggtggataaggacaaagataaattttgtattgggatggagtagaaatagatcatgtctgaaaactttaatctcagtaaagtaggtcatcctctgtgaataagctgggggggcccggataaggtcatatctggagaggcaaagtcaaatttgtctttctagtaaaacttcaggctttatagttcaataattaaggattttgaaacacaagagactgttattaaatgcatgggaattacatgtatggtagaattggatcctttccactgaaacacttaaatacacttgaatctgagatttcaatcttctgtatttttttttttgaagttttgatttttagtgaaattctaaaaaccttggttaaggatgagaggcctatgaaccatatatgtgtgctaacattttaagatttgtttgtttattttatgggaagattttctcttcctgatgaacataaaaccaaagaaagtcacaggagtgaattccttcagccccaccctccaagttgttattaggctaacgctgaagggaaagatcactcaagatgcgctccttggggtaaattgatgtgatgaaaatttattgtcatgtggcacttcagggagcagcatctggcatatttgtccctgtttatggctctgacgttcatctgttattctatttttcttacatagattaactagtgttttatttccactgaatttttctgttattagataaaagtgaagcaaagctaagcaaaccaaaacaaaacataaaaccttttagtctgcacagtccaactcccagtgagtccaaatctatctctgatgttttatatcaatagtgccactgtgttatcactcctgagtgctgctgcttctgtggtccatgccataggcatttcttttcaaatcacatccttgattcagtaggttaatggggccagtgagcatggcactggttgataaacagagctaataagcaaagctagacattatcttttatgtgcaaacagattggaggtgggtttgtttgttaggttctcttattatctccggagagctctggcaggagaatatcattctccagttctctaatatacctcttctctgaattgaaattgagatctccgatcagcctaggtttgaaaaatctaataacggtttctgtacactgcttcacgctctatagccagccctcaaggagagaaagacataggtagaacagaaaattggtctgagtgcgaggtgcactgccagattggttgaagaataaacacttgatattctaagtttgtgtctcacactacaatatgcaagccaccaaaaaatgttggcattatgctaggagatatgtgaatatggcatgtgttcctggggtgccatataatttagattcaggtgtttggggaaagtttgaggtttactatttaattcacgtatttggagaaaatttgagatttacttttataggctattggaagccactatagagtaataggcgtaagagcattgcattgaaatctacatttagaaaggtttgcttgattttaacatataaacttgaatagcggaagagaagattagggggattggccattttagtgacctaggggtgaaggaataagggtatgaagaaataaaacatgtccatagcaatcattaaatcaatcagggccatccatcatgttgcagcatttggatagccagatgtatgcccttagagaggccttggtttccttatttggaaatgagaatgcttgagttggatcagagattcctaagtgtgttccacagtgtacttgtgctgtgaagcacactttgaaaaagaaagggctctataatcaagtcagtttcgtttcccatagtccatctgcatggtagagaggcctaacgctggttagtatactaagggatttgagaaggtctgaaggcaggacaactgtttaaatttcctgaacccaccctttcctaaactttgtgaacatatagtcttgtggagaataacacgtctagtgttaatctaatactggggttacattctaaattttaaggcaattatcagaaatgtaaaatccaacacagccagttatttttttctagcattctgtttcttttttgttgttgttgcatgtaagataatttatgaatgtgctttttgaagaatacgtgctctgtttttaaaaacttgaactgctctcaacctgacaagaggttcacttacatagggacacaagagaacaaagagtgatcaggggaaggcaaattcataattcagaacttgagtttactgtcttttataaatttattcatgaaatagtggtagaattagtaagtgaccacaaatttaaatcactaattaattctcattctttctgaactcttgcactctctcttctttttgcatttatatctgtgtatctttttctctccttgtctttgtgtatctatatgtctctgtctatgtctgtccctttgtcactctctctccttttctctctctgtcttcttttcccttccctctccttttttttttctctcacctaaagagtccatctgcaaatatagagatgaagtcccgtaaattaaatatgcatgtgccgtgactccctgtattaaccttttgtagaactgcgcttccctggaaactgtggactttagataatcccaagatcttttgcctttgatctgctctgctcactctcttctcctggcttttgtggattcagttctgcttttcaccttgaacttcactgcccctgcagtgccattcacgtgtaccccatcatttcaggacagaggcatggagaaggatgagagagtctgccttgtctcaagccctaagcaaataatctttgcatttctccatccctacttggaaggcatattcttaccatctgtggatcatataatgaatgacttttttgaaggaatgttcacatttcttatcttgcttgttatacacatcatttttcaaaccttggaacgatgagatggcatttcaagtaagggtggtcccacaaatcaaatgtagtgtgactttggtttcatttctttgttgaaacatctggtcttgtttaatgcacaacaagaaagaggtaggaaacatgtaaaagtccttgctgccctcagctctgattgctttctcttactgccattgtattatgaaactcactgcctcgagtagagaaaggaagttaattccacaataactacatttgccaagagtcacttgcatgtccatgggcatgaaggcactgtgtatattgcttttccaaattccagtctgggacttctgccttgaacaaggaaatttgaggcacaggtcactggagtctatggtgacatgatttatttgcaacagtaccatgttaaatgtcaccatattagggtggtgtggccacggctgccccttaagttttccagtcacaaaacagccctttttcccctcagaaatcctaaaactcccatataggaacaaaatcctacgccttatggtacacagacttcaggttgtcaatatttgttaaaaaggcatgatgcttactagaggacagcattggtctccagagctagccatgtgtgccaaacaggtgactggtttatagatggatagtatgcttaatataaatccaatcacttttacagttgctcttgaattccagcctcaagtcttggccttattccctcccagagtttagcagttgactttcggcaaaaggaaaattcgggatgagtggagagtagtcagcacaaattagatggattatcctttaacaaatacacagaaatctccttgctgttattgcttatcatcttctggttgcttgggcattggcaaattttctttcttggctttgtctactttgcagtactgtggtggtggaggtataggggtggtgatagtaatagaagtcataatgatgataggcaagattatatattcatcatactttatgcaactccctaatcttggtgtttaactcagtcttcatagcaaccttgtggtaaaaatcccatgatactgtatcctacaagtttagatgtaatgtagttggcagttggctccagaatccttgaacttatcagccagctagctaactttggtcatttcattaatctggcaataataccttctcatgtattatgggattgaatattttagattccatgaacaaaaacatgacagggctcactgtcctattagtatcctcattttacacattaggaaattgaagtctgacttacttaaaggtcactgctggaaggcagcaggcatgtagagtcagtgtggctccagaattcatgctttccatgactgtgatacaggctgaggtttataaagttatctatgggagggataaagctgttgcttaaaggttaagagaccatggctctgaccctggtttaattacaagtaccctgcatttcagcattacatcctgtttttatctcgggtgcacaggggtggagggaaccagatatggtgtgcacaaaacctactggggagctgaagccaagagctggtttgttaagtggccttgactttgatttaagtatttaaattgtgtcccaatttgggtcatatgaagtgaagcaaacctaacttcatgtatcaaacatgagtgatgtcttgtatcatgcttttctgaattagagttgctctttccttaagtgcctaaaaatgtcatgtgcctttgctcagtaaagtgatgccagtagctggcatgagatcagtaagaaatatgccaaaaatcactggagctttggggaacccaggattgggaaacattctaaatgactgtggccataaatatagagctccaaagtttagagcctgaagcttttatgcctaggagcatggcaatctctggtttcattatagtccttgctaaaatttaacttaaaaaagaaaacagataaattagacactattggcaccattgaaaaacaatctagcattatttatcaataaccttaacatgtttataagctttcatctaataacttcatatctggaatagtaagaaatatatacattcagagatgtttgtcgtagttttatttgtttcttcatcatttatttcatttaactacagaataatattctagttgaaaaaaacccaaaaatatgtaaagtaaaatgtaagattcgtattgcaaaagttcaaccacttttaacagtttggtatatacttcaaaacctcatcctcattatatttcttcctccccttctcatgtatacacacatacatacatgcattcatgtacacacatacatatatttgtgcacatgtatatacacatttagctacacatatatacaaaaatataatttccaagaaaactgtaaggctagggacattgttcagtaacttacttttttatcatattacgggcatttgcgtgtgtgagagagagcttgtggatctacataattgttttatcaactagatggtattctagagtcacgatgtactgttaaacattaaacttggtaaatactaagattgtttccaattttgataatacaatcatgctgcagtgaacacactagttgctatattttggtacatgtataggggcatgtccatgaatcaaattttaggagtagaattgtagagtcgaaaggacacttaaatttttatagatcaggctaaatgcatctctaccctaccactatcactgacacagctctactgattcactttcccacaaacaacatatgagagtccttcaggttttgttattgttctttttctagcttcttgagataaatgctgtatcttttatgttttatgatgaatttactttagactgtaaattttccttcaaatgctctgttggctacctcttattggttttgataggtattaccggggtgatattaagaatatctaagaaccagtaaaaaataaaaaaatatttcaggaaagaggccatcactgcctagtccagccataaacaactggtatggctgtcctggtatgaatgtgccagatatcagacatgtgactctcactggaattcacttcttctagcctatcacccaaccaaactctacaatatgatattttctaaatatgtcaaatatgcattgcttatatgactttgatctgactttttgtttgttttgtttcttctgggattgctattatcaatgaatctgttcattaaaattcttactcataattgaaagttcagcttaaatgatacctccctagcaaagataacactcttctatgaaaaattttgtcatttggtttgaacttcatatggtagttactattatcatcatcagggatgagtgaactttcttgtaaaggaccagatagtaaatattttctgcttgctatgtatacactttccactgtgctcactctgctctatgtaacatgaaagcaagcttagtgatacctaaacaaatgagtttaggtgggtctgtcctgattaaattataaattataattaaattattaaattaattatattacaaaaacagttgtccaggctccgggccatactttactaattttcatattttgagctatactatttaatagctattataaacttctctaatcttctattccggactatatacttcttggaaatgaggcttgtgtaagtggtgatgtggcttaacctttaattcctacgcactcaagagacatttgttggataagtgaaaaatgttaacaccgttgttattcacctgtagaaattttagtgattcttaatataaacaatgaatactggagatattgacataccagcataaaatttttctgaaactctaatttgatgcccaatttgtatgtagattattcccttgcttgtgtgctgggtttagtttattctttgagattcattcttttgtcaaaacgtttttagggataaaaggagtgtagtaaaaactcagtcaaatatttgaaaaagccttaagtcaaaatatgatagatctaaaaggaagcctattcatattgcgtactgtgacatttattcttgtttaggaagctttatgtgggttgttaatttgtttttggcttaggtaaaccaagctatgatagagttgagcaatgatatattcagaaaaccaacataactggtgaaagaatttttttatccttatattttttctatgtccagataggatattctttaggagacttacagtagcatattgagttttgtttggtatttctctctggttttcggtgttgcttgaacctaaaagctttaaataatctgtagatgaaaatctcacctattctatcattattgcgacaacagaaggaatgtgtaatgaattcacagccattcagaagccgcagaggcaaaacacatataagctgttattaattggatggaaaagacaagaattaataaacacccataatatacacacacagaaatacataaaaataaaggaaacgctctgtaaataattaattaatttaaaaattaaaaaatgtgaaagaaattgtgtatttacatagtgaagatttgagaagaaataattctacctattgatcataaaaggtcaaaaaatacagtaatgtcacatcatttaaactgtatagttcatcttccagtagtagcaggagtttgttttactcatctttagttttcttcttacaagactacactcgtttcacccactcatggaaagaacagcttgtcttatcaccctccagtggaaatgagttatgagccttttatctggagtttacaggacagctttaacctctttatagttgaacttcagtgatgaatgcaatcttattttatcttagttaatttttttcccaagaattccttttcctgttctgatttgtaggtacatacaagataataataggaaagatcaaattaccctatttgggatcatgttaaacacttttctattgtcctgcaagtcttcagtattaatttcctgtttctttttctgttcatatcaatctaattagaaaaagcaggcatttgtaacattcataatattctggtgtcttcaccgtatttcaaagaaaagcttgtattttatgcatcttaaaatatttttgtgggctaagttggtttacttcttcttaggtttataaactaggctgccaagaattttgcaaactagaaatgtagtgactgaggtaacttgggtgtcagttgcaagacaaaatgatcattcacaaagatgcagaagccctaacctgggttctgtgagcaatagcaggaagagtcagatgtactgcgtaagtcaaatggatggccttatttggtatctggctaatatatcactctggctaatatatcacccgcagaatgcaaggtccttactgttttaactcatcaaacacaagaggtccttcccatggaacatatcctcccctggcactgattagcaattatttccgaatgattacctttgaatgattggacagagtttatgatttgccaaaagtcacaaccaatgtaggtcatcatggattagcttctttcctttgacgtttaattaatttattcacacattcatcatgtatcttgtgccaactgtgggccaggtattgtgctatgtgctagggatgccaacttgaatgagacaagatctggaaccttgagagacttaagtaagaaatatgcaaatccatgattacattacaattttattagtgctataatggaagcatgactaggatactaggggggcataaagggatcaaaatcagattcagggaaaataccctagaggaaacaatatttatactgaattttgaagaacaagtgggatttcagttagagagcattgagacagcattgtagcatatatcaaagagatataaaacaggaccaggtatttaagtaatgacaaatacttcagcgtggcttcagcaatagaagctaagggatataagtggtagatgttgaagctaaggatccagccagagatcagatcacaaaagatgaagatgataaactaggaagtatagtttgggacaaagtgacataaggaaaggattcacctttctcatttaatagcattccagcaccatgccaattccgtgtcacacaaccacaaagctcttcccttgcctcgttcagtgcatttctatggggtttgggatatgagcttaaaagtaaaggcaggactcatttctctaaatggaattcacataccaactgctaagagaatctattcttctttaacttatttcagttgtatctcttctgttaagctggggacctactcagcctgccaccttcttgtgagcaacttcccctttatctgtactggtttgactgtatagaaaaagatgcagaaatgccgtaagggaggcataagcgaaaataagaaaaagccagcaactactgtgggccaggcactgtgctggatcatttacacggtacctcatttaatcctcaccatgtctatagatattattctcatctccattttacagataagtaaaataagtgtcttgcttaaaattgcacagtaaatatgaaatttggatttttaactttagttgatctgtttctagaaaaccattatttgcatattctaatacttcctagtctgggcagtattctcccagatctaagtccaaagtacttagaaaagtaattaaatctgatacctagacttgtttctattatattcaaattgttcatgtcagcacatgtcaaagctcttaaggacataggaagcaccctttccccttaaaacattgccttcttgaactttctgtgctaatattctggcagacacatggtagaaagaatctgttttgagattctggagccgggttttaaacctggtgctgaccataacaatgtttgagatcagactcgagtcagttaagctctcagggatttagtctctgccatgtaaaaggaggcaactgacttacctcatcaagtccttttcctctaagtacctagatttttgttttcacaggtgagacattaaatgggttatttagatcacctttgcacaaattgctagctttgttactgatggataacaagaagttaatttcactctcagagtagactacggtcagctgcaaatatgaaggaacggaggttctacaaaataggagaactttctctgagacctctgaaaggttcaggctgcctgtttttattgtaactcttaaatatcaaactccttttaaatgctctaaaggaatttcatgaaaaatgttttctccaaaggtgaataaaggagccattgactgagtaaaaaaataaatacatgaataaagaataaaagctggatcatcttccttcctggaaacattctatggcatattaatggagaaattcatactatcacagagaaaaatttacaaacatgacatatgtaacttagagatgtttaatcccgagaaaaacagtcaaagagaattttattcacttacagaggaatatttttaaaggaaggatttgctagcagattgaatttctattttatgttagttatttattagcaaactcataactttgctattcaggcagcttggagtcataagagatgtattataaaaaagctattatttttagttattaagaatttgaataaataactgtggcccttttttgaagtggagggctattaagaggtacagaaatgcagataaaaatactccttaatagaaaggtcagttaaatataatgtgtcatatttaaaagaataaactttgaagtcagagaggacaaaatatgagccatggctccagtactctgtttttaagatttgtgaatgtaaaaaaaaaaaaagtttggggaaaatctttaaactttattcctgtgtcatgcaaaacagcgagttttgaggaatacattgagttaagatatcatatacttagccaatgaacgtaccaaatgacccatacatcacctgctcagttcatagggcaggaaccttaagatagaatctcatagaactctttctttcacttataacctgaataacctatacataattaccttgctttaagtgttttattgtactagacatgggttttccaaacttttatgatatattagtccctttcattgaaatatgtaatcccagcaacttccttagaaatgaaaaaaactaatcattttgacattattacctggtgaaaaataaaatacgacacatttttactgttttccatttaacaaatgttgtgctctattcagttacttcaaagttaagtttgtaagcaacttataaaatatctgaaaatagaacaataatttgaacccacaaagatatcagattgcaatgcatattatgtggctaaattctataattttcctgagttgtttctaaaggatgagataagaaagaaactcatgttgtgagctttctccacttgttatattttgcttacatgaagactcaaatatgtacatacgtagtttttcctcttgcaattccctgtgaaatactagggtcattttaatgttctgtgtaagatgaacaccaattttattctcaatagcagtgttccatatacttcttgcattttaacaagagctccttcatcaatccaaataataaattacaagaccaaaaatgaaagcaatttgtacatctgtgaaggtcaaagccaccaagctggctggagatattcagctgagggcggtaactactgaagtcctgagttatgggcacactcgtcctctctgagtgctgtgcatgctcactcagtaaaaactaagcggctctaaatggtttccttttaagaagaaaaagcatgtttagtgtgttatttaattcaatgatttttcaaaattagatattataatggatcccaatcatgcccttaataatgagactgtacaagaatacgtgataaaattgtagaaaaagaaataacaatggttttgccaggcactgagcttagggctatatacagttttctaaaggatgctccatctatgaagggctcttcctctcttttatttttttttcatttccgtccttcccatttgttttctttcttcattttcttcttttctaccgtctggcttatttgagtcaaccaacatttactgtatccccatgaaaagccagacatcataggaggaactacggatacgagaaattaaggagttcataatctagtaaaaatgttgtctgtgttttttttgtgtttgtttttaatttatccggagtttgtgtttatttacctatccatacatgaatttataatcactttggatgccttaaaatacaataatattctggggcctatatcacctaatgtaatcctccacatgctgtagacatgattaaaatcctcatcctctaacattcaaatagatctggtgaaaataaagtgtacattttatgagttaaaaatcataaaatcttagtcctgctagtcttgattacagttcttttaaagtacctagtccagatcaagtcagttgccatgctaattagttttcacatacgaaaaaaaaaaatggccatactccagacactggtctttctatttcaggaaagatggcatataagaaaacctcactatatgcaaaggatttgtggatggttccttggagttaattttcatgggctttagaaggtatttaaacctcaagacaaggagagggtttataaatgattgacagaagctctttagctactcaagtccaagagggtagcacctcttagccgttcaatgaatagtatggagaattcgaagggctgcttagaactctagggcagcctattttttgaagattatgcttttgacctttcttgctagaagtcatccatccatctaataagtgttatttaagggcatacagtgtgccaagaacgcaacttggcatcaccatggagaccataaaattctagtctcatcctctcatccatcacaaccaagtagaagttggtgctgttaatgtcaagagcaaatcaagaagtcaagaaagactgaagctcagacacattgtcactggtgtaatctccacctttgaaggtgctgctctgatatcaaattttatgtacagagacaaacacatacacagttgacaaagtaacagacataaattatttttatgttttatatgttattttttgaagtaacatcaggtatgtactttagcttattttttcacacaaagttgatttttttgggtaataacaatagaatttatactagttgcagaattatctacaaccaccatagtaaagaaacaaagccgtaaactaggtcgtattattactgttatcttttgaatttttggacagagctgatttaataatttggcaaacttgtaactagggtaactagaaaatgctgaaatttaaatctatgttatttatattattttgatctttatatggcctaaaaatgcaggtttaactccagcacacatagtaaaattaacagtagaaagaaacaaacatcagaagccatatgtaatatgtctgtggtgctcttgacacccctctgtcttctcttctgaaatgtgtattccttctgatattggacacatacagttacacacacacatacacacacacacacacacacacacacacacacacaccccttggactgaattctagatgcaattttaaaaatcaataatttagtatctcttcatataattcacaccccttcttatttcccccatgatttttatttaagcttgtacgcaatttttggcatgaactaagctttttaagactttatgccactgtagggatttttggaaaacactgataaagccaataaaataacacaccgattcagatattacccttgttcaaacagggctctcaaatgggtcctattttcttggatttgcccactctgaaaaaaaaaaaaaaattcactgcaagctaaattactttctttaacatacctagattttttttattttgtttttatttttaactctggactttattaaaaggacaaaggaattcactggagtgggaataacacagattttactgtgcaatgaacttaaatgcacttctataaagtaagtcatgaacactgacttcaacctttcattttcctcaggaaggacccagttagaaccagcagtcactgtggctgagggaagaggcacagtattctggtctggtctaggttcttctttcctttttcagtttcttttttggttcctttctgtttgtactgctcttgtgagcttcttattgttcaagcctcatagctatttatggattatgcacagtttgggctaatatgattaacatttgcctcaagagccaggtcttctcatgtaattggttctctttcaaaacacgtggcctccgcctggatgactggcttgctacgtaacctggaacggccatgtcctgggtctttctgtgctgcatgtttggccgtggaatttatttcttctgtcctgctggagtgggtaggattgtttgaacaggaagagtcacttccttgttatgctctcccagcattgtagagctccaagatgtttcccctgtgcccttccattaagcccttacaatctcctgcactaaagtttaatcacttccctcctaatatcctaaagaagacaagagctttctctcctaattctttccttctctcctttttctttttctctttccttctttctctttgcttacctagtattctttccagcctgcctgcctatctgccttttcttctctccttcctctcctcttcctttactctcattattccctttgttttccttttccccactgttatttttttttctaatttcatgtcatttctgttatgaaaactagatcccagttaatggagctttatcgtatttgcacacagatgaaagaatacatgcatataataatgaattgctgcattctttgtaacaagagaatattggaaacaacttgaatgtccattaataggggacaaattgaataaactatggcatgtctgtaaaacagaactctctgtaactgtagaaaagaatcaggaaacactctatgtattaagttgtaagtatctccaaaatattttgtgaagtgaaaaaaagacatagtgcagaacatttgtattttatatttcgtttgtgaaaaaaggcggtggtgggaaataagattatattttacattttattgctcttagtaaacaccaaaaaatttgtgtaggaaactattcctgggtgtcaaggatagatgggctgaggaatagtagaaagggagattttatcgttataccgttttgtatttattaactttcaaaagtgtgttaatatattatccatccaaaaagtgaaatataataatgtaaacctgggaagccaatgtaagattcagttgaaagaaaactatcccattaaatgcatatatatatatatgtgtgtgtgtgtatgtatgtatatacatgtgtgtatatatgtgtgtatgtatatatatacatgtgtgtatgtatatatatacgtgtgtgtatatatatgtgtgtatatatgtatgtatatatatacacatacacacacacacacacacatacacacacatatgtataaatttgacatgactggtatagttatccaaactcacaggtgttcttctagaatattagctatctatggcttaaattatgtaaaattgtcattttttactaaaaaaccatttcaaatattggcaatttcatactattggcctaatctttccttgtcttaagttgaggcatcaaaaatctatcatcaggttgcctgggctattactctctttaacttcattcttctcctgtgctatagaaacttttggagtcatatttcattaatttccccaggtcacctggataggactatgaagtgtggcaatcctgaatcacctttccatccttgctttattaactttacacttgactgtagattaaactgtcataatctaccactgagattatggtgtttttttcctaagaagtcattctgaatctcaggctttccttgcaggtctaatgtcttcattgccaccaaatttatctttctacaatgcagtttgactcctgtttctttttactaagtgcatcccatgtcttctcactggctacataatatatatggactaaactccttggaaagcatgcaattcatcctcattcttacctccacccactgatctttccataaactctctaaacctgttctttccccaaattatgatccccaataagtctccatggctttgctaattactttctgtttattaaaatgagcttctccaccttctatgtcttgcaagcctcttattaccatttaaaggttttacacaaataagtgttctctctgtagttctgattcccaactatccacaattaatctcttgcttatttatgtttccatggtcctatgtaattacccctattataaatctagtcattaggacctattccagatatttgtttatgtggctacctaccttcctcactaccttctgagtgattggcagcacagatgaaggtcttggttatccttgtattccctcgtactgagctcagtgtttggtatagagttttgtgattagtaaatattggtttattgagtaatgcttcagtcttactactggcatcctttttttttttttttcgagacagagtctcgctgtgtcgccaggctggagtgcagtggcgcaatctcacctcactgcaacctccacctcctgggttccagcgattctcctgcctcagtctcacaagtagctgggactacagacgtgcaccaccacgcccagctaattttttgtatttttagcagagacggggtttcaccgtgttggccaggatggtctcgatctcctgacctcatgatctgcccgcactggcctcccaaagtgctgggattacaggcgtgagccaccacacccggcctagaatccttttgtatatggaaggaagtattttaaaaatcctttttaaaaaaggtaggagactaatgttaaggaaggttttgggagtggggaaagaaatgcctttacattaaggacatgaaaattgaaagtacaaagcagtctctaatttgttcattatttgccataaggacatgatttagttttgaatgtattccaccaggttctctttatctcctttgcttcatattagtgtttattttgatgatgattaaggcaatatgctactaagaattgtgctgtctttttgtaaattatgcctgaaaaaatcgtgattgttcctgttgctttgaagtcttatgtttatatttaattgtaaaagttaaggctacctctatgtgatagacagagtgttctccaaaaaatgcccgcaaatttggagtggaggataaatgacagttttctcttcctacttctcccttcctccttttcctcctccttctgttacttaatattatcactattatcattattttcttctaatctggaaatataatagcttaatagcctagtctagctgagttggacttgtgtatttgttgaaaatattaagttataactttggagtaaatactcatcataaaatgagaatgatttgatggtgtgtgttcttgtgtattgcacagacacattactgagtggcacatagagttgcagtgagttttactgtaagggagtattttagccatcatgtcttccaaggatcgcatgccctgtttcctaggtcctaataaaagcttgtatttatatgtaactcactattgccatttcagttcatcaagattaacaccaaggagctattatcgatcacgtcagagtgaggcaggtagaatgctagaattttttgaggatgaaataaagtgatcttagtctctggcatcttagttgttgggtgccttcctttttcttttatcagtaaatgattgttatctatgaccaaagaaagaagagaaattcgcattatttagcattttgcccacttaggtggcacttactctgatttagtctattataacatcattatgtcttgctaatggcaccatgcagttcacttccttcaactgtttgcagagtgcctctccatttaaacaacgtggcacgtttaaatagtttactagtactataacattcttggcttattgtacattagattttaaaatttagaaaattttctattgagcacaagaatatataatggtgagcatgactttaaatactgaaatgaaaagtctgtgagaacaattatctgtttcgttatgtgttagaagtggtagatatgttttctgtaaatgtgaataaactgaaatgaaattttaaagcttgtggaatgaaacgacaaaaaggacattggtattacacagtttctttcaattccaccatccctaccacccacccaacccttcatcccagaattagtgttggtctgttgctttccacggttccatgaaatagttagatgatttaataagaactttggaatatgtcctcttttccctcaacctccaggtaaatttattggtagttaatgttgctagtcttttcatggcctagaaaattgttctctcttttcttcacttagttaacttttatttttccttctaatgagagctcaggtcttccttcctatgcaaggcttccctgacctccattgggttagatctctcataaaggtgctcagagcactgcttacttggcaaaccttcaaattcacatttgtttacgtgtttatttttattagtcttccttccctattaatccaaaagccctataaagctgagggcagtcttcaactccctattggattattaattccaagtataatgttttgcacatactagtcactgagtaaatatttttgaaacatgaaagagtgttcagatgtgaaaacactcatttttggctatagaatataatttggggtatctccatcaaatgcatacctagttatgattttattaattttctgcaatttaaatcagtattgtttctttactccgaaatgtaaattaaggttcagtgtttaatgccactataccgggaaaatatatgtttttggcttttaattccataacatgtattttttgcccctgaacttcaattaaatgttctccagttggttttttgtgttggggtggggcagggggtttgtaaggtaacccttttggttttagagcataactgcatccatacttttataacccatttacaagtgttgtaagtatatgaaccttaaaatgtatatacaattcttcaaagctcatgtgtaattaaaatctggaagggcaggtggttgagaggttctagtaatttattgtgttactctaagataagaatcaaaaatttaaaaatcacaggagagtctatagttagcgtgtatccaattgatatacaataaaagccacaggaagcatttattaaaagactcataatgaaaccaaaagaaataatccattaggagttaactcgcagaatatcatatagaaaactgaataagctttagagaaatgtcttattctttgactcttctttgggcagaaggtactacagaatattaactagacagattttcatgattgcctattcaaagaaaatgaagtattttgatgtgccatgcattgagtcaagcttaatgcatatttaagcacagttctagcatctgagtggtaaactggtcttttactcctaatggaatttttgttcctgacatggaaaaaatcatgtgaaaaatttttatagattatatatattatatgtatattttataaatcatgtgaaaaattttaatatatattaactatataatacatattaatataactatataattaatatatatattaatataactatagaattaatatatatattaatataacttttgttatattcacaagatactttaaaatcttattcatttctccaacttctagaacaatttttcctgggcaactattcaaatctttgtgaaatatacatcttactctatgacatcactagggactatagccagaatagaccaggcattcagagctctatgtctgtaccacatagacatcagacagtgtttggacaaaacagatctaacacttgcaactattgctaatttttgacccctaaatacctaagtttgaatataccactgtgtgggattgcggtctctatttctccacactacaaaaatctgccttcctggattcccatggtcctgttttcagagtgggtgtttgtttgtaggtgctagcagtatgtttgtaattccagttaggtttgtcactcaatagcttctgcattcagccatctctgtactggatacactttggaagaagtaatagttaataagtaatattttaaactaaactactttatctaatttatgaaatcatttgggctggaagagccctacagtgaaatacatagctcatccccttttctggaatagcgggatagcttattattgtctataaaaaatccattctgggtgggtatctattctcagccttcattatctacagtgatagcaattccacagcctcccttggcagccctccctattgctgaactagccttgcttattaatcctgtaataataccttatgttctctaaatattgaagcagtgcttaagtttcccctgctaactcattcctccctgctcaccctgtgaaatgcttctagagggggaataattatataagcacacagcaccaaatgatgtgttgtgcagccttgtcctaaggcattctgcaaagggcttgttaggatggacgttgtcagtccatagaaaattaagctattaaatctgcagcacccggatggtgattgaattgcttgtgccactggaataaagttgctttgcagacatatgaatttcacagctagtagtgtccttcccttcctgcatgctctaattgtatttttatattaatgcactgatttaggggctatgttggcatatttgtgctggtgctgggacaagagcattggctggacatttcctagagggtgcagtccacaaattttcccagaaaccgaattgattatgctgatgggataagcctgtcctctcccattttcaaccagtctgtgcgctgcctggtgttggcactcttacccatatctctctgaatacctttttactatttctgcactcccttcatctgcttctgggtgtttgacttgtgcaggctagcactagtgactttcttcagaggactgccttaggacagctggagacctgaggtacctgggagttccacgtcctccctggtgtttatgagagcccagctccctttccttaagttaagacgaactccaatatgtaacttacagcctgtagtttcccagtaggaccaaactaaagctatcctttgttgaatttcacttgaaaaagtactcttgcttgccttatttcccttctctgtcttgtttccccatgatttccttcccaattatccggggagcacttctttaataaattttacccacaaatcctcatctcagaccttgcttccaggaaaccagacttgagacatcattcctttttctgtgatccatgtagaatgttatagtcagacttctcagcctcgcgtggctgaccagatttctatgactgtttttctctcatggtacacacatttgattctgtccatggaaatcacaaggtttttttccagattcacaggggcttgtccataatggtgatttgagttttctgaaataacaaaacttactcaaacccaggatagctcctttttttttttttttttttttttttccgtttgcttttctcaagtgcaacatctctcctgtgctgtttctgaaactggcttgttcatctattagagcacaggccacatactatgtccaattatagaatttgtctctcaaactggactgtgaactctttgggggagtatctggtcatcagaatccctgacaagcaactcacatggtgtcttccactccacagctcctccgtagttggttgctgccttctactgatgaaaggactcaagtatacctaggtttgtgataacagtctttgtgactgcttcattttgattagcctcttctgtttcagtttattcagcccagctctgaaaacactgactgatttatctcttttaaatttaatacattttctatccccaatccagtgaatatcggaatatcaggataatcaagaacaaatggcaagttaggaagtgatgcatttggagacaaaacaacaagaaacagtcatgaacattctcttgcctccttttgttttttttcctaaggtctttattcacaaatgaaatgttattgttttttcagttctctctctcttgctctcactctgtgtcatcctcaaatatgttagaaatattaactgagaaacatgctttatctaagaaatgagtatcttttcaagaatgaatgctgacctgaatataatgtggaattaccctgggcaccaaagacagcttgcctgggcatgattgttccggaagctattactgaaatttggaacagcaccctcaatgtggtgtcaatgcctccttcagttctgaagttttgaaataaatactcgaaacatccagttatacaccctctttccaagagtgtttgcacatatttggtgctcctcaagtttttcaaattaatgttgatgaaataaaagagtgatcagatgaatctggcactatatttcttgcaaggacaagaagctatttttcagaatcttgccccaaatatataattgataacattggaaaataaataaggaaattttacttctgttgcatgttcctccaatcattagtagactgactttgaaatgagaattcaaagtataattaaataatggcattattctgggatgacttcataccattgttgtagactagcatatgattttactagttattattttctcagctagtctattaaatatagaaaaatttcagtaacagaaaatattgaaaaattttagaaacaggaaaatctaaccttttacctagtaaccatgtactttttttcattaggattcctcttaaatttgtatatgtgtgtatataatctgtatgtatagtaatatttgcatatgttacttttatatcagagagaaattaagggaaaaggttctggcaaactctaaaactatatttagtccatctttgaatcaattgtgtatttctttcatggcataatcctacctggtagattatttcctttattcccagaggtgaactagtcagtgatcatttgcatccagtgccctctcaagggtttatgcccaattagaaagcagtagcactataatgtagcatcagcacgtataacattcagtgctgagacggtggcttaacaattcatggggcttgataaaaagtataatttaaaaaaaattccactgcattaacccattcttctttaactctaagaccagactgagggaaaagtaaaacagaacaaaactgctttcaacctacagggcagtttaaattttaaatttatagtgaagctacaattaaggtgatttagtatagtccctattctcagttaacaacttccctttggaactagggtgggtaagtcttgaaatattcaataaagagcgatccatgtgactaagttgagtcgctgtgtctccgttgcagcagtgcaatgaagcctccatctggaatgaattcagcatctttaacaagtaagaacagggatgcaaagttgtctttgttttcttagtaggattaggctatgatttttgatatgacagacagttctttataggataccctgaaaatcctatttagtatttgtttatgcaaagaaatttcttgttcagtggagcaagagtcaagaaaatatagtaagacagaatggttaagtgctcagtacttccataattagagagatctagacttgcttgtatctagcgttatgaccataggcaaagctgtacaattcatacaatttctatgttttattttccacatctgtacagcgggactatactagagagttgatgtgagagtgaaaatttaaaaattatgtctaaagggcttattagcttagtacccaacaactagcaaatgtttcttaaaaatggtgcctgtgaacaataacagtaaagtcatagttgttgcattagccttttgcttttattatacatcattactatttaagcttttcacagttccgtttgcaatacacatataacttagtcctgtaagttcattccaagattgagagttaagatgtctttacaaatatgaaaaaaatgaagaggttagtttgcttaaattacttgctattcctaattttgatcaagtgttttcttaatattttgcattatttagtagctaatttttcccatcctaaaagtatgtttgtaaatactctcgtgtctctatatttttaagaaacagtgttctgtttttatattaagcttaatagtttaatttttttttgcagctgtgaggcagcagatgataaatcaaaaactaatattttcaactatctcaaaagataaaagtctgacacactaaatatggactaaatgaggcttatggatgatttattctaattagatataaggtaaataaatgctcctgcagttgtgaattttattaaagtcaggacatgtcgttgttcaggctttcctgcattgcgctttaaagaatcatttgaaaatattttgggtctgctgttgctgagacaatatggcttggcagtgtattggtaacttaataagctcaccacatttgtcatgcagaaactgttctttatatgcaaagctgtcagacagattgagtgtataattcttcttcgcatgaaataatatgataaaactccagtatcaaattgaatgctgtactagcgtttggaatctttcatgcataggttggaattgttttacaatggaagcattgtttgatgacaaatactctttttgtaacattcatcagttatgttttaatagcaggcattttcctcctgactataggtctgccttttttgctgttaacatactggaaaatgaagcctgcttctcagttatgtttgacattttttttttaatggttaactgctacaattagactgcactgtcagtgttgtagatgtttttgttcttcctacaaaagactatcctattggattttgccagttttatgatagagcaaacattatttactccttcctggttttgattcaatctccaatgataatgcgtactgatacaatattttaagtctcacttcatcacagaagagaattgcctggtatgtgcccatataatgcctgttggtgcaagcagtgagataataaattagcagaaattatgcatatagtccacgtggcacattctagaaggttaagcatttattttggtccgtggcagatatgctcaaagaactcccctgccatgtcaatttcaagggtctaaaagggaaagaaattgctacaaatacatacacagcaaatgtgcttaaagcagctctttgccaagcaagttcctgttacagagtggcctggtgccaaagctcttctaagcactctactgctacttaatgtatttggtatgtgggagaaactcgtaactctgggactgcccagtgtacggcgtctgtcacgtctgaagtgtgagcattccaaaggctcacagccacccagctcagaactcagcggggaagacaggaacaggggtcagcctgaatagaaagagactaaaagatacatttgtgaaatttgtgaagatatctttttctctcttccctccttcctttttcctcccttcctcttaattcctcacttcctgcctccctccctctttttcattttgttttttattctgttttgtttttgaggggtactctgttctaaatgtattcaaatgattataaaatattcatggcaattcttaggactgggcctggcgtaccttaatttttcaactgatcagcctttccggtttttcttaacaaaggaaaaccagatcttttgcatcccataacttcgtagcaaagcctccatctggaatgaattcggcatctttaacaaatatgtgttctctattcaaaaactatctaaaaatagttctcaaacaagtaagaaaaaatattttgacattttcttcatgttttgggtggtaagcacagtttgaaacaggctttctgttaattttcataggcttaggagtggatgtacttttgtgtgcatgtacaacatattttgctcaaggatgctttctgatccaaactataccatggcagttgtgtttttttgcaaggcacaattcttaacatgagtcagcttttccatcaaactcaattacaagtattcaaagtaaaatgctcaatcaagatctactgacacatgccaatattgattttgcttacgtaattttagatgaaaaaaaaaaccataatcaacctgtgagacggtgtttgtggcctcaaccccaaagatactgatggcaatgactttattgcggaacgaaaggattactttataggaaagctgggcccctgtaagaacagtatcacttcctataatttattaatcagctaccatgtcttaggcatcatgaaatgaaatatacatatgtgaatattcttatacagagatatatcttgtcatttaatcctaaaaagatattattagtcattctataatgaaaaaactgaagcttgcaaagttgagcaaattgtcaaaggtaaattggttaaacattccaacccaggcctgacactgcctgctttgccatcatgttttccttttggaaagacaaaaaagacaatatgttgatttttgggggtcaaattcatatttaaacaattacaaataaaattaagtcaaattccatgtaccttctcctatttcctagacttctaatactctttggtcttttaaagtatacagttttagcaaatctgaaacggttttttaaaatgctctaattataatttcattgtaacatgcttaaaattctaaaattaactctagagtatttatatacatataatatggttaattattcttaacccccacagcttatcccttttgttattttttaaagatgatttcactttaaagttggtgctcatttatggaaatatttgtaaactaatgaatacattgctatcactggagtaatttctagcacccaacataatgtccttgggatatttgatacaaaatgttaaaaaattatccctattgatcaaaattatttttctatatgttaccatataggtactaaaatagtacctatatggccctagtaatctgtaagatttaggaatatatggctggatgcagtggctcaagcctataatcccagcactttgggatccaggggtgggaggattgcttgaggccaggagttggcgactagcctagacaacataatgagaccccatctctacaaaaaattaaaaaattagctggtcatggtggcatgagccttttagttctagctacttgggtggctgaggctgaggcaagaggattgcttgagaccaggaggttgagggaactgtgggctatgatcatgctgctgcaacccaggctgggtgacagagtgagaacctgtgtctaattttaaaaaaagactcaggaataggaatacactagggaaggttatgttttagatgttctaatgtgatatgaagctgcacagaatcaaagactaatgtaataatacaaccatctgataaagcacaaataaaaaacaaccttacaatactacttgtctctacaaacactgtgtttccagtaaaacagttaggggacatgtttgataagcctgatctttctaaattacatttgtggtgcaaaatgatttctggtaattataatttaggaaaaagcaggtcacttggaaaacaactctgttgactaccttataaccttggctagaatggtataaatggaagggactcatctattttgacctctccatttttgagatgggaaaattgaggctcaacagtatcaagtgacagaaagcctcaagacctaaggccagttaaagatgtagggatctgggaacaaaatatgcatgccatgatctgtgctgtttcttctgtgttgtgattgggtctctttaagctttttttaaaaacgaagctccacatctattttgtctttgatttgcattcattttcatatgccagttataaagtatcaattctagcatcttaaatatcacaaatgaggcttagaatgtatttaatacttcatctatgagttatataaaagcaaataaaatgtgtcataatttacagattggtgtcaactgaagcacaaaaaaagagtaattggtttgccttcagcccaacaatatggtctttgtaaactacagaatagaatctctcctgtaaaggtttagaatagtagttctcaaagtgtggtccctggacaagaagttttagctccatctgggaacttgtaagaaatgcaaattctcagatttctgctcagacttactgaatcagaaacacagtgggtggagtccagcaatctgtatgtgaaaagctcttcagataattttgataaatgctaatgtgtgagttactggtctactggtctagattatgctgtctaggatttctcctctcctctcctcctcctctcctctcctctcctcctcctctcctctcctctcctctcttctcccttccttcctcatccttattccataaataatttgttattattattattatataaataatttattacttttgcatgagtaatgtctcttaagaaccaccgtatcagctattactccagacttctgatacggtttagaacaaattttgtcaccatgttatggttgagtggaacagcatcatcaattttgatatgattcttggcaggtgttttccttgctaatttcaaatgattgcttcacctgttagtctctgccactcttgctactaattgtcatctttgctagcagacctcactcagaggtcagccactgtaagccaggagactccaggatcctctaactcttgttggcctctcacccccacctgtggtatcccctgacagggctgtggaaaggatgagttagtagaggaagcctgacttctctagggcccatgccgtaattcttctggagataagtagggaagcctcattcttcaagctctaggccccaatcctgttttcaccgacactaaattcacttcattatccttgtctgcctgaagacagaccaagacaaatggcatttacaaatgaaaatcttgggggcgggagcattaaagtgtgcctaataagaaatcagttgttctctcagtgtttcgtgtgctggtctgagcaccaggaagtggctgcaggtcctcgcagatgtggaatttctgaactgaatttctgatattttgttgtccaaaaatagtcggacagtactatttgcagtcattaatcatgattattaagcaaaggatcaggagagctttacagctgttatttaactcctaatgacactgcagagtgattagatctcaggtagactttaacttttttttttttttaagaagaaagaatgatgtggtcagaacagtcatccctttttagtgaggggaatagcggtattaaataagcagttgcctcacaagtacaattcctggagttctggcaagaactgctatctaaaataatatgttattcacaagtctcagaagttatgttaccctttaatagagtaaaaaatttgaatgcattagtggaagatttcaaggataatagaaatgccttgaaaagagacgaactattgccttaaagtcacaagatggcacagagtatgttgtctgactatgcatcagtgtagggtgagcagcacattttgttgcctgcaggtaggaggaaaatgagagaagtagcatcctttgcacctaaggagatggctgccaagggaaaacgttgtgcaaaaacaccaagttggggccagacacaaacattgccttgcatttttgctgaggacaggtctctactgatagatatcttctattaaagcacaatcctagatcaaagtaatgtcaagcacatataggaagatattttgatagagtttgtctgtcttctcccaggactggctacataatttgtggagcctagttcaaaatgataatatgaggcttctggttaaaacaacaacaacaaaaataagtatttcagaggtggtagcaaagaattaaactaagaatggtgtccctctaagtgaagagctctgtgtaccagtttcatgcccatgaagctggccttgtcttcctttagcacatttactttttctgttttttatttggccaatggacaccgccattggggtgttatcttatgacagaatgcaattttgcaaagtctaattttaaaattgtgtattaaaagttttccctggacttaatgaaggactttgaataccctctctagttgccaaataaattgagtttaatgaatctcaaaatcatatgtgttcatcatattctttatagcgtcagttccaagtttgtactagagagatttgacaaaatgccacatcttttcttctgttcaaaagtcaaatatccttagaagagaggaataccttttgcctgaatctattatagcacaagcaaagctggttttactgtaaaatcccctaaaaccaattctactttttaggagatgtcaaatatcttggttttctctatgtgcttcgctttttcagtttgacaagataattagatcatagtatttcagtgacatagcagaaatggtagcaaataaagtacattttatattttctatccctccttcctattatatatatcatttttaaaaagtttaagttaaatccttttttaatagataaaatgctatctgtaatgctttttaaattaatttaaacttagtttaataatttttaatatatttgtctgttttattagttttcaacatgtgaaatatcattatcataagcgccataccactcttgcagtgattaaggagagccagccactagcaataatcctttttcttgttaaaggaaaattaatccatgtaaatatgaaaaatccctgtatttgtagaaataaaaatccatatataaaaattcatatatacataaaatgctgttatacgtatgcagatataaataaatgaaatcttaagtaatgaaactgacaagtggtaattgcatacaaaattatgaaatacagaagaatcaaaatgttttgtatattctctcatttaattattaacaactctgtgaagttggctttatcactactttgtcagaaaaagagattcagggaaatttcattatgttgcccattgtcactcactggaggatttgaacacttatttgtattaattctaaaatccgtggtctttccataccactctgccatctcaagcataatattttaaatcttataagtatttttattttatcatctatttgtatttctacttttttatattaagtaatataataaatattcaatttgaccagcaaggttattaaagctcaaggaggtaaagtgaattgtctgagcttgctcatttctctgggagcccatcagaggctggaacattgcactgatgacccccagctctgtggtcttgtccctagacctccacttggcttctcttcctcttactgctcttaactaacagcatgcatttgtctttagtggtttataatcctttataagaatttctgcctatttaacatatatgaaattattatttttcacctcccaccatctaaaataataattaccctcaaacaaggaagacaaactaaagtcattttttattctgaaaatgtagaactgaactcttcattttcagtatgatgccaaacactactaactggatttcatttaattggattaaaactgacgggacacatattctctcgaatgtgcaacctcacccctcttgcttgatcttcataaaacatcatgtatttagtcagattgcatccctggagatacagttggagtagctggtgactctagagaagtctgaaagtaagaatacgattcttgatgtgataaggagatatatttttgaagtaacaacatggaataaatcaagaatagtctgtgctgaattttgagttatttccagaagtggaggcttcaggtgtgaacagaaaatggaaacctggttttcttaccaattgatttactagatcatccgaggagatttgagacctagttctttctgctactcacagatgtatggaagagctgcccagtcataaaaccaattttgaggccaatttcaagtggacagataatggtaaatctttaattagtttgattatatttttagccagttgcctttctggatttggaatatgctaaaaattaatttacctgtgccttacccattgtgtctattattggcacctcccatttctatttgaataaggtattgaaagtttagaatcattgaaaaaagtatttttatagtatctttaagaatcacagtacaataaatagctaatttaaagcttggatcgtgaaaacacaatggataacatatagtataacgtagctatatgccgaggatattatcaagtgggtagggatttatttccatagttataaaaaatataattgccttgaaacttatgttttacttctacttcgatcaattatatagtcaggtaagtatatgttaaaacctatacgtagtggttgaattacacagtttttcacacattatacaaatagttcatttgtttgagaaagagttgaggaagatcctccagccccttctcactataaaattatatgattctaagtttataagatacaaaaaagccaaataaatggaaattaatggaaaaattgatttactggcttgtgtgagagtagagactgaaattctacttagatgcatgttatgtattatgtttaagctattttaaaagtagggctattaggaaagaattttagtgcaactggtttcttatatagttgctattcagtaggatacttttgaaatggtgaaaagtttgtatctgtatacataaaactcaattcagtaatatgtttgtatccatattgttgatctaatgtagtagtataaaaacaacctaaggaagagcttccatgcgtacacagaggttatgagttgtggtctgagcgaaatatcttttgggattggcttataacaagtgagtatttgcataaataatgccgtttggggagttttttaaaagaaatttcttaagatatagccagttacctaagaaaatattgtgttttctatttatctagttgtaccgacactgataatgttgagaaatctacattaattgacaaagaagaacaatgcaatttgacatattaactactttagtctgagtgaattatttttggatctttcaaaataaacttgctacttgaaaaaaaaatttacatatctgtctaattaatagactatagtttcccttaaatagacggctaatattttacccttatttatgaacagtttttattttgtatgtagtatcaaatcacagaaaaaaaaatgttcctaacttcaaaaatggaagacaacatgcctctcaattggaatacgacttaggtcttggctggaatgttggtgaactgaaggcactgaggaaaaccagttcaacctcattgtccactagaaaacagttcctttacagaatgaagaattaaatatggtggcataaatttaactttcctgctgcttttgatcctaaggtcacaactagtaagtagcagagacagaatttgaactaagaccgttctctgcattccctattttgctatgctatgtagcagattgggctgcacactggtagtttgcctccattatccttgcccttcactacaataatggactgcaaacataaataacagtgttttcattttacagatacagaaatggggagtgagtacagtacaagtacttgcctaagggcatacaataatgggtggtgaagctgccatttggacttagatctctttcctaagtctctattattgcctatattgaccccagacagaagaaattacatttttctcccttttctcctccctccctcctttccttctttccttccttccttacgtctgtccttcctttcattaaagcaaagaaactaagctccctcatatttgtaaggaaagccttttcatatcacttttattcatccattatttgtaaaggcatgttgtcgaccaggtgctgtgctaggcatcatggagtgctaaacagttgtgaacactgtcacagtaccatgtggtctgtagaattttatcacacaatagcaatggcttacttcctgaaaagtagaacagacactccaaaaaacgtagtatttctcttaacaaaacaagggcaaattgaaattgtccttggttctgcttcagttcagcagttttgaatcttcttttgggaactgctggtagagagcaagttcccaatcatggctactatttttagcttcataagactcttgtgtctataaatgatattcccttttttgaggataatgtcttaaatgcagtccaaaatcaattagctattatgtgcaaccaggctacccttagaaaggtgactatccttttttgtatatatttaccagtatttgccacccagaccacaaggcaagggattgaggtagtcactggtatttttctgggagtagcttaagcttataattttcatgtacatatttccctttctctctttccaaaaaggattatttaaatttttcaacatttaagcatagaggaaataaataaaataggttatcttgtcattttctccataaggaacttcttcagaaaagacagtgtgtagacagtcccagtggctgtcccctttaactcaagcccaggacctacagatttctctgtagctcaacaaaatgtctttccacaaagggctggaggattcttaattatcagttgttgaatttcagtcatcctgataacaccatttagccaactgtgatggcagcgatatttgtcttgttaaagaccctgaagttaaattactgctgtactattttccttcaagcctgacttgttagttatggtggaagtgagctattgactggggtcctcccattcatctatacttcctttattattttaaatgatctctagagctaaggggcagcaatttgcattatttattcaatgaattctacctgatagtcttgtctataatttcccttgtgaagagaacagaaagactaagaatgaataaattgtctcttgaaaactcatggctttatctgcttctgtcacagaaatgctatagatttcagttttcttgactgagaaatatttaataacaagaagctctacattctagcagtttaaaaggaggaggatttttttttcccccactctttgtctctcactgtttcttcctctcagctatactttacctaaaaccttaattttttcccccattgcttttatggggattcctctgaaagacataaaatgcctctctccatgagaagccctgtcataggagacagctctttccatctgtatattttacttgccttgcatgtaattttctcatccaaatggaaagctcaccatgctctaatgaaacttactagagactcccagaaaattcatgtaaccaggtttatgtgtgggtctgatgttttaagggacagactgacaattcatggccagaggaggccattaaggaaacaggtttgattgaagtcccgacacagatgttgacagcataattaaaatgattaattggagtaagagaagtgtttcaaactaattagaaaaatggtttggttatacccccagactgtacaaatggccagaggagccaatttttttatatagagaagggaaaagtgaagatgtatgttaaaacaatgtcattcttcttttatcaagaggatactgcaaagtttaaaactatgattattgttatgttggttttcctgtgagtctttaggtctattatcccagccccttttgccaggtggctgactgggcataggcgtgcagccacgttcaagaaacaaagggaatacttgcatagaactggagttggcccatattgacataagacagttctcaatcacaataactatttacttgcatattgcttctccagagagaatacaagtaccccaaattaccatcagatggcttagcacatagtagggcctcaatattttgtgtgtttgctgaggcaaccaaagccatatttttaagtatgcctaaataataggactgagaaatttttcttccagttatgctttcattttcttgattatttctgttttattgtgaatcctagtaaaggcaattcattctttttttttttttttttttttttttgagatggagtcttgctttgtcgcccaggctggaatgtagtggcgcgatctcagctcactgcaacctccgcctcccgggttcaagtgattctcctgcctcagcctctcgagtagctgggattacaggtgccgaccaccatgcccagctaatttttgtatttttagtagagatggggtttcaacaggttgaccggactggtctcgaactcctgacctcaggtgatccactcaccttggcctgggattacaggcgtgagccaccgcgcctggccagcaattcattcttatatcttcagaaaacctgaactatcatggaccaatcggttttagagattattaatgagcattagcaggggcatgtttcagaactctttgcagacacaatttagttaaaacatttcttagtttctataaaagcaaatgtatgctattgtggtgttgaagctctttgtacacaaagtaaacattacgtgaaagaactcctttggcctgcaaacataacatttaaatggctattgaccatatgtttctaactaaaagcactatgaaaaacaagttcttgccagatttcaggtttttttctagttgtgctctgtgaagcctggtggtaggttttcagttaatgcctttggctacatgaacaaggagtttcaccaagaatgttgggaattcctttggtgaccaaaaggaaatatgaagactctggaggctgatgagagagacaaataatggggaagtcataaacatcatgccaattcctgtcatttatttcattttctttttaaaataagatctgaaattgtttaaaagaatttttgaaaagcatcaagttaactttctagcacttttaagtttcatgtaaatcagtattcttcaagtgccacataaatatgtgtaggtaagtgtgctatttctaggtctataatatttaaagatatttaataaataggtttcattcgttgcatgcaggatgctgactaaaattgatagaggaaaggtctaggggtttgtttattttaatttaatacaatgaaatacacttgtaatcctattaaattatagtctattttgtatattcttgataattgaagttattatctatgggtgtgtgcattcgcgatggggggaaaatggtctattgggaagaatggcattttgacaaatcacaggaaatagtcaattatgtggattccacgcagtttccaaggttatgacaaagattttacccctgaaattcatgaaccatagtctggagggagtttggatggaattacaattcaagtggtttgttttgggaggagtatagggtggggacagaattaaatgttcagtttatttctccccacaaaactcgccgtggcagcacccttaagagggagagaatgcaaacttgttttctttaacacaaaatttctagcagtatgaaatactgaaacattccggatgataagggccttaaagcttaggtttatgatcataacaataacctattcacattaatatactcaataaagttggctatatacatgaagtgctaatgaagtaaacaacaaatgagttttccaggatgctgcatacttgaaatttactgagtgtagggtctctttatcaataaagttggaaatttatttttttccatcgttttcctcttgtttcaagtctcttcactgccttgtcatttaagtaaatgacaagtaaacaacacatgagttttccgggatgctgcatacttgaaatttactaagtgtagggtctctttatcaataaagttggaaatttatttttttcctcagtattcttgttttcgtcttgtttcaagtctcctgactgcattgtcatttaagctgttaaggctgaaaataattccccaaaggggacattgaactaaaatatttcaggcaaatttatctctaaaacttttaatctagtcaggaaatattaataatcgatgcaggtggggttgtgcataaaagaaatgctataaaatgctacattgttcatcgagcatatagtcagacaaaacactgcatttactgtctccagaaaatgaaagttaatttatgtatttcatcaacagactttattatagtgccacatatttgtggtagacttaaggccgtgagaaattttcactcttgacttctctctgttaaaaaaaaaaaaaaaatcaaatcaaaacactctttatgtttaaaaatggttacaatacagtaataaaaatgtggcttactctttgcttttcactaataagttgagtagcaattggcaaaaaccaaaaatcgtaaactccctgagctccaatttcctccttaattaaatgaggtcacagagaccaggatccactttaagtagcaaattgaggctcaattccgaaattagaatgtgcagctcccattcaataatccatctttaataaaaatgtagattaacattgtgtcccatcctccagcccaagtctgcagtagaagggacttgagagtaagatgcttggtgcttctttttctttcctctcttgcagttcacctcattcttcaactgctggttctcatttctaaccctgctagtgtcaaagtgagagggtaggggaggacaggtgaggaaggtagggaagttcgtacttgactttcttgagatggctttgtatattcttaccaggtctctctctttcttgagatctttcttaggctcctttgaggcctttactgtggatgtttgaaagcacatctgtgacattgatgatagatttttctccagctctctgctccctttgcaccccgtggagatctactcctaaaattctctctgcaggaatctcattagcctccagtggttttcctggacaggagacaaaaaagctacagtcgtactctctctattcctctgtaacccacatcttgtccagggacattgatccctggctccaacaaagtctgagaatgcaggtcaatcccaatacagctgcacctttctactttgtgcccaaagcagttcatcagttgcttactttgtcctctatgtttcctgtatagggaccaatcacagttcactttgccgtattaactcagagcaacatattaagctcttgaggggtccctctgaagctcctctgtcttaacttgagaagcaagcacagaataactttctccaaacagatctttaacacaagtccttcttcctggtttcattggtttgcactaatttttaatcctcaatgtagattttaggccatttagctctctgtcaccctactctgacattttgcaaatggtattgtatcgtgtgtctaacaactcagctgtctgctgtctgttttatcttggtgcctcagttaaagaatccaatgtaacatgctgttgcaaatgagttaaattccgatagccttcagaactaattttttgtttctctttgtgaatccatcccatgaatctcgatttattcataaaaatatagttgttcaggccgggtgaggtgactcacgcttgtaatcccagcattttgggaggccaaggtgggcagatcacctgaggttgggagttcgagaccagcctgaccaaaatggagaaaaccccatctctactaaaaatacaaaattagctgggcatggtggcacatgcctgtaatcccagctactcgggcggctgaggcaagagaattgcttgaacctgggaggcggaggttgcagtgaaccgaggtctcaccattgcactccagcctgggcaacaagagtaaaaactccatctgaaaaaaaaaaaaaaaatctagttgttcattttgaacatttttgaaagttagggattttttaaaaaactgtcattataaaattatggctaagaattaagggatgactgttcctgctagttagcatggttcataattggttgttttttgtttgtttgcaaattgaatgatcaattgagttaggtttggttctttcattttagagattgccaatatatgtaaaatttgtctagacagggattgatgtccacagaacagaaaatcatataggtaattatataaagtaaactaatttcagttagtttacttcatgtaaaataagtgaaaacaattcaatcttaaaaggtcttcatgtgacgaaattgccctaagcatctcatgtatgtataaggcactatagtagacagtacaggggccacagagatggagagaactaagctccctctctcctgggacaaagcttatgctctgctctgaaagtgtctgtcttgagtgagccttaatcagcatcgcgaatatggagtatcttagtttcttttgaatggtaatcgattgtttaggggaatagttttaaatttactaaataatgtgtttttcttttaatgttaaggaatataaaaaaggacccccaaaatgtttcataatctactgcacagataagccttttgccataaaaggtaaaagaaaaacaaagtaaaaacaaaaaactataatgtgcatggtaaaaaaaaaaaattaatactatggaaagctataaaaggaaaagtggacatcttctgtgccattttctccttccaaatctaccattaacaattctgcctgcttttctagaaaatattatgtgtatatatatatatttgcacatatataaagttattatagatatgcctataccaacttgcttacttgatttcttccctcctttcctcagttgttcattttgctttttctcttaaagcactacctcattctttttaatagcaacgttgtatttgctgtagttaattagtccactcttatggaggctttcattggtaatacaaataatgacgtgatgaacattttcctgcaaatttccttatgaacctctaggatcgtcttcttaggattaatttctctaagagttgctgtattacatcaaagaaatcctgagttttctgttattgtaatagaaattgctaaactgcccataagaaattatccatgcatttacacttcacccagtacagttttctgtgtttcctcataattgctctaacattacaatcactgtatttacaaatgtttgccaatctgaactgtgaaaaacacaatctcttaattttactatatatctacttcattacaaaggaggataaaatatttgtatgtttctcctggaagcctacccttccttacagatttttcactttgtattgtcttttactgacttttttgagttttttttagattaaggaaaatacatatgtatttgataaggcattgcatagattttccccaattagttttctgcattttgattttgcttatgatatttttgccatatagaagtttaaaatatatgtataataatatctcatatgtttttcttttgtgctttctaggttttgatgtctacttaaacacctttcccaccaaagcttatgaataaatgcaaccattctttcttctagattttttttgtatttatttttatattttagtgtaagcgatggaatacacatgtacgtgctcatacattgcatacacacacacacgtacctgtgtataatttcagtccaatcaactggacctagagtcccaacactaattattgtaattattgaataacttctccgtgtataccgatttgaaatttggttgcgtcattatggatttaattctcatatgttttggttatatttctgaattcttctattttttacatttgctatagatctatctcttctccaaaaaagagtattaaaaattatgatttcataattatttttaagactattctcccttcttgattcttaattttcaaaaattttctgcaactgcgtctttttttgagacaaatattttgttcgtttttgcaaacatacactaatttatggataattcatttgggcctacattttacttataagttaattttgaacaattttggcttctttatacattcaggtcccccttttatagtgcatgatatatctatttattcactaaaatattttatggtatgtggttgaattttaaatttcttcacttaagtgatataaatttatgttagatttatacccagtattttatatttatttttaactgatacatgatacatatttataaggtacatgtgatattttgttacatgcagtagagtgtataaagatcaaatcaaggtatttgaggtatccatcactttgggtatttatcattgctatgtgttgggaacaattcaagttttctagctaggttgaaatatacaatacattgttgttaaacatagtcactctattctgctgttggataatcactcttatgccttttgtctaactgtatgtttgtacccatcaacctacctctctttatccctcttgcacccataaacacttcccaccctgtagtttctatcattctactctcactctttatgagatcaacttttttagctcccacatgtgactgagaatatgcaatatttgtctttctctgccaggcctattttacttaacatagtgacctccagttccatccatgtcactgtaaatgacatacattcattctttttttttttatggctgtacagtatttcattgtgtatatagtattttatgtttttgcttgctattgaaaattggttcatgccttcattatacttaatacgtttaaatggcaattttatatattgctttcttatagaataatcttagtgttcctaatatatttttaatttgatattcttgggttttgttaggtgtaatcacatcacctaagattggtgataaatatgtctgattctggcttcccatttctgcaactctttttctttctcttatctgattgcattatctagtacctccagagcagtatcaaattatggcacatttttattatgttcttcattataatgagaacaattcttatttccccattaaatgtgatggtggcatttgactttgtgtgtattggtacaaataaaccagatatttttattatcaggagttttttattattaatattagacgagctctgtgtgccattttgcgttaaaggagtatagatttatagaaacatttatttcttaaatagctataagctactttctttgcttgattgaagctgggcatttttgctgttcttttgcttataattaggtctgtaggaaggaagattttgtaatcatgcttcattttgccatctgaaaggaaaagtctggtgggaatattttaattattcatcatggaatctctgtatagcaaatcaaatagagttatgtattttttacttgatgattttgctaatgtggttctaatactcacaacttaagcaaccaaaaacaaccaataatattttaaaacaacataattaattattgcttgaaagtttctaccaaggggcatatggacttctatgagatccaattataaaccaggaaaaagagagatcaacacttgtattttaacacatatgcagtttcttattagcaaaatttcactgataaacatatgctaagttattatagatgtgagccaaaagttctttagaagtaggtatattctgcatttgaactctacagcatttgaaatcacattggctgacacgaattagtattagatctggaaactttgccagtaattcttctagtctccaggaaaagtgaaagcctttcattttggttttctttttggtttgttggttttgctttcatttctgatttttgtttggtggtaggtgcttttatgaaatacttttttaaattacccttactatttattgattaattgttggtaattattaattatctacctttcttagtgtttttcttcaaactctgcaattaggaatacccacatattggaacatttgctactctatctcattccacatgtgtgtgtatggtgtatatatgtgtttacatatttgtgtatattaatttccacaagtattttatgcccataaatattcatgccataatagacttttgttcatttatgatgcaaaaattaactctgaagcaaactgtattcttgcttctcatggtcacatactttctctctctgtctctaagctttgttaacctagtggtaaattctgtggtacccatttgcatgcatacatacgtgtgtgtgtgtgtttatgtgtgtatagatatagacatagatatagatattcttgactatttgtatccatggtgcacgtgtgcacgtgcgcacacacacagacacacacacacacaagtatgtatacatggaatagcaagtctctaggggctttgctgaagttaaaccaagaatttcaatatatgatactactactaaacagtatcaggccctgcgaacatgacacattcattgccaacatcaggacacctaatagagtggatactgaccaagggggtgtattcttgcccagatgatacttatttaggcaatgccagtgttggctaatttcacttttccttcatggcctctgtctctctgttacttatgtagcactcattctgtgtcagactgtgttctaagaacttcaactatattaaccttacttaactgttaaaaagacttctgagatagataccatttatccatttcattttcaggtgggaaattgaggcataaggcatttgggcaatgtgttcaatgacaattaaacagctagaaagtgcctggttagctaggatgtaagccaggcattttggttcctgagcccacactcttatacactgtaatactatctcattcatcctgctgtaattattcatttaattacatgagctcctgccagactgcatgttctatgaataaggggccatgtcaatcttgcctgtctttctatcttgtgtcatcataatgcctggtaggtaatagggaatacataactggttttcacttttaattgaattaaagtaaaagtttgtctctataagatcccttttcatatatcttcctgataaaaaacctgtttaataagctgaaaagatgaggtttcattaagaagaggtgatacagaaaaacaacaccatatttttctaacttatgcctcatctggcttactgcttagttcccatttgtcatcagtgcacttaaaaaattattttgaaaaattgccatttttaatatctttggaacttcctaacacattacctattttttaaccaaacgaggtgattccttatgggaaaatatatacagcaagaaaaaaaaaaggaaaaaatgttgatgatacctgtttaattgggaaatatgtttgcatatttattatatctcggaaagaaatgtatgacttattataacagcatttagtcttccaaaatatcagtgactccacagtatatgccttcatttccaaaatgaggggaaaagcattgagtgtatagtacttcctttttttcccccacaaagaaaaaatcatagtggaaattacattgaagaataatctgcacaaaacaaaaaagcacaaatcttatgtttctggttcagtgacttttgataaaggtaacccataattactaacccaatcaagatacagaaccattctgtacctctggaaagttcccatagtctccctcccagtgaatcttccctagtcaccccttggtaaccattgataggatatctatcgcaataacttaattctgcccattcaagaacctcattttaaaccttacaaaaccagaagttattgaaagagatgtgattgtaaccatctttgtttttgtaaggaccacgagttaactacacgtagatatatcatccagagaaaagtcctgataaaagtataatcagtgcaagttgaattcacaggtaaggtttactgtagacgtggaagggtgtttcaaaattactcttgagaaacaggtctcaggctaacagtttctctcacctctgttgcattgtctctttcttttgaataactactgtgtgctgtggtttcacaaacctctcagtaaagtagtgatgggaaaatacttttgttctatgttttgttgacctagtggtaaattctgttacccagctgtcaagcaattagattataataatgaatattttcttaaggcaatttattgggccaaagaaccctgtgaataaatagtagtatcttttattttcagagagcctagttaacatccctccacttgctaaaactagccagaatgtgatattagtgactttcattctattaaataagcattcatgattatcctaaacattcttgccaaatgtgcatatgaaaatagcatagccactgtaattgttaagtcagtcaatttttctcaaggactgtgttgctttaaaaagttagtagtgtttacacattcatgtgattggtctgaagtttacatgctaaataatatttactgtgaaagatgtgtgtgtttgtcagtggatgtgtgcatatattcagatacctaatatgaccaatgtgacaagggaccccatttttttctgccataaattaagggttaatgatagcatttattgcattgagctgctgagaggaccaaatgagataatgcattcagaaatgttgagtgttatttggtttggaaattgataaaaagggcaggtcttacatcgagtgcagctttacaacatattatccatgcatgattacatataaacaaaaatgtttagtttagaaagggaaaaatagtgggtacaatcacagttttattttatttttatatatatattttttattatcctttaagttctagggtacatgtgcacaacgtgcaggtttgttacatatgtatacatgtgacatgttggtgtgctgcacccattaactcgtcatttacattaggtatatctcctaatgctatccctcccccagcccccaaccccacaacaggccccggtgtgtgatgttccccttccggtgttcaagtgttctcattgttcaattcccacctatgagtgagaacacgcggtgtttggttttttgtccttgtgatagtttgctgagaatgatgatttccagcttcatccatgtccctacaaaggacatgaactcatccttttttatagcagcaaagtattccatggtgtatatgtgccacattttcttaatccagtctatcattggtggacatttgggttggttccaagtcttggcgattgtgagtagtgccgcaataaacatacatgtgcatgtgtttttatagcagcatgatttatattcctttgggtatatacccagtaatgggatggctgggtcaaatggtatttctagttctagatccctgaggaattgccacactgacttccacaatggttgaactagtttacagtcccaccaacagtgtaaaagtgttcccatttctccacatcctttccagtacctgttgtttcctgactttttaatgatcaccattctaattgatgtgagatgatatctcattgtggttttgatttgcatttctctgatggccagtgatgatgagcattttttcatgtgtctgttggctgcataaatgtcttcttttgagaagtgtctgttcatatccttcacccactttttgatggggttgtttgttttttttcttgtaaatttgtttgagttatttgtggattctggatattaaccctttgtcagatgagtagattacaaaaattttctcctattctctaggttgcctgttcactctgatggtagtttcttttgctgtgcagaagctctttacgtagatcccatttgtgaattttggcttttgttgctattgcttttggtgttttagacgtgaagtccttgcccctgcctacgtcctgaatggtattgcctaggttttcctctagagattttatggttttaggtctaagatttaagtctttaatccatcttgaattaatttttgtataagatgtaaggaagggatccagtttcatctttctacttatggctagccagttttcccagcaccatttgttaaataggaaatcctttacccatttcttgattttgtcaggtttgttaaagatcagatagttgtagatgtgtggtattatttctaagggctctgttctgttccattggtctgtatctctgttttggtaccagtaccatgctgttttggttactgtaacctcgtagtatagtttgaagtgaggtagtgtgatgcctccagctttgttcttttggcttaggattgacttggcaatgcaggctctttgttggttccatatgaactttaaagtagttttttccaattctgtgaagaaagtcattggtagcttgatggggatggcattgaatctataaattaccttgggcagtatggccattttcatgatattgattcttcctatccatgaacatggaatgttcttccatttttttgtgtcctcttttatttggttgagcagtggtttgtagttctccttgaagaggtccttcacatcccttgtaagttggaatcctaggtattttattctctttgaagcaattgtgaatgggagttcactcatgatttggttctctgtttgtctgctattggtgtgtaagaatgcttgtgatttttgcacattgattttgtatcctgagactttgctgaagttgcttatcagcttaaggagattttgggctgagatgatggggttttctagatatacaatcatgtcatctgcaaagagggacaatttgacttcctcttttcctaattgaatgccctttctttctttctcctgcctaattgccctggccagaacttccaacactatgttgaataggagtggagagagagggcatccctgtcttgtgccagttttcaaagggaatgcttccagtttttgcccattcagtatgatattggctgcgggtttgtcataaatagctcttattattttgagatacatcccatcaatacctaatttattgagaggttttagcatgaagggctgttgaattttgtcaaaggccttttctgcatctgctgagacaatcatgtggtttttgtcattggttctgtttatatgctggattacgtttattgattttcgtatgttgaaccagccttgcatcccagggatgaagcccacttgatcatggtggataagtttttgatgtgttgctggattcggtttgccagtattttattgaggatttttgcatcaatgttcatcaggggtattggtctaaaattctctttttttgttgtgtcgctgccaggctttggtatcaggatgatgctggcctcataaagtgagttagggaggattccctctttttctactgattggaatagtttcagaaggaatggttccagctccttcttgtacctctggtagaattcatctgtgaatccatctggtcctggactttttttgcttggtaagctactaattattgcctcaatttcagagcctgttattggtctattcagagattcaacttcttcctggtttagtcttgggagggtgtatgtgtccaggaatttatccatttcttctagattttctagtttatttgcgtagaggtgtttatagtattctctgatggtagtttgtatttctatgggatcagtggtgatatcccctctatcattttttcttgcatctatttgattcttctctcttttcttctttattagtcttgctagcagtctgtcaattttgttgatcttttcaaaaaaccagctcctggattcattgatttttggaagggttttttttgtctctgtttccttcagttctgctctgatcttagttattccttgccttctgcaagcttctgaatgtgtttgctcttgtttctctagttcttttcattgtgatgttagggtgtcaattttagatcttttctgctttctcttgtgggcatttagtgctataaatttccctctacacactgctttaaatgtgtcccagagattctggtacattgtgtctttgttctcgttggtttcaaagaatatctttatttctgccttcatttcgttatgtacccagtagtcattcaggagcaggttgttcagtttccatgtagttgagtggttttgagtgagtttcttaatcctgagttctaatttgattgcactgtggtctgagagacagtttgttgtgctttctgttcttttacatttgctgaggaatgctttacttccaactatgtggtcaattttgcaatagctgtggtgtcgtgctgagaagaatgtatattctgttgatttggggtgaagagttctgtagatgtctattaggtctgcttggtgcagagctgagttcaattcctggatatccttgttaattttctgtctcattgatctgtctaatgttgacagtggagtgttaaagtctgccattattattgtgtgggagtctaagtctctttgttggtctctaaggacttgctttatgaatctgggtgctcctgtattaggtgtatatatatttaggatagttagctcttcttgttgaattgatccctttaccattatgtaatggccttctttgtctcttttgatctttgtttgtttaaagtgtgtttcatcagagactaggattgcaacccctgcctttttttggtttccatttgcttagtggatcttcccccatccctttattttgagcctatgtgtgtctctgcatgtgagatgggtttcctgaatacagcacactgatgggtcttgactctttatccaggttgacagtctgtgtcttttaattggagcacttagcccatttccatttaaggttaatattgttatgtgtgaatttgatcctgtcattatgatgttagctggttattttgctcgttacttgaagcagtttcttcctagcatcaatagtctttacaatttagcatgtttttgcagtggctggtgcgctttgttcctttccatgtttagtgcttccttcaggagctcttgtagggcaggcctggtggtgacaaaatctctcagcatttgcttgtctgtaaaggattttatttctccttcacttatgaagcttagtttggctggatatgaaattctgggttgaaaattcttttatttaagaatgttgaatattgacccccactctcttctggcttgtagagtttctgctgagagatccattgttagtctgatgggcttcactttttgggtaacccaacctttctctctgtctgcccttaacattttttccttcatttcaactttggcgaatctgacaattatgtgtcttggagttggtcttcttgaggagtatctttgtggcattctctgtatctcctgaatttgaatgttggcctgccttgctaggttggggaagttctcctggataatatcttgcagagtgttttccaacttggttccattctccccgtcactttcaggtacaccaatcagatgtagatttggtcttttcacatagtcccatatttcttggaggctttgcttatttctttttattcttttttctctaaacttctcttctctcttcatttcattcatttgatcttccatcactgataccctttcttccagttgattgaatcggctactgaagcttgtgcattcatcacttagttctcgtgccatggttttcagctccatcaggtcctttaaggacttctctgcattggttattctagttagccattagtcgaatcttttttcaaggtttttaacttctttgcaatgggtttgaacttccttctttagctcagagaagtttgattgtctgaagccttcttctctcaacttgtcaaagtcattctccgtccagctttgttccattgctggtgaggagctgcattcctttggaggaggagaggcgctctgatttttagaattttcagtttttctgttctgttttttccccatctttgtggttttatctacctttggtctttgatgatggtgacgtacacatggggttttggtgtggatgtcctttctgtttgttagttttccttttaacagtcaggaccctcagctgcaggtctgttggagtttcctggaggtccactccagaccctgtttgcctgggtatcagcagtggaagctgcagaacagcgaatattgctgaacagcaaatgttgctgtctgatcatttctctggaggttttgtctcagaggagtacccggccttgtgaggtgtcagtctgcccctactgggggctgcctcccagataggctgctcgggggtcaggaacccacttgaggaggcagtctgcccattgtcagatctcacactccgtgctgggagaactactactctcttcaaagctcagttggaaatgtggaaatcacccatcttctgcgtcactcacactgggagctgtagactggagctgatcctattctaccatcttggatggagtacccacaattttaacctaaatgatttcttccaaaattccatagtttactttttagattgagccatatatggtgtactgcacaagtggattaagatattttaaggtatttttaggagtaattttgactatacttgagctaattaacgctgacgtcgaatctattccctggcaaaagtaaactccattgtattcctgttctttagtccttttggtagaaacccatttgggatattattccaacatatattatctatctatctatgatcttgctttgtacaaatacataaatagatgattcccttgcttttgatattttgggttgagtagaaattttgcccctctcatctgtccataaggttggcctcatctgtgtgcaagtctgaccattatatctgacaatggcttgagtgtctgcttttttagttttgtgctcacctcaaggcctttttagttgaacttggcctctctccatgctttggcctaaatctgagggttgccttattacaatccttcaggagacttagtgtgttattcagaaagttggatacaatgtgtttattttacgatgcatttgggcagaaatatgcctgggaagaattgaaactagattgttccttatttttgtttgtctactttgtgactcagtgcctttactacaaataatcatgacgagatcagcaagatctggttactatctaatatgatacctacagagactctctaatccaaggctttatgaaacatcaaaatgtgaaaaggatgatgaaggcttcactaagtagtgaaaatatttatacattaccacaaagtcaattgacactcaaattaaaacaactatttgccgggcgtggtggctcacattgtaatcccagtacttgggaaggccaaagcgggtggatcacctgagatcaggagtttgagaccagcctggccgatatggcgaaaccccatctgtactaaaaacataaaaaattagccgagtgttgtggcatgcacttgtagtcccagctactcaggtggctgaggcatgagaattacttgaacccaggaggcggaggttgtggtgagctgaaattgcgccactgccctctagcatgggtgccagagtgagactctgtctcaaaaacaattaaaaaaaaaaaaaaaacctgttttttagcaacagttaaaaacagcaaatattttaaaaaattgataaaaatttttttttgctatcaaataggatagaaatttaaaacatattatttaatgtggcaaagatgagcagaaacagttactttcatatactattaagtataacttagaaaaacttttgtgttaccacttgggaatattcatcagatttttaaattcatgtttcttagggccaatatttctacttctaggaagtggaatgatataggtacaggaatgtttattgcaggcatattggaaccattacatgtccaaagtgagggggaggggcgattaaatatagaacagatgcgtatatggcattaaaaattctcaaatatatcattaatcgaaaacaattctgcaaaacaatgcatatagagtgatatgttatataaaaattgatttgtgagtatatatttataaacatttacaattgcataaaaacattagcagagaataagggggattcagggaagggtgataaaggggagaagaacaaacatcaacagaggacctaattgtggcagaccgtgactatattttataacttagcagagcttccaggggttttatcataaacacagtatgtcttatctaggtattcttatgcttccacagcaaagtatgaataagtatttaagaagacaacctaaatatattaattgaagcttgctggctaaagttggcttcttttctgaggaatatatatgaaggtaactagcagcaaaacatcatagatagtatcagtcttgggccttcttcacatactttacattttcccatctataaaaagatgctttggaaacagccatgagagtccttcggagtagcccaatctcggcagccttattagatgcatagatgtgtgtctcctggtgagagtctcatgctgtgaaagtcattagaataataaattaaacttctttgtacacaggctttttaagcttcaggtgcatatccttttatgccttttccattttcttatagcttgaagtattgagatttttattgtcgaccaattgcttcctccacagttttgccagcataatgagttcgtggagtcactgatgcctaaaataatttgtggagtttggtttgaaatagctccacgtagtcctcctttttcccagttcctaagagctaactaaaaagataagacctagttaatgaaaataaacttctcaagggtcaaaatggaatatcgtataaaattatttttgatattttatattaggatgtgactacaggttccactaatgttaatatcaagattattcaatagtacctatttatatgtgtggaaattattgcataaaatttcaattttcacatagattttggaagaggccttggctgcaccaaatggaaattttataaatggaataatatttgtgggaaagccttcagaaagcaataacataaatttaacattaagctgtgccttttaaaagtaatatcaaagcaaattaggagatatatatatatattctttaaaaaattttttagatattgccattcaatttaagaaattcagtggaaaaaaacatttttccatcattcataatgttagcatggattattttctctcttcgtatcaaagaagtaaaggaaaacaatacaacattacttcttacaatggtgattgacatctggatcttctaggctaaaatttgaaaaaaaaatattatttcaaactacaatgaacatgaaacaaaaagacagtattctttgcgttaagtctctttgtattcgttccctccggcccatactctaagaaaagatcacctttgctctcttaggtatctctgttagtccttaatttctcctatggatgcaatgtccattgccctggccgccttcaaatcattctccttcacttctgccgttaggtacatgcaaatgtctactgtatttcctctgttactgaatggaaaaagaaatcaccttaatttagcttccaatttttctagttccctaaattttattttgaaacttcttgaaccttacattttcattgactttcttccagtttttgaacactgcctccttaacatttgtgagctgtggcaggttctcaccagtttactgtactgagtactctctgggaacctcatatttgaattaagtgattttactcatttgctcttattattttgactgaaggaaaaaagtcacatagtataattttagcagagaggatgtgaagtaagagttgaaccaactttaagctttaaaaatattccacactgttgtatgcatataaatttgagacagataaagaaatccttctttgtaaaaatgtaactaaagtcaggtttatttttttcatataaagtgcctaaaataatttgtgaaatttgaattgcaaataggatatatcataatttaaaaatatgattactttgttaagtgatagttgtattatcagtgccatgcagacattacccaaacacatagatctagattgatcaatttgagaactataacatgaacttagaatcctaaggaacaatgcctccaaatatgtgtttctgaatcctttttttgtttgtttgttttttaaacagggtcttgctttgttgtctagactagagcacagtggtgtatcaaagttaactgcagcttcaaattattgggctcagtctttccacctcagctcctgagtagctggtactacagctatgagccaccaggctgagctaatttttaatttttttttttgtaaagacatggtctcaccatgttgccaagctgatctgggatcaagcgatctgcccgtctctgcctctcaaagtactggtattataggcatgagccaccacacctggcgatatccaactgttttaagaactagagggaatgcggtatctctggggccaagagttccctgtacagcccgaatagcaaatcaactactttaacacaaataaaattagattaatcttcctgcatcattttattcctctttctatagcggggctgtgtcactttttgatgacttttttgccatttttaaaaaatctatagcttgacatgaaaataaaagtcagtctctaatagaaaagcattttggtccttgatcaagtaatcaaaacaattataaaggctgatcagcaacctagatgtctaataatggggaaaatattatatagaacacaaaatgatctttggtaacacatggaagaactaaaaaggtaaaagactacaaatttgtatataacatctagtgaaaattgtgtaaacattatttctgagttgaatatacagtatttatggagagaattgaatgtgcttaaaattttgatatgtttttccattttatgaaaaaactgggaaatgtgaattaaagaaaaattaacattcatttcatcattaattgtaatagaaaaatgattttacctaattcaaataatatgtaagtattcagttattttacatatctatgtatatctatgctaaaacatatattcaaaaatgtttttaataacctgaaaaacagttgggatatattaagaaagcaacatacaatgtgagtgtctacgtgtgtgagtgagagagacagagactgaggcaagaaataacatttaatatgatgttgaaaggaaatgtgccaatataaaagcattggtataatcacagatgtttttaatacaactctccatattccaaattggctgttaacatatattgatatttataatcagaaacacataataaatagtatgttgtttacaaataaagcataatactcaaagaatgtactatttttaaaataatgttggtacttgcttataggaatataattgctttttgtttattgctgactttctgtagtttctattttttcctataaagaacatgtatcactcttagaagaaaatataaagttgatttttaaaaagaggcaaataatattcccctatgcttaatcaaatattttgatgaagttagaaaaataagacagtaatgcactttctctacaactcgattattactaatcaggaaggacaatagtacattttattttattatgctttcttcctctgttctaagccaatagataaaaacaaaattaagaaggatatgttcaaacatccctaagaaaaaaaatcaagatttcaacttggatagaaataagggaaacattgctacatctttcttttatacatacagaccagtttgcacacacaactcactgaaactgtaactagctcttcacatcctgcattagtagtcagataattgtaaaatgtgtctttgtatatagatatgggatacttatgtggccatcaatttagttgactttctatcaaaattgagaagttttatcctgaaatagcttaccaatggaagttagaagtgggtctgacattgcattatttggtggaaaaaaccatcaaggtctgtgcagtaaagctgatgcagctctgtgaactagcaaatcctattagtacttagcctgatcacctgggaagatgaaattgtccttactgagatgtggaaggctgaaagtgaaacaggttgatctatatttattggagtattgctgggtagaaaatttgtcatcacgttatccccaatgcctagtatctaggtatctagtggcacttaataggtattcggtaaatatttgttgaatgaattcctgaattctaaaaggcttcaatctgagctatttttcacatcactactgaaaaatgagagttcacaaggagctgttaaaaaaaaaaaggtcttcactttcagtttaaatagaatgaagaaaaatgagatttttttagattttttgagtttgtgacagtctcaatttgtattagtctttttttaaaaatctcacaaatatttatagagaaaaaggaatgcttatatactgttgctgggaatgtagattagttcaatcattgtggaaaacagtgtggtgattcctcaaatacctgaaaagagaaataccattcgacccagcaatcccattactgagtatatacccaaacgaatataaatcggtctacatacatgcatatgttcattgcagcactattcacaatagcaaagacatagaatcaacctaaatgtccatcagtggtagactggataaagaatatgtggtacatatacatcatggagtactgtgcaggcataaaaaaagaacaagatcatgtcctttgcaggaacatggatagagctgaagccattatcctcagcaaactaaagcaggaacaacaagccaaataccatatgttctcacttataactgggagctaaatgatgagaacacatagacacatagaggggaacagccggcaccggggcctacttgagagtggagggtcagaggagggagaggatcaggaagaataactaatgggtactagacttaacacctgggtgatgaaataatcttacaaccaacccccatgacacaagtttacctatataatgaatctgcacatgtatgcctgaaataaaataaattttaaaaatctcacaaatgtttatattaggttggtgcaaaagcaattgtgttttttgccattactttcaatggcaaaaaccgcatttacttttgcaccaacctaatagtcatttaaaggaaacttcttaagccagtgtccccacctcagattctcagatcatcactccttaacacacacacacacacacacacacacacacacacacacacacacactttgagtgagggtgaggaggagagagggaacaatgaagaaaaagttctgctaattaagggaactgctgaagtttcagctagtcttggtgatggttgaaataacatcaaggaaagagggaatataggaaagacaggtgggaaaatgattcagagtctagagctaagggacaaaaagagacagaaaatatggggaactaatgtggaatagattattgatcctagaaataaatgtagctaaaattctttccagtaaagaggtcccaaattggtgataggtgggacttttaaaggcagccatttttatcacactctccaattctaccccgatttacagtgataagttttcttagtaaagaagcagctttgtctgaaacttcaattccaaacctccgagactttggcttaattaatctgaagatacaatgcagacaccagcttttctttcagaggttattttaagtttaaaattatgtcttcctaacaaatagcccaaagaaatgacttcgtggttttcctttcgtacattcagggatgatggacagcccggcctcatgacaggtgttccaggaggtctttttaattgacttgtctatagatgtaaagaatttgaacaaccaagttgtctcgtattttctctatcactttcctgagggacttttcttaagagaacaagtgaactatgatgtcattatgtcatttattggttttagttggactttgttgagcctatgaacctgtttgagatatagtcataatatcttgcagctcatgtctgaaaatttatgtgaacacttcacagaaagttctgttcaggttgtacatccattttcatgttagataacttgttttgggagttctgcctcttagtaaatttattgcttttgataatgtgtggaacttttaatttctatattttagttctttttagactcaactatgcacaccctttagatttagtatttggcttttaaggcatatttagaccagaccctttctattggttaattgtggtataaacctggctcatccacttgtgagactcttagattccaagtgtctaataaatcaccagaggaggaataattaaaagcttctttcagttctagtattaaatcaacaaggttgcctggaccgtgcttctagatgtgctgtaatttatactattagtgtggattgctttggttttctaaaaataataaatgacccagtgaatagcatttggccagaggcatacaagaaacaatccatagtatatagatttgttcaatggcatttaaaagaccttgattagaattcagtctgggctggagtgatgagaatgctgtttactgatgtctgtttgaagtctccctacatggcagaggctagagggattcacaaatagtaacatttcttaactccaatggctggatccagctgtctggaagagctgacattttaaaagagaggtacaaaaatgtctgaatgtcatgattgctaatgtcattttcatgattttatttttaagcgatctttgtttgctccgtgctctagcaatgagctgggttagaattcccaaaacgctgtgttaaaaattccttgtgaaaatgcagtggttttgttcatggagtgggaagtgtcttctctgacaaagctgttcactcatacctgtggtttctgccacccaacctaagaatcatttcaacatacttaatgttttaagattggtaacacagggatagaggagaggcagggagaaggcaggtacaagccaataagtttgaatagttcatctttgaaacagaaacagacatttgattggttttgccagtgagcctgggaaattcctagtgttgaaaaagcaaaaacatgtacttgatggtccagacaagtttatgaaccagaatgggatttaaatatctagctgtaaaattatgttggaaacacacagacacacacatgctttactgagtgagaaaacatgtaggaagtgcttgcaaggaactaagggacaccatgcaccaataaccatattaaaacatgatagtgatagtgtttgttgtttatataagcatatgtgtgaatatgtatgagtgtatatgagaacatgtatgtgtctgtgtttgtatgggtgttattttaaaggaaggtatgacatggcacatgtaacataagtaattttgttttattggttccaaggaagcctttacatttgatctaagtttctcaagaaaggtccagagtaaagatagatatgatactctggaggagagaggaattaaaaccagcaaacctgactaacccagagcttaaagaactaggcgatgtttcaatcagtttcatttacaagaagttttttttaaattatttttccatatcctcgtcacctttaaaagattcctctattcatttatttcttcatttattaatcatttgaacatttttaagtaacaagcatgtatcaacattctgtttgatgggagagattcaaagataacttctagatcacagaacaacaagcatagccaaaaggcacctggtaagtagggggaagaggaagacaccgtagaagtgcacataagcttccaatgattgccgttagaatgcaagttcaaaggtgtgaaacagttaagtaagaaaccctgtctctactaaactacaaaagaaatgatctggatgtggggacgtgcacctgtagtcccagctactcaggaggctgaggcaggagaattgtttgaacccgggtcgtggaggctgcagtgagtgagatcacgccactgcactccagcctgggtgacagagcaagactctgtctcaaaaaaaaagaaaaaagtttaccaaagcattgattttattttatttaaaaaagaactttaataattccgggttctatttgttttataatgagataagctaaagtgtcattagtttccccttctgataaacaggatgttacctagtaaataataaaacagaaatatttcagaaatttaggttggaaactattgaaaaaaaaaataatggttttgttgggaggcaaagtcccaatgtctctttgagccaataagcaaccaaataattcaacttgattttttaaattgcactgtttttatgtattggtttttttgttcctctctctcaattttactgttattcctctaataataaatgtctcggggagacaaagcacatctttcttgtgtgatgggaaaagggaaactactaattgaaatatgtactctgcctaaaattagcattgcataaaatggaaaaaggacaaaaagatttgtcttcaagtttacttgtctataaaatgggaatgataatagaacctgcctaatagcattattgtgatgtttcagtgagagagaaaaaaaaaaacaaaaaagaaaaaacgccttgaaaccattagagtggcgcctggaatatagtaagtgctcatttatgttatccctattttatgcttatatattattaaacctaaatataaatttttaaaacgagcaggaaaaattctaaaactgggcacacataactttctctgggtttttaataccacaaagcaggtgcttgaaattactttctgaattattgtatgatgtttctcatattacagttactgtctggaggccacatgcatgtggtggtgatgtcatggtctctttctgtgttaatcttgaattccttctgtccatttgcttccagaacccactgatcatgggcaatccagtgagttctcagcactgttactcagggtagaagcagcttctgaaactgagaaaaaagaaaaaagatactatttggtcatgccaaggataatcctccccctaaaagaaattttggcttcccaataataccagctgggtgttctccctaacttctggatgcacatatgtaaggaataattgtgattcagcaaaagaaagtgaatggaaatggaacaaattgaaacaattaaccaaaagatgcagaagggaaacaagagtcagacttgacccctagaccttgtgggaaggaaacccttggtgttggtttgaaaaatgataatgatcagtttctgtttccagactgttatcagtggttaaggtccttatgatttgtgctagagactgggaaagaatgctaacatgaaaccaagcaaacaagtagcaagtaattgagccttgagggatccctttggaaagcatcttgtcatttagaatgatgcatttttgatattcttctagctggtttctgagtgcctgtttgcaggaaatgaaattctaggctttgcagtttgaaaagggttgtataggggtgggtagtgttctcagaagtaatcaaagcttttttagtattaaagatgactgtggaatgtttagagctagaggcataatgatgcaaatcaaatggcgtattagtatcctgcctagtaaatgtggaagccttaaaaattctgctggtggatgggtggtcagcattagagcattagacacaaggcactggggcaaagaaacccagaaggctgtgcacttttgctgggaaagagagtttactgtgagggctgagtgggacagcaatgggcttgcagagaaggggaaatgtatcagcctggggactataaccatttgacttttctccatctgcatgtaacaaccaatccaaaacggcagagatcagcaagaagaagagactaacattgtgaagatggatcattcacaacctagataaatagccttttagaaaatgttgagttgattttataaggagaatatatcagtaaagatgtagaagttactggtttgctacaggtagctcagaccagcttgtgagagatgagtttttgatttcccaggaatttttcaagctggttttgaaacagagccaatattaaaagttacatcatagaaacttggatagaaacttacacagatagtatgtaacttagtgatggcttgaaagcaatttgcatttagtagaaactgtactttgggtacccatacaaacattctgtttttcactttcagtacagtagtcaataaattacctaagatattcaagactttattatcagataggctttgtgttagatgattttgcccaactgtagtctaatgtaagtgttctgagcatgtttaagttaggctaggctaagctatgatgtttggtaggctagatgtatgaaatgcattttcaactcgtgatattttcaatttaaaatggattcattgggatgtaacctaataaaaacttgagcagcaactgtatttgaataaattacagtatacagaaaaggcaatactcaaaactcatcacgtcataataactgtactatgttttaccattatctatgctttggcagctatttacatgtattgtgtctgtatgatgacaactatataatgaggtgctactgcacatttctttccaaacctgcattctataatgtgatgttggtggcttgaaattggctttccgctacagtaaccaaaacagcatggtactagtacaagaacagaaacatagaccaatggcacagaatagagaactcagaactgagtctgcacacctacaaccatctgatctttgacaaacctgacaaaaaagaagcaatagggaaaggatttcttatttaataaagggttgggaaaactggctggctatatatagaaaattgaaactggaccccttctttataccatataggaaatcaactcaagtcagattaaagacttaaatgtagaactccaagctgtaaaaatcctagaagaaaatctaggcaataacattcaggccataggcacaggcaagtatttcatgatgaagacaccaaaagcaattgtgacaaaagcaaaaattgacaaatgggatctaattaaagagcttctgcacagcaaaagaaactatcatcagagtgaacagacaacctacggaatgggagaaaatttttgcagtctatccatctgacaaagctctgttatccagcatctacaaggaacttaaacaaatttccaagaagaaaacaaataaccccattaaaaagtgaacaaatgacatgaacagacacttatcaaaagaagacatacatgcagccaacaaacatatgaaaaatgctcagtattactaatcattagagaaatgcaaatcaaaagcagtgtgataccatctcacagcaaccagaatggttattattaaaaagtcaataaaacaacagattctggcaaggttatggagaaaagggaacacttttacatgttggtgaaagtgtaaattagttcaaccattgtggaagacaatgtgggaattcctcaaaaacctagagagagaaataccatttgacctagcaatcccatttggtatatatccaaaggaatagaaatcattctattataaagatacatgcacgtgcgtgctcattgtagcactactcacaatagcaaagacatggaatcaacctaaatgcccatcaatgatggattaaataaagaaaatgtggtacatatacaatatggaatactatgaaaaggaatgagatcatgtcctttgcagggacatgaatggaactggaggccattatccctagcaagctaatgcagaaacagaaaaccaagtgccatgtgttctcacttataagtgggagctaaatgatgagaacacatgaacacatgatgggggaacaacacacactgggtcttgtcagagggtggggggtgggaggagggagagcatcaggaagaatagctaatggatagtggccttaatacctaagtgatgggatcatttctgcagcaaaccactctggagcacgtttaacaatgtaacacacctgcacatcctgtgcatatatccctcaacttaaaagttggaaataaaaaaataaaaatgaattggctttccatttacccctttgattgcccttacccctatccatatgtaaagcagcagcagggtggtgattctgaatgtttcacgggagcagttaaaaagacacaatgtgggccgggtgcggtggttcacgcctgtaatcccagcactttgggagactgaggcgggtggatcacctgaggtcaggagttcgagaccagcctgaccaacatggtgaaacttcgtctctactaaaaaatacaaaaaaacgaccaggcgcagtggctcatgcctgtaatcccagcactttgggaggccgaggtgagcggatcacgaggtcaggagatggagaccatcctggctaatatggtgaaaccccatctctactaaaaatacaaaaaattacctggcgtggtggcgggcgcctgtagtcccagctactcaggaggctgaggcaggagaattgttgaacccgggaggcggaggttgcagtgagccgagatcgtgccactgcactccagcctggtgacagagcgagactacgtctcaaacaacaacaaaaacaacaacaaaatacaaaaaaattagccggacgtggtggcggatgcctgtaatcccagctactcaggaggctgagacaggaaaatcacttgagtctgggaggcggaggttgaagtgagccaagatcatgccattgcactatagcctcggtgacaagagcaaaactctgtctcagaaaaaaaaaaaagaaaagcaaagaaagaaaaggcacaatatgtaatgctatttgctaaagtcagcctctttatgggtcttttgttgacttcttctttagtggctccacttcttagaagttaatgagcaattcctgctatagcagcagagcctctaccaaagcagggggacttcagggaaccactggttgtcagatgtgctgggcgtgaacatgagcgtgaacagaggaaaagtgtctgatttaactggtctcgggtgaggcctgcatgttgggatgtttagaggttccccaatgataactaataagaagccaaggttgaaaaccacatctaggccaaactgcgattaatttttgccttccacctccttatcaatgtcctctttcccttatgaccccgctgcctacctgactcagttgcgtccactttctctgtgaatcttcctttacctccacgttggctgccagcttcaagattgcatgcccctctgagcagtttatctctaaccaagagaggtattcctttccaagagttccattaaaagtccaaaggagaagttaattggcctgactttggaccatgtgtgcccacctctcaaccaatcactgttatcagggcagtcatccctttgtccagccatgctcctgtatcagagaagcactgccatgacagatattgggcaaactgatatatgacccccaatactgggtttggtgctcattcttgttaatgcatgtgttaagggtttcattctaatcatctgcaaaaaagtgattgttgtctttaaaatgttaccaaaactagtcttttagcaagaatcttactagaataaaatggctcttgctacctgtatttttaatcagcctatgtatattgatcccattcctgatattatcaccttaatatataacagccccaattcctcttattgagcattggttgctagggaaagcaaaaagttaagagaaaactactgagattttctctctaatttgcctctgtctgcctctaactagcttagagatcttggacaagtcctttaacagttctctgtcagctgcttggactgtgaaatagagataaaagtacctgtctatttcaggccgggcacggtggctcacgcctgtaatcccagcactttgggaggcccaggagggtggatcacgaggtcaggagattgagaccatcctggctaatgcagtgaaaccccgtttctactaaaaatacaaaaaattagccgggggtggtggtgggcacctgtagtcccagctacctgggaggctgaggcaggagaatggcatgaaacccggaggcggagcttgcagtgagccgagatcgcgccacggcattgcagcctgagtgacagagtgagactccgtctcaaaaaaataaaacattaaaaaaaaaaacaaaaaacaactgtctatttcatagaggtattgtgaggattaaatgagataatgttgatgaagtaattttgaaaagcatatcaatgtgcagctgtaaagttttattcatatttaccagccaggcaagtagtattagctgttataagtaaaggtaaacatccaagtgcatatgttcagatgattatttttaatatacattttctcctgatatatattcttctagttgcagatctgattgggttgtatattctgtctttgctaaaacagaattgtatcgaaaatcttaaaacgatttttttccagtgatcattcctaatcattaagtgtgatgtcaaaattaaaacaaaaaaatatataaaaccaaaatgcattcatatgggaatatacttaatttattttccaaataagctcaatggtatttgggagactatctctcatttgatttctataacctttgaaacaagtctgctgacttaactttctcagcctccagagcattatctctgtcttgtctgcagagagattttcctttgaggtcaatctctggatcttccatggtaaaactccttttgccattttctgtgctttcctcttgagtttcctgagcactgaacacacatatatatgtacatacaggaatgcagggacataggccctcacatacagtgcaagtcacattttataagggtaatttgttaaatggtatttctctaattcttaaaagcagtgactcaatgtattattctaacctctttcacctaagagttctgatatgtagctgtaatccaataaatctccaatgcatgattgaattagagaattttttaagttgataagaagttagagtaactagaaaaaaaatgggtcttttattttagattaatagagaaatttgcctctgtattaatccattttcatgctgctgataaagacatacctaagactggacaatttacagaaggagttttattggacttacagttccacatggctggggaggcatcacaatcatggcaaaaggtgaaaggcacgtctcacatggcggcagtgcagggaaactcctctttttaaaactatcagatgtcatgagacttactcactatcatgagagcagcacgggaaagacctgtctccatgattcagttgcctcccaccaggtccctcccacaacaagtgggaattcaagatgagattttggtggggacacagcgaagctatgtcaacctcattgactgaacgtatttgctaaatatactatataccaggtatcaagctggttatgagatttatcagcgaagacgacaggtgctgccttgatccacattgaagtagacaaacaacacattaataaatcatttcagtctgtgatcagagctctaaaggaaataagcaaggggtgggaatagaaaataatgaggaagacttaatttagtcagtatagtcaggaaggacactcttaaaaaatggcctttcaactgaaacctgaagaaatagaatgaatttgctttgcagaaacctagagggaggacatttctgacagggggaaagagcaaaaaagtatgaggatttgcaagaagagaaaaggggaaggaaaatttgtggcttttatgaagcttaaaataaatagtgggtactctattattcaaggtctttcagccaggttaaagaatataaagaatagtgagaatctagtaggtatttagtaggggaatctcacacacacacacacacacacacacgtacatctataataagctaacatgttataaaaagtacaggacatttcttaaaaatatcctgtaatttttataacattagcttattataaatatggttattggcatggcaaggaatgccagtattttctactatcttttatatgctgctgtacatattttgatgtataccagttgcaaagccagccatgtaagttaaagtggcataattgtaaaaaatctaaaatgtaatgcttataatgtgcttggtattgttctaattgtggtaagttgcattgcatgttttaactaattttaattatcacaacaagcctgtgaggtaagtattgttttgttaccatttcatagataacgaaactgagtcatagagggattaggtaaattgccatgtcacacacatttgtaagcaagggatggagccaggaatagggcaggtcagtgaggctcaaatcccatagtcaaaatcagtggtattcaaagtgtagtccacagattgatgccaatttgtgaattatttgtcactagtctatgataaatacagaaactggaagtaaatgtgtgatgattggccttgtcctattgaaaaacctatagaccactttgagtgtagtgtggaattgcatgggacatgaactacatatgagtcaggaactgtaggaacacatttccattcatgatggattggagataagtggtgcttcacctcagataattcaaaagtaatgctctaaactacatgctgtgccaccgtagatgaaataaggtgttaaatcttctctcctgtgtctctcgatactccatatgatacatcatgtgcaaaaagtgccatttgtaatttgccttgtggaaattcattttatttttttcttacctcttgcacctgtgaggaagtgagtatgagagaaagatccagaaaggggagaggtcatatgaccccctgctctccactggcattgacaagtagtagattgggttccatagtatgatagtcactttcctgcaatcattcttcaacacctctggaaattgtgagcctgtaagagaagcaaggaagtgtaagtgctgaatacttatcaacatcctacctggtcaagtggtccagaaagcttgagcatagtgttaaatggaccaatggtatgtgctaccttttttctctactaaggtaataatgtactcttctagctgtaacctaccagcctacagaaatggggttggttttgaggtttggatagatccctgtactgttattatcctgaagtaggggtgggggatgctgaagagagcttcacagtgccatctttgtatgtaaaaatggcacaattatcctcaagtgaagaaataatgtagaaagagctgaagtagtgctttttctaccactttgcagaaaattagtgtcagcagcacattattcagaaatctttatcttttaatctactatgctaactcttatcatatctgcccctgccctattgctttaactagagaggtttattttgttcccttagctaatgactctatctgggtcagacatcacatatgtggcacctgggtggaagtgctgagttcatttttgtctttttgttattgttattaacatcacctcatgtgtttggcattctgtgttggctgtcgaaccagattcctcttcctttcctgaaagaaaacagggcctagcataggaacagcttctatctttctttccttccctgtatatctctttctttccttccctgtctatctctttcttttttccttaactggggaatcaggaaacttctgatgaaaaatcagtatcatagtgttgagtaaatattgtgagtagacaggcatttccttgcagttttgaatagaatcatacccctaataaagacattctgaaggcttataattctcacaaagtccagatgtttctacaaacaaggcaaacatggaggtaaaatgtggaatttttgaaagacgtttagttcccatgttgtcttagtcaaaaacaatgaaaatttcatttccagttaaccatcaactaccttcagtagaagactaacatcttccttgggcagtttgcttcatggatagtaaatggaggcagagagcagttattctgcagcacacaatgccatgaatgctcccacatatgtaataatgtatatgtaaaagcatggatttgtgcagtattgatttcttcctcaacgcttactacttcctgcctctttggtgttgcaaggttttgtctgttgctttagtatttaaattgcctcacttaagaaatgtgcccattatgtgtgggggagaggaagggttccatgaaaacgaatgctctgaagtatttgaaattcttctatgagcaccgaagcactgcaactcacactgctgtgttcaccaaaatcctggaagcaacacgctgttttgacttgaagaagcaataccaaaattatgaagtcatctaacatctttccaattttaacacagactctaaatatgtggcaattcagtattttatttttcgtttatatcccctttctatactaccaccgtttaaactaacaaagttgttctttacagttttaatatagaatccagagatgagacatcctggatttgttattttttctcctatttctttttataaccctatttaagcaaattaacaacatctgggttgattaatgaacaagccacacatactcataggctcatctgtatgtacatattatgaatgacgcctctgatcaggaaatcaaacaagcaaatgagaaaacctgttcacttgttcaatgggtcaggtgtaactgtcaaagagcatgacttggggaaatatacccttcatctgtgctctggcttttcaggccccacaagcagcctctagggcaacaaggtcatagatgatgtattctgttaaaataacaatgccttttattttaaggacactacttatactgggaaggtgatcttttccaagatagcaattaccaatgtgaatccataaataagttaaaaaattatgttttttgatcataagaattgacacttgagtggaaatattcctctgattagactagcttggtttctctcgtcacttgtctatgtaggaagaattacaatgcagagctgtcctttttgattttgcctctgatattgaatgcaaatattttggctatcagtctttcctaatgctacttaccccttgaagatggggagaaaagctgaagaaagctatttctgtaatcttaatatttcttccatgacacttgtaaattgatttgccaagaagggtaaaaaaaatcaatgcagatggctagttaagtttattgtggttcagactcaaactgttgtatgtggatgtacacttgggagccaaggaatagggatatattgttagtgtaaaatatccagttccatactaacttatgaactcttttaggtcattcatcttattcaacttcattccctggcacctcacttagtacctggcaatgtgttgtagtagctaagaaaatgtgcgatctggactctgactatccaggttcaaatttttgctcttctacttactaacaatatgatcctggatcgtaagttttcagtgaccgtaagttttcagtgtctttagctgtaaaatgtgggcaatactattatttaactcatagaattattataaagattgaaaaggcaaagtgtgaagtactcagcccatagtgagcaaccagtatatgttaactatacgataagtatttctttactcaccaaattttgaaataaaccattacctgaggtggttggtaatggtgaaattataatggaagagagctgggcacagtggctcatgcctgtaatcccagcactttgggaggccaagccaggtagattgttttagcccaggagttcaagaccagctggggcaacatggtgaaacagcatatctacaaaaaatacaaaaattagccaggcatggtgagatgtgcccatagtctcaactaatagggaggctgaggtgggaagatctcttgaacccgggaggttgaggctgctgtgagccgtgatcgcaccactatactccagcctgggcatcagagtgagactctgtctcaggaaaaaacaaacaaacaaacaaataaaacaattatagtggaagagaatctgaacatgaagatggaattctaaccttgcttaagaagtaaacatatacaccaataataataataataataagaagaagaagaagaagaagaagaagaagaatccagaaagactccagacataggaaataacatctgacatgatttgaaaaagagtagtgaagtgaaatagaggcccacagctcctcttttctggtataaaactttttattgaaactacctgtgtcgtaaaacagggagagaagttttgctaccgataatgataatttgatgccttaactgtattaatatagcaagtgtgactcaaggatgtctggagtctaaatataaaggtctgagaagagacatgactgtttcagaggtttagagtggtaaagccaataagtggtttccggccttcccaggccactccgcataaagcatcctcactccctgagggcctctgacattcctcagtgttgtgagcggggaagagagaaatgctttttggttggctcagattaccttgttctggttaaatgaaaaagtattaacatacgtttcttgtcaccacaattccagctgtccaagtcagtgctttcggagcagagatgtatgatcttataactcctgaggttaaaaaagaaatgtgttgccgaacaaacctcctcatctttgacaccctgtttcctgcctgttgtgtgtgacaggaaggtaaaaaggtaaagactaaacagtagatactcttcagtgagtggttagtccagcattacctgatggtgtttagtatttgccattctgaaagatgatcagaaagcaaaccccttaaagagaaaaattaaccagtttgttttggcaggctattctggagcacatgctaaagtgaccacagttgtttttaatgcccagcagaccttcgcaactaatcctattaccgcaggactcccaggactgtctggttagcactccccacagatttgtccactcccatttctgaccccacaaccaatcccttcccttgggccctctggaactcggtcatacagaaaatctcctttatcctcaaattttcctgaattttttggtttcactgttttactcaaattcaaacttggataccccagaagacactacttcctctaagccacctcaaactgggggagcataactgctggtgccagtgggccttctttattgtagtttcagatcattctcattccatcttctgtgcaacccccctctatgagtctcgtgggtctttggactatgtgactcactacctctccttacttgattcactgtatcccatactgaccttgccatattcttggaaatttttgcaccgtggcctctccattctttggcttcttctcctccattgattttattcatattttgcctcagccacacatgcaaaggacatatcctagactctctcattaccaattactaaaaacccttcataattcctatctcaggcatcttacttttgggtcgtttgttcctattttagcagctcaacactttgagcattctgataccaacactttctttaaatctcattatgaactatggcatctattattttttctttgttgctcattttcctcatgtcccagcatctctttatactctgcttagatttcgtgaaaagccattatttcatgaaaaactgttccaaactaccaatgtctgtatccttataccgttgcttatataaactcgcttgtccctctctcttctttctttaaatgactctggtaaaatcctaattatggtatatccaattgacttttgttttacctgcatgtacacacctgaacagagctggagaaaaacactctatcctgcttaacagtctcattttaacagcatgaccactcgcttaccttaagtgggttctcggtgctgccacgcaacctattatatttttctagtctatttattctcccattccataatgatgactattttgtacattttctctcctttctgcctttcaatatttattccagctgttaactttactatttcattaaaaacagagaatcaatggaaagagaacttcaaaatgatcccactataacacctcccaacccttccatactaccaacatgtatatccttatactcttctttctttcatgttactgtggatgaatcatgagggtccttcgtagcaaagatcatctcttctacttgtgcactggatcacatacctcttctgtatacaaagcagcaattgttgctctcctgaaacatcagttatgtttttccttttcaactgaattatttctaccagcatacagacatgctgcaatgcttcccatcttaagagaaaaaaagctcttggctccatttcattttcagtgactgcctaatctccaccccattttaaagcaaactcagtaaacgagaagtctctactcactgtttccacttcctttcttcctgttctctcctaaagccacttcaatcatgttttcatctccactactcgagcaaaatgatttttgtcaacgtcatcaaagatctttatgttgccagatccaatggaccattcccatttttcattttactttaaaatcttggtaacatttgatacccttgatcaactcttctttcttaaaacttggattgtgagacagtcttctcttgtgtccctcattgcttaccggttaccccttctcaatctcgccagcttgatttcccttatttcaattctaggggattctggcgcttagtccttggatctctggatatctttatcttcactcatttctttaaggagcatatataaatttgcttctttaaatatcacctatatcatgatgatcctcaaatttgtatcactatggttgacttctcacctgaactccaggttataaaaaactaaaaactgcattttcactttggatgttaaataggaattccaaagttaacatgttcaaaacaagtcattattttccccaaacctgctttactttcagtcttcacaatcacaaagaaaaaacaactccatccttctcactgatttagctaaaactttgattgtccccttttttctcacctgtcacatagaatttttcagcaaatatcaatggctctacttgactgtttttcacatttccgtctctgtaatcctggtccagacctacataattgcctgcctatggtatggcaatacatttttaacagctaaacctgcttatatccctgcctccccacaatctgttctccaccgtgcagccagagtaaacgttttaaaatgtatagatggccgggcgcggtggctcacacctgtaatcccagcactttgggaggccaaggtgggcggatcatgaggtcaggagatccagaccatcctgggtaacacggtgaaaccccgtccctactaaaaaatacaaaataaataaataaataaataaaatatatataaattcatgccatgcttttctgctacaaaccttccaaaagttttggatctcattcaaagtaaaagaagaagcttttgtaaatatccacacaaccttgcttctcttctgtgttaccttcttctctcctaatttactgcattctaacagtgctggcctcttacctatttcttaggctaagagaacccaaacatttttcctaccactcccaccctcatttatctgtttggtttatttattcaggtctctgatgaaatgtcactccatcagaaataacttccccaaccaaactgtctacacacacacagacacacacacacacacacacacacacatgtgtgtgtatgtatatatgtgtatattaaaaaatacatgtgtatcaccactccctttacccctagcttttcatatacctttacctgctttatttatctccatattctaaaatcactcaggatagagaaataagcggtttgcttgttgtctgactctctgtaatagaatgtcagcttcagaaaagtataaacttctgtgtgttttattcattgccagatttttagcacctagaagagtccgtgatatatagatgcaccataaatatttgttgcatgaataactcactgaataaaggtgtatgagcttagatttgactgtttatctttttttatcactgcactataaaacccaagtttggtttccaggaaggccacgttaaagaaacactgtaattagagagttagataatttggcattgaggaaacaccactttgccccccactgccaatctgtgcactggcaaaattttttttcttttttgaggcagagtcttgctctgtcgcacaggctggagtgcagtggcgcgatctcggctcactgccagctctgcctcacgccattctccgcctcagcctcccgagtagctgggactacaggcaaccgccactatgcccagctaattttagtatttttagtagagacagggtttcaccatgttagccaggatggtctcaatctcctgacctcgtgatccgcccgccttggcctcccaaagtgctgggattacaggcgtgagtcactgcgcctggcccaaaatttttctgttgcaatgagatactactattttcttacagaaagagcttgcagacctgatgtctccctcccatttatgtagacacatcatcaggcagtttgcctcagtattgatttgagaatttgagaggaatcatctcttgattttttaaaatttaaaagttttatttaattgaatccttttggagaattatcctaccttaggaaaaatagtgaagacataacagcagaatcagtttggtgctccctctagacaagcaaaaaataaaagtgtatggaagatctgactctcactgtcttctcttcccctctgattgcccaggtatatctcttagccatgggttctcatttttcttctttgccattagtttggcttttttattttctctgttaacacattccacccttgagattgctgtaacagtgatctcaacctctgataaggtaagtttataaacttaatgaggaaaaaatggggaaaaaggtcactcttctgctgcagaagtgcgcttggcttctcttggtttgctgcctattcactggcattaagtacctgaacaaatgttttatcacagacagggaactgttgagggatgttcacaatgcattgaacatccttaggcataatttttatgtgaactgggcatccttaaatacattctgactccatgatcagattaccagaaagtgcaggtcccactcactatcttgattcagcatctcccatctggccaaagttgaattttacattgagttggatggtgataaatatgcttagcaaaagtatattcgttgtttctgaagttctctgtgctgataaacactggctgggactagggaagtgggccccaaataaaacaatagcaataatccccagactgcttgagtagtggcagtctttattcttgttcactaaatggaagttgtagtttagttttatttctctcataaggctctgctgtttgaggactcagctttggggccgttgagtgcttattagtggtagctccagaattgcttcatagaggtagaaatagggaatggggcgggggctcctggtgggtggaaaaaagggtaagggactgctactgaaagtggtcactatactttatttagattttatatttgtttgtgatggctttagtagggattgataggcagtgcatgtgctgatggagataaaagaggctctaaaagacccctcctacaaaaccccttgataccactcctgtgaaaaacatcaagttttgatttttgtttgcatggctgttatcaaattccattttgaatgagtaacaaagctatgggagactttttaaactcttttgaaaattgaagattgtaggaatccccctttccccatctcttctgcctatgtagacatcttggggatttccaaattcaagataaaatgttattgttctaaaataaatagatttggaaaatgtggttttgacactgtatttaccaaaaaaagttctattgctacatatttaaagagatattttattattttaaaaagctgcatagtcaaataagctgggaaggccctgactatcaatgcatttcattaaatctaagatgcttttgattataatatagactgttttaatgtactcctaagaaaaatatactgccaattagactctgcttctactgtaagaagcatctccatatcaaagtttatttaaaaaaaaaatgaaaagacatgcctttgaatttatgaaatataatatatacaacctttctgaagagccccatggttgattagtgtatcttaggttctgagaaacactgcagtaaaaatatctgttaagatttctttaaactagcatttcccaaaccacctgattagccatttgagtttctatcacaccactctgtctcataacatttgttagaatttctttggctctttcactgccaagttgccttaatgtgaggaggcattgaaaattgggattcacccgtaactcactgccatgcccaaggaaggcattgctgctggaggcgtagtggacattaacactgctttgcaagaggagctgaagaccaccctcatccatgacggctaccatggggaatttgtaaagtagtcacagtcttagacaaaagccacgcccatctctgtgtttacattcaactgtaatgagctttgtatgtcaagttggtggaggccctttgtgctgaacagcaaatcaacctaattaagactgatgacaccaagagactaggaatcgatagtggcagaaaccccaaaaaaatggttagttgcagttgtgtagtagttaaggtctatggcaaagaatctccggccaaccatgtcattaaagagtgcttcaaatgccagaaatgaacaaataaaatgttggctcaaaaaatttgaaaataacatggaatattatccaatacaagcatggcaaaggcaggctatctattgaaatatttgaagaaattctgagaaagaaaagaaatgaaagacaaacttgaaaaaaaacagatggagcaagccaggtagaacaactgttaagaatccagaaaaacaaaaatcaaagaaactattctaaacaagctatcaaatttgtgtgacaaactgtgacttcatggagaagagttcaattagaaaaacggtggaaaggagattaagactttgattggtgagagtttatgaagactgacacaatttaaaaagctattatagttattaatacactcttagctataagctgagagtattcctagcatgctatttaaatctgacatcaggcaacaaccaaaattatatttgtgtaagtcatatgggaagggttagggagggagacaagtggctcacccttgggaaaagatgttcatatcaactttgcagtctctactttcttatctgtaaagtagggatgagcaaaattgaacaagatatttagttttacaaaaatagtcacccatattatataaaaatatgattatttttgtaaaactcaatacagaaatggaaaccgatgacatgcaacccattgacaattaaatgagttgtatgagattgatttttaacataatagaggaattatagccatgataaataaagttaaattaagaaaacgtagaggcctggcatggtggctcacgcctgtaatcccagcactttgggaggtcgaggagggtggatcacttgaggtcaggagttcaagaccaacttgggcaacatggtgaaaccccatctctgctaaaaatacaaaactgagccaggcatggtggcacaagcctgtagtcccagctactcgggaggctgaggcatgagaatcacttgaacccgggaggtggaggctgcagtgagccgagattgtgccactgcactccagcctgggcaacagagggagtccctgtctaaaaaagaaaaagaaaacgtagagaaaaataaaaggtaagatctattgccaaatatatataaaacatatacaaaccaaatgaatatgtgtatgatactacctgaaataatcttattttttggttacttgtttattccatctcatccacctggaaaatatcactcatgagagtagactttctttttttcatcactttatcccagctcttatggttagttcctggaatataggagtcattcagtaaatatttgtaaaatagttgcaaagtaaattaatacattaatgaaatataatttaaccccaccatttagtacttattataatttgatactgtgtcctccttaaagcttttaaacctttgcttagtagataatatttttctctggaattttttaaaattgcaaataacaaaatattttaaactgcaaaccatgattctacagtggagagaatgttaaacacacagacatacacacagacacacaaacacacataaaaattgccttaatatgattggtcacagttatacatctatgatggcaaggatgacagaagagaatccactgctatgttgggtcaggtgaaaagagatcatgccagtcacttcactgcagttgccctttgccacattataagatggcatagtgtctacagaaaaaaaaaaacaagaaaaaaaggaagacttatcttctccctgttacaatttttcacctaaatgtcagggtcagattcaccctgctgaattttttttcctcctttctgtgaaagagccactatttccacagattgctttaacaatgagtaaacttttgctggtttatgtgtgaaaactacactgcaaagtaccttataatgtgcttaactattagcagaacataaccttttctatgacttgtaatataatatactgtgtggacttatgacagatatagcccatctctattataaggtccattctgtgacccagaaactattttggattctgagagtttaaaaaatgcatgggactacctgccaggaactcatggtccaggatatgataccaatatgaaaataaatacagcataatgtattaaagaaaaggaatgaggcttttgaaatttttataaatacagtacagtgttgaagaattaaagaattctggcagcgatggcttaagaggtgtatattccaaattgtatgcacacacacacacaattaattaattttgttattcaatggaaaatcatcagaaggagaaaatgaggactagtggatgatgaactacccagatgccacttaatagtatcatatttaacaaaaccaggcttatgacataggacaaaaactctactgattctattaaaatataagtcaggttatgtgactcctgtgccccaaactatcgggggaaacagcccccagtatttcaacgtaggttcttttctatttttccctaagtgtcgaccctaagtgttgagaagagaaagagtacaaagagagaaattttacagctgggcctccgggggtgacatcatgtattggcaggttccgtgatgccccctgagccacaaaaccagcaagtttttattagggatttcgaaaggggaggtgggtacgagcagggagtaagtcacaaagatcacatgcttgaaagggcaataaaagatcacaagggcagagatgcagagcaagatcacaaggctagagcgaaattagaattactgatgaggttccatgtcccactgggcatgcattgtcattgataaacatcttaacaggaaacagggttcgagagcagacaactggtctgactagaatttgccaggctggaatttcctaatcctagcaagcctgagatcactgcaggagaacagggtgtatttcatcccttatcttcaactgcataagacagacactctcagagcagccatttagagactgccccctgggaatgcattcctttcccagggttatttcttgctgggaaaataattcagcaatatttctcctattcgctttctgcaagaagagaaatatgactctgttctgccccaccccgcaggcagtcagactttatggttatctcccttgttccctgaaaatcgctgttatcctgttccttttcagggtgcccagatttcatattgttcaaacacaaatgttttacaaacaatttatatggataatgcaatcatcacagggtcctgaggagacatacatcctcagcttacgaagatgacaggattaagagattaaagacaggcataggaagttataagagtattgattgagaaagtgataaatgtccatgaaatcttcagaatttatattcagagattgcagtaaagacaggtgtaagaaattataaaagtattaatttggggaactaataaacgtccatgaaatcttcacaatttatgttctttgccgcagcttcagccggtacctcctttcttggtccctgacttcccacaacaccaaaccatttaaaaattctcctaagtcctcacagtggcctctaaggccctctgtgatctttccaggcacccccctgtctttgattgcctctcctgttacttttctggttcagactgcttcagccacagtggcctctttgccggacctcagatttggcctttcttcaactcttttccactccgcattccacctgttgggaacactctttcctcacatagccacacctccttccagactttgttcaaaagttcaatcgagtctgctctggccaccccacttaaatttacaaactgcctctctggcccctttcagcaatgccacctcccaatctcccagtattactctgtttagttttatgtatgctgggttgggggggttaatctgtaaagaagaataattcatgatctgttcaaatcctcattaccactttctaatctgaatgtgaaaagcatcaggagccagttatcaaagtatccctctcctctccattgctagtcattttctaccacaagttttttctagccaccattggaactaacctacagcaaacttctggaattaggtattagcttgtcaactgacaatacccacaaggatgtgcatctgaaatttgtgtgtgagtgtgttttatgtatgtatttgtaaaacggcatgtagggtatggggaaaacactgggtcagtggtcataagaaatacttagggtcaaatccccatctgtaaaatgggggtaattcctgttctacctaatgcacagaattcccattagataaaaatgagttagtgtatgccaaaatgctcttaatgctggagagtgctatgatgcttctccatcattgtcattagagctacatttaagcaaatgcttacatttgataacaccttatatctttataaaatgttccactttcaaaagcaataagcaagtaaccattgttttcaagtgaatcattgtcttaattttctcaaaaatattgttggcattcttgtaatggttaaattaaaaacaaagacatgttttaaacattaaagatattaatgttaaaatttagattcagagaaggtcagtgacttatctgtgatcaaattgctactaagtaataaagggtgttgagtgtgttttctgctccaacttggcttcccacataaataatgaaacatataatagggtaaatatggatggaggctggaattattggaaatcaaaatacagaaatatcaatggacaaatctagggaagagagtttgatgaggagcaagatatttgcatagttttgaggcatctcttcataaattgctttttagttgcaagctgaaaaattgtaactatacaatggaaacattagataacaatttgatcaggtgatgaacatcaacaatgaggcgcaggtggatatcatgtgcctatggatagaggcgcagctggatatcatgtgcctatggatatgattctctgagaaggacataacataacttatgtatgttccagccacgaatcatgcataatctgaatttgatcacaaggaaacattagataaattcaaaataaagagcattcttcaataaaacaagcctatatttttaaaaaatgtcaatatcacaaaagacaaaaaccaaagacatgttccaggttaagggggacaaaagtgacataacaattaaatgcactgtaactggatgctgtatggcaagatggaaaatgctattattattatggggttaaatggcaaaattggagtactaattctagattattgtatcaatgttagatttactgatattgataactgtactatagtctaatacgtgaatatccttattcctggaaaactcatactgaagttattagggataaagaaccatgatttaccaatttcactcttggacggttcaggaaaaaaatgtttttagatagttagatggacaaataaatctagatctagacagagcagtacattttattaaagtaaatagggcaaaatatagtaggtgaatctagggaaaagatatattcttgcattttctttgtactatttatgcaacctttctctgtttgaaatcatttcccaaaaaaatacttttaaatataatgaggcacagcagttgaggcttctgtttatttgactcatctgaaagagtttattttctttagtaaatacctaacttacaatcaggcagggacgttttctcttgggaaggtaagatgtttcgtgcataaaagtagcaatacagaggtgtttgatatgacaatattttactgcattttcattttttattatttattattaatgaaatgcagttgcctttgtagcctgctgagtgtttaataatgaaattgtgcatcattcattttcaaatgtctgtgcctcgtatgtgttaggaacatgaattcaatatgaacttcaaatcatttcgtaaagggagaactgcagatagagttaaccaactgatgctctttaaatgcatgtttatatacacaatttccaggatgacatggcagattaggagtttgtgtgttatatgtaaagtacctattcattgagcttctggatatatggttttagatatctacttaagtcctcataatatagcatggtttaggaacatgtttcctgtagtctatgattgaatttattcagtttcaaaaactgattatattcttccttaaagttccaaggttctttatgtaaattcacatcaattagttcttaatttatgatggtccgatcccccaaattggccttggttttaaacgcttactgtgttgaatggttctcccaacttttaccattgtactcagcatgttcaatataatacctatccttggctagtttggaatgaggaagtgagactaactttaaccctaaagagaggaacagacccctaagacagccatgtcccaaaactcttccccctcacatgtccttcttctcccatcctttcctattatcctcttcttcttcaacttgctcttcacccctcccccttacagctcttctgttctaaactcctttccattttattttgagatgagatctttctgtgtcactcaggctggattcgaactcctgggctcaagcaatccacctgcctcagcctcccgagcagctggaactatagatgcatgtcactgtgcctggctacatttctctattttagccacaagtgagctgcagacaggtgattccatagccatagggtctcgatctcccatcagtgacagaataaataaaagatgcttccatgatgagcaagtattcaaactatgataaggaaggatatgaaagagattacttctaaatctccttatggcctttgggaaattatagacatagctactctcagtgctgttagtgaatttgcagaatctagaacccagattccttctttacaacttagtggctatatgagcatcataaatcaacctctttgagtcacagactcctcatccatcaaatagaggtaatgatgagatgaattcagaggacacttgagaggtgtgaaatactgtctaagatgctatttatattgtcattgtggccagcagtgttatttctttaatttcacttttagggtagtttacctcttcaacaccaagacagtctttacagaacctttttgactagggagcaggatggatacaatttgtgtgaaggagcttatgtacaagagaggcaaattcctctccctttttctctctggtcatcaggaaggtctcaaggacaagtgtctcctcaactgcacatcctagaatcatgtgccagctattggagtaaataaaataatcttttaactgataaacagatcttggtttggcaaaagtcagatttttctgtgtgtgatttgaaaactcttctgaattagagatgaaaagatctttctcaggtcttccctttggcagagttccagctagaacacgtggtcattgaccaccataactgttggtgaccaggatgtctagaaatgctgtcaagatggctatgcagtgaaatagtgttcttagtgcttacaagatccttgtcatgtgctgcaggtgccaagtgatgcaaaaaatgtttacatgccatgaataaaactaaaagtgcgaacctcaaccagtctatttttatagtggatctacacacaagaggacacttacaaaggagataatgtaatttagctctgggaactcagctttaagaggacgattggttttgtttttatgtgtttttgcttttttagaattttctgctgtacatctgggaaatgcttattgtgagtgtgaatcacttagtagctctcctcagcgtttccattttgatattcccaggctgccagtgctaagcagtgtttctggctgaagctttgaaaaatcattttttcctatcaagccttttctctactttagccctgcctcatttccctttcttgcctctaaaagttttaacttcctttcgtaaattgcagggcataatgacttcaaacaaataaagtccaagtctcaaacagctatggccccacatgtgtgtgtgtgtgtatatatatataagcaaatatgcatacatccacacatctatatatgttttcaaaccactggcttatatcagtaatagtttggtggcaaagttcctgaatttcaaggtggatttcaaaactccatttcttccatttgttggcttaggtacaatgtaattgagcattgtgattaacaaatacagattcttggctataagcaagagcaaatctatctattaagagcttgaaaaaattgaggtttatttgccttttagaaaagaaggctgagacaaatactctaggaatgaattgctactgaaaagttgcaaacatccatggcacttcggctttggcctcatggtctcaaaatagctgccgaacttccagcatcatggcctgattacatcaatgtcctgaattttgcccatgttaaaggcttcagtaaagccaaaggggaacaaaagccaaatatatttgcccactgaatctattaccttgattagaaaagtaatattttttttaacccaataatatctgcttagccaatattcaattatgccttgttggctagaagtgtcataaagccactcctagctaaagcactgataggcaggtagagaagtaaaatgaaggacaatggctaaatcagctaaaactaattgtatttgtcacagatcccaagagaattatagaaaactacatttttttgttttgctttattttagaatggtcaagagataaaaactgtagggatcaaattctatacatgtgccaggttgctgaattcaggtttcaaggatatggagcaaaagtatggtaaaggtgttgtagatgcagaagcagaaagattggcacacccaagcagaatatttggctagagcagtaataaattttttaaatgtctactttccagcccttctggggaaaaaagcttgataaacctattgataaaattaaatgatatctgtatttcattctgagatgaagagttaaattcaaggcatatttatgggccacttactgagttcacaagcactgtgctgacaccacagacattctgacacatgctacaatatgatgaaccttgaggacgttatgctaagtgaaataggccaggcacaaaaggacaattactgtacaattccacttacgtgagatggctagagtagtcaaattcatagagacaaaaagtagaagagcagttagttaccagaggctggaaggagggagaaatgggtataatttaatgagtaaagagttgcgactcaggaggactaaaagttctggagatggatggtggtagtgattgtgcaactatgtggatgtacttaatgccactgaattattcatgtattaatggctgacatggtagattttgtttattctaccacaataaaaaacaaagacaagcagaacaaaagcgaggtagctgcaatcaattgggaaaaggacctacttattcttaaaccaggtggcatagtgaataggtgaaaatggaagttggaaatgaccgtggggatcaacaggttgaaaggatcatatttggttagccaaatggatcttgatagatgttttcaagttttacaggtgaaatgattggggcgatgatgagaaatatcaggaactccatgacacttctaagggagaataagtccactgctttgcctgagtatgtaggatagactgtaaacaggagatttttggactggagagttgagtttggagaataaaagaatattgaggtaaaaatgtaattcattgcaaagttggaaaccatggaaggttttaggataagatcttgatataatcaatattgctgtgaacttaattagtgaagcagtgcaaataatgtgtgggagggagagcacgatacaataacagctcttgattttaactgctggtgtcatatgggataagatgaaacaaaattcaatatcgattgaggcttcaatccagttcgctaggagttgtcccattttctcccaacaggcatacctattaaaaagaaagagtttccagaattttccctcatttattgtcaaaatagctcacattaatattatttaaaatttggtgttttatgttggtacaaaatatgtttcagtaagatatcatcacatcattaatacagtgaagttataaactgttatgtttacctccacaaaaaaaacttgaaatctaactaggctgtcccgcgtttacagtctctgcatttacagcctaacatttctcagaaggatgaagagttttaggacaatatatacctcttcatcatgagaagatatttaatgccttcactggtgcagggctacaggaagggatgttgcttctgctgactactgctttcttaaacttagggcatgttttaagaggaaaagttatagctagactaggttggcttttcatttaaacagtgctagtcgctttggtgtcataaaggagcatgggcatatagaatgacataggtgggaacttctgaatgaagatgggggaatggaatttgccttcttttcaaatactgctgataagtaaaaccaaacttaatttaattttatttaaactttgtgacacagggaagttccctttgcagaaaaactttagtgcttaggtttgtatcattttcagtgttcagacagctgctacgattctttactatcttgtagtcatggctatgatgattaattttttaaaacttgaaaagggggaattgcctcaaattagagaaagacagctttgaacaagttgcccaagagtaaagcattttacacatcaagaatgttagtgaagctgccgatactgtaatttagataacagcaaagataccaagctggtgtgtgttagttgttgagacatgtgggtgattgccattttcagtgttctttattttatgccacagtgttgactttttacattgacggtgatgaaaaaaagcccttggtaatatattgaagactaggcttgtggatatatgcctgaaaaattagtaaatgctgtggccttcaaattgtaagaggctcctatgtaggaaacattattctaatgaagaaaaagcttatctggagtatctttaaccaggaattcaaggtagtactgaagactccaacaaaaccatgatattaagccaaatgcacaaacagctcaattgcccactttagaaatcagtccatatattttaagggattgtgtcttatttgtttttgtattccctgcagattttgtgtgcaataaacatttcttgaatgaacagattaagcagtgatgtaggtttttacaacaccagaaatcaaaaatgtgagtaaaattatctagtagttatgaaatgtactttgacttcctttattttctaataatgatggcaatgagttagctgtatcaatctttacagagatatcttagaaatatttccccatttgtttaagacatattcttgattagaagtataactggtcaaagagctgatgattttgaagacctcttctgtgtagttggtcttgactccaaaatgtagcatttgattgatatagaactagtattaaattttatgtttttcaaggggaggaatgatgttctgtacaatgtttgcattctgtggcacagaactttacatcatataatactgaagctggattgataaagaagaattcaaattgagggctaggatgataaactggagtttatggacacaaaataactcagcagttctaaacagtaggagacaaaaagcacaatgatcatatacaatagttatcttctgtttatactttacttactgagcacttaacttgtacaaggtcctgtagcaactgaaaaaaaaaagtataagacgatcatagaatgatttaaggtaaaagagtacatgggatgtggggctgagctgctggttataaatgaatcagacaagatctgttctcaagccaaataaaagagtaacaaagttaaaaaacaaacataaaaaagtattcatcttctaatttcctatagttcattaagaattgaatatatattgaatatattttcttatcttagcaggaaaattcttgaccacacctaagctaagattcaggtggagaagtcaaaaggaaaaaaactgtatgtaatatagatggacgtatttcttggtttcatttaaggtgcttgtttagatcaaacatgagaagcaccttatgtcactttaagttgagatgtggctgtaggatgcaatattgtggagtgtacaaaccagatttggctctaggaagagttagagccacttgcatagctaactttgccatctttctatcaaccagggaagatgagctggggaaaagccaatctagaacatgtaagaacagcacctccaactttaggcccaatcataaggcagatcagactggaagaagcaatgggatttctaaaaggacattccagggctgttgaactgtcggaatcactggaaagatgatagtgaagtagatggaacaataaattgcaattaaagttggagaaaaaaaacaataattattccttcttttcttttctgtcattattaaaaagtgattgcagacttgagattaaagatttctattaataaaaaagaaattccttgcttctgcttctaatctttgaaaataataaaggagccaacatatttttaaaagtgtaaaaatccatccccaacacagacaatgctatgtagttctgaaactgcccagtgatttctttcttctcccatatgaaacttttgataatagaaatatgaatgactttatgttttgatatcaacattcttctcgagtggattatgtggtatcatcatagattggatgagaacatgaatattctgtacagacaccagtatcctgggcccaaaagggctgatgtccagcagtgctcctcagactatcgaagatgaaaattgaattttcattttcaacctcttgcaggctaaaatgaaatcagacacttggatgacattatgatatcaaaccagcataaaagtttttaagtccttattctcagtttctataattgatcttactgcagactggtcacagttttgagtgggaccaatccgtgaatcacactgagatcactgatttagggttctggctctgctatttgtttttgggacagtggtttacccttcttttccccatttataaaatgaagtgagaacatattacatgattgctgaaatccaatgattctgtttgtattttgatgctattttctttttgctggttaagagacatatgttataggtacagcttactatctaaatgctctttgttaggtccaacttatataaatgagtgaagagcatgttttagctgagagtttataggctatatttctgtaggattttcccttaattgcaacactattttcagagtagtgagctcttttgtttccatcagctactttgaagaaaaatattacttcctgggtagctctggactctccagtgaaaccccttactgccatgccctaggtaggataatcatgatgagttagcaggttggtcttgagtgataaatcttcaatttgccttattaacagagatatgagtgttgggttacaaataggtcagttctgaagatggcaaagtacctgcaaactgaatacattggtttcctcttctctcccaatacctctggtgaaaaagtacataccgaaaatatagcaacaaatatgtgactataaaaattgacaaataatatagtcttgcataggaatttaactgtggaaagattataaagccagactgctctttaaccctttctgaattataatgaatggtaataaaactaggcatggaagaaaacatttatctagagttaaaaaccacaataaccatggataaatgattgtgcttagtcacttcttgcctagggtttatgttttagaatgtgttttacttctaggacccaaacccaagttttcatagattttaaaaagttcttctcaaaagagagttagatattaatgggaaagtcaggtgttgttcatgaataagttatctggaaacttttatgttctctctgagaatccaagagaatcaaaactttctctgagaagacagatcctgcatatcgtttaaccatgtttacgcttttgaatgctaacttccaggctttgtctataatcctgtgcctttgttaaaaaaattcacagacaatttatttgccaggtcatacttttaagaattctttattttgtgtgcctctgagaagagaaaatgtttttccaccactacttctgaattcataaatattcttgcctgtatattattgtttttgtggcaaatcagggtacattattttcatagtggatatccttgattgttggcatactgtaatgccatttgccacatacgtggctgtaatgtggctttggtaaggtgggaaggagagaatatgtactaatcaggtgaatgggtcacacacacacacttacgaacttgcttaactgcatcttgctccctcagtctgtaaattttatggctattgttaagctacctgcttcatttctcacctaaaacatgggggaaaattcagccattttatctatacttgcagttattctaaggtgagcttagtgacctagggattgatttagaaaatgtatttggttgttttggttgtatgatttgccactatctgggaaaggtggagaggctatgcaacttttgaatgtatttgctatctcttaagaggtgtattggattggatagattgaaacagtacttgaatgtcctcacaaaaattccaactgaacccacacatgatttttcccctgctgcatatcctaattgttacattttaaagaactaacataatttctggagtgtcttccagagagatgcaaataaacacccagactatgtttaacaaaccttaaagttatactgtcagtcattgtgatgtttgcctagaggcaaattaaattaggtatcttcggtgcaattctgaaggagacattcattcagcatcgagatctgctcttgatgtgttaaatggttgtggctcacagttgtgctgtctccaaattcattctgttgagactgaccttaagataatgtaaaaaagcaattagttttaaacagtaggagtgccaacagtgtgaaagaaacaaattacacggtgggatgatatttttagtgatttttaaggagattattaaaaatgaaatctgtactaaaagctatgactgtagcttttagtcacaaaaactgacacagagcaattcatttatttcaaactgctacaactccctgaatgacaatccaagcccctttctatgtctggctgaaaggtggtctggctcattaaaccacatcacaactcccctgaataatcaagccaaacagtttttacacatgatttgttaagttctactcctttgccttgtcattcaatatttgagcaaatatttatagcacacatatcatgagccaagactgggcttgatgttgaaactgttttttgtaaccctaagctaaaccctgaactgtgttaaaaaatacaagtttatatgcacatacacatacacaaacatatatttatagtttaatactttttttcattaaactaattttttagtttttgttgactactttcagttagaaatcccaaaatattattttactcctttgaaattgttaagtagtaaaacaatagttaaaataggcagaatttttaaatttgaaaatcaaatttgttgtctgcatcacagtcacttacctatatccaggtttctttggccaaggaagaaatgaccttaactttgtgagttagattactatttttaagctcatattcatgaaacttagatgcatgctgatctccttatagatgggtctccaggttgaagttctgacttgatgcagaagctatgcaatacattttgtagaatcaatgtacattccaatgcagttcagtgataaacttaaaaacaagaacaatacaaatgataacaatgaccaacaatcactgcacacttgctcactgccagggactgttctaaagtggtttaacatctgctcagttcactggattatcacaactgcctaagaaggttgatactggccttattctcagttttcagacatggaaactgaggcacagagaagttaaataacttctcccaaagtcacctgactagcgactgaggtgtatgtacacgaccttggcagtcagtttcagagtccccatttcttaccgctgcattctgtggctgaacattaagggtgatctttcttatcaatctactcatgataatttggttaaaatatacatagtcaaaaatcttagtcaaggcagctacattatgcttataatttgatttaaatatgcatattatataataaatgcaatgtgattaaattatgtagagtcaaataatcttaatatagaaagctgttttcagggcccaaccatttagccaggtacttaaatgtttctatatctttctccctcttccctctaacagatgattgagttaggcttgagcattacacttgcttctgtggctgaaatgccacatatttctgccctgttagcacagtcttattttacagtcaatgcaaatgattatccccaaagcttgtctgaataaatcaatatcatgaagttatgctgttgtaatatttttgtgcataaatattctaacttgactaataatagaattcacactattaatgaaaataacattagtaaataaatattaatatccttaagagacattatggaactcagaggagagcagtcctaatttactcaattttcaaagtcattagaaattaggaaaattggctgggcacggtgactcacgcctgtaatcccagcactttgggaggccgaggtgggcagatcacgaggtcaggagatcgagaccatcctggctaacacggtgaaaccccgtctctactaaaaatacaaaaaattagctgggtgtggtggcgggtgcctgtagccccagctacttgggaggctgaggcaggagaatggtgtgaacccgggaggcggagcttgcagtgagccgagattgcgccactgcactccagcctggatgacagagcgagactccatctcaaaaaaaaaaaaaaaaaaaaaggaagtaggaaaattatgtaaataaaatgtttctgtttaatgtacattggaatcacagatctcttttgacttaagtttttgattaagcacttaatctgtctgtgcctcaatttcctcatctgtaaaatatttggaacagtgtatgacataccataagcactataaaagtgatggtttaggaaaaaaaatctctaagggtcaagaaaatgtatgacctattctttgtacttaattgttacagaatagacatttgataatggtctttaaattaccctgtacttttaggggggttatatgtcataggcacagacttctgactctctaatgtcattatgatacactttttttatatatatattttctttctaaatcataaaatgagtttacagcagcagaccccagcttttctgagaagtacctacactgttatattgtgtaatcgctgtaccaactaatatttttcgtcagaatatgtacaatacagagttgaagaatctgtatcaaaatgatcagctgtgatgagcctgagctagagggctttttcacaaagcatgttttgttctctggtgaacttatattagaccatggctgccaacttaaaattcctttcttttaaggatgcaatgttgcataattagtctgctattgcagtcaggatgcttgcacactttattttactcctggtatagaatgcaatagactatcagagttgaaaggaacctctgagaccatctaattcaacttgctcgtaatatagatgagaaaacagcctctgtcagttttaatgtcgcacagcaagttagctgtccattagaatctcagaaataagtttcattttagaaaatctcagttattttctgtataacaaatagaaatagataaaaaaaagtagctaaaaacaataactattttttctaatgattcttttcattgacagagcaggcctctgctccacgtggtaccaattggggttactccagtcactgaagagtttggctgggacacctcagttgcggcacctcagtacttctctacctggactcttttttcatatattatctcattctccagagtctctccatgtggcctccctctctagaaggatattctgggcctgaaatgacatatgtttcagccctaacacaacacagtcttcattgcagtaagtacaaattattgtccccaaagcttgtctgagtaaatcgacatcaggaaattatgttgttgggattatttccttacagcatagtggatgggttccaaaaggctgagtagttgggttctaaactacttagttattctcttgggagcatcccaggataataagctccaatgtgtgggagtgcttatctaaccactgctttatcatactcgtgactatcttttggttgcagcaaatctatggctaaactcagagctaatgtgagagtatactggactggggtatgaattatggaagatgtggttcacttgaagcatcaatgtgcctgcctatcaaaatggcagataatttatgtggtcaaggtcaaggagcaagttgcagtatgtaacacataatgtaatgctacttaaattaattgatttttttttcattacttcagtatactgtgcactgttatgggtctgttattggattgcagaaaagttgaaactttctagaatttgatgagccctgggaatgttcacattggttttggcagccaccgtttctttctttcaggtaatgagattgtactagagtcaggcagctctcaacatttcaacattcaaatgtttgaccataagaccagaaaagatccaacatatttaataaaaagtgaaggcatggaaatactattttggatatgtttcactaataaaaagagcaagacttcagtattagccttctattggaatgtaaattattctgacttgaacccacactgaactgcctgcagcctgtaacttagaaggaaaaaacaaagtgccaccactgaactgctggccttctaacaaatatcacctattagcattcacaatgaaggcaagcatgaatcagcatgaaagtataccctatataaggtttcttttagcttctctcaagtcttgacacacacctgtgtcactgacagctagtatgcaaattgcctaaaagctccattaggctagtctaggcaaggaagcccatctgttcgttccgtgacactttccctcctagatcctcatgtgggaatatgtccttgagacatgcagatggatgaatttgcgccagtgtctggtaccaccaaccttaggggaagttgtcacttctacttgctttattgcctctaatatttgatgtcctcttccttcagatgccaaagaataaaattttaaatctaaaacttcaaagggtggtgaaggtttttaaattctgaatagaaagtacatattactttttaagcacaagaaaatggaacatgatgagccctctgtttaaaaattatggtattcactgggtgtttttcaaagctgtgtgtgtggtctggtgttgacaggagagaacatacaatttcaaattagctagtgcttgtcagctgttgctgatagctgttggaaggttttgggaaagacaggggcacggtgatattttggcaagcttgcctattaaggacatttgctggaaatgacttcatgattcctatccctttcttcttaaaaaaaaaaaaaaagcaacacaactacatgtaagcaattggaaaaggaaattcaaccacttttttctggtggttttttgagtagactcaagtctcttgcccatctcagattgaaatccccagagaaaagttagaagtggcaacaacataatcagaaaagcagctatcctttgatatctgatatccattcatcataaacaggcttctttcattttgttaatctggcctagcagaaagatctactcatatttcattctcaacgaaggtaaggtggcataaaagtaatggtaatctcacctcctgggtaaagaaaacattacaaatcagaaaatcgtttttagaagcatacaataacttgtaatctggaaccagaaagatagatatttcctcttttgacaaatcctcattctatagcaaacaatgtataaagacatctgacatgtttaagacaggacagaaatgatgcttttgatcattttggcactaaaatgattcatgattttatcagattagcgcctgttttccatttttcaggaaatggtccaaaagacatactgtttttattgacaggacttccaaactagttattatttgctaataatgttgtgttaaaaatctgagcagagtgtcttgccagagagagagagagtgaaacttttatgcccaacggtgtttggatgagcaagataattacacccttgtccatagcagatgctctgttcttcgctttggcagtttccctgttcagtgtgcaaataattttctctactaaagttggtagctatttgctacaaatatattgcttttccagcaaagaatggatcttttccatcaccactcacaaatagcaactgaattgactggagtttttattgtttcaaacacatacacaaaactgatgtgaagcagaaagaaactcatatgaatgccccatgtctgtcaaaggatgtgaataaaataagttatttaccaaaatagttgaaaaactacattgtaacaatgatttgaacttatttaaattaagacttttgaagaagtcaatgttgatagtcaaatatttttaaaattcaaatgtgcatttagttagtttataatagaaaagacacttatttacatatattgcaaacatcttatgagctctcttagcccctctatttctgtaacaggcaaaattcactttgtacatatatagtgagaccaaaaataaggagctcatattcctcacagttttgacagtcatgtatgactatgcttgaaatgggtgggtgtattctccctggccagtgatgaacgaatacatttccataagccactatgcttgctttttgggtagcccagatgctgtggttttgtctgtaagcagtatgcttgcaggtgttttggcagagaactgcagaaggagaagggtggagaaaatacatttattatagttcccttttttgttcttaccacagccccagaagcataaaggcaagtagaaccactcctcaagttgccatgttttcatagatacataaggcaacatatacttatctaataaaactaataatataattgggggttaggttgatgaattacccctgagtctcccaagaagaatcattgttgactagacttttatggtaaaattcaccttccagccaaagattaattaagtgccaactgaaagattttgttccaagtatgtatatgtaagtgctgagaatcagaagtgtggctggctgcgtggcctgtcctcaactcttcagcattccaggggtagaaatatctactgaaggacaaaatgtttatcaccagcagggacatgagaaaaaaatgtctcctagaaccttaagcagggaggagataaatctgtctatgataaaggtttctcagaggaggtgaaatttgaatcctgccttcaggatgaataggcttggctactggggaaccaggaggaaggcattttatatagaacagcagcaggaatcaggaggcagtagactgctcattttcaaatggctttttcagagcatgctcaaatactactattaggttagacggcactgaaaagagaagatggccctgtttggacattaatattatttctcttctcacataagaaaaagagaggcagcagaaagccaggcgcggtggctcacacctgtaatcccagcactttgggagcccaaggcaggcagatcactaggtcaggaattcgagaccagcctggccaacatggtgaaaccctgtctctattaaaaatacaaaaaattagctggatgtggtggtgtgcacctgtaatcccagttactcaggaggctgaggcaggagaatcgcttgaaaccagatgcagaggttgcagtgagctgagatcgtgccactgcactccggcctgggcaaagagagtgaaactccatctcattcatacatacatacatacatacatacatacatacatacatacatacatacatacacagagttgcagcagaaaagctaggagaaatgcagtataattttgttaggaataccagataatgatgtgtatgtatatactaataagaatttaataactcaaatatttggaaacataattctagttttatttaatagttacactggtgttacaagagaatatcaaacatggtaggataaacaatggtacagtaggattctaggtacatccagggttaagtaagattagaaataactttcattcacataagacataggaggtcatttttcccttggatcctcagtgctggatttccatttccgtttctaggtgaagagaactgaattgtgtaagggccattcacagaacttaatcactgcttaaaatgttgtatcaaagttataaataactgagtagatcctgtatgaaattgggaacttccttttccataagataataaatgcctgcatcagggacatggtccttattctctttttgttccttttacttaaacttctcccttactggctgctattctatcctcccttctctaattacacatagacacatctatgcttccaccctctttctcctttcagaatgtgcttaaacacacttagtaaaaacagtccattttgggatatcattttctccttgcgcgggagtcttttaaggttttaggatgaagcattattgacaggtaacttgtgtcctttctaatcactgttgaatcatccctgcagtttctgtgtttattcttatgcctgatcacattcgataacaaagcttgtgcaaaatcaaaaacaaaaaggtcttgaactgcaatcaaataaaggggagctacctggttaacaaattttacaaaacatttattggaaaatatatctatcccatgagataggacacagtcaaaggaccacccactttctccattaacatgtggatagctgtctgcttcttactgcactttcattctctaaaaataaccaccaaggtcttttagtgaaaataagtaagttggaaccaaaaacaaaggcacaacattcttctccaaataagttgctcagaaatgctttttcgtgaaacatagtttctagcatcttccattttcttgctatttatccatgcttggaattacttcattcattagttctgacaacggattgtatttgtatcattgcttgacaaatgtgttacatgtttcagtcttaaaatattccactctgagctcagtgctgcatacttgggagataatgttaaatcagcctcgcgacacactgctgtcatcatgccaaataactcagggaaaaatgataagggtataaagagatcaataaggcaagaaaatctgtgctttcaaaagtaaggcaaaatatgagaaagactatcagtcaagcatcggggcataaataaagcaagaatatgccacgtttagggcaccgtgatgctacagtgagcaattatcccatgagtagtaaatttctcttacgtttgcctaacacctttattgtaggtcattctaaaatgtagccatgagattcaccggcacattgatcagcctagcattgctcttttttctcccataatagaataaaatgaggatatggctgataaatgctgagaaggacaattcccagaccatttagatgtgagtggccacactggagtgttctccctgtgtaagaaagatttatataacgcacattttttaaaatatgaattatgcaaatacatttctgcccattgagatgatattactcaacagggccctcgtaagtgcccagttctgttggatgtttagacagaaaacaagcaaactgtagataccggcaatttggaaattaaatcttttattgagtaataggtactcaggcgtgcatcaggaagcaatcgtttttctttttcagcaaagagcattaaattattataaatttgcaacaataaatggaatagcttgcaggcacaagacagtaaatttatgaacatttgaaaatagaaatttatttttgtgtgctaatggtcagggagactgtgaaactggcccagagcccttgaatgtcagtctcaggaaggtgatctatagacagtgaagagaatttcaggattgcttttattaacatggggatgaagtgtgaaaattaatttttgttgggggaagataaagcttaaggctgcatgtgggatagattagagtacttggagcttgggaacaggaaatacaatttggagacagttaccttaatccatatgtgaagtgaagtgctctgaatagaaatagtagaacggatggaaaaggcagatgtgggagacactgagaatgcagcataggcaggacttggggcctggctaagactcagtcatgacaatgaaattttttttttaaatgatgtatccagatgttaaattatcagtatactgtatatctgtggaaaatgattgctgagttcaagtgaatattcaaggcataatgtaggatgaaattttcatgccatgatataacacttggaagtacccttcagcatgtagagccatcaggaaaagtgtccaaaaaaggacatgaaggggcatgggctaaaacacattgtagacagaaagaacaagtggaaacgcataggaaaagcatggcctctgactcattcctgtggactatttagaattaaacatctgttgctttcaactttcttggtgctctccctatttaccttaagtcatttagctctatcacacgagatacttacatctgaaaatggaagatcacctcttgatatgacagagagatagaattttcagaacacctcttggtgtgtgggagaggtggagagatggaggtgtggctggaaatgtgagatagtgcaggtttgcctagaagctgacaaaatttaggctttagggtccctccttttccccaacctcttctataatcttatatctaatcctgtataatcattttgtattcttctcaaaaatggtcaatggccatccaaagtgtataaaatttagatcccacaagatccacattctttccttaactggcaatgtgtttccatggttacatggatttggaaaatttgtaaaagaaatgcattttaatcacaactggtccttgtctcttttcacactagtttccctatttgcattttttttttccttgcagtggtggcaggtattttggaatttagctaagggtaagttgggtaagagatgcatttattttgaattcaataggatccatctttgtgttattgctagctgttttgtggtctgaatggtttccaagaatactcatactcctcactgtaccagtgtcttgggcattgtggcaggaacgtgctgggccaactcaaggttctattgtgataggaatgtggtctctggtgcccaacactggaaggatgtgggaagtagaagaaaaaatctgaagccagaagcgaactctgtgcaaaattcatccacattgttatgcccaaatttactatcctaaccttcctaccattcttaccttataacaagttataagctattaccatttatgagttgtgaagctgaagaaaacatttctgaactatcactagaaaaaaaagtgcctatcagctgttagaggacaggcagaattatctgtctctagataattctccctggagaaaatagtatgaaattactctcatataaagagacaatcaaaaggtttgcagcaaaaaaggagaggggattatttctgaagtgtgtcagggaattaatattattttctacattttttattttcatgttgttcttcagctttttaatattagtgatatgttgaaatttcgtttttattctaaacaaatattcattttttaagtaattttatatttataaattttattctttttttaatgggtctccaacattgtataaacttaaggcacaacaagacctgagtttgtccttgggttcaggggacaccttaattttcataatcaagtatgtaaacttaacctctggctcatccatgcagtccacgtagagttaaatatctgttgctttcaacttttatggtgttctccgtttttaccttcagttagctctccctaatattatcttaattctctaattattataatttgggaatatcctatgggtttatattaagtggaatatattggtatcccttagtatgctgtaccctaattccagttaaaaagaatgtccccctttctgcatagcatagtatttgagaaatatatttaaacagacttttaaaactgtttcaaaacagagatatgtggttcaaaacaaaacaacagtggaatatacaccaaagtcgggaatatctgaacatggaatattattccatttagagaagtttgagaatttaaactagtttcatttcagaaaagtattttcagaagtgacacaatccggtgaaataaagtatataatcagaagtgtataatctactgacaaggaaaggaattgtctatcgtttatcaatactctattatattttggtaaaacaaatgtaaacattatttttactccatctcataatggaacacataagatgtgttcttgactaacaggaagaccaaccattggaatttaagcttgtataataggcaaaattataatgtcagtgattatttttctagttttcccctttgggtcttcaataaaaaataatctatatcattaggcagggatgagatattgattggtcactaaaactagcacatcagctacaaacataactttcactttcttcccattcataaacaagtcattatttgacctgctgggatgtgataagaagttcaaagtaaatggaacacactaggtcatgccattctcagtcttctaatcaagataaaataagtgcagaatatacttcttttttgttattatctgtgtcattgcgcaaaattgtaaattgggtccaggatagaaactggtggccaaaattagaggtgtgtctatttgtctctctgaaattgctaacatatgacactaattgactttgtcagaatcctcagtgctaaatgaaattaatgaccagtggaatccaaataaataaaaggaaatgtgcctttgcgtatagcatagccagattcaggatgaatagacagtcaatgttgcagaatattataatactccaaaaagtggttcttggccaatggtgggtgtgctagaatctcactcttctgcatgactaaactgggaggatttcggcattaaaaaaagagctctgtctctgtgatgtagtgtatactttgagaatctttgctttcctctgctgaaataaggacataactctagagggtgcctattttcattgggtgaaaaatattcctttgctaaaaaaagtctttcatatgagtctactgatggatcttaattcatttgagtaaaagccaccatgctaatagcaaaagtcctatgttgttagtccttctctcattttatttttatctgtattattactaaagcagttttctcccattactgcaaaccacaaggaaaagcaatcaaattgattacatttattgtcttcgagaactccagttataaaactagaccattccatcattctattcattgtgatacttaaaactgtcactctgggtagtaaaatgtgttttcctttattataaagaatacagtttacagtaaaataactggacattctcacaagaattagcattggatgcaggtgccattttttcctgtactctatgcttgatcaaaaggccaagaagcaatctcctatactcttaatacaggtaagtatagaccatatttcagtattccaagtttatctatttatcttttctttgctttctatgctgtgctgtgtgctgagaactctgtattaaccccacctgtataaactgttctactttcattatcttaggacttcaaggagtaattgtcactggatatattttaatctttaaaatattttctcataacagcatttattgtaatattatcattgaatttatctgctgaattctaattatctgttctattttacacatgttatagtgtaggttaaatttttatcaattacctgagaattagaaatctctggtctttgttacattatcataaattttctctaattagatctcttcttcaagtcgaaattctggatggaaattcttaataccagtagtgttaggaagttgacctatagataaaaatattttctctacttacaaaactatcattatagtaatatagtacatagtaacatggtaatataatgagctgtaattctaggctgcttcactggtttgtaaacttagatcaattatccattattcgccaaagtgttgggttccatatgatgttggctatagggagaaggggagagcgatgcatatgtaagtttgtgtgtaaattaatatataaatcttgcttattaaaattttgaacttcacaagctattattaagacccatttcctgaatttaaggaatacttacaccactaccaacatgattttaagaaggcagtttgtatcattactattgtagttcatgctatgctttttgctttggcgatggatgctgtctcaatttagcttcttaccgttggtgtctctgttttcattctgcttaagatgtagtcaattttatggcattaatggtctgccctctgagagcttacagtagaccctgagcatttgtaaagcaagaaatgatgttagtaaagatactttaattgcggggagttctctgttggctggtgaataaggacgttctctttgagttccacctttctttgagaaattttcatgtttcctgtacttttcctctattatatcatggaaacttactaaatcagcctgtgcattccgcccacatattccctcatggtgccttccggtcctagcagctgagccagggccatcaataaatcttcttcttttcccccaagatattcctagttgcttctttactattcattcttgtaattccattcatctgtgtgtatcatttaggatgctgggcagttgcatcgcatttcacctaaggtcacatcctgatgggatttggtgggatcctagagctggctaggaccacttgtgagagctgattgttaaattctccgaaatgacgtgactcagttgttagactgcttaaaggtaaaaatcagtggtgtacttaggtttgtttttttttgttttgttttgttttgtttttatcaacatagctataaatcagggcttttcccttgttttttttttctcgcagagtttcagaatacttgcacaccactaattgtgaatagttttctgttttgattccccacttcttgcaatctgccttttagtgcatagagcaagcactgaggcttctttaagggaagcaaataaatgatcactcctagaacactctatgttatagtgattgtactttagaaaaggctattatcggccaggcacggtggctcacgcctgtaatcccagcactttgggaggccgaggcgggtggatcatgaggtcaggagattgagaccatcctggctaacacggtgaaaccccgtctctactaaaaatgaaaaaaaaaaaaaaaattaactgggcgtggtggcgggcgcctgtagtcccaactactcgagaggccgaggcaggagaatggcatgaacctggaaggcggagcttgcagtgagctaagatcgcgccactgcactccagcctgggcaacagagcgagagtctgtccctaaagaaaaaaaaaaagaaaacagaaaaggccgttatcactatttgccaagttttacatcgtattcttcaaccaaagcaaaaacaaaacaaaagcatcctctgaataatggagatgtgtagaaagtactctggaatgtataaatgtattactatcccattcttatgctgtggactatttgcttcagctaccctagagcatctatcttatgacttgttagaaattcgggagataattaaactgaaaaaaacaatttaagccattgtttacccacaaaatgttcttgcaggggaacaattttttaaaaatctaattatttttagtgttaggagccatgaaattagtatagtttatttcttgtatataaaactccttttaattaagtgcatggatatttagtagttggtgtgttatttaacgtataagttttttccactgacagttaaatatgtcttattttaattagtacttttacaacttttagatatttctcagaatctgtgtattctaagaatgacttcccttataaaaatttatatttgtcttaaaaaattcttctgagagtcttgtcatcagcttatctgagagcattctaactactatcagtagctactattagtagctcctctcagtagctagaataataccaactaaacctaatgtcccattaaagaaggacattctttgacttataatctagagaatttcattctgacaagcatcaatggactttttactttgtatcatgagattttaaatcacacaagccagagttggctagatcagtcaacaaaccaatatacctgttaaccaaaagaacgttactgttcatgaaaacaatccatattataaaaatgctttaggatttatgtgataataatagctagcatatatagaatgctgtgtgccaggttttattctcagtgctttacacacaatcactcacttgaaatggttaacagtgttctgaggtagctattatttcaattttttgagatgaggagatggagacaaaagaggtggcatagaggtaaagcaagatttgagcctgcgttgtgtgtctgcaggatctatgtccttagacactatacaatgacaataatgttcctttcttcttcctgagcctatgaagagtataccaatcaagggcaaatgccctttaactgccagtctctgaagctcaattacttctttaaaaaaggacaatagcaatttggagaagaaaaagcagaactgtcttattactagggatagttccttctcttatgtagaatatcaccagcccaaaaaaaaaaaaaaaatctccagtaataatcacacaaaaaagaaaagatgcatctggaattggatgtgcctatattctttcgagaaattctctaaggtttgaggtgcattgacttaaaatatactgaaaatgggagtcctcatagaggtttataattaagagcaatagaagtttgtgtaaatattttataagtttcttattataaaaattataataaatttgataatgtaaattgcctaatattcattttatcatgaggtatttttttcttaaacttgaacattaatttattctcatagttaccacctcacagccccaaacataataaattttgaaaatgtatttatagaaaattatctgtgcaagtgctcatttcaatctttacaatgaagcaattactttgcatgtattaattcctgtcacatttttgatctgtgctctaacattgtcttcttgaggaaattattatgttttatagttcaaatttcttagatttaggacttcaaaggcctaggttctgttcacatttaattttgctacatcaataaaatatgaatgaattggctaataaagcaacaaaactattttatgtcatggaatataggttatcgtttatgaaattgctgaattgccctggtaattcactgtaagaaaaccttctcctttttttgccttggtcctgtttggacagaaataaaattggtagcatgtgtgttacatggaggatggcagggttgcgggggtggtttctcttttgggatggcaggtaaagtagattaaatggtattgaaaatgctgagggccccaggcaggcagcttgtctgccaaagagagacacatttactctgtacctacagctaatcttaatttctatcttttcttggtatttagcaattttacaatttagatgaaagtttggttattggttaaaaagagaaaatacaccttttcccctcaaattatatttttacttcctacaaatcttttaataatgtgcatgtttggtcaggggaggtatcagttgaaagagaggttttatatgccaaaatataaacctacttcttgagtgtgggaggaagcttgaatatggtttctactaaaaggagattaattacattttaagaaattcctgtaactagtagcatagcatagaaactgtgaccattatttcatcagcacatagtatgggagattatatgttgtagctataagaatgatatatattagcattgtccagtagaactttctgtgatgatgagaatgttctgtgtctacctgtcagatacagcagtcagtacccacgtatgtttttcagcatttgaaatgtaactagcgcaactgaagaaatacatttttaaatttaagttaattttaattaattacctgtgaatttaaatagctgcatgctgctaatgactgtcagattggactgtacatatttatatttaaacctggagttaacggaggtgaagactgcttagcttcaggtcctgggtatgatgctgagcagctgaacaaccttgaaaagtcgtttaacctccctaagtctcagtattctcttcttcaacatagagataataatagttcttacctctaagagttctgagatcaggaaataaatcaatgagcataaagctcttagaattgtgcctggaatataatgtatgctcaataaactttagccattgctattcttattttataatcttttgtagatattgatgaagtagaaactgaaaaagtatggaaatgaaatagctctaaagtaataaaaggaaaatgtcctgaatgggtataattttaggtgatccttgaggaatatgtgggatttggataaatagaaagtaattacagggtgaccatacaccctgatttgcttcagacaatctcaattattccttgtgtcctggtttaattactaacatccccctcttttgctctcaaattttcccggtttgtaagataaatattaagtcactgtagaattagatataggagtacagcccaggcgtttcagatgcagggaagataacatattaaggtatagatgcagatgtgactatggtgtggtttgaatggtgagtactgggaagtagaaggaaacagggatacgtgtaggctggacacattatggagttgggatgagaactggtataaggaaattagattggattgtatatgctatttgcactattgttgaattgctcctgtgtcaacatagattcactttcagaaaagcaaagttcccatttaattggacaaaaatatttggtgtatcaaaaaaacctgatactattttgtgttctgattgtatttccattactgacagtaattttcgttatacgtaattgggaacaaagtgtgttatttctatcatccctttgctacaagtaaccaaatcagtaatatgattggttaatatggaaactagtcaattaaaatggaaaatgcctcattattatctgaagccatgactttcacaactggaggaaactttgcaagagttcatttagttgcaataaagtattatcactgaatattttatgttgctctttaagctacatccattgtagcttatcactgcatattttatgtagctctttaagctacatccattggtcttcattctacttaggagggtgtacattttaaaaaagctaggggaggccaagcgcggtgtctcatgcctgtaatcccagcactttgggaggccgaggtgggcggatcacaaggtcaggagatcgagaccatcctggctaacacagtgaaacactgtctccactaaaaaataccaaaaaaaaaaaaccccccaaaaaaaacaaaaaaaaaaaaacaggcgtggtgtcacccgcctgtagtcccagctagttgggaggctgagtcaggagaatcgcttgaacccaggaggcagaggttgcagtgagccgagattgtgccattgcactccagcctgggcgacagagtgagattccgtctcaaaaaaagctaggggaattttaattgttggcaatattactaattgtaattttagggaaatagagtattagactgtaggaaaaaccccgtctctactaaaaatacaaaaaaaaaaattagccgggtgtggtggactgcacctataatcccagctactccggaggctgagacaggggaattgcttgaaccaaggtggtggaggttgcagtgagccaagatcatgtcactgcactccagcctgggtgacagagcaagactctgtctcacaaaataaaaaaataaataaaaaatagagattatggggaaaaactgaactaaaatattaggcaaatatatctttcttattaagtgtaagaatgttactctaagcataattgttgtacatttctgaagacctctttatctctgattgcatttgacattgacatggttggctagcccagaaatctccataaagagtttctggtgacctgttctgggttttccctcattgcctacttattctagctcatcgtgaaagcaggcatttgggttgatctctgaggtattccttggacaaacacagcagatattccattatggtcactttcagtatttctggagaatgctctgattctaacaattattgttcatattgtagctaacactgtaatctccagctggggaacacatcatggctcattattccacaaggaaccaatcattatcaatattggagtcctagcattttgggttattttcaaggtatacacttgactttttaaactaattccataagcactgcaatgtctgaagtatatgttaattttgtttgtttgtatttaaagagataaaaaattagtcaaattaaaagaagaattgggcaaagaccagatgtcactgccatttgaaaaactgataatctttataaaactccattgatgtcatttatagcaccactttttgctagcttataaatttattaatcaaatttgtttataggtgcttgaactgaacaataactagtttatttgtgtttccaagtaccatgaattttaaaatgtcatttaatatctaagcctctgaatagaattcaatgactttaaattaaacctatttgtaaatagcacagagcaatgtgtgattatgcaatctgctgaggttttcaaaaactaacatttagagcaaaagtgaatctcattctaacagaattttaataaaaactcagtagtgatttgtaaatgctttgaaaccaattagccatcccatccacaatgattgtttcatcacagcttagttcttaatgaaaatggcaaaccacggttctaatgacataatttcatttcaagaatagtggctttcatgtttaaaaaataattggctctttagcacccccttcaaggtgaattactccaactagaactgagaaggcaacgctcatattgtgggtctgccttgtgatgatgataatgacaatggtaatgatgagaaaacaaagaattactgaatattggctctgtgccaggccctgtgctaaacatttgacacataatttatacattttagcttcacaacactccaatgaagtgaaataatcataattcctctttcactcatgacaagaggtttaagtgcctagttagtggtggagctggattcatagtgggtaatctggagctcttaagcaccatgttaccactgttgacagcagctattacctaggccagttgatagagaatattcaaatgattgcctttcatgaggagttttgtcttttattgcttatttccatatctagctttgggtaggaaaagagaagtaggacagattttcaccaaactgttacaaaagacataattgaaacaattgtttactatgcttgtattctagataatggagaggcaattgcctagcataaaattgcaaagccataatgtatgtggttcatgaaaccatggctgtaattgcatggcttgccttagatattaatttagctgcatttgttattacttgcacagagagtattcatattcaccctcatttaaggctattatagacacactagtgactaccacagttcttatcgtgtccactctctcacgttgtgttcacactagaggagaggtctgaagaataaaggttatgtggaaattacactatcaaggagatgaatccaacagcctgcagcagtgttatccagcgagcaatggattacatgtgtacgtgcaagctaaataatgtatgatttaagacaataaggtagtatgtattcatttttggatagtaaaagagatggcatgtcagtcccttgggagattttatccagggctttacccttgagtggataaaaagagtacaaattctattgcataggaggtgaataaaaacaaactggggagaccatcagcagaacagactgctgtgtgatggagtccagagctactccaaaaccaccagaccaactgcctcaggatcctgccagcaaccagatgccggcaatagaactgactgcagtttggcatcagggctctgtgatttccagccaaggggaattgcatgcaaaaaatatttaaaattctctttgtaaagaattatgttttcaatcagaaggagaagtatgtttcagacttagtctgctgcaaatgaaatgtggcatactgacatcttggttacagatggtggaactgcgtatgttggagggggtgaatgccatgcgaagttgaactttggtttggtggtaaggttttgtttacggtttttttaggccattgagttagtatcattctgtgaggggtactgtactggcctttcaagaagatggtctggatctacttaaaatagtgattctcaactggaagagatttcccaaccctacagggggacatttggcagtatctggagatatttttggttgtcacaactttgggagagggcagtgcaactagcatctagtagggagaggacaggaatgctataaactatgctaccatgcacaggacagctccctaaaacagagaattatcttgtccaaaatgtgagtggtgccaaagtatggaactaaggtttaaaattatctggctcatatatattcactacaaccccgcctgcagacaagtgttcatcaaatatagtttgatagtgtataaaaaaattgttaaataatttgctttactctattgatgtgtgagcaacatttattgaatgtcccaaatgctttctgttaaaaaaaaaaaaaaagaagaaaacacaactaacctttctccaaacctacatacccaaaccacagattttacaaatgtaggaggacccagttgattcacttttcaaacttgaaaaatgaggtatatgaacaaagcacactaaatgaatcagctgtttaggaagatctacaagccagttcattttcctgttattaaataacaaaccatgaatcttgacaaatgaacccacttgtttgacagtatttgaaaaactcataacatgcttggttctgatggtcacttcccctttgaaattacattttaagatggacttcatttaaattctgatagagaaaaagagccttttaaccttcattttgactgtctgctgtttatcatcatcattctttccctcctgctgatacttagatgctccagagcttttgccagagcatcatcctccagtgtttacttcaaggaagtgtttatgtttattggtgtccatataattaagagctaaagttctgcagtgttgtgggagactgcgtggcttctggagtcagagtccctggcctcaagttgggctccagctgtgtgaccttgagaaggtcatttaccctttttgtgcctcagtttcctcatttgtaaaatgagaagaatattatttgcctcattgtgctgttgtgaagatagcatataaaatgcttagcaagcacaaacggatgctacctataattattaggattactattttaggaatagcatgtttcacaatggatgccaattcatcttatttcatttcctaaagaggacattggcactgatcctctgagatagcatccctaatgtgtggctgaagggctttagaccctattccataatccctaacagaaccttccagcaaagctacaatgactaaacatctaagaaaaatctgcatactaaccaagcatatgcagctgcaagagaaatcctctatctctcttcttcaatcagagtgtcatccaaaatccccttctgaatgtgccatttccaccgcttctaagctgacactgcaaattcatagcaaccccttgccctgttatagcacagtgttacagtgttcagtaaccccagaccgtaagtactctctcctcctaaataggatttataaagtgtgactttgagcaatgtagcaaagtcaattttatctgcaggaaaatatttttctttactaacattttaaaatcccttcctcagtgctccaaaatgatttaaaagctaatcaatgataaaatcccaaatccctctaaagacaaagaattgagaaaggaagcagagccactttaatcagtaaaggggctgctgtgacccattaacccctagagattattgacacttcttttatttatttatttatttatttatttattttttaagattctgtagtttggtcatatgtctttggcagcaagaacatacaaaatcgcttttgcttttcacaaattaattcatttaggcctgtgcatttgtcaggcattccgggaactttctgccaacattttgttgattaaaggatgtgtatttggaatatgggtggagaggaaggaatttataattcttaaaaccaaagaatgatttataatgctgaccgctacctgaatcaatcagtgcatcatcaacagataaatgaaatactaaagataaggaagagttcctacactgggtgttaaaatctgtggattgattggttcaataacaccgagaaaatcgaccgctttcagcagaatttctagaatttacgaacaaggatatgacaaagaaaaccgcctttttgtattttgttcagaaagcttctgaaatacattctttcttcacaagtctggtgcttccactcctaattataaattacatatctcacttcagtgcacacaagttcctgatcctcatcccaacttcggttggcttttgactattttgttaatttttttccctgtgaatttgttgggccttttggaggacacgtttattgctttaggcatcatgcaatttactaaatggtgttctggttatggaaatgcttacaaagagccctaggggggaaaagaattaagtaaacacatattgatcatcctgtagctggtgctttcttatttgattagtcaaggactcagtctgaactggtccttctaatctgtgatacataaagctggagacatttttctggctccctggtggttttaaaggctaaacaaagtctcatttttgaaaaagcctgaatgcagaatggaattcaaagaatttggagagaggggaggtgaaagtggtagcaaacagctttaaaaaggccctgggaattttaagagagtaaggcatataagggaagtaaagagaaatctcatctgacccattatgagatacaccaggaagccacctcggcaagcatgtactgaacacctactgtgtgcaggacttgtaaaagaggtagagcttaagttttgtgaggattccaagaagctaaacagaatactttatgtcaggaaataagtcatagtttttgatgctagctaagaaacttgagctttctgtagatattaaatttcaaaaggcaatgaatatattctatttaatccaaataccaggaaaagaaggttttatcctgtataattcattttaaaattcattttaaaattctatgtgaaaaatgttgatactaaagcaatactaaagaatagttgagaaaaatgtttctttctttctttttccttttcttttttttttttgacagagtctcactctgtcgcctggctggagtacagtggcgcaatctcggctcactgcaacctctgactctcgggttcaagtgattcttctgcctcagcctcctgagtagctgggattataggcacataccaccatgcccagctaatttttgtatttttagtagagatggggtttcactatgttggccaggatggtcttgatctcccgaccttgtgatccgccctcctcagcctcccaaactgctgggactacaggcgtgagccaccgcgcccagccaaaaaacgtttatttcaaagaagaaatctggaggctctgggttttgctcctgtcatgtctattctttcacttgtgcatttctcaactgttggtcaatgtgtgtttgcgttgcacaattttctttctttgttatttttactttttattttttctgagactgggtcttgctctgttgcccaggctagagtgcagtggcgccatcatggctcactgcagcctcagcctctagggttcaagtgaacctcccacctcggcctcctggatagcagagaccacaggcacatggtaccacacccagctaatttttgtgtattttttatagagatggggttttgccatgttgtccagactggtctcgagctcctgggctcaagcagtccacccatctcagcctcccaaagtgctaggattacaggcgtgaaccatagtgcccagtctggacaattttcttattcccaacctaccctgccttcccaaaaataaggggcataaaaggtgaaacatgatagaaagcttgaagctcgctgcatatgagatggtacagtctctggctgagggaaacaatgggaattcagagaaaaggaggtttccaggaggctgtttgagattttggtggctgactgtattctgagatttagaattaagaagcagataaagctaacaccaagttttctagcatggagactggcagaacaacagcaacattgaaagatatggggtaattgtattgggtggctggtgtggggaattgggaatgagagaataggtgcaatgggttgcatgtgatatactgaatctaaagcacattgtcttatagacagtgggaaatagggactgaccaaatttaaaatcctggaaggtgtaaaacagattactattgcaagaaatgaagctgggtactgctaaaacttggccttctttctctaaatgctaagtgctgtctttattccattttttattatatatatagtaacctaaatatttctcaagcacctactgtatatcaggcactaggctacatacatgacatactcatgtatggtttgacacattccctgctctcaggaaacacagattactgttagaggcaggcattaaataagccaaaaataattaaataagacccaatacactgaaagctgtgaaggaaaataccagagtgttgtaggatgatacttaatttgaaatcagaaggatggattagagccagccgagtagagtggggctgagaatgggaagggtgaaaagttgggagtaccacagtgtctggtctaagaagtgattggagaaaaagtctgataaaaaatcatgtggagctttcaggactttgtaataagtttggtgggaagccactgcaggattctacatacaaagtttagctgtctgtgattaaggccacagtcagttctatttccaggacatctcattatttacccagacccactaggcctgtcaatttggtcagcagcagaagttttgggatgaaaagacatactattttcatgttgaatatgtttcttgaggtttttttttttagaatgaaactgtagagacacaaagtacatttttttccctcagattatattattccttacctttatgccatggcacaaaatgtattatagtttgacctcatctgaatacttacttgctaatgtgccaaaaatgtgctgtttgacaaagacatacctcccaaatctgataaaatagctaaagactcttcatcttcagatgagaacccagcccaaagtttccccactggaatcttgatgaatgtgcttattttgtttttgggtagcatttggggtcacaactgagaaaatctgggacagttatataggttgatattactacaagacagatacaaaccatgaatattcatattattgttatttttgctaatattgtacacttattaatttctaggaaccattttgtttgcattaactcaactttttgaaaaaatcttctaacttaagagagtaccgttattatctccttcgtattaatgagaatgctgcttctcagagaggttaaggcaccacttaaaggtcacatagccagtaagaggcacagcagggactcaaccctagacagtcagtgttagttgagaacttttgaagatatgcctgtataaaaaaagaagcataattagtaaatatatatctatgaattctggtatgtataattttaaaaaccctcacattgtttattgcaattttctgggagtcattttatcattttaattttgccatataataatgtaatgaattaaaacagcggttctcccagggggagattcctaccagcaccagggagcatttggcaatgtctgggaatattttttggtgatcacatctggggaatgggcattactagaatctgggagatagaggctaaggatgctactaaacatcctacagtgaacaaggacagtgcccacaacaaataattatcctgtccagatggtttatagtgcctaggttgggatcctggattagagtaatttaaagaggatcttgaaggtaaggaaagaatggtagctccatcttgcaaacaaggaacattcaatgtaaagaaacgattttgggaatatgagaaagagctaagatggtttcattcattcagtcattcatagaatcactatttataggaatgatttctttgtatcaggaattatgctgaacagtaatgttgaggaaaacaataggagggagtttctttggagaaaaggagggaacaaggtaatagagggaaaccaaagatgcttgggtattaaaggtaagctagggtcagagtttattgccaaaagtgactgttttattttattagggaagaagatatgctactttaccaatctaaggagagtcactatagtcagagacaagttcaaatgccatatgctactgccaggagcacctgataactgttttttgtcccttttatggctgacttatgctgatctgaatggagggccagggcgggggacgatattcttgaatgcaacagagagtagtgatataaatgtgtgtgtgtatgtacgtgtgtgtattggagaagacgcatagcttacattgatttcaagttgtgctgctggcctgtgaataggtgctggcttttgtttttccagtaacagctttttctgtttccagcagtcctatgcaccagctccccaccccatggctcctcccagccccagcacaaacagcagcagcaacaacagcagcaacaacagcagcggggaacagttgagtaaaaccaacctgtacattcgaggcctcccaccaggcaccactgaccaggacctaatcaagctgtgccaaccgtaagtgtccttctgctgcccgtgctgtttctcactcccatacttgccttggtgggcaggatgtgttatttcagtcaatgtactcatccactggtgtctcagtgaggaagactcttctttacaaacaggacttaaatttgagattcaatgctagtttattttggggagtggaattggtttactttttgttgttgagtggaagttcttgagcacatatacatggaaatgctggctgattcatagatatatgacctgcaagatgaagatcaagtaatagagttacactctcaaaccatgtggccagtggagtcattgatgagtctcatgaaataaacgattttcttgagaagtattagtgaaaggaatctcaaaaactcagaagcggtggatttcaggattacctcttgtgttacaaagcttttctggccagtgcttggtaaatgtccgttcagccaggaccatgtatttggagaagcataagactaatcctctagtttctttgaaaacatctgctgcctagtccagtgaagctatctcccaccaaggccaaggaccacactcactaagtagttttatatttgcttggaagcttggaaatgattaaatcctcttcaaaaatgttttcatgaatctactatctaccaacacttatgtcattaattctcttatttctgtgcaaataaaaacatatttaagttcaccttcccataaaattaataatgaattaagaatcatagacctggccgggcacagtggctcacgcctgtagatcccagcactttgggaggctgaggcaggcggatcacaaggtcaggagatcgagacctgactaacacggtctggctaacacggtgaaaccccatcctggctaacacggtgaaaccccatctctactgaaaatacaaaaaaattagacgggcatggtggcgggcgcctgtagtccgagctactcaggaggctgaggcaggagaatggcgtgaaccaggaggcggagtttgcagtgagccgagatcacgccactgcactccagcttgggcaacagagcgagactccgtctcaaaaaaaaaaaagaagacgaatcgtagacctgtattttttggttagtatctgattattttcaaaataatattagaacatatatttgtcatttgattgtgacttagctgtgtatttttaaattttaaaaaactattactcaattgttatttttctcttttgcaatgctttttaaaaagccatgaggatatttattttgtaaatgttctgacctctaaaatattgaaagaggaaaacaaagcagaaaatatttatttgcctttgtcctagattttaagattgggaatacatatcaacacaacagaaagtggcagataaaccaaaatacaaatacataactgtctaattgtttgacaaaacagtaggtacattagggttggagtcccctgttgctactgagtgccttgatttgtgaaaaaggcaaggcggaaccttgaaagataaatatatatatttttaaatttgttcaaaaaatgttaaatgtgccaaagctcagacatacaaatatacgttagattttggcccatagaatattgaggttgagaatcagaagataaataactcaactttttcttttgttgtttaaaaaatctaaactctattttgaaaagcaaggtctttgaaaatgtgaaacattgtagactttatgatagaaggttcaggtgaagtaaaaagaaaaatagctattgttcttaatttatatttgaaactcatttatttttaagggtagctattagggaaaggttctttcttactggtctttaccacttgtagagcctgttgacacacagatgtctgggcccaaggaattatgattcactaggtctggggtagagcccaagaatatgtatttcaaacaggatctttagtgttgttgatcttttgtgaagcacttctctcaacagtcttgaagaacaccaactatttctattgtataaagtttcactaattgatgagggtagttgagatggaattttgagtgttaaaacctgttcaaccactgtgtaatcttgaggcatatcacttcctccctctaagcctcagtttcctctttcttaaaagactgggttggtttttattatttctgtgtttacttgtagtatcagcagtgtgctggagctggctctgactaacacacttgagccaattgttacatattcaagaattttgttagcaatctgttacagacttggtagcatgaaattggcccttgtgggagtatttataacacaggaatcagcacatcctgcaaatcagagctttttaaaattttattttattgaaaagctgctgtatgaacacaccactgatgtagcatcatactatgaattgctgtgtcaatatccatttctgcatagaattgccagaattttgtaaatggaaattattacttaaaagcctatattgccatttttaactcagagatgtggtaacacagaaacattgttgagggaataagttttgttaatgttttttatgtgcatttgataaagaatattaagtgaacagaggataatagttacttgttcatattaatatttgtcagctaataagatctggcccatttattgttattgtaaaagtgtttgtgggttctcctgttacagcagtgatctagaactgggatttattgcttagattatttttcctagagaatcttaaagaactgatgtgattgggcaacataatgtagtggaaataactgtgcactaagagatctgtctttcaatcttggctatgctatcaactgagtctttggccttagagtaatgactttttgcctcttaacgttggtttcccccatatacaaaataatggatttgaactcaacaatcttttatgttttcttcattctaaaattttgatatttgattgaagacctcattatttatctgccagacttactcaagattaccttttgtatctttctccaatcccctcgtgcagtgttggcaggggcacagtcagaatttattcagcttcatgggtatgacctgatggctgaaaaaacctttggtaagagaccaatgcaggtcatttgtaaaaccttgcttgtttctctctctctctctctctctctctctctctctcgtagtgttggcctctcacagtgcttgttaccattttacattaacagtcttctaaagattaaaatcactttccattcctgtacctcatctcacactttaaaataatttcactcacacaacagataattttagtagatttaaatgaacttgccatcaagattcattttccatatttatttctatgaaattataagcacttttagagttaatattccttataggaaatgcaatatttgctaatatccattgtaataaaataatagaaaacagatacacaaaacagcatattgtctttttttaaaaaggcatagacatattggattttctggtattagtatattatatccatgttaatgctaatgaacggtaagaaaattgtattaaagaaaaagaaattgcattatttctaaatatataatctgagagcaaattcttattgaggaattctattcacattcatcatcaaaacttctatgttcagatcacaagtaaaatcaaagaaaagaagataagactgaagaacaataaatataaagaatgattttactctatggaaaaatctagttgtacctatgttttggatgaatacattatactgtgcgtagcgtagaaaatagtatagttaaaaaccttgtaatgtctttttcttgagacaccttaaggaactttattttgttctcaatcaagaaatatttacagattatatcctgcatgcctgtggtgaggagtcagtggtgagtaaatttagataaaggagaaatattatattctactagggaaaatgggcatcaattaaatatatgatctgataaaaaattgcaactgtaagtgcaaaagagagaggagcatgatactaacagattttttagcacaagattagacctagttagggcgattagcaaaggtatctctgaggaagtgacaattgagctaagattagaaggataaatagatttaactaatctagaaaaaagtggaagagcagccaggtaaaggaaacattgtgtgcagagccaagggctggagggggcatgccaaggacaaagggctaagaaaaagccacgtgactatagcagagagaaagaggtaaagtgtggggcaaaatgagctagaaaacacgaaaggacaagatgattcctttggagatgatgttagaagcttgatttatcttaagaacaatggaggaaatcattgaattgtcataaacaggaagttcgcatagctatatttttgtttcaaataggtaactccagctgcagagtacggagaagtgatcctctgagatcaaggaacaattagagtaggaatagttgaaaagctgaaagaagaatgctttttgttcagagaagagggtgtgagaagtaatattagtggtggtagaaaaattatgtgtggtgaaagattttgtcatatgcattcttttttccgttaaaaagcagggacatgggaacaattaaccaaatgaacttcaaaagaaacagcaaagtagcacagaatagaacccaaatgagttgatttttagttaatctctttttatttatttatttatttttattattattatactttaagttttagggtacatgtgcacaatgtgcaggttagttacacatgcatacatgtgccatgctggtgtgctgcacccattaactcgtcatttagcattaggtatatctcctaatgctatccctcccccctttttcttacccagtcttgaacgggtcatcaatatactgttaaacaattaaatggctgtaatattaaaagcactaaaggcaatgtaataaaaactaggaatccaactgattatacagatttactcatggatggatgatcagttgaagactactgacagaacacttggatcatatatatcctttatgcttatctcaggaagaccagacggaagtcggagaagatagatttggtttaagaaagagagagagagcattgtaacttttttgagccagataaaatatttgtagtgtaatgattttttacatataagttatattttgtccttccaagaaattggtaacttctattttatgattctgaatatgccctggaaacacatttaaattgttcctaaaaaataaaatcaaacgtgcatcataatgggtagcatttacaatggaaaaaaatcattattgtatttatattttccacatctacaacatattttatctaaccattttgtggcttataaatttgatttaatacaatgttctcaggaagccccagccaattgcccccactttcctgtgattgactgctatggagttaattaaaatattgtgaaggaacagagtgcattgtttttctattataaagtaaacatgccgctgctaaggccacttgaaacagaatgcaggaaaatagagggaaactcttgggtaggtacatacatatttccagtccttaccagaagagcaggaaagtcaactgccctgcccccacacttttctccgtaaatgttttctttgctcaagtcatgacaccctagcatttccccctttaaaatgaaactctgaatgtcactttaacatttaaaaagagaggggaaacacccacaatgaaaagccagaggaacgaaatagaagtgtttgcgctggagagccgaagggtctgcccaagctaatctcccggacttttacacaaccctgttggatgtctcattatagtgcgtgctgaacgctgaatagtaagagccagactcaagtgccatccaggctccgagcgcagagtccattatacatggtgtcagacagttttgacaaatgcaccgacacaatcaaaccttttatcagtttaaaagtaaccttgtcacaataatctgtcagactgttcagatacaactaaaggaaaacaagtcatcatgcactccagggtaaacaagtaaataagaaaaatgtgactggaaatttttagagttctttcttactgtgtcattgaagatttaaaagtttcctctaataagaccctaggaaatttattagtagctgtcttctgcaagtcagactcaaattacgcagctgcttttgagatgtcataaatctatgtggtggcaggtgtgagcaggaagtgaatactggaatctttaaaccctgcctttgtgtattttaaatgagagagtgctttaaagacccaaaacacgatgttggaattccttgattcagcagagatttgacaatgggttacgtatattcattcagatttgggcaaaattatgtttgccaagcatctgctgtaaactagacatagtatttgattagtactaaataattgtcattaataataggttgttatatttatatatttacattaacacagttattgtatattacatgcctcatactctactaagtttttaaattatttaatgttcaaaacttccctatgaagtgggaataatactttctttaaactgatactcaaaagggttaagaaacttgttcaaatttatgcagccaccatagccaccaggattcaaaatctggatctgacttcaaagccgatattcgtaatcactgaaacattcatataatgagaataagggtggcataaatcataggttctcagttccatgactactcgtgagaatcccttagggaccttcagaaaataggtttggacctcaagtgttctgatttaaccagtatgggtcaacctggattttgggattttttaaagcctgctcagataattctagtatgtagcaaagattgagaacttttagacttaatgatgctcacacaaatcggaaaacataatttaatcccctgttttagctctcttactctgactttcataggctctagcaatttcatgggacctaccactgtgctttcaattatccagaagtattaaaaatgaatattattgtgaaaatttggggatgaatttgattttctgataacaaactgacattttagattaggcacatggataataaagccctggaatatgcctctagaagtgttttcaaggatgtccttggaagaatcttactttcctgctttatataatttccaaaagtcaaacatttattcaacattctactttttaataatgtttgcatttaattgatgattaagcaagaaactcttcctattttgactcatatgattaaatttctatatatacttacatttttttgccgactatagtttagtgaacaaaagtccagtgagtcttaaaaaataatttacatctcctagtgttttgggggcatcctagaaattattgtcccactgattcattgatcactcatttattattgtttttattactttgaagaattttctgctgaatgtttacatatctcatgatcaatttaaaaatatacttaaattcctgatagccgatgatatttttccatatctatctttggaacagagaagagaaaaataaaaataaaaaaatcattgagaggaccaattgacttagtttacgatcttgatggtagcacaaaaaagatggagatgtaaaaagatgtgatcaactctttctggatgtgctgagtaaacatctggagctcagagaggtggaattctaggcagatctcatgctgaatgcctgaaaatttgagggacttgagttttaagggcgggactctggcaagttcagatggcatcctggttttctatttgtccagtgattttttaattgataaatacagctgaccctttttagtccttattttaattaagctctctgttacttgaccctgttgacccctcctttcttctcctatggatggtaaattccttttgcctggatttcctcttaccttttggagattattctttctactttctcttcttctacctgtctcttgaatattttggagttttctggagattggacccctcttttcactctataaactgtctgctctttattacacaaacaacatcagctattctaatgactaataattctatattgtccaccatcaactatttgtttagttctggatccatatctcattattccctagacaattccagttttgtaacccaagagctatcaaattcattgtccaaagagggttattcttggacttatcccttctttaagggatcccactattctctatgtgaatagtggtccaaataaaaaatcttggggtaactcttttccccagtctagaatcaatttccaagacctcaactgtttgatatttatgatacccaatagctcgtctgcttcagtactgccatggtctttttactcatttattcaaacgtacttattgattgtcatctgtgtaccaagcactgcagatatcttaaggattggtaagtttttccatataatttgcattctaatggataaaaatgatatatgaataaataattaaaaaacattagaatatgtaaatgtcatgaaaagcaggttgtaagtaatgactaggaggttactctagactatgtgttctctttaatgtgagacttcatttgcaggaaggagtcaggcagataatattcagaaataatgcattacagacatatgtaagaatttggccaaagcttgaagaaagaaatgagcttgttgtatacaaggaacgtaagaaaggttatgtattcttctgcaaagaatagattttagaggagtacaagagaagaagcaagaagacgagcaaggaggcttttgtggaagtacaggaaggaggtggtgatggcttggaataagatcacaatggtagaggaggttaagtgggatgaatttggaatatattttggagatagttttgatagcatttactcatgaatggcatatgacaaaagggttaagagaaagagaaattagggataacgccttaactcttagcttgagcatcttgagggatgactccttaactcttagctggagcgaatatggagccatttcagaaaatgaaaaggattgtggaaagtgcaactttgggtggacagaaatcaagagctcttcttagtcttgttatttttgagactgtattatacatctaaaatgagctttgcattgggagtttaatatctgattctagttttcaaagtgaaaaagtaaaggatataaaatgggagccataagcattataaatggcttttaaatccatattgatgagacaatagtgtggtatctaatatgtactacagactgttctaagtattttgcacgtgagtacttcatattacatatgttaactcatttagatgtcatgccaattcccattttataggtgaaaaaccaatgacatgaagaagttaagtgactttcccaaggtcacacagctggtaattagcaaatccaggctttaaattaataagttttgtttaagagccccatctcttaaccatgatccatacatagggagtgtgtataacaataaaagaaaatgttcacacaacttgaattctgaggttctaagagaatgagaaaccaagaaagaagtttataaaggaacaatcagtatggtaaaggacaaccaggagtgcaggagtgtgctataccacagcagctgaaagaagaaagtatttaaagaaaacagaatgatgaaatgtgttgaatacttgctgagaagtcaagaaatatagggagagagaagttacatttgggtttggcaacatcgaggtcattggaaaacttgagcaggaaagtctttgtagacaagtacaagctaaaagccatttgaagtggtcctttcttcatcactcaacaattctttcaagcggaaatatatgccttttttttttttttttttttttttgctccatctataccaaaatagtcatctttcctaacattcctcccttgatcttctggtttcctctatcatctccatctatctctgtctctgtcactatctcaatttctatcttgttccatttcagtaactcctctttctttcttttcctgtctgtttccttccctccctactccctaccaatctgtactgtatccttaaccgaaaacttttgaggacaatagatttattcaattcatttttttacccctagtacctagtacacttccagatttttaagtggtaactgataaatatttaatgacagaatgaagcccaaattcatcagtaatataaaaatgattttattggacttacatcataaaacttgttctaaggtagagtttgagtttatattgggagatacaggaaacagcattttatcttagatgctacatccaatgttgtgccactgaggtgaaagaaggaaggttctgaatatgaagctcttttattgtgtagatcccaaggagagttttgaagggaagcctcaggataacttgaatcaaaagaaacaaataaggatcaatactttgcttactcactcaatattgctgctgagacaaaaaaaaaaaactgtttatttttgcctgagccgtcaggtttcagctgtcaaacagatcacagtgttccaccaaatctgctaattctatgtctaatttaagtaagttggactcgttgaatggtgtttgctgaattttgttttttcacagatttctctttgcaatctttgacttttaggggcacacaataagaaactgttggtgaaaaaacacacagagcatatctgtgtatttggcataataaaaatgaaagctttttatctgaaaattggcagtagtatggtatatacacattgtttaatcatatgattgagaataaggtacagttaaaaattatccttaaaaagaaaattttaaaaaacaaatttttgttttatttcttatctgttgtcatattcgttatatctctaacacagtagtatctcttgagaaacaagcactttgttttacacggtaaatatgtccacagattttttgaaaatagattttttgttttagttttttaagccaacattattgaggagtaaaattaagtgcactcatcataagcataggatttgatgagttttgaaaatgcatgtacctatgtagccacgacaacaatcaagatataaaacatttctatcatccgcagagattttttaaaatataatcatattctaagaagtccacaatttaaaatcatcctacttaagaaaacaaagagacggcataataccatcacaagagtagcacagaattttgagtccattgtgggttctaattgaccacttactcattgtgaaatcttaattaagtcattgagactttctgggcttaatagttccaggtacatgttaagccctcaataattgttcattattgttactcacttatgcaatcaaaaacatttattgtaattcatatttttatatagcaggaatagttaaataaaattcacctgtaattttaagagtcttgtattcaaaaagcacatattttgatttttatattcctatcttatttgtatattaactgagattatacgtatttagtaaccatagatccttatattatcttgtagtattgtgtatcatcaccactatacatagtacactggtatattttacaatatgaatattcatggtatcagaataaatacatacaatttaggttgcagttaaaagactaaaattaaaatacagcataaaacaaatttaaaaacacagttatagtgcataaacatgtcataatagtatgctttgatagtaaaagggaagtttttgaaccaaaaggataccaagcatttcagttcttcaatataataaagcagtttaaaacatggtaatcatagtcaacatgtgtctatcagtgatattctgatatcacttggattttatccctgaatctatagattgaatttgactttagggtgaatcagttcttattaactaggtgtgttttttacatagcatatatttaaggagtgtttcttcaatgcttccattaagcagtcttttttttttttttttttttttttggagacagagtatcactcttgttgcccaggctggagttcgtggtgccatcttggctcactgcacctccgcctcccacgttcaagccattctcttgcctcagtctcctgagtagctgggattgcaggcatctgccaccacacctggctaatttttgtattttttgtaaagacggggtttcaccatgttggccaggctggtctcgaactcctgacctcaggtaatctgcccacctcagccccccaaagtgctgggattacagttgtgagccgctgcacccagccagcagtcttttaaagaaaattttgtttattaaaaatattcatttaagtaattacagtaaatttagaatcaggaagatagatgcttaaataatatcaattattgaaatattcaattataaatagataaattcagatgcatgttaaacttagtttaggttgacttgtttctcagaaaatatagagagcttgatatttctattctctgtcacatcattatgagggccattttggcaccagaatgcctgagttcagctctcaaacctatcaatttttagctgtgtctctttagacaagttatgcaacttctctgttccaaagtttctctttctacgaagtggatatagtaatgctacctccatttcttgaatagtaaagatagttaaatgagttaatacacaaaaagcacttaaatgaagcctggcatggagtgagtacccagtaagtattaggattatgagaacttacccaatataaactgaagttaatttgctcccaatttgaaaattgtgtgtaaaactgatggccattttgttcaaatgattttttacgctgtactgaaactctctattcaaatatacttctaatgtcctttcgagctcctgtgtctggtcattctttaattctagaccttgtgtatataaacagaatggcctttattatttgggccacagaccttcgtttttgatcattgcagccttccacacatgagttttcagagtcaccaagcctaacattattcgtttacctgcaaaactgagccttgctgattcttgcacaggaatctcgggaaatcaaccaaatttaagataaagaatggacttgtttcactgattcatgtttcaacatcatgggacaaacaagagacataatctatgggtgacctgcatgtctcaacacagaacagtggtgcaattgcacagtgaactctctgatcgctacaaccacctgcgtgttttattgcatattaggtgtcctaaggacactttcatgacaacaaaccagaaaaaggccataagcagttcaagtatgaacttgaaatgaggttatcagagtatgactgtaaaaggctctccccatttcagaatttaagagaggagtcatcctgaactgataatgaatgacacctctgaggaagggaaaggaggcgtatttccagggaatgctttttatgtcacagtcattttgtttgagcagaaagggatttgctgtcggtctttaaataaacagttctttgttctctgcctctgtgtgcgactcttctttctctaactctaaagcaaaaggctaggatttattaggatacaactttacgctaaatctgtggaagaataatgcatttgtattcactccatgtttgaattgcagcgaaaaggacaattatagtcagagttgacattttagtgagtgctttgtacctggtattgttagaagcacttacaggtagagtggtctactctttctggtttgctcaggacagtctcagttttaccatgtaagtcctacatcctgggaaactcttaagtagcaggcaaactaggcctcccgttacaagtattatttcatttaattatcaacccctccaattcccaatgaggtaaccttatattcttttgcaactaacagaactgaggcactaagaggttaaacaatttctgaagttttaatacttactgacatttactgcaagtgactgaatgagaactcaaacccagacattacagcttactctgtttctccctacctgggagtaactattgtaataaacacttaagttgttgaactagaccttactcactagaactctggacttgggtacttcagtcttggtggatgtaaggagagaagaaaaattatttccacatcatttgtggatgacaccaaaccataatgctaacttgtctcaaaaatgcttgtcagtggctacaaaggattgtctttccgaaccactaattaatctgtaaccaattaagtacagaattctaacaatacaacatacctataatttgcaggttgtgtagtaccttgcgtagcagctacttaagaaatagtgttatgtctagtttggggaaaaaaactcttcagcaaaaatgtgttttgtttgtgttatatcctttcttactttcaaaaaaagagcaagaaaatctactcagacaagtcacgataaaatatctgcaaatataaaaccacatttcaaatggaacttactatttattatttaccaatgtgatataaatgcccattgatgcagtttaaatctttctatcacttactgcctatgtaaacaaccaaatgttcttactatagtagtataataattctcagactttgggatttagaaaaccaataaaataacaaaataagaagaggaggtcagcatagtgttaccactttttaattctattaagcaatgttaattaaacaaaacacttactattatttactggccctcagattgactttaaatttaccatcactggcacacttctcttaaaagttcgttttaacgctaaaagagccatcattttagtgtcatggttgaaagttaaatcgtatcccaacatacttcaaaaataggagttatgttacaaaaaataatttggcccacacagttgtattacatgcacttgtttttttggtatttatatgttagtttgtgacactaaattcagtgcaacattacatgggggtcagttttccaacttgctccagagcttcctatttttaccacagtagatgtagaattccatttcacatctgcatgttgacagaaatggagcagcatatttcatgttatttcaattgagagttttctgggaaaactgagagaagcagaggaaccacagcccccaagctagtgccaagaaggaaacaaactacagcgggcctaatgtctgtctaacatggccaaggggagaatggattcttggcttaggagtggttatgcccactacatccagagtgtacaactgccagcatggagggaatgaatttgaaagacatccattgggtcagggaaaatgtgagcaaggattgaccactggtatagtggctgggaatgagtagagctgaaaagtcccttcccaggtcagccaccaaagggctccatggtctggcaagtccttttacctgcctaagtttcagttgccccaatgtttttatggccttccaaactcctttcattactcaacacaaaactgtttgatttccaattctcttaagatccctcctttatgctaatgaacagtgcacactaaagtattaatcagttttattgaattagtagatttgtcttttcaagcacaccattaagttttacctggattttagtcacagtggtttcacctaaattcaaaatcctatgttgcctctttgcacagtcctgcttggcattgatgctaattgctaaaacattgaaattaccgcaaggatattattcatcttttgtttttgaatgccttattcataggggtaacttttaaacctgatgaaaggtatgtatcctaagcctaaaccagggtggtaaatggaaaacaaacaaacaaaaaatagcagattatgaaggaataagggaagcatatacttaatgtgtcaaaaatagtgaggcagatttgaaatctgtggttagtttttcaaagcaagtactatgcccagtacccaccagcacgtaacagtctacctcaacacacagatacacacacacacacacacacacacacacaccccccacacacacacatggtgtctatatgcttgtcaacactttcatatttgggagctgtaatttcctcaaaggtaggcacggtattgtcttcatcgactcccccacatttagttcaatgcttaccacataccaagtgcccactaacactttgtgtcaacaaatgttaactgttggaattaatttccagatcctgcgaatgtttctgacatcttatactcttatcaatttcactcctaggacagagggaaagaaatgcattccacagaaccaacactttacagaaaactcaatttgtgttagtacatgtttgtatattaaaattataggatgaaacttttttataacctcaaaatgctgaaccaaatagttgaaagggtgtaggtgatggtgaagatgaagaagccaaagattattatgggacattgtcttaggtacttgcaagaattagtgctaactcccccctttctaggctttttaaaataaagatagtaaaggtaaaatttggggacatcaggaaatggtccacagaaaaaagaccactcaaccagcatcttagtgtctccctaatatataattaagcaaaattcaatattacctacaatatcctcagctttcccttctacttatgaggattttgtggtttttgtttttttcagatatttaagtagatcaggatcctttactttttgagagggcaggcatggcaggttttgcacaaaaccactggggaaggaaggatgctgtcactttttttcatcttggatcagaactgattggcagtgtgcttattcatttatgcctacagtgcttcatttgagatgggctaatggacaggtacctggatattctttgctagccagcttagatagtaaatatgcaactgtttttcaagaaagtttccaagcataccacgttcatgttgttgcagcatatcctgtgtgaatcgtgtgaacaaatcatggtgtaacccaccttaaattcaataacacaatttgctaatcccctttgtttcccctgaaaagaggaggaaaaatcaaagttgcatagtgagtgttatgagggatattttgcatgaacaaacacaaattaggccatggactttcagagcagttgttttctggatctagatgtgtccattatgcttgaaggatgtcaagttatacatttaggcatgacgtcagataacagggattttcctgtgtaagaagctcgtagtctctggctgtgatatgtacaatatatggctccctctcaataggaaatgtccctcccagttgattctcagcttatttaactctctgttgtacctcctattttcaacaatcctcagggtgtgtggacgagttttaaacagagcatagatatacagtcttgccatctggatcaatggaagcaaaaatgagaaaacccatggcttattacctgcctcctttttttggaggctttgacctggttctatttaagagcattctcatatattttactctgtgatctagaatcaacaaatttctgcaaaatctataccaaaagcaaggtttcttgaaataattgggaaaaaaagagagatttaggatttcaaatgtcaataattacattattctgacacctagaatgcccgtaagccaacttcaagtgttgtttggtatattttgcgaaaagaattgaaaccagtccaggaaagctggagataagaaagagtttcagctgttgagccacaggaatcagttattattaatgtcccatcaaattatttgacatttatttgcttgattttatgtaggggacctaggttatagtttatgaaaacaggtaaaaacttgcaataaaatggaaagaaacatacattgtcactatccttcctgagtagctcaaaccaggaattttataataaacagaataagttaaggtaaagctgggtcctcaacaagggttctaagaggtcactaaaattgcatgcaaaattttgaaagtatgcttgaatatacatttttcagggtcaagtttacatagcctgaaaatgttttaaaaattggtgtaaattttaatgcattctggacgtatagaacctaatacttgtaatcttgctattaatatgttgatacattggagaaaatctacatattcacagagtttacactgaaagctctttgaatccccgctgcttcccttgcttgctaagacagaagcctcagggacaagggcagctgcttccaggatgtgaaatttagctaatctcaaatgtttgactttgaactcatttggaagatatgttttagtatgtagcatttgcttttcagccattttctctggaatgcttttactccacttaggtaaagaaaactgggacttagggcttccacaggaagtagataccactggattggattttagacaaggaagtgttctgtgtctctggtttggcacagcctggtgaaaattgttgaactgcagcatttcagacctggtgccagcctaatggctacatgccaagattactatttggcgacaagcagccagacaagcagctggttattgcagcgaatccgagcagtgtgcctgaggccatgtctctgttgccagatcccccaacccagttagtaaccaaacccttgaggctttctctgggtttgttctcttccagcctcatggtgggctttggcctggcaagggtcgtctccagcaggttgtcctgcatgcgtcctgagctgtggtgtctggctggaattaggatgcttatagaccacgtaaagttaagagatttcttggcagctgtggctgacactgtgggggcactggccagagcatgcttgcactagaggctggctggaagagggcagaatcaatatgagctgctggcattccacgctagccaggggtgatgaagtgacagcctgctggcatctccctttggccctgctggcatctattttgcactgttctttgtgaaaagtgctaagactgagggacctggtgagcaaacttgtcagaggaaatgaactggaggaggtgagggaagagaaactggcccacaagatagagccacaaccagtgactgtaatgatagtagcaataggtgatcacagtcttaagtaaattttctctgtatttccaaagtggaaaaaaaatttcttccctaggcatttcaactccctttttctgccagaacttctggaccttgagaatagtttgatgttaagcttttggaagggagaaagtatagctttccaggaggccccagctccctgtaggtattcccctcctgggatctggcaccatctgtaagtttgctgcagctgctgatgaatttaaactgagttagcaggagttgggcacagcatatttagaaagcactcatccctcttcttttgttggggtgggagtgaggagaagggactctggcaagattagtttccctctgttcactcacagacaccgtaatactgtttgcagcactgtgtcctccatgttgattcctgggtaattctcaacatctttgaaaggatctggtaatttctcccagggaaagttgaagtatactacaatggtggatctattaaaaatattggcatggaagaacaagagctctattgtctctaatccgcgtcaccacccaggacaagcaccaacaggacgctttctatgaatcgtgtcttttattccacatatgtaatcactttctggaactaagtttatgactagaatatccagcacttaacataaatgaagtaagtagaatgagagtatagtttcaatggtattctgccatggtaaaaattttctgttgccttttctttgattcgatacagtgataactcttttacttatttgaacatttatccaagaaaccttaatgttgtagcccaacatataaaacaaccctcagggctatctaggtcacagacaaagcagagtcacatacatagtttcaggaaaaattctattagtagtttaatgaatacttcatttccaaataattttataatattagatctgagtgttttttaaaatgtagctatgcatttcaacgtcaaaatagcacattggtatttggcatttttgttcatgaagtcatagttgaataatttgtgtttgagcctctatttactccatctccctccctatctatctgttgaacactcactcatacctaagaaactcacatgcatttcataatgcactctacattttgtctccaatttttgcaggatcgttcgccacaacatacatgtatgttcccgtttcactttgcctatatctcgatcatcacagttttcaccctgtgttctagttctttaatacattttcatctcttctgttagcctgaggattctgaaagcaggaattgtcttatcctttattgtatacattatgattttagggaaattaaattgtatagtaaataaaaattaacaccatttacagcaagtacatttaaagtttgaaatacagaggtagagtcgattcttgttattcacagaatgtttttctatgaagtcaccgcaaacactggattatcaaatattgaaccagagctcctgtggaaagtgtagggtaagattcccacaagcctctgatcacaactttctcatcaaccagttaatgtgtaactgttttgcatgtttctgtttaaagacacctacttaatagatattgttaattcattgacatttgtcaatcaaatcaaaattaagtttataatttacaaactcaaggccaaagcactgtaactgatacctgaacaaagcttatctaatacacatactttctcaggaaggtgcatcctagcttcctggcacttaggaacacactagagagcactttaccactacacgtggggaccattttaaacagcaaaatcacacacacgcacaaaaaaaaaaaaatcacaaaaatgtgaaaaacatggcagtaaatagatcccaaaaaggatacttgtttacgataagagagctgaaacaagaaggcagaccatcaccttgttctatctcagataagaatgtgcatatcaggctgtcaaatttttcaccacactgtacatgtcgtcaagtgacctcaaaactgctgtgagtactgatttggggattacaaataaatgttagcaagtaggcaaatttgcaaatacagaatcagtgaataatgaggatcaactctattatgtatcgctaatatttaatatgatagtcaccattttatttaatccaaattaagtgtgtcatggaaataggcttagtttctgtggagtattttataaatagtaattaaaaaattttatttgaagtagagtttactttaaaattatgtgatatccaaagtatcctttatttatcttgagtgtttaattcagaagagtgagaaaattttaaaacatgtgttttccactctccctgtaatttgctctaatacagaagttaataccatattatactaaaaataaagtatagaatgcataaaggcacatcacgagcacaaatatctgcacaatggattcacagcagcagcgatgagcttggctcagaatagaatatggatacgcatcttagtgatgataattcactccggagaacaatcctctgcaatttatccaatccactgtgtgccactggatatattatgtacaactttttattcatactatgtgggattatgaacaatatcaggattcattaagatgcctaggaaagtaaagaccattttcacagtaatagtattttttataataggaaaaaatggatattgtatttctaagatattattcaaaaatatttgcctacatgagtacttgtgggaactaaaaaaattaaactctcatctttaagtaagtgtgttcaatgtaaaaatcaagtgtttgcatgtgagggtgatataagaaatacatggtagggcataagtcctgacaatacacaggtgaagaaaggcatagcataggaattttaaaagtatataactaacttttacacaaggaggctggacataaagtactgtgataaagattgaatcagaatgagaagatatggataggatcttttgaaatggttcttgtaggacaggttgtattatgatggttatggtgagccacaggaaaaaagcacacccatgggacagcacagccatgctcagagtcacacttcatcccaggtagaatagtgtatgtgagcctgtggcatgagttgacacagtcaggtttgactcactcaaatcagtaatctggcagacatcttctacacctcccttcttctccacctccatagtcaaccagttgccacgtcctaacatgtctatcttctagatgtctctcgagtttgttcatccctttctcctcatccttcctttgactacctccacctaggtctctgcagtctcttactccaaaagcctcttgactattctccttgtctctaataaaggcccatcaatctgttcttcacactgcagttagaaccaacttctcatgttgtcaaccatataattttaccggtaagcccagaaccctttaaagattctcacatggcctgaagcagtggctcacacctgtaatcccagcactttgggaggccgaggcaggtggatggcttgatgtcaggagttcgagactagcctggtcaacatagtgaaaccttgtctctactaaatatacaaaaatcagctgggcgtagtggtgcatgcttgtagtccctgctactcaggaagctgaggcatgagaatcatttgaacccaggaggcgaaggttgcagtgagctgagatcttgcccctgcactccaccctgggtgacagagtgagatcagtaacaacaaaaaagattcttacagttcttgcatgttataaagacaattaaatacaggttgcttccccatttccttctccaaccttagctcttaccatttctcaatttgcactttttttttttttttttgacattaagccctcacctcaaataactatgattgccaggttgtcttttgcctacaggcttttataactgctgtttcctttgcttagagctttttatcttccccaccactctcctatctaagtaacttccacttacctgttcagatattaatctacatgccaattcctttaagaagctcttcctgactcagaaatttgatcagatagccttctgaatctttcacatagcaccttgtccttagtccctatagaattaattcacagttcattatgattatatatttaaattattgactcccttccaaccagactgtaagtttcttgcagatgaagagtatgtcttatttattactgagtactttccagtataaattgaaataacacagtgactggcaaatgggctagtgaagatttctgatggaaagagagtgctacacatagatatatagccagagatgcacagtatttatctgtatattatatgttaatactcagatggttcgtaatgactcatggtttattctttaaattagatagtaattataatcatctctgggtatccagagggaattggttctaagatcacccccttggataacaaaattttaagatactccagtcccttatataaaattgcacagtattggcatataacctaaacacatcctcctgtatgctttaaataatctctagattacttgtaatacctaataagatgtaaatgctattcaacagttgttatgctgggtttttaaaacttcaagttattgttgtattgttattttttattgttttgggtttattccaaatattttcaatctatggttgattaaatacagggatgggatacagagggccaactgtacagaaaaaagacctattataaatcttgataggactaatggaagagcatttaaattgtttttctcaacatatacattgaatttgcaagttacttatgcctttgttgagtggtcagatgtaagcaggatgaatattaccaccacactgtcagctaagcatattatcttacactacttcttacaaacatttagtgttatatcttcttttattcaatttatctaatatttttctctacaattaatgcattttcctattacatcatgatgtgagagaaactggatagagaaatcaaatgaaacagcaatcaggagatcttgttcttactctcttaccttgggaaggttaatctgactgtctgctgaagaagctgctgggatgagtgtatcagaacttgcaagtcatttgttcctctggacaactgtgttattaccaccctattatgtgcaaggcactttccaagattcattgataaacatacatcatattttcttaattatcattaagaagtgattgataagttttcttcgtttgaaatttcactccctcccctgtggttttacagtttaatagcatacgatttcatgataaactattagaggtaagggttctcttcatcagtagtctcatcatgtagagcttgactagcatttaagaacttgatttctgttctctttttgtccctttgtcagctgaataatttcataagcatataacaatcatctaaaatataaagaatggcattatttattatccacctgtttaacattccataaggacaaattatactcttcttaaactgtcttctgcttcctaggtatgggtatttatcatcatgagaaatattcattcattcagtctttcactcatttagaaaacttgctaatcatcagctcgtttaagcctctgtcataggtgctgaaacaaaaagtgattagagtaaaggcccagcccatgaggaccctagaggtgagtgggggaaccaagggaaggacataatcacaagagtgtgctaactgcaaaatgcatgatttcgaacttaaaacaattttgccttagatgcacttctgtaatataggccctttgggtaagtacagtagagaatttagagccgcaatttgctaacatgaagcaagaacttagaactgagggaaccatagaatcctagagttagagtgtgcattgaaacatccagttcaaacaatttgctaaagcttgagtttactcaagtgccaaatggtccactagcttggcttgaatacttctaataagacacactccccacctcctttcatgtgggtcttgatcaactcttgttgtttatgaattattttcttgtaatgaatcaaaatacatcttgccacacagaacaaagttaattcttcttcagcataacagccttgcaaatataacaaggtaattgttagtgactttgagccctttctccaggctaaataaaatcgatacaccattggtagaaatatgttcaccatcccaaagtcttttctgaatatacacaatagtacagagtttttcaaagtgccagttgcaatcagtgggtagtgatttcagtgcagtggatgagatttagaactgaataaaataaaatacaaaatgtttgtgtgttttccacatagtaagcatagatattgtttcatgaaatattaatttgtttcagatatgtgttcatggtggtgtttctgtgtaaactgactcccaaagtaaaatgtattttttaatgtgggtcacaagagataatataaagtaaaataaaatgccactgatgtatctggggtgaggtctatgaattgcatttttaataagcccccaagttctgatgatgatgatctatagagtccactctgagcactgttgcactaagtgacaacatgaagagcttacataagagctgagctgagtaaggacaaaggtgtcaacctacataacaaattttattaatgcttagtaagtgtattagtaatgcttaatttcttttgtatttttaagtgaaactaaatacttgtagaaattgtaataatgtgcttcgcagccctctttggagacaatggagatgtgggaacagtgctagagagggaggctgggttagagatacaaacactaggactctcagagaacagtgtctgattctcaggagttattaatttaggtttgctgacctcagagagagtatgacccatcttagttttctaatatatcttccctaaactgcccttaattcatctggcggacaatgtatactgaatggtttgctttgttttatgatctcaccattggtttcatctaactgctccagtccaaagttgattttccttaacagaaaatgtcaatgcaaaatagttcacaaattttactcactatttgtcattttccaacttgattttctcatttccttgttaatgatttaccataacatttcattttctcctcttcttcctttcttgtgcgcttcattttatcttagaatcatccaagggctgcttttgggaacaccttcagtgtgcaatatgcttacagttttgagggatttccccagcttctaaagttggctttcctttcaaagatgtatgcttggccttatgcctatgcttctttcctcactgttttctcttctccattcctgaaattcagaaccttgctcacccttacctttgcaagtcttcacaactctctatgccatagttcctctctccaggactcttctgttgttcagacaacaaaaacaaagtgccaattttggtttcacacaattccaaaaactgtttacaaactgttaacaattgcagaaagaagctttgatacacacaaattgaaatggcctgcatcttggtaatattacaacaccgtataggactgagctcttgaaatgtgtccaagagtaggaagtggtttttcgtttgtgagatatttgtgaacttttaatattttggagtatagcaagaggaagtctaaacttatgagtttatacctgccacttatgagcttgtaaattttgggtaagatacttaattttctgagtctctacttctttctctctctctttttttttgaaacggagtctcactctgtcacctaggctggactgcagtggtgcgatctcggctcactgcaagctcctcctcccaggttcatgccattctcctgcctcagcctcccaagtagctgggactacaggcacccgccaccatgcccggctaatttttttttttttttttttttttttttttgtatttttagtacagatgaggtttcaccgtgttagccaggatggtctcgatctcctgacctcatgatccgcccgtctcagcttcccaaagtgctggattacaggcgtgagccaccgcgcccggctctacttctttctctttaaaatggggtgataatacatgatgagattgagtggtttaaatacatgataaaatgtgaagaattatactcatggaaggttctgtgctaattaccaatgttcgattcctgaattacaggttcatttgttaagttaaatctaatttctctacagaccctttgtcaatgtcgttatcatcaacttcaggctgcatgcccccttttaggagaggctgtcttcagtctgtgctatgtattgatttaatcttgctgtgaattccaaatatttaatgataaatcactggctgctttcttgcatgtacattatcatatgttgcctcctaattcaatgatgtatcatattctcatttacttctgttgtccatgtatttattaagtattctgagcagtctaggctaaattgttggcagttgcctggctgtggacttggagctgatccttctcagttttcttgactgtttcttaaatatcagttctgggataatgctacccactctctctgtgtttcccagtgttactcagaccttagaatggatataatacttactttacccctgtttctcttttttaatttaacaataacaataaagctatatttgatgtatgacaaatgtatattcatagattgctaccacagctgagttgttgagaatgataactctataacccagagggatggagtttgtaaattagagctctttaattattggttttgacttaagagacaaatgacacaatgacttaagaaaatgaagtggcaattataaattaaacctatctttcagatagcttcagttttttagagatgatcttcagtcattcaacaagttggtattaaatgtatatgactagtgttttgttaagtgttaaaaacatagagggaaactatagatataatgctattgttaggaatttttaaatctcatgaagggaaaggcacatgaactactaaaatctgtggaagaaaagtacacagtatattttaaagagatctgatttaagctggagaggagggggacctcatggtcaggcttccatgacaaggtgatatttagacaatatgtgtctccagagcttctattcagcacaatcacatatttgttaacatttaacctatttttaggtaaatttgagggcattgttggtgctcagatgaacaaccaatgagtacttgtacctatatcaatgtagctttagattagcaaataaaaaaattgcaattttgcatttcacagccctaccctaatgggaaataccattcaaacatttggtttaactatgtatgaatctagcttttgagaaggttgaggtaaatatgttgaaatccagagctacatgtgtggtttttgaatcattcttcagagacaaggtatgttccttcccaggcatagaatctcgccattgctccctttccagccaatcccagttctgtcagcaacgattactcatggtccttcggttacaaaaaatacagggccacttgtcaagatatcagaatactaggattatgtatttctggttagttgaaaaaaaaaaaaaaaaagcagtatggaagcagaaatgccttaaagagagagggctctatagcactactctgggtcctggcagctggaacccttagcattagtccaaggtaacatcagtggagtggacatcctcattacttaaaaatacactacagtcgacactccctgtttcttccttctttaccccctaacctaaccccacactacatactacattaaactatcttgtggaaataggtaaacacaataagaaaatagagtgttatcctgttgccttttctattcctggataactagatgctgccctgccttccattgtacatatgaagatacaattcagaattgacagccacctaagcctgtcaaatacattgtttagtgaaacgtggaccaatgaaaaattttctacacaatgcataattgaggtctttgagaccttcaagatctttagtgatcttgttttttctcgggcacctgcaacccttaacttgtgtacaaattgaccacaatttaatgaaaaatcagcctgaccactacccagggctctaggggtttctaaaatataaagaaatataagaagattagaaaaaccatgcgtaagtctgtggttgcagccagtaagactgggaggtaggaggcaaggcccttcatggtcttgagaaatgataggtggttggtttgtaaaccaccttctaaggaagctgaatagccgactgcagggtgtttagtttggttcaagattgtcaaaagagccatttgcttaatacagcagaggatagactgaggctcactctccttcttttttccctagtacctcaagcctttcctttaaaatatcaaatttgagtttgaagggaaccagattattagttgactagggctttcaaatgcattgttaaaccatagttactcacaagtaaactagaaataatctaaagccaggactttgtcttgaaatcttttttaaaaaatttctgtggcatttggtataccttataggtatcaaagaaatatttggcagaggattgaactctctatgactgtcaggggatacaggtgattgatgaacatcacaggttgaatgttattcatcattcaggaaaaaaatacactgagatcaagcgctactttctctgggaggcctttcagacttgtcctcctctgttcacccccaccttattcctagcttccagcatagatgtatccatgactgcctttgttccctcgtgatgtcttatctcatgtatttcaatcatggccactctgtatcaataacagaatattggactgatttattttcatgtctgtgaacctgaattcacctataagcattttagggacagaactcacatctgattcatctcagtattacaaggacaatgattggaacagagaaggtaccagatatgtagtttaaaatacgtaaatgaagagtaaataataaacatgataacaataaagacattaatttatctagtgcaatctcatttctctgaaggaatgtacagtatccacaatgaacgatgatgataacacaagggcctttgaagatagaaagtggaaaatgtgaatctggatgctttttaatttttttcctgtgttctaaaaagccacagaagaagtcatgtgaataaaagacataaatgttagtgaatggatttatcatttttaactgtgccagcttcttggtgtaatgcttgagcattagtagttaggcaatacattttaatgagtgtttctaacttacaagtgcatatttagaggtgagaacactgtagcacttaaataattaataataaatagttaatatgttcctccagagtaatatgttcctccttctattatctctggcctattggacggtcttcatttatcttttaaagaaggctttagggtttgggacccaaacagatgggaatgtgcccttatttttttttttttttctgtaaatctagtgagcccctgagctgaggggtctttcagaacgcgtactttgtatttgtaggctctggtatctatatactgaaaaatactttcagttgcaatactttatgtaatgtcctaaaaaatgtgttttcaaagacagaaatcactgctatttagatggtttatttttctagagcaaatagttcatagtattgactttctaaagctatgtttctgtaagtgttcttttagtcatgcaaattctaaagtcatttgaaggggatcttacagatgtgctttgttattttattttcttaaattccatcctaaattgggtctgagcatattatggtggaatggactaggagtgaaagattggtcgttctggtttgccctgggccatccaaacagctgtgtaagcagcaggtcctggaaatactgggctcacgatttttggatatgattcagtgatcagcatgactccactgcaggacctcactcactgcttgtagctgtttctctgtggtcattctggaagtcaaaattcaatatgaatgccttgtgagaaatgcttttaatgaactataaaaatcagcagtctgaagagaaggtcatttctgatacagtgattatagtcatttctgcacaccaatgccaattaaagactatagatatgtaacaagcaggagacacacactattgcaacggcagctgaattatgacaactgacaaagcacatacctggaagttggtgatttcgctatgaaaagcagggttcagcctcctgtgtttcacactcgtctttcaagtgccctcacagtgaactctccaaaatgctttaattttaaaaaatcattttgaattcatggacctagtgattgtttatatatttttttagctccttcagaagattaaatatttaagatttttttttagatcatggattcgtgcagcttttgaattcttttgaaataaaattgctcttaatgagacatctgaaaacatgaacaaacactgaagaaacagagttctccagaataatgatgctattgttaagtgattgaatagttgggagattaatatcatggtgtactggcatgttggttaattctagccataatttaactgtaaaacctacttaaggaagcaggaggctgaacggcatgtcaaacacaaggcacccacacatagagctcaacacaataacaaattaagcactgtttatgtacagacatagttggccttatgttttttttcttaatctgtgatttaggtaataattgcactataattttaactctctatgcagtttgaatgtctgcttaattgttttattaccattgtattcagtgatactaattgatggtgccagtgaaatttagctgtgtgtccctaagtctttatgcacataagactggcattgatttagtcttgatagcatatatcctgtttctgctagattactctaaaattgtttgaccaaaggctatggggaaattttggcccaagtgaaaatgtataatttaatttgtgaagagttttcatatactctaagcttggcttttcttttccttgaacattttgccaaattccctaaatgagaccaaagtgccttttgcttaaattttggcataccatgaaatgtctttctgtattagctatagattatgtgaacctgttgctgtacaaaatcatgcaaaagggaaagaaaacaagagtctcatgtaaagttcaaatgtaccatttagctacttcagttttagtaattgcagggttttactaacctgaaaagttatcttgactcttaacacaaaattaatttctccttgtacctaagttcaacaaaaatgcatggaatttcatgagtttgcgtttatgtgcttacatacatatgtgtgtcatgaagctgtgtttcagacagtgataataaaatatccttagtgatctaattaaaatgcagattctggttcagtatgtttgggatggtgctttataacctgcatttttaagaagctcaaggtgatgccaaagctgttgttccacagaccacactttgaataccaaatgtgaatttggtaaaatgttcaaggaaaagaaaagccaagcttagagtatatgaaaactcttcacaaattaaattatacattttcacttgggccaaaatttccccatagcctttggtcaaacaattttagagtaatctagtagaaataggatatgtgctatcaagactaaatcaatgccagtcttatgtgcataaagacttaggcacacagagctaaatttcactggcaccatgtattagtatcagtgaatacaatggaaatacaaagctaaatttccataatttggaaatattagctttccaaaaatatgtaaaaatatgatactattcacttgaataagtgagaatctattaagaacttttttcttggtagaggactaaataatgctttacctctttgcctgttggctacagtttaatctttcaaggaatgctattgacactttcagcaacttggtttctccccattactgtggtctcatctatataaatgtatatatgtgacaatgaaaatggcttcaggaccatgaaaaattccataaatttggttgcttttatacattttatggtttttaagtgaacttaggagtctaccggcactctacatgctgaaattgttgatgtgcttgaaacattccattcatcaaaaagaaacagtggaccagaagatctctatgtcctctggcttctgtggtggcagattccccagaaggcttgcggtttgatgggacttaagcttgtttagataactgcacacaatacccatatgtacctccagaaaggctcagctttaaatgcagccattacacttagaaaaacatcatgtggcattaacctaatctggaataagttaagtagcttaccctaagtacgtggtagaataccgtaactttgtaggactgggctttggggctttccagtacagaaagccttataatatgtaatctttgagaaataacttaagatggacacttaattgtatcttctaattttgtctctgtattaacaccgaaaacatggttttatttgtactgttaaatatttattgcttggattatttcatactctcctaactagtttatttcacataaaattggcttcctttttcttttttctttttgttttttttactgatgtttgcttgacagtctcatgaatttggttttctaagctagaaaaatcttcttcagacctaatgtaaataagctacctgaaattaacaaaaatcttatggagacagaaccatctaaagaaaaagtgtttgaaaatgaggatgctctctagataaagtcattttctagttgctatttttgtgtgtatattataaccaaacacacacacaaactcaagatgttcctccaaaagcatggtgaattatagagaaatggtgggacataatattacaaacatttgttctttctaaaaatcagaccacatattggaactagtttatgactcaataaggttacagttcagcattctcgtaaatagcagggaggcctatcttgaaatgcctaatttagatttgtccatcaagtttcattaatgcattatttattattctgtaaagcctagaaatcttacaaatagtgataacattttaactcatagtatgggaaatattaaagaattctgcatcattaaacattggtaaggctgtggagaaactattattctgttggtaagacaactactttgggaaatgtgttctgcatgcttcaatgatcccactcctgagcagataccctagtaaaacttctgcacatttttaccagtagatagatatgagaatgttaataacagcaatgtttataaggacaaaaataaagggaaggtgtttggataaacctaagtgaaaacagatgggagataggataaataagttgtgaattatttgtttaatgggactctataaaccattgaaaataacagaattgcagtctcttacaccatcatgattgaattcatgattaaaaatgttaagtaaaaaaaaagttgtagtaaaatatgtaagctatggctcatttaaatagacaactaacatgggaaaaactaaaccatatatatatatatacatacgtataagaaaacaataagaaagacaagggatattttgttgcagagggatattttattacagaacacagggaagcagataaaatgtctgtggggaaaagtggaagaaatgaggttggacagaggcaagcaagaaagttcacaactaagccatgtattctttaaattctgtcatgtgttaatttttaattttttacatcttttatatatttataaaaagcctttcacatatttaatactcatgtatatataaatatatacatacatatttaaataatttatatgaaattatataatatataacctatattatataaaattatataatatgtaattcaatgattaaaatatataaaagaataatatactgattatatttaatttaaacttcaataattaaatatactgaaatataataaattataacacaaataaacaaggtagtatttgtatataaataaactaaaatttaaagatatccatgactaaccccaacttttaccttttgcctgtaatgatgcggaaaatgcatgttttaagttttttgaatgtctgttttaaaattgcaatttgacagtaaatactttaaaatacccagcaattatctaacatgcaattgaaattctatagtttcaaagatcaaaagaagtcttcagaagtcaaagactcaaaagaagtcttcagaagacatgtcacttcttacatgtagtgaatgaattctttcattgtatcaacaactttaaatagctatatcagttattctctaacaagattaaatctagttgcttattgactccactgtagtgtttgtaggaagaagtctttctataagcacacatacatacaaacaccacagatttccatgctttctgatttttttttctagaaacatgtaatttacagaaggaggcaatataggctagctcaaaagatacttatggcaatactaattataaaataaccagtagacatgtacattggtaaaaatcagctgctgatacttgcattagtttgaagtttattggaatgcttatataccctggaatgaagatatacttgaaataaaaatgacagtaaaaatgaattaaatgaattgtcacttatatattcctgacattttttggtatttagtaacttatcacaatcaatcaataaacaaacacacaaataaatttaataactaataactactgattccctcataagtgtgtaaattataaaccacccagtgaatggcattagttactgcttacttaatgcctgcttgtttgtgtgtgtaacttgccctgataaaattttctaacagtactaatagatatttatattaaatacattgcttttggcactggtcaaacttaaaagtcacgtggacaggtatggaaagtgttaacgccagatacaaaataatttatgtaataagattaccactgtgtgaaacacacaaacaaaaaaatatatagaaaagaaaacaacatagcatatctgtgtgtgaaggagttataactaatttacatgtttctgtttttctgcattttccaactctgagtttatgggatatgttccctctatattggcaaaaataatcaacttatgtcagtactcaggtaagaagtaagctgaagacagttaagagaatttcatttttatgggcatgcaatgtagcttttcattcatttaatgttaaggaaagtagaagcaattatgttcctgtggcatgtgaaaagtacacacgacataaatatatcaacttttactttggcttccccacgattaaagttaagacaagcgaacaagaggccacctcttgagcagaatatatttcattttgttgttaggtgaattccatcatgtaatgcacatctgtaaccacaacctataatccaattgggaaaaatcgtgtagccttgaagggaacctacctggtaatagaatcaggcttatttataagaaataaatatgggcatacagcttatatactatgcatctcaaaactactatttttattgctgtaatgaattttatatcatgaggacttagtttttttttttttttttttggtaattactgtcctttgatatggctttcatattgtgtcttcttagacacaataaaatccaatatgttatctgataatttattctcatctctaatgtgtacttctgtttgcatattttttctttattcagcttgtgtcagatggttctaaatttaaaaagattttaggaactttaaacataacagttaaatttcctgggagaatgatgaatagaaagcatttcatacttctccatgtctatgtatctcatcctcactagaaaacattgttagcttctgccatcaatgctactactttccacacatttttattgaaaagtaacaagtagatagaaaattgtactaatcgtcagtgtatagtttgtattttcacaaactgaacacatccaagtaaccaccagccaaatcatgaaacagaacatgcccagcataggaaaaaccctttatgcctcttctaattttttttttttttttttgaaatggggtctcgctctgtcgaccaggctgctggagtgcaatggcgtgatcttggctcactgcaacctccacttccccggttcaagcgattcccgcctcagcttcctcagtagctaggattacaggcgcccgccatcacgcccagctaatttttgtatttttagtagagatggcattttaccatgttgatcagactggtcttgaactcctgacttcaagtgatctgcccaccttggcctcccacagtgctagtgtgtccggaattggtgggttcttggtctcactgacttcgaatgaagccgtggaccctcgctgtgagtgttacaactcttaaggcggcgcgtaccttctgatgttcggatgtgttcggagtttcttccttttggtgggttcgtggtctcactggctcaggagtgaagctgcagacctttgtggtgagtgttacagctcttaaggcggcgcgtctggagttgttcgttcctcccagtgggttcgtggtctcgctggcttcaggagtgaagctgcagaccttcgcggtgagtgttacagctcataaaggcagtgtggacccaaagagtgagcagcagcaagatttattgcaaagagcgaaagaacaaagctttcaaagtctggaaggggtcccaagcggttgccatggctggctgggacagtctgcttttattctcttatctggccccacccacatcctgctgattggtagagccgagtggtctgttttgacagggcgctgattggtgtgtttacaatccctgagctagacacaaaggttctccacgtccccatcagagtagctagatacagagtgtagattggtgcattcacaaaccttgagctaggcacagggtgctgattggtgtgtttacaaaccttgagctagatagagagtgccgattggtgtatttacaatcccttagctagacataaagtttctccaagtccccaccagagtagctagatacagagtgtcgattggtgcattcacaaaccctgagctagacacagggtgctgattggtgtgtttacaaaccttgagctagagacagagtgctgattggtgtatttacaatcccttagctagacataaaggttctccaagtccccaccagagtagctagatacagagtatcgattggtgcattcacaaacccttagctagacataaaggttctccaagttcccactagactcaggagcccagctggcttcacccagtggatcccgcacggaggccgcaggtggagctgcctgccagtcccgcgccgtgcgcctgcactcctcagcccttgggtggttgatgggactgggcgccgtggaaccaggggtggcgctcgttggggaggctcgggtgcacaggagcccacggaggaggggaggctcaggcatggcgggctgcaggtcccgagccctgcccctcggggaggcagctaaggcacggtgagaaatcgagtgcagcgccagtgggccggcactgctgggggacccagtacaccctccgcagctgctggcccaggtactaagccgctcattgcccggggccggcagggccggccagcccctccaagtgtggggcccaccaagcccacgcccacctggaagtccagctgtcccgcaagcgccgcgcgcagccccggttcccgctcgcgcctctccctccatacctctctgcaagctgagggagccagctctggccttggccagaccagaaaggggctcccacagtgcagtggtgggctgaagagctcctcaagcgccaccaaagtgggagtccaggcagaggagaggccgagagcgagcaagggctgcgagggctgccagcacgctgtcacctctcactaggattacaggcatgaactaccgcgcccagcgcctcttctaatttttcatctctgccaaggataaccacgatcctgacttctaatacattagtttacataaatgcaattgtagaccatacacttttgtttatctggtgtcttttgctccgcattgtttgaggattcacccacaattgttgcttgtagctccagtttgttattctcatagtggtatggtattccattgtttgaataaacctaatatatttatctgttctattattaataagcatttgggtagtttccagttttaggctgctgatgaatattcttatatttgtaaacagtttatgtttagtacaagggattactacaagaaaaaagaaacacagcttccctaataattttatctgatgtggatgtagcagaaaaaagattcaagtttaacttttcttttaagttgattgtttacataggattaacatcctcatttttgcctattttacaacttatgttgaacacctattttgtgctgtgttttgtgtgatgactgggtgacacagacaaggaaggcacaatttatgttttcaagtaactctcagaaataagtatgcgcttaccatatagtagggacagtgctacgaagaggcgtactggtctagaagaagcttttaattcagctaaaagaaagatggtgagtgaaatatttatagaggagaccattaaactaaaattagacaaagcaagttgtgagtagagaggcaggaggaaaggaagaaaattcttggctgttggaattgcaacatagcagggaacattttagatacttcccatgattgaatttggttgtatttaagggttcacactggggagtgatggaaatataaagaatagaaagagaatctgagcttagtggggaaaaactgatatagtataaataagatatataaagcattgtgaagggctaaagaattattaaaacacaagaagcttcttgcataattcactgagataatattgcaacccagctgagcaaagtgatacatatggtaatgaaaggtttattaaggtttattatggtataaatagtgtctgtaacggatgcttaaggcataattaaataccaaaattaagaggaataattagtcaagtacaatgcatttgtcagtaagtgattggctttaataagtttcttttcttttcttttttttttttttggagacagagtcttgctctgtcacccaggctggagtgcaatggcgtgatcttgtctcactgcaacctccacctcccagattcaagcaattctcctgcttcagcctctggagtagctgggactacaggtgcacaccaccaagcccagctaattttttgtagttttcgtagggatggggttttactgtgttgctcaggctggtcacgaacccttgagctcaggcaatccgtccagctcagcctcccaaagtgctgggattacaggcgtgaatcactgcgcccagccaatttctccttttcttatttacaccacaattaagagtggttggtcttatctttcctccaggaacattaccaaatcatgaaacatttaccgtatatctactagacataaatatcctttgcatcataaacgtataaagcacggggtatctcctaaaggattatgggatgtgataggtgcctaagtacaaagattcatagtcatagatatttcaagaaagtatgaaagcagtgctttggattgtgagagtacagaaatcaggtcatattgagagcattatgtggggccatgtgttggaagttagataaatatatttaagcttattaaaaaaaagagttgatctggtaaaaagatctataagacaacattacatccttcctggcatgcagagagtggctgaatttttcttgcatttttccttcagcccatgaccctcctaaatggcacaaacaaaaaggcatcctaggtgtgttctttgtcatgtaaaacatcccccactgactccctgtggaatgaaaggcatgcactcaggggagtgtgcacacctgcagtaatgagaaggattaaggcaaacaagtgaaccagaagtcactgatacttcacttgagacagcactacacaaacttcacagtctactctgtttcttgattatgctttatggaatctaattataacataagcctgaaatttctgaccaataggcaattaaaagattgtgcatgaccccatgaactattgtttttgagtatctactataagcctattattgagctagaagactttacatactcttttaggtcttctcacctacctcaccaccagtaaggtagttatatacattttacatagaatttttaaagttctctggattatacagaatctataaagccaataattttcacataggtagttgaactacaccatcgatttatgcgattatgaattatttagctaaagactggacaatgggctccctagtatagttccacaaggattgatcttttggagtgacaaataacagctttacctagcatgcatctcaaaatttaatacaaggagattaacgtattgacaaaatagctgtggtctctttcacttgggtacttcgtcttatacatttttagaaataagaaaaacagagttattttgaattaaagctggccttgattttatcttttctgctttttctatgtatgtaatttttaaaaaaaaataaaaatcaccttcatggaactagttatttctgcattatatggctttgtgtattttgccttttgtgggttctgaatctttaaatgaagcatgcattcttgtattacttaatcacagaaatgcaatttgagtgttacgaagctcagaaagattctacagacatctcaaaactgtcattcttttacagacaaacctccctgagaaatacatcattgagttatttgtattaggtacttattcatagtaatactcaaaactgcgtatctattaaaaagcttacagcagctgctacagtacacggaatttctcttttagcattttaactcattttttttcctttgagtgtccttgaagttttaaaaataatacaaatttcataaagtattttacagtcagtatttttaaactctgttttcgtttgacccttgagtgatattatagctcactctcttagtggatgaaatgaaggaaatgtgctcaatataatgtataaaaagcaatgtatctttatcagcagagtatgcactttgtcactttgcaaaataggaggcatatcactgtacctggacatacttgactcccatagccatcctaatcatcttgtttcatgttcaaggtgtaatatatggtatccactaatctattcactcatttaatgggcatgtattgatccctgtgtgtagggtcagggatataacaaacaaacaaacaaacaaacaaacaaaattatgctctgctcttgaagaactcatcctcattgttaggataagaaaagatacaatatagtacaatacaatacagtactaataaaatacagcattttatcactgatacaattaatgatccaattgccatctctaataataaagatatgcccaaaatcctattggatcataaccacaattaaaattagctacttggggatgagaaaaaaaaaatgagagatatgtcagttgagtagggatgaggagaatgaggttagtgatatagataatgtttattttttctttttctttttcttttttgagacagggtctcactctgtcacctaggctggagtgcagtcgtgcaatctcagttcactgcaacctctgcctcctgggctcaagtgatcctcccacctcaccctcctaagtagctgggaccacaggaatgcaccacgatgcctggttaagttttgtatttttttctgtagagatgggatttcaccatgttgcccaggctggtctgaaactcctgagctcatgccatccactgaccttggcctcccaaagtgctgggattacaggtgtgagccaccacacccagcgcaaagacaatttggaggaggttagaatgaaactaagtgacccatgccaggcttgggagctaccacctcattagcaacatataacttctttgaaaacctaatatgtggtttggaactgtgcttgcagatacagtgagaaccaattgtcagtctatttgggctactatagcaaaatgctacaaacctggtggcttatataatataaaaatttatatttcacagtgctggaggctgagaagttcaagatgaaggcagcagctggttcattgtctaatgagggccccattttctggttcctaaatggtgccttccagctttgtcctcacatgatggaagtgacaaggtagcttgctgggccctctttcgtaaggggactaatcacattcttgagagctccaccctcatgacctaatcacctcccaaaggccccatctcctaacaccatcatattagtgattgggtttcaacagatgaattttgggaaaatacaaacattcatactgtagcaccaagaatgtgctataaacagctgacttccactctactgaaatgtggctctgaaaatggttacatatgttgcagatttaatggagttttctcttaaaactgagactgtagatgatgtcaggattttcagaatcagatttgatgtcttctcaaatagcagatgtaaaatctgctgtgaagctatgttttccattacgtattcggttgatgttggatacacagttgtactagaatgtgctacatattgtgaagccataagctgcttcaaggaacaagtttctttagaaggaagttctaacaagcagtggtaaatatgcagctatgttatttccaaggaatgttggtaatttttctgcgttttaaaggactagtcatgtccaaaatttgcaaaccttacacatgtttttttgtggcatcttgactggccagaggacttaattttatctgagcttattcactatacataggggcagcatgaaatcaaagaaagagtaagattttgaagccaaatgtaattgaatttaaatataagcaatataacttaagtgctgcatgaacttagtcaagtaacttaatatacctaaatttaattatttcatgttaaataaatgaaaataatatcaactaattatgtaggcatgagaatttgcaataaatatgtatactgctctctgtcacatagcaggtgttcagttaatagcatatgtaatgtatatgtgtatgtgtatatatattatatatataatatacaatgtatatatacatgtaatccaatcattagtgggtgtttctgatatggaaaatgttatcaggtccataaaaattactgagaaatttaaagatgttcatggaggcttattatgcatcaagctctatactgatctgggcctctttaaaatgaaggtctcattgaagagaaaatctcatgggggaatcaacagacaacatataaaataataaatatataaataaagtactgggtgctttcatacaggctgtgagcacagcagctattcagatttgagagaaataattggtgatcaaataagtcaaaacatggaatttagttttgaaggacctgtattatttagcaagaaaaggggaaattagacaatagttccaagatcacaaacagattcttcaggctcagtcagcttggaaatttttttatttttcctttgcattgctttgtaaaatctctaagccaaccttaaaaaattgggaaatattgcctaaaaatcaaggtctttcaaaaaaatcagaaggcctggaaatgctgagattatatttgtttatggtaatactggttgagctgacaagcagatgtcacatcagttgaagcgtaagttctccaggtcctcatggtctctatccagtatccatttcaatacctgactagtttctgccctaaaaatactttcagagaaaagaaaaaggcgaagatggtgagttgaactttgttgtgtcatttgagatgatcattcagcatacaaggagaaatatctaataactctaactggagattcaggactgaggattgagggcgaaggcagatctggagaggaaattttgagagtgaaacacaaagaaatgggaattcaaagcatgataataaagaagatttgtaatacagttgttcttaaagtgtggtcctgggatcagctcatgcccagtctcagacaaactgaatcagaaactcgggggttgaggccccagatttataagaagccacccagatgttccaatgcacattacattttgagaattattactgtagtggatattgtagcaccaaaactcaactggactgaggattcagcttgtctacacacactttctggaacatgatggaagagaaggggtaagtgatggagataagggaaaaagtacaggcaagaaaaaaagaaccagatgaaggtaatgcatggatcccagggaaaggatatttcaagaggaagctatttaggaggtcaaatggtgccaagaagtcaatgctagtaactgaatatttttaccaattagaaagttactgttcacttttcaaagtattgttccaacagaagtcagtgtttaggaattaagcagaaactggataatacaaagaaagaagtagcttgagtagagcaatcattcaagaaaagtctggcagtaaatgaaaagagagacaccctatgataaccagtgtatggatggaaaggatttgcacatgtttaagggcaggcagaggggaaagagccctggcatttgggaaaaagcatgtacatttcagagaaatataggtgatagataggggaacaggtcacagacatcacagggatgaataccaattggggagaaaaggagaagcaggtcttcttttgagacaggagaatggcaggtggcactagagctgagaggcaacaagtgttggcagagcctggactctgtagctggtctgtctgagattggatcctgcttttgctacttcctagtcatgtgaccctgggaaagttacttaccctgtggctagctcagtgtcctcatttgtaaaatgtagttagacatagtgcctccctcatgggtttgttgcaatgactaacatgagttgaaaaatgtagagaacttagaaaaagggctagtgtctaggaagtgttataaaagtaggtgccagctaaatgaaacacagtggggtggagatgagaggctttgaaagggatacccatgaattcctgagagacctttaaaacctccaaaatctgaaagccacttacataagaacttgagaattgatactacatggttaggttctagaaggcaaatggttctggagatggggtactgttcaagatcaactatgcatgaacaaatgagaagttgatggcagtgagaaccaagaaatggtcaagatgtggtcaaccaggtataatggctttcttgggtgatggccaggaaaggagacaatagaaaacagggttgaatagaggtactgaagtagagcggtggatcctggtggaaagattaggagggacaagcatatgggaaggtagtggagacagcattcaagtggcctggagaacagtctgagcaagtaactaggtattggcagaaggagactgagtgagtgaagaagaaactgtgaattgacttggagtacaaattagaaagcataaatgctaaatcatgtgcttccttggggcctctagaagcattgaacggggacatactggctctatcaaatggtcattagatactagtgtctgagttattattttatgctatacagtaaatgtataggtaataagggagggtttaataagagaaaggaatcaattttaacatgtcacacattgtgctaggagttttaatacatactattttatttcatttttacagttgctatagaaaacagaacatagtaatcatacagatcaaggaacaggtgctgaggggttgagtaatttgccctaggtcatgtgggtgggagagttcagattcaagtctatattaattgattctaaacctcatcctctttctatattagttggccaaatattaaagaatgttaaatatgctgaaatgcattggaatcagttgtagaaggtactcagatgcatgtgaggtttctgactctattggtatggaaatccctttctcataaactttcgctaaggtgacaggttatatatatccccaaattacataacccaactatataacctaaagcataacccaagagttactaattctgagaaccagcaaataagtgattttcttttgattttagaacttgaaagtatgcatttttggtctgctatttttgtgccagatttacatctatttctaattaaagaacaaggaaaggcacaaaccagttactaatcattatctgcttgccatttttcctcacaagattttcactgtaattcagtcaaactactacttagcaactagttatttcaagtggcagaagagatttacataggcattgccaatgttttctttggactttgtttctagaaggtatctgaaagcaaatttcaaaacagctatacttgagttgtaagttgttactatattggctaaatgaggaatatcatcaggcaaaactctgaaaaagtacacagtctaccattttctttctttctttcttttttttttttttttttttttttgagacggagtgtcgctctgtcacccaggctggagtgcagtggcacgatctcggctcactgcaatctctgcctcccaggttcaagtgattctcctgcctcagcctcctgaatagctgggattacaggtgtgcaccaccacgcccggctattttttgtatttttagtatagacgacgtttcaccacgttggtcaggctggtctcgaactcctaacctcgtgatctacccacctcggtctcccaaagtactgggattacagacgtgagccgccgcccccagcctaccattttcaatttaaagtattatatgaaggaaaatttatttgaagttttaaaagtagttctccatatcgacagaaagttcccttagtcgagatcgagaccatcctggctaacacggtgaaaccctgtctctactaaaaaaaatacaaaaaaattagccgggcttgggggcgggcgcctgtagtcccagctactcgggaggctgaggcaggagaatggcgtgaaccctggaggcggagcttgcagtgagccgagatcgcgtcactgcactccagcctgggcgacagagcaacttcgtcttaacaaaaaaaaaaaaaaaagaaaaaagaaaaagaaagaaagttcccttagtctctggagtattgcaaataacaaaccacattctttgctgtttgtgtgttagtcttttggagcagtggttctcaaagcaccatcagcagtatcaaccttacctgggatcctgttagaaatgcaaactctccaggcccacctctttatctactgagtcagatttctgggggtggagtctagcaacctgtgttgataagcctcctaagaggttctgctgcccgttaaacatggagaaccacttactttgagtatatcaaactcgaaatgctgtttgtagccctaggttcctggtgaagctctttgtagcatgaaaatagaaatttgctaagtagtaatacactgacgtgaaaaaagactcatttttttaacaattgtttttctaatctctaagacatataaaaatcattcctcattgacaaaatattgccccttcttcaaacacttcctcttctaggaacttttctccaaatctcccagctagataatcttattttgtgttctttgtaaggtattagcccgaaatagtatgttaataaaagacgttttagtttgcacaatagacatgtaaagtttacttggtgtggatgcatgatcacagtttgattatctctccggggaaagaaacactgcccagattacaagaccaaggaccaggttctggattatttgttgtctgctctttgtaacactgtgagacttctaggcttctgttatcatacacaaatgttagatgagaaagagcttgaaggtcttaggtaagagcttggaagggacaagtgcaaaatcattgagcaaagcattttagaaaggtgtcttgtctgatgaatcctctcacctctgttctttttgcaaagctcaggaggccttggagagaagattattgtgttagtttgttagaactgccataacaaagtaccacagactgggtggcttcatgaaaatatattttctcacagttttgaagtgggaaatacaagatcaaggtattggcaccattgctgcttctaaagcctttctctttttcttgtaaatggctgccttctctctacgacttcatatggtctttttgtgcctgtctctgcttataaggacaacaatcatattggattcgggcctatcgtataaccttattttaccttaattacctctttaaaggctctgtctccaaatacagtcacattctgaggtagtgaggattacaattttaacatattaattttgaggggacaaaattcagtccataacaattatgcatgactttgatgacccatttgtagattgaacttgttaaaacttcagaatataaatgggttgtaaacttgtaggtgaaacgtggctgatgtattccatcagagagatagccctacaacattccaactgggtccctaaagctacagatatgctccattaccatcctcaaatgccaaagaatgaatgagccatctagaagtaggcaaacaaccacatttgctaaaaggctaatgtttcatccattaaataaatgtgatacctttttctagtctggtatcaatatagaaggcatgtgaaaaatgagttagctgagagttaattgactgcggagactctattttcagtctctgcctgtattttttgaattaatatacacagtgggtgattcagcaaaagggtttaaaaataaattctttattgaaggatcccaccaatttgatgtcttcataattcatgaagagtagacccataataactctattttctcttcagctttgaaaataaaagatgccattagtttaaattaggcttgtatgtggaataatcaagtgtatcaacaaatatagtttgactcagatgctgtttaagaataaatgccagaaaagaactggctatttctcttaaaaaattaaatatgaaaattgtattgacaagctagggtgaaagtgttttaaaaagttgatagacaatatatacatttataaaattatgaaaactcaaaaatgtaataagcaaatagttactgtagactagctactcttttaaagcatactctttagaatataaagaaaatagaatataagaaatatcattagagacctggctgtatttgaatataaagaaaatgtcattagagacctggctatatttgtagaatacatgagcactcaggatagttggtgaatatgtaggtatggggttgccaaaaagcatctttgcaatgctgtattagggagttcctactttggctagagaaggcccacatagaaagaactatagtgtaaaatatatttacttcatttatttatttcccttgaaaagttcaaacccccaaggaagtagactgtggatagtattttatctcctctagctgtaagaaatgaaaggatagataagtgaattggatttgtctgaaagcttctggagtcaggaggcacatgggacttgtgctcaggtgtctatttccaggcattattcagcaatttggtcacataattttctctaatattagatttctgcttccaatggtgggtggcatagttgaagaaagaactttatgaagacataaggtcttgatctaaaccctaagaagggaaagagtaagtaaatgaggttatatacctgaaggcatacttttttacttcagaaatttttattttccttcggagtgtataaaatcatgtacttttaatctgcagagtagttttcattctaatctactagtatactttgataaaagcataatttcataggtatattacattcgtgggtctcgtgtttatggtggttacgtctttaaaaaaaatctaaaccttatttatctacatcagttgttgactttgcagatcacagagaatacagagccagtcatgcagaaagtacctgtttgtcatcctgagagttcagacatgaactgtaaccagtggcccattaagtaccttctcttgttgtttaaagcatatcctagctttgcaaattaattgttaatgcagaatgttgtaacggagccatggaatgaaattcctgttactccagtcatagtagatgttgcgtcaagtactctgagttgtgttccattgttttgtgattctgtgctgtcggaaagtctggcctagagagtgtttagaaataaggaaatcaagaaatagtatggtttgcttttttggactctgtgtgtgattttccattgatagtaatattgtaataatttctgagaaataaaattctttttctttgtttataaaaaagttacttgtcaaaatactcacaaatgctttccataagaaaacatttaacattttttgctgtaaaagtgattacatatactacatttaatgcagtagaggacattcttgtaatattgatacagtaggacaatatgcatgccattgactattgttaacagtccagttgtgagatgaaatccactatgaaacacagtaatgtttaatttcatatttaagacagagctaaatttcagtttagaaggttcttatataaaaatttcaggaacacctttataaaccaattaagaaggatttttgtcttaagggtttatgtgcctggtgtaagatagttatacctgatctaatttttctttctttttctgatttttacttctcacatattgtattaatggtgcttggtgtggaaaaaaaagatgcagtgacattttcttctcttatcccttattttctactctaagatacatataattttgcaaatatttatttaccttaatagctcaaacctagctaacattacagctagttaatgggtatgattgtaggtacgatgaatcattgtctagtaaagagactgttcaaatatgattttattttactggttattttcccaacagagagactcttggggtgaaatagagctccaaaaagagtgttttgggggagatgggaaagggaggattgggagtttttaaagggaataatctcgtgtggtaataggcatgaggtaatagtcattttgataatatgaaacaaacaaaaaagcttcgaacaggtgagtatctgtacaactaggtagagtgagaacataatgaaatccctaacatttaaaactaacgatgtaaactgtaaatgtaattatcttttagcaaataactttacatgtcaattttctcagtggaattttttgacagtctaagtagtaatgtttgaagctttggggacagaatctttacccccttccacttctcatcattctcagagaatgccgagggctggagacatttttatatagctgatagcagggagagcatcattggaagaagagctaacattaataatacttactctgtgtcggccactgtcctcagcacgttaggtaaaccccattttaccttcacaaaaagcctataaagaagacaatattatcctcatcttatatacttacaaaaatatttatatcattacaaataattcaaatcattatttaaataaatgtatttatattattatagatgatcaaatgatgcaaaaagcacatattacttacttagccaaccaaatatacccaggctaaattaggatttgaaccatgatagtttggtgtctccgtatattcttttaactactatattacattgctcctggagcctaatatagtggattcccaaagacataaatgttgattgaactaggagatttgacatatttagcttctcatttttgcagatgaagaaactgtgtcttagtgaagttgggttaaactctgcagtgttacaacacaaggtgagagtcagagctggatgcaaaccctgttcagtctagcaccaaggtccatgctttcttccatgaatccacagagtgcgatttactgtgatcacaatcacatgtgatcctcttttggctgcctgtgacagcctgacaagtttatttttgaagctcaacccattgcttacatagggaagaacattcctaagttataaagaagaactggtgaaaggacatcatccaggtgtgaaatgggaatccagagcttgttttcttggtttatgcatgctcagttgtgtgtgccccgatgttcattagagtgttttaagtgtcttcaatgggttacaataacatgggtttttttctctctctctctttcaggtatggaaaaattgtatctacaaaggcaattcttgacaaaaacacaaatcagtgcaaaggtatgtgtaagggcatccgtaccctgaaatcttgcctatgctatctgattaatggttcttccattgtggaggtccaggtaccagctgcacaatgatcacaatgcatagtatggaaaacctctttaatgatgccaatgttttgataagttgtatttctagtaacattgctcattcatttttttcattaacaaacaaaatgaaaatcacaaatcagaacaagtatcaaattgcttcagcataaaactaaattacctcctaacaactttggggtgtctgatgtgaatgatatcatcagtgatgcaaattgatttcctatataaaaatgaggaactctggggaaaacttccccatgcaaaacacattttaatttctctgttctttaaagctttagcaacattggttgactatgaataaatttactgatgggcctattgtattaagcttcagctataagcatctcagggatttcagagttggtatcttattaagacaggcttttggttttcctggaaatacttctgaagtcattggactatatctgtggctcatgtttcttcatgtctgggagtcctatattcttttaaaatttgcattagattaattgtggaacctgtatggtctctcttgcatgactcagttcttactggaaaattggaatgcttcttgtaacatgctgtttgttgttcctttaatctaatctttgttgtaacactgaaatcaagaagtatagcacagccacgttcattctaaacactgcctctatttcatatacaaacataatgtgcacaagttttaggaaagaacactcagaaactcctgtatatgtatctcctcacctacttgcataatggtagtcagattcaattcagcaattaaaaaaataaaaacattccacgtcttctataaactcagaaatgaactacatattacaagacaaagaataatatgacatgatttcttccacctcatagattcaagtcctagttaaaaagacaccaagaaaaccaagaaactaattctaatatccttattaggattactatatcaccttaatatatgtgagggtgtaacagcggtatctaaaacagaattatcgacaaaccactgttagaggagaacatagagatttctttttgggaaatgaagtttataaagtcaaggtagaatgggtgagcttgggacaggtggatgttcaggagagagaatttcagaatgtaattgagtagacccacgtagctgtaaaaaaaaaaaaaaaaaaagtactgctgggcgcggtggctcacgcctataatcccagcactttgggaggctgaggagggtggatcatgaggtcaggactttgagaccagcctggccaacatggtgaaaccctgtctctactaaaaatacaaagattagctgggcacggttgtaggcacctgtaatcccagctacttgggaggctgtggcaggagaatcgtttgaacccaggaggcagaggttgcagtgagccgagattgcgtcattgcactccagcctgggctacagggcaagactccctctcaaaaaaaaaaaaaaaaaaaaaaagtaccagtgaggacagaaacaagaaaggggttaaaattgtgtaggtttttaaatgatatcctggatattttaaatttaaaatttaatttaaaattaaatttaatttaaaattaaaatttaaaattttgagcagacaaaatatgattctgcaggtgtttcgtaatgttatttcagcaaaggtgtgtgaaattgaaatataaagggagggagtggaaacaaaaaaaaatgtaggctttaaagccatagtacaatagagaaattagaaaaaaatcagcttaactattactattagggtaataggaaggggttcaccatgaaagtttttaaaggtagagttggctattgactctaacagtgaaagagaggaatgtatgaaacaaaccctacatacatgttgagtcttctgattgggaaagatgcctgtgcctcttggtgaggtaagaagtccagaagtagtagtagtaggttttggggagaaggtgttggacatgctgagttagagtctctggcatggcaaccatgtggaagatgtcaaagaggaaattgtaagaaagcccagggctacagatgctgactgaagtcaaaggaatagataagattaccaaagaataatgtgtagaaggggaaatggagtggagtgaattagggtgggcagttgagaacttggagaacatttgagaagaaagctgggccatggccaagggatgttctgtcactcttggcctgtgggaagcatgtggcatgttagaagcattagaatgcgaattatagtgcatctagacctgcccaacccatatacaaagtcttgggtcagacagttaataatattaatcaagcaccaatcagaagcacaaatactgcacaggtaagcaacacctggaaacctcaatagatagactcataaccggagcggtcaatatgaagggatacttccttatgcagagttttgctcaagcatgctgatatctgttgtcacagtacaactctgaagaccacgaaaatgtaaattgccaacatgcaaaaactgtacccttctataactgtgaaggtttgaagaaaaagggatgtaactaaaaatgggcggtcagggtctccataagcaaattatatagtgggagcgtgggtgcttatcaggacaaattatactatgggtatccttatccttacatcagctcctaaaatccctatccacgctattttgcaacagcttatttaattttctgtttctgtagagagattcctaaaatcagtggaaacagggcctgtgtgctatagaaaacttacctccaaagtgggatgtgtgaagggtgatacaagactgtttattggagaggctaaaagaaaatattagaatttacatctctctttgttttttatatcaactttttgtgaacattacatattaatataatcttacaaatacatagattttaaataaatatgaaaatgttgagtttgctgcttcaaaatacttttatctctagtgatatgaatactggtctcaccaataaatatggaagaagaaaaggagtaagagaaggaggtaaaaaaggaaggaagagagggaaggaggaaagacggggctgtggaacagcctaggaaaatcacttaaagaaaggcatctgtaagaaattggacagcggttaggccgggcgcagtggctcatgcctgtaatcccagcactttgggaggccaagatgggcggatcacaaggtcaggagatcgagaccatcctggctaaaaccgtgaaaccctgtctctactaaaactataaaaaattagccgggcgtggtggcgggtgcctgtagtcccagctacttgggaggctgaggcaggagaatggcgtgaacccaggaggcggagcttgcagtgagctgagatcgtgccactgcactccagcctgggtgacagagcaaggctcagtctcgaaaaaaaaaaaagaaattggacaccatttagaccgtttgccctgagggtaatacgaagaaggcaaagtgatcgtgtgtccattatatgcttataaaagcctcccattgccttgcttatcctcagcatgtagagtctctgcttagcagtggtgagtgaatcacaaccttcatcaagcacatcatgggggaggtgccctgtaagtcagcaaatcatgatcaaaaatatactactatccctttcatgtttttagaaaaatactattttaatgatatgccgatgtatattagagtattttcctttcaaaaaatagaccttgacatagatatgagaagatatgattagaaagacagcaattatagaaaattgtgtataattgttcatgatgaccaagggaataataggagaaagatatgaggtcatggaaaggttcaaggaactgataagaacgagtattgaaacaatcgtctaaatgtttattggaattgccaagaaatgaaacaggagttgtattagaaaaagtgactaatccagaaagtatctgcggagaaataatgggatgggaaatgatactagggatctgtagaccatgatgaaaatgaagactagttggttataaaatttgatgatgtgagattctaaatgggagattttaggtaggggagaaaccatactgagaaaggaggaaagtggactaccacttacaggtccagtgggaggaaggatatgggagaaaaaaaaagaaacaaaactcaaacttgagagggctacaaaggaagtagtgtcctcagggtaagttaggtagtgatgggaaacatgcaaattaaagcaatatgcagtgatagtttataacccctgaagtagcaaacattataacatgtaggccattcatgctgttcactctgaaactggttcatccattcttcattggtaccatgctaaatcggtacagcttttttaaagtcagtatggaaacagcaataaagagcatacagttgaaactagttagtctgttgagaatatttattcaaatatgttatctaaacatatgttttaaattatgtatctacgtacaactttgagcactctcgttttccttactaggaaaaaatataggaagcatccaaattctagcttatggagcatatacaactgttatgtagctgttaaaatggtagtcataaagactagattatgccaagcctagaaaaatgtttattatatgaagttaaatcaatataaagggatataaaataatgtgtacactgaacatggagctatgtaaatatttgagagtcaggatcagtgtggttatgactgtggtagatccaggctgcctgggttgaacgctgcctcttcgcttagtagctgtgtgacctgtggtaaattagtcaactgcactgtgccttctgcaaggtaagaacatcagcaaagtaataacagagcctcactcacagtgtgttgtgatgattaacaaagttaatacatggaaaatgtttgacgatatctcctgttacttttgtataaaatactggcaatatcaagcaagacaaaaatgtttgttttaacatggtgggcttatgggtgatatattattattattattatcttaacatttctccaaatctgttctgtttttttgggcaagaaaaaaatacagctcttggaaaaattaagctggttttaattatgtttatattttgattgttctttctatggaacctgagtaactcatgactgtatggttcttcgtttttgtaaaataattccagatgaaaatagtgaagaattaggagagaataacatgttttgctttttaaaataataggcagagattgagtacttcttgaccattgctttatttaggaaagaaattacaggatgtgtgaggtgcctttttcaaacaaaatcattaagagcatcaagactgtcgtcattagaggacacaaattggatttggtcttctctgtgacacttggttttgaatcctttgcaactttatctccaggcaaaggctatacaattaaatctaaacattatgaactgaaggatttgtttatttttatttttaaagacatgatagtaattcaattcttcattagctgttacacgtacagcatattgtgtgtaagttagtctttaccaaggtatgagaaagtccatgaacttgtctccttagagataaaaagaaaaggtataaaaattaacctaatgcattaaaccaacagaattgaatcctattttagcatttaaaagaaaagcttttatgctctcctgaatcccacccacaccctgtaagttagggacagtagtcaggcctaggtaagcttactcacttttttattccggaaggggttatcaggaactttcaacataacctctcgttttcaagattattctttcttgggtggtggctgcatcagctttcattccgtataatatgacaacatacaacaaagcagtcaccatcaagccaaaatgaccagaaattgctgaacaaagcgagtaacagctccagatggggagtaatgaaaaacagaccacagttctcattcagatattcaaacacaaggactaaataagagctattgtacaagacacagagatttgcactgcattttttgcttgtttggcttttgttttcccccatgtgttttccttctggatcagtgtatttgctaaattaaaaagtcagggaaaattaaatgaaagctattggaaacaaggtgtaaatcttaaaagaattcacttgtctatgccttcctgcttttgaaggttggtttcccttttctccctgcacccaccagccttaccaccatcatatttccgacaggctatatgtttagagtagagggaatgagtaatggatattccgtagaaagtttccatgcctattaaccataggatataagagtagatagagtgtgccaaacataccagctcacttctgagggtttgaaatactctcttttgcctttgttgtcacaggctggttaaattatatttatggagcttatgttacctttgacataacattgagcccttaaaatcaaaattggagacaagtatccaaaagttctgaaatcatccatgaaggatattcattcattcattcattattaaataaaatcataaattgttatttcttctataagagaaataattctgcatatgacacttattttatagagaggatttagagcccatctagattgtctcagagagtggtgtgactttgttactggactgaatccatttagcagttctaaactcacaatcatgttatacattttgaaagtatttctaggtgaataaatattaggccatacacttggatgactttggaattcatcaattttattttacttttcttgtttatgcactgatggaatatttatacatgtgagggaaatacatatttctttctttttttttttttttttttttgagacatagtcttcttctgtcacccaggctggagtgcagtggtgcgatcttggctcactgtaacctccacctccagcaattattctcctgcctcagcctcccgagtagctgggattacaggtgcgcgccaccatgccccattaatttttttttgtatttttattagagacaaggtttcaccatgtgggccaggctggttgaactcctgacctcaagtgatccacttgcctcggcctcccaaaatgctgggattacaggtgtgagccactgcgcccggtcagaaatacagatttctgtgttgaaccccctgaatctggaaggagggcaggatattatattttgttatatgtttaggtagagtaattacaggacatgaggtatcctttacctatggattagttttaacaagtgacactgacatgcatttgtggtgaaatgtttaagtggaactatttaactctggcggataacagacatttccagggctggtccacatggaaatcaagcaagtaaaggaagaaaccaacaccatggaaagcctcttttctagtacctttatttcttgaaagcagtggaaactaaaataaatgttctgtgaaatttatgagtgtgaggaattacattttgagaagaataatcacctccaccaggtgggctcacagtctattgagcaagaagctcatgagaagcaaaatggcttgaaaaacacatttattcaattttcatataatgggattaggtataccccgcccacatcaaaaaaaaaaaaaaaaaagaaaaaaagaaaagacaaaaaaaagttatattttaaattatatttctctttggaatatgaagtgtgtaatatttccctagcctttttttgtgaattttactctaatctactctagtattaagtttaccaccagtcataggtcatcaatatataaacttgaaggtttgctttatttgattttgatattggcttttgttttcatttcagaaaaggttagcatatgcaggaactttggaaccttcattagtgcatcaagtttactcagaattgtcctgtaggtacattttacgtagaatttttatcctgtgactcttttaagaaaataccaatttttcttgtcttacagccaagttcggaaagaatatccactttgatggtaaatggtctttatttgttgtctacaacccaaccagacaactacaactaaaggcaatacttctgccaaaaattagctttccaaacttattatttccaatatcaggatattaattatgttatgattatttagtgttaactttgagaagtccttgatataaatgtaaaacaaaataggtatttatgttttggaagtcatacagctacacgtttttcagcaggttttatagctatatatttactcagcatttgcttgtaatcacttaatatacatattagacaaaagtaaaattatccactaacatgaaatataacatcagcattgctgttttaagcatcaacttgtgttcaatagcctttagtattgtaacctacttccctaatgcttttgtacatgcagaacgtgcagaaatgattttattgggaaaacttttttttttttcttgttttttgagacagagtctcactctgtcacccaggctagagtctcggctcactgcaacctccgcctcccgggttcaagtgattctcctgccttagcctctcaggtagctgggactacaggcgcattctaccatgcctggctaattttttgtatttttagtagagacggggtttcactgtattagccaggatggtgttgatgtcctgacatcatgatccgcccgcctcaacctcccaaattgctgggattacaggcatgagccactgcgcctagcctgggaaaacatttttaaaataattgttgaggaatataaaacagcttaaaaataaaatgatagagttacattactttcacccgtaaaccgaatgttacttttactaatccatgttatctgactaaacagaaactgtcgtccaggtattctgtttgcttccttgctcctgtctttcacttccctattttaagaatttgactcatgtcgataaacataaaatgctctctcttcctacctctagtagtctatgtaaattattgcttccaaaagtcaccttctcaaaaagtcctccaagactctactcatcctatctaaacacctttacaaaaccacttcctttgggcaccatctgtgtgcaaagatctaaggataccccatctctcatctctcatgcttttatgattagtttgtgtccttcctctagattataaactccctgggacccaggtagttaggattattgccgaagtattgaggatgcaggacagttctgagtagtcacttagatcccagtgctttacctctgtctctgagaccctttgatgttatatcaatggaaagcacaagcttggccaggtatgtgttccataggcctgtacagacaggaagagtaccaaagacatacagatgcatatgtttctcagagttattctctaaaagtattcatttttttttttttttttttttttttttttttttttttgggagacagagtcttgctctgttgcccaggctggagtgcagtggtgcgatctcagttcaccgcaacctccgcctcccgggttcaaacgattctcctgcctcagcctcccaagtagctgggattacagtcatgcaccaccatgcccagctcatttttgtatttttagtagagacagggtttcaccatgttaacctggctggtctcgaactcctgacctcaggtgatccacctgcctcggcctcccaaagtgctgggattacaggcgtgaaccactgaggccggccaaaagtattcattcttaattcagagtacttattttgttaatgtggagttattctttttaatggtttaaagctatttttgttcattaatgattttattaatacatggcaaattgtatatactaatgtatatttaaaatgatatacaaaatataataatgtataatgcacaaatatgatatatgtgtgtattcagttcactaaaatttatgtaaacttgtaatactatgtaaataaccttttaaatataaaaaagacacagttcttcaaaaattttctaattgaagtctataccaagaaattctctaagttatgatcttagtttccttggacaaggcacataacatctctgaacatctgtttttcaactgtcaagtgaggttatctacacctgcaatacaaaggtattttcagaactacatggaaccatgtttgttatatgccgggcacatacatcaggcaaatgtttctatggccttggacttggataccttctaggaaccaacttgtttagagcttgtatgtaacttacataatttaatgccattctgagtacattttaactgtaagaaatgtgtgttttatgaattgacttgtgtttattgagattagcttcgttaatagcaaaaagtataagtacttaaaggatgtcttaaaggtatgaaagataccttttggtgttggctatatgatagcttcaagattttttagggcctataaacctggtgtgtttgagataaagcaaattccatcgcagtgacaggtgatggaattcattctagttgagttgtataggttctgggaaaaaaattttctttgttcactcctttgttatgctattcactctgtaatattgttttacaagtttaaaggaaaaaaatgcctaaagattcttgactccttagttttttaaactatggtaaaagcatctaacatttaaggcatggtcaatcatcatttgctttggtgctagccattgttcttattattagttaatcatattgattctaaatagctattctttttccttccctttagtaaagaaaagagaactctggggtatgaaagagaaaaactcatgtacatagctgaaaaacaaaacaaaacaaaacaagctacaaaaacctaaatagagtttgaaaggtgaatgtaccacttgatatgcttcttcaaaggactataagtgagctcagatgcctgcttatctataaaatattggcaatataagtactttaatatgatcattttagaaacaggtataattttctccttgagttgtggaataagagaaaattacaaagttttcatttaatttctacttctcttaagaaaagggcagtttattttcactgctaggcatacagatagacctattggtcattcagcggacaccagccctgaattagcagaaacctgtatcataaagcatatttggaacactttttctatgccacttttaaaaacacaatttctttcgataaacaataggaagcttaagctgcagatatcacagctgttcatattctcagatctcgtccacaattcaaacagcagcagctgaaacaaacgattttagggaagcaactgtcaaaaaacacactgggccttgggcttaagggtagtgtgaaaaataaccatatttgagatatactgaatgaaatcatgtggtgaaattccacgggaaatataaagcacattggaatttatgtctttgggacacatgctgcaatagataaaccaaaaactgtagcttttaatcaatgagaaggattttctttttttttttttgtaaaaaagaagaattacataaggtagaatttgtaggctcattaaaaaaaatagtattaagacactgtggcataaaattttctcaatcttcccatacattcttttgaatgacgaggggttcaaagtgagaaaattcctaatttcacatctaagatataaggaaattattggtaatactatttctttttatagggaagcagatgataaaattgagaatatgacaagaggacaacttaacaagtcaaagattcccgtatagaaaatagaaattttctcagtctatctcaatttctggctattgttttgaaccaaataagaataactccaagtgaaatataaatatatatatataattttattatatatacatatatttacatatttattctacatatatagtcatgtattacataatgatgttttggtcatcgacaaaactcatatatgacagttgtcccataggattataccatgtttttactgtaccttttctatgtttagatatacaaatacttatgattgtgttaccattgcctacagtattcagtattgcaatatgcggtacaggtttgtagcctaggagtaatatgctataccatacagcctaggtgtatagtaggctataccatctacatttgtgtaagtaaactgtggtgtttgcacaataatgaaatcacctaaggacacatttctcagaatgtattcccattgttaagtgatgcatgactgtatataattacatgtgtatgtcagtacatctgtgtgtgtgtgtgtgtgtgtgtgtatcacagggacaaaacatttatgaggtatttttattcaaagagagtttaaaaattgttatataaagatttacctaaaagtttatattttagtttaataaaatgtaaaaaggaatcttgaaatgaaatccccatagttctttgtaattaagcatctgctatgttacataaaccgaaaagtcctggggaagttgttctgccttagggagttgtcaggttctttgtggttgtctgctgttgtgagaagtaatttaagataagtaagaacaagttaacactgcatatacaattatctaataaaagcttgttcaagcattgatatcatgtgtatatgtttaaaatctccatgaaagtttaacacgtccactttgtatttgccacatattatgtcttattaatatggactattagtacaactaagtacattcctttatggtgtccaggtcagtctatatttccactctgtgcgtctttcaaaagttactagtttagagccaaccctttgtctctgtttactgttgcagacattttaaaaaattcatataaaatatatctttccagataagatggttccagtttacaagtgatcttctgtagacaatagaaagccagtatcacacgtaaatttgtgaaaacatccgacgctgttgcaagcccgaggttaatttatccgttttaggaggaagacttacggtgcttctgttaaccgcagccatttgttgcatcaagggtcagccctatctgcattagcatttaccaacatctctatcttttgtttcctgtctgagtttacttaaatatggaaggtaaactcttcaacctatctcccatcagcctatcaaccaaccaatcagtggaccaaataaaacagactaaagaaccaatacccaaactcaaaacataaacataaaaatactcaaaaaagaggggaaagtcaatcctaaggggagggatcatgaatggtgtctttggcttgcttgcccaggagagacgccctacttaacagtgagcagaaaatgagtaaacgaagagctgtgtagtcctcagaaaaatggttcgcggtagttatggtgtcagagatatatttatactaacatactctgcagctcagccccatgagcatactgagtctagaagtctcttagaacattcctgtaattcatcagaagggcaaatttgtctagggaaggaattttgtttggctacaatactgttaaaagtatttaaattagaatgccttttagcgggacctaaactatcctttattttcttaaaaccagcccgcttcactcatttgtatacctgcttggccattgaagacatgtgcatcttcaactttcaatagcctataccattgttgaatggacatcaagtaactaacaaaattattattattcgcattttactcatgaggaaacaaaccaggagatgctgtgaaatgtgtcaaacatcaaatggtcatccaaacctaagtctgtctaactcccaaagcataggtctctccactgtttcactctttctcccataaaataatcccaataagtaagactagaagtaaatgatcctggatgtttttaatgacaattagacacaagcacaatgttttgagttcgcataaaggcagacaatttgatagaaacatgtagtagttcttattctcccacttccatcccactataaacagtatcgattaggggttctagttctgtttgtcactgaatatagatataaaaacatggagctggcactatgaaagcacatgttccttttgaaaatattttgatcattttgttccatttaaaatcattttccttttttatattttgagaatggttttctgctaacttcaattttgcacttatgttggcaaatgtctagctttctatctaggttaactttaaagtgagctgcagttaaataaattttaagtgggaaaatagcctcagaattattgtggtagaaagacaaggtgcagctgatactttctcttactctcaggactcagaatgagccatgtgcttctttaaagggcctatgtggtcgtttcagagcaaatgctctctttcatcttatttaagttctgtttggcttgcctcccatatttgctcagtggggataaggttaagacctctgaggaggccactctatcccaattacttacccagtctcttttcttttcttcaaatagcttgcgtgtagttgtggagaatgtttgggggtcattatcttcttgatggatgaatccagagataaacaaacattttctatttgaattctaaaggtatgataaagtttaatccaaagacttttatgttttgaattcatccaggcaccaattcttgcagcaaaacatccaaacgcctgctaaggccaattatttcttttgaaatctggtttttctcagaaagttcttcccccatccacgtagtttcctattgtctcaagttgccctccagcctctaattcttaccgagatttaccttgtcattcattcccttctgtcctttacggaaatgttaagcatctgtgctcagtttttttcaacagctatattcaagcacatgctttatttcctcgtactcactctagattcccctgtccaagtttgagtctgaatttttacagtgtttagattctaactacatttctttcttgcctagttcctgagtggtctttctctggcctgacattctacttccaggcaccaatcctaatataactggatcctgctttgggaactgtaaggaggattgttttacttctccaacaccattgtctgtgttaattttgctgataggatttttataggaagcagcataacagcaaggcagtcatttcatatttgtaaccaaaatcaagtaattctcaggtagaccacagatgtattttttcctgcttctttgaagctgaagatcgtttgcaataggtgcctataaagtacctctgcagtggaaaaaataacatcctatgtggcatggcatccctgttcctccatggaaaccacagttagttttgacattgccagaatttttgaattttggggagaagctatggggaaaaaatgtaaaggctttctcatctggatttaactcgagttaaagcattacctgaagctctgtgcggccttgtttgggctttgttctctaaacagtttgtagatgattgtgttcagaattcccagcccacattagctaactgcacacatgtggaaacacagagaggctatgacctttagatccactccagaaatacaaacttggtctctaagtttagagaggaaattcttccctctcactagccaggatctgggactgatgttttgcccaggtcacacatatgtctgagccgtgccagttagtaggggaaaaaaatgacctcttgggtaatttgtacgtcatgaagacttggctctgtcttggtccagggagcagcagctcatttaaagtgcacaggaccttatgagttttagggggccacaaaacatgaacccaaataaagtggaaatttgtgatgattggtctatgagaaggcaaccataaaaataatttaagaggcagtgagcaggcctcttgcctttttttctgtctgatttatttatttataaaattttaattggaaaattaaaaattaaaaaaggttctgaaggtagattccatttcttggctattgtgaataattactactatgaacaagcaagtgcagatatctctttggcatactgattctattcccttcagatgtgtacccagtagtgggattgctggatgatatggtagttctatttttaattttttgagaaacctctatactgttttctctaatggctatactaatttacattcccaccaagaatgtgcaaggattcccttttctccacatcctcatcaacatttatctttcatctttttcctaatagccattctaacaggtgtgagttgatagctcattgtggatttaatttgtgtttctctgatgactagtcatggtgagcatgttttcatatacctgtcggctctttgtatgtcttcttttgagaaatatctattcaggtcctttgcctatttttaaaattaggatattgaattgatatatgttaaccccttattagatctatggtttgcaaatacttcctcccgtatcagacatatgttatgtcttcaccatgttgattgtttccttggctgtgtttttcagtttgatgtagtcccattcatccattttcacttttgtttcctgtgcttttagtgtcatgtccaataaataagtgaccagaccaatgtcacagagcttttcggctgtgttttcttctagtagttttatagtttcaggtcttatatttacatttttaatcccttttgagttgatttttgtatgtagtatgaaataaaggtctaatttcattcttctgcttgtggacatctagctgtcccaacaatatttattgaatagactgtccttttgctcttgtgtattctcagtacctttgtcaaaactcaattgactgtaatcacatggatttgtttctgggatctctattctgttccactgatctatgtaatagtttttatgccagtaccatactctgtttattattgtagctttgtagtgtattttgaagtcatgtagtgtgatgccttcaattttgttttttttttttgttgtttgtttgtttgtttttactcaagatagctttggctgtttgaggaatactgtggttccatatgaattttaggacttttttttatttctgtgaaaaatgttattggaatttttatatcaatcacatttaatctgtagattgctttgggtagtatgggcatcttaatagtattcttctaatcaatgaacgtgagacatgtttccatttatttgtgtattcttcaatttcttttatcaattttggatctttttttaatgtacaggcctttcatctccttggttaaatttaattttaagtatttgatatttttgtagtgatggtaaatgggattttaaaaattgcatttttggctattcattgttaagtgtacttaacatatattactatattgtatgttgattttttatccagcaattttactgaatttgtttattagttccaatagttttttggtggaattttttaggctacattatagataaaatcatgttacttacaaacaaggataatttaacttcttcctttccattttgaatgccctttatttctttttcttgcttaattgttctcgctaggggacgtccagtaatatgttcaatagaagtggtaagagtgggaatccttgtcttgttcctaatctcagaaaagaaaaatttcaactttccctcattgaatgagatattagctatggtccatcatatatgtcctttcaggtattgagatacattccttctatacctaatttgttgagattttttatcatgaaaggggattggattttgtaaaataatttttctgcaactattgagattatcatatggtttttgtccttcattctgttaaggtgatttatcatatttatagatttatgtatgttgaaccacctttacatcactggaataaattgcacttgatcatggtgaatgcttcttttaatgtgatgttaaatttgacttgctagtattttgttgaggttatttacatctatgttcatcagggatattcgcctgtaatattcttctcttgcagtgttcttgtcaggctttgatgacaggaaaatgctggccctataaaatgtatttaaaagtattccctctgctgcaattttttggaagtcttgtttgaaaagtattagtatcggttcttctttaaatgtttgttaacagtgaaatcatcaggtcccggacttttctttcatgggaaaaatgttattactgtttcaatctccttgttattggtctgttcagattttccattacttcatggtttagtcttggtttttatgttttagttttatgtgtctaagaatgtatccattttttctaagttatccaatttgttggtatataattgttcatagaagtctcctatgatcctttgtatttttggtatcagctataatatctcctctttcatttctgatattatttgagtcttctttctttttgttctttgttggtctagctaaaggtttgtcaattttgtttgtttaaaaaaaaaaaactcttggttttgttgaccttttctattgtttttctagttctgcttcacttatttctgctctgatctttgtttttttttattctgctaactttggccttaatttctctttctttttctgattccttgaagtttaacattaggatatctctttactatcagctgtatttaaaaaaaaatgaggttcttttatgacctcatttcaagagtcaataaactttccatactctttaggtacatacactagattatgtaatttttttctacagaaataatgttttaggaatagaaaaattatacacatgaatgcaacctttgctttgtattcctgaaaacttggaaataacctaatatgcacaaatagaaatggctaaactctggttaaaactatagagtattttataattatgtaaaggaaaaattgttaagactctgaggcagcatggaaacctagctatagtatgatattaattgcgaaaaaaaaagacaaatctatgtatgctctgctaataactaggtcaaaatgtgaagtatgatggcttctgacaatgtttttacttgatatgtgtaattatcagttgacatgtctctctcctctgcactgtgacttctttgatggggagagcatatttttccatatgtgcaaaaacaagacctagcacataatatgagctaataaatatttctgaattaacccttgaaaaggtagcaaaaaaataaaattatataattgtatccatgatctgaccacaattctctaaacataatgcatttagaaggcaaaggtctaaaggaattgtatagaagtgattacaagggttcttgtgtggtgaggtattgatttttcaatgttcattatatgtttaaaaaattctcctatctataatagaaaacaacaataatgactaaagtagtattagcacaatttagcaatactgagatgcaagaaaaactcattttttcaataatgagaaaatatgaagattcatattgtcattaaaattcaattatatatgtgaaattttgaatctctgttatttggaatgagatgtcaagaaagagaaacttctaactactaatcataatataaggcctctcgtcatctggcttgttctctcctctctaacaccagaaatagtgtacatttgtataatataatctattttttccccatatctccttcttttttaattattatactttaagttctggggtacatgtgcagaatgcacaggtttgttacataggtatacatgtgccatggtggtttgctgcacccacgaacccatcatctacattaggtatttctcctaatgctatacctcccctatccctccacttgccaacaggccccagtgtgtgatattcccctccctgtgtccatgcgttctcattgttcagctcccacttatgagtgaggacatgcagtgtttggttttctgttcttgtgttagtttgctgagaataatggtttccagcttcatccatgtccctgcaaaggacatgaactcattccttttgtggctgcttagtattccatggtgtatatatgccaaattttctttatccagtctatcattgatgggcatttgggctggtttcaagtctttgctactgtgaatagtgctgcagtaaacatacgtgcgctttttttttatagtagaatgatttttaatcctttcggtatatacccagttacgggattactgggtcaaatggtatttctggttctagatccttgagaaatcaccacactgtcttccacaattgttgaactaatttacactcccaccaacagtgtaaaaccgttcctatttctccacatcctctccagcatctgttgtttcctgactttttaatgatcgccattctaactggcgcgagatggtatctcatggtggttttgatttgcatttctctaatgaccagtgatgatgagcttttcttcatgtgtttgttggctgcataaatgtcttcttttaagaagtgtctgttcatatcctttgcccacttttgatggggttggtttttttttttgtaagtttgtttaagttctttgtagattctagatattagccttttgtcaggtgggtagattgcaaaatataactcttgagtgtagggagtattcacattctactccatgtgaatagcatctctagaattatacaatgagcaacctatgtggccatagtgatggctctggtcaattcttatctcttaccacatatccaaccaaccatacctaattatttacatgccacatggaaaaatactttggtgcctgttctctttgcctgtaacgtaacaagcaccccacatttactaataatgactaatatatagtgagcattttctatgtacataaattattctaagagttttacatatatgatagcagttttttcaaattgatataattattgtcttcattttctaggtgaaagagacaaggaacttgcctaagttgccataacatgaaatagcagatttgggatataaattcaggtctgctttgttttaaagcctgggtatttaatgtctcacatgtcatccctcttttatgctgcctgtgtgctcttccttgacttgcgagactcagctgataaattcctcaaagctttccctgtgccttccacgctagcccaagctgcctttggtatccttcctctatatcccttaatacaagtctgttctcccaaaagtatacccagaatttagcaagctgtgtataatcagtgatttttctttattcatgtttcacttaaactatgggcttatcaagagtgagaattgtacacctattcagaacaacaacaaaggactgtatcgtattcatttcttgttcactcatgcttagcacatgctttgcacgtgaagtagttgtccaatgcatgtctaaaagaataaaatgatgaatggcttaaccacatctcagattctcaattcatggttatagcacaaaaaaatgatcatgcatgtgattttggctgtgattagaaactgggataaaattgcagccatttatcacagagatggaataagcacaatttcttattaagtacctgtggactccatacttttgcagatacactgcttctttaaacaatgctttaatcacaacatttggctgcttcaaacctgtatgtgacttgttatttcattctttatcaagtctgaatttctcagtatagatttaaagagcactgatatcatagatcaacccatagtgattttcaccttgttctaatatgtatctttgacaccaagaagaccagtcactttactctcccaacgcgctatacttataccaccattcagtctttactcagctcatactccagctcattattcttcttccattctaaacctgacttagattattaggcaaacttaaattctacttactttatagagggttccctgcctaggttagctcttggtaaagtcccttttctattgcctatgtcaaataatgtaccatatgatacaggttgagtatcccttttctgaaatgcttgagaccagaagtatttcagatttcagatttttttttcaaatcatggaatatttgcattctaattgagcatctcaaatccaaaaactcaaaacccaaaatgctccaataagcattttcttggagcatgaattttgagcatcatataagcaactcaaaacatttcaaattttagagcttttggatttcagatttttggattagggatgctcaatttgtaatattgttgactatttgcagcattgctttagttatgttagcattgtttattttttcctataaagatatgagcagatgctatgcatttctcttgtttaaaattacaagttattgtgtgcccactctgtgctaaaatctattctgcatgttttacaaatattttattatgaaaagatttgagtttccttttggttagtgataaaggagaaaatctttcaacagatgccatgagaactgattaaaataaaaagttaattttggccgggcgtggtggctcacgcctgtaatcccaacactttgggaggccaaggtgggtggatcactaggtgaggagatcaagacctattggctaacatggtgaaactctgcctctactaaaaatacaaaaaattagtgggacatggcggcatgcacctgtaatcccagctacttgggaggctgaggcgggagaatcacttgaacccaggagcagaggttacagtgagctgagatcgcaccactgcactccagcctgggcgacggagagagacttcatctcaaataaaataaaataaataaaaaaggttattttaaaccaaatttctaaaaataagtgtgattctcaaatttaacagtgatcctaataaggtatatgaacaggcgatagcataaaactagttctgtgcgtgggtgttttgtgtcactttaatattcagtatataacatgtggagaactagttttacttttccatggtatttgttggtgcctctgtgagtcacgatgttgggtctactgattctaactcatgtcaaaagacctcaactttatatttagcccaacactgccaatgtctgctgttggaaataaaggggagccaggcaaaagagtttgaatcagcacaaataattaaaattatggaccctactcataggaccatcatacataaagaataacaccccttttgcctttatttggagaatattactcaaccacttcaccatttataagaataataacaaaaatgggattttcacattatgactttaaagttgaaggatccaattgtgtcttgggaaaaaaatgaaagcatatgtatcacaagactaactgaaaacagaaatttcatttctgttcatattcagagccactttgttaacactgtgctcctgggtttggaattccctggagagaagaagttagaaagtaaaaggcaagcgttcccagtaacatttggtttaaatttgcatgcaattaaaatcttatgttatggtactaatattttttcccttttctggtttcagaaacactaggtgtttctgacacatttagtaaaagcctccttttccttatcatttctgactctttattcagatttactaaaaataagagtcaagagaaagaaaaaatgggaaagtctgcacaatgaaaaggtggtcttccttatttttcatcagttagtcaggattatttaccaagcagaggactgctctgtcatttttatactaatttaattctaaataaatatatcaaagatttctaaatgttggatttaggcatttgaaaaaggttttaaaaacagtaatttatcatttagctgcagcatgtgataagtgcaatgaacaaattttgattcatctgacattagttagaattaaattattatctagagattataaatgttgcattaatccttctttaatttaataattaagatttataagtattcacaaatatatctggaataagtaatttaaaaagtcttaaaactttaagatttgatatcaggatataaacataattctatttatttatattttccatttgatatttgatccatcctactttatgactttcttttcatcaagaaactgacccaaagacttgaggattactactaaggacttttcagggaaaataaaaacgaaataacccacaccaaacaaaaagcggcggtggtacagccataatacttcctgttccttgtagatcaatctgggacaaaggctgtctaatatttcaaattctgtggcatgtgaacaatactgtgtgcactgggcttccaaccttggcatttagaatgcatatatatgagcagaggaaaattccaacaatctatcctttctttataatcttgcagcagttccaaaagtccttagctgaaggatatatttggaaagcgctgcttgtctgctctcaccacattcaggtaaccattccagagttcttaggttccacttgagaggtaacttgctattaccatttgtgctatgtgtcataaaagggccctattattttcagcaagacccctcagcagcagttccaaaggagcagctagagatttgattatataggtctctctcctgaacacatcctttcgcatttgacatttacactggtggcggatttttatgtaacttgttagagagcagtctgaaccttagaaaggtgttagtcttcctagaaccctctggcaaaggaaaatcttttattggacttaaatgttttgagttgaaaactgtacttgtttgattggaaaacctttcagggaacagatttcgttatttttctaagctaggctgcaggaattgagccgaagatatcactaaccaaagacctgagaaccaaaggaaatgactccagtgtttaaaatccttttatttcctctgtgaacgatatctctgcaactgagatgaaccattccaactggcccccacccagactttatgggaactgagattaggaagttgtatggtcacaatagtcactgtacaaattgctttcagtttaaaaacctcaaagttcttgacaaagccataatttcttgccacattttattttttcacatgggtgactgatctgtcattcattaattaccctgccaggattcttcagttcttttagaatgatctatatatataataatttcatttgggaggaggacacagagtttgtgagaagtatgcagggtgcctgtaaaatttgtctttgcgagacaccacatattttgcccatttctgttgccttctatttgaaaaaaaatattgttgggccacagtcaagcttataaaaatgtgttcttttcctttcctaatttcattctatactttccttcttgcctagcttttccatagctgagatgaataaaatgttggatgtggtctcaaaattcaacactcctgacttcctttgacacaatcatgccctggggaaatagaatcatattcataactctctaaagcattctctgcccttgctttctctacccaggctggagaatcttattaatctttctattccttgtgcctaacacagtgcctggcatgtttgaaggcactgatttatatttaaacgtgaagtagcctagaataggaagcatataatagattggtaaaacatagagtatgtaaggaagggattattacacactttaaaaaatcagggactgttgtctgaattaaacattgttaaggatgtagcaatgacacaattctccattcttctaaaatttttagtacttccctatattcgtctctggggaatttatgtggcagaatgctctctcaccatgtttggcaacctaaagctactcagacttccttagaggtagtcgctcctctatctcaaaagctttcttgacaagaatgatttgggttggatggggattggtagtagttttctcatttaacatctgcaacacatattaaaatgaactttagtaacctgacatttagcactgaatgggatttacacatacgagttgctcaatctaatgtgatttgatccaacatttgtcaaacatgtacttttggaaaaacactgtgattgacactgaggataagaaaaaggaagcgatttatccccaaatgctcaaggggaggagagataggtgcatatatatatgtgtgataggcacatatatatatatatatatatatatatatatgataggcatacatatatatgataggcatatatatgtgtatatgataagcatatatatatgataggcatatatatataagcatatatacgataggcatatatatatatgataggcatatatatgtatatatgataggcatatatataataatatgaggataatagctaaaaataatacctaactgtcagtgagtactttatgcatgtcagattttcttctaataactccagatgtcttatttaatcctacagaggcccttcgaggtagatgtcaacgttaccagcatttcacagatgagggtaatgagccactatgttcaagatcaatcagcttccaaagtcacagagcctgatagagtccaggaagttcccaaatatatgctcttaagtactatgcagtagtgctgtaaataacatgctcttagaaagaatgaggaagtggtcaaatcgaccttaagtttggaaaaggcttaggtgaaagctgcaggaggaaggtagtatttgagctttgctctccaaaatgaatgtaagtttatctagcagggatagcaggaaaagatttacctggaaaaggaaagagcatggaaatggcagaaagttgttgaagtgcatgacattttctgatgtcttcaaagtgcagtgcttgcataaggaaacagtaagtgatataatctgaatgcaagctcgtcttatggtgaagggtcttgcatcaaggctagggtaaagagcttgttataaaggcaatggaaaccaaggagaggtttataggcagaagaaataatatggccagagtaatattttggaaagtcgattctggcaaagaatttggaatgacaaagaaggaagaaagctagatgcaggaagacaggctggaaggatgtatcctttctcttgcattcatgtgctaataatagaaagaatgactaaacactgacttaaactgtttttcacaccgcataagaaggagactgaaggtaagcaatccagagcagtagggtgactccatctagacactcagcacttggtgtgtacctttcacttcctgcctttgccttgtggttgcagagagctagtccactttagcattacatttgcagtacatgcaggaagaccaggaaggctaaagggcaaaagacaagtgccagctgagtgtgtccttgttcaaaagctttgtgcttttataattggccccaaactgtaacatggtcgtgggttcttaatacccaaatgatgttggaaatagtagtttttatacctaggcacatgccaaaacagaatgccggtagggaagagaattccgtcaaaattgatattggaattgtttatgtgagagttgaagaggacatggaccagggactttaagggtacaaaagataaagtggggacaggatttaggaatgagaatcaggaagacatggggaccaataagatgaggcaggctgggaaggggattgatcaaggaagatactgttgtttctgactttggcaactgcatctgtgatgatcgttttagccgaggtgtggagaatcaagtaagatcagtttttaccaataaaataatacatgtgattcaagatatattgagtttgatgtatttctaggacatccgatgaaaaatttggtaagttgatataaacaggcctagaggtcaggagatgacgatctgagtgtcagaataatctaaaccacagaagttgatgaaatcactaagaaaacacatagagtggcataaagcctgaagactatggagaggaagtttttttttgtttgtttttgttttttggttttgttttgttttttgagacagagtctcactctgttgcccaggctggagtgcagtggtacaatgatggcttactgtagccaagacatcccactttagcctcctgaatagcagggaacacaggtgcatgccaccatgcctaagaaggtctcactgtgttgcccaggcttgtgtctaattcctggccccaagctatcctaccacgtcagcctcctaaagtgttgggattataggcatgagctaccacacctggccaaggagaggaacttttcaagagcaagctgaaaatatcagagaaaggggagcaatatcacaaaaattaggagtaatatttttaaaatgaaatgctcaacagtatcaaataccttagaagatttaagaatgaaaggagatgttgagttagcaattaggttatcattagtgttcagtacatgttgaaacaataaatgcattaaaacatgaacttctagccaggtatggtggtgcaatcctgtaattccagcaatttgggaggttgaggcaggtggatcacttgagcccaaaagtccgagaacagcctgggcaacatagtgaaaccgatctctactaaaaataccaaaaaattatctgggtatggtggcacgtgtctgtcgcccagctacccaggaggctgagatgggagggtgacctgagcccaggaagtcaaggctgcagagcgttttggttgcgtcactgcactccagcctgggcgacacagcgagaccatgtctctaaaaaaagaaaagaaaaacatgaaattctcatctgtgtatgtgaggtgatttcatatatgtgtgtgtgtgtgtgtgtgtgtgtgtgtgtgtgtgtatatatatatattttttttttgttttttttttgaaacagagtctcgctctgttgcccaggctggagtacagtggcgcaatcttggctcactgcaagctccacctcccaggtttacgccattctcctgccttagccttcctagtattcaggactacaggtgcctgccaccacgccaggctaattgttttgtatttttagtagagacgggatttcaccttgttagccaggatggtttcgatctcctgacctcgtgatccgccttcctcggcctcccgaagtgctgggattacaggcgtgagccaccgcgcccggccctacatgatctcatattcttgcagagacagttgtctactgctactgtccactatttctattggacagtatgattttctagacctagggggaatactgggtttttgttagctgttttatcttacagaagatgttttcaataagttaagagaagaaatcatatagaagtcaaggcagatcaaaaacctattgaaagacaaaaattgtagttgtgggaaaaaaatgtcaaggaaatgggtacatactgtgagtaaagttctaagtgaagtcactgaattttctattttatttcctgttcctcagaaattctttataacctttttcttccccctaaataatcattcttgtagcttttgtaaaactgtcttatcttagggtagctaaaaaggcaaaaagtaggcctgttgtgcataagtaagagtaactcacaatgcctacattttttagataatccttacctcttatctctttctgagagcagggcattcattcacatgcacatgggtatatactgagtgaccattaggtgcctgatactgtactaagcacaggttattgggtgtagctagcacctgtattactgtcaagaactgcaactgtttgtggttaaatttggagaaatactaaaccaatatccaccctccttctgtgggcctatacccacttagaaattaatgtcttttggaaacttatagatagaacagttgttattttatgagttatcatgtcatggcattgggtacaaaactaatgcttctatttcttgttttagtcagtaaagtagccagcgccatgtgtggacatgtaaataataaaaatgccttaggaaatatacagagattttattgttaataaatgtgcatggctatctcctgatctattgtatagtaaaagaaggtcattattaaaggtgcatcctttaacagaaaagaatatgaaaacatttatgttttcaggatcaattagcaactctcttttcaccttggcaggacatgtctaaagtttaagtagccattttcatctcgtcaacacatttcataccactttctttattcattttttaaatttggtacaatattccagctcattcacagtttgcaatttgctgaaggcagaggtctacttatacactgtatgttaatatgtagcagagatgacattctaattttgtgtctcaactagcaaagtatccacttcccttataaagaattaattatgatgttcactaaaaacaaaagacaactgtagatgatagggctacttctgtgagcaaagctgttgggggcctggagtgagaagagaaatgggaagcaagtgattgaaagtggacattttatattagtaagatcgtaatgaaccatttgaaggaaagtagaatacgcagagagcaaattctgcgctttgagtgtattttcgtgttccaaaagaaaaagtaataatagcatgaactggcaatgtgacagtgaaattacaatgtcttctgttgatatctgtaacgtaagttggtacaacccttctagaaagcaatttgtccatgtttcaagccccatagatgtgttacctcagcatttacactactgcaaacttattttggtatagaaacttatccaagagaagaagaaagccatctgtagaacctaaatgaggaattatgaggactaaataaggcgagggctgtgtcagtgcagattgagggaattcaagaagggttagaaaggcacattgactccgttgggtgatggaagggacagatgtgggatgcaaggtgaagaagaggaaggagcctagaacgacctccaagcaactgtcttgattcattcattgagaaacaaaatataaaaggagcaaaaaatagaaaggtcacaaacattttgcttttgaaaacagtctgaaaaccactcagtcctatgccattctcctcagatgagggtgtggaactcagaggtcaaccaacagaactcaaatcttagttaactaattgactggcagttcttttgctgtttggtttctatctgaatgaaaaatctcctgcttggctttcacacttcctgtcaactagaccaattaggataacattaagggatagattttactatggaaatctcaagcttggacctcattttccccccaaaatagtatcaaactgccttgttattattaaaatgggagctttacgatagcattcttaagtatggtgatttttttacaccacataataacttttactgtgatttattgagtctgtggccaaaagtctgacccttctgttctaatcacagttgccagataaaatacagatgctccagttaaatttgaatttcagatacataatgaatacatttttagtacttgtttcatataagtatttttattataatgtgtcacatgcaggtattattcattgtgtatctgcaattcaaatgtaactggccatcctgtatttttatttgctaaatctggcaacctagtcccaatattaagaaggtccattcattctaatgatctagacatagcaatggtagtcaaggagccaagtgtagctactgagcacttaaatgtgcttagtccaaactgagatgtgctgtgagtgtaaaatacaaaccaagttttaaaaacctactattaaaaagcgtgcagtatcttgttaataattttaaaattgattgcatgtcaaaataataatattttttatagctagggttaaattaaatatatttaattttacctgttccttttactttctaaaaattcggatactagaaaatttgaaatatttggggcttgcactacatttctattggacagtactgattttttagatttaagggaaatactggtttttcgttagctgttttatcttgcaaaagatgttttcagtgagttaaatatacaccaacagcatagaaagtgaacaaaagttgtgcaaggtttacacaaaacaagtttagccaacataaactgagaagaaggagagtatatcttcatttcgatacatatagtttaataaacacgtagggagggtttttttagatcagaaaacacatatgcactatatacaaattaatatgaaggatgtattatgctttattcctgtgtctcagcgaaacattgaaagtgctgatttctttgtgatattaaaaatacatgtagtatttcttcatggggttccagtcataattctttggtgtttcattctattcaaggaggttaaagaatcttacagcatagacacctaatttggaaggaatctcaatgaaatacctgctaaggtcaaggttcatgtcaaaactaatattaactgttctctctgcctgtagagtgctttccacggagagtctcaagggttgttcctaactgtgttcaggtctccgctcacatgtcatctccgctcacatttaagaggccctcctctgacttattatctaaaatagcaccctgtcactctctcactcttaccctgccttattatttttttccataatactgacatcctattttatcccaccccatccttgattatattaatatttaaaattatagtaagtagtttctattatttttcatctccccagaaaagcttcatgatggcaaagttgttcactgcagtatcttcataacccacagaacttatgaaccctagttcataggcagtattgtgatcctatgagctctctgatatttcctagtacatttatcattacttgttacttaatattttgttgacatctcaaaaactgagtctttcccattttgaaaagcaggaaaatataacttctgaatatctgctcatttgctttctcgtattgggcttctgtactgagtcagacacatggtagatactgggaatacagcagtaatcctatagccaggtctccaggactcaacaagcttacattcctggaaaaatctcactgttactgggagtaaactttctttctgaactggcataccagaaaattgagtccaggatgtacaaatctgtgctaaaaattttgtttgctactttttaagtggacttgataaaatatgaagcacatgctttgtgttcagcctgttcttacctctttatgtacattccctcatttattctcactgtaacatggagtgctatcattatcttcatttttcagtagaggaaactgaagcagcgaaggcatcacttgctcaggtcatacagtcagtaagtggcagagccataatttgaatccagaaagcctaactctggaaatttttaacaaccctgatacataaggttaatgcagctgaccttgtgtatttactaaaagatagctactgttgacctcttcattgaaagtttaagatcatgagttatttaatttggtttggccatgcagtcagtttggaatgttctttatcttcatcttaacataatccagttcattttacaagacctagcatgctataaaattagcgtttagttaggaaaatggaaacacatctaggcagtttatgaagaagattgtttgcacagagaggaaaatctaagaagctaaacagtctagaggagcaatccagaggttaggataacagggaacactggcccacctagttttttgttttgttttgtttgagacagagtcttactctgtcactcaggctggagtgcagtgctgtgatctcggctcactgcaacctccacctcccgggttcaagcaattctcctgcctcagcctcccaagtagctgggattacaggcccccaccaccatgcccagctaattttttgtaattttagtagagacggggttttatcacgttggccaggctggtcctaaactcctgacctcaggtgatcggcccgcctttgcctcccacagtgctggtattacaggcatgagccactgcaccaggctaatatctaggtttcgagggatagtggaaggaagtggggttacaggaagctgctaccaatcctaggtctagaggattgtggcaggagatggggttactattaagtcagaaggtggagccatctaatgaaagctagaaccatgacagggctgccaggtgggagttggtaccaggaggaaacactgtaggagaaagaaaaaccttgacttctccttttcttcagtcttttattcgtctgccaatactacccattggccaatcctactggaatctagttgacaaaggagtctggaaaaggtagatttgcaggatacagagcatgagactggttctatagaccaacagggagttggccagcacacatgaggtgctgttttgtggagctgtcatttagaggtcctctgaatgcagaattcccatgacccttacttagtacttctcttttgcagcattgtcggtgtaacagtagtgctgagcacacagtcacttattatctactagcactgctatgagtgtcattcatatagtaacctcattaatcttacaagagccttgtgaagtaacaaaaactattatctcaatattccagatggggaaactgaagcacagtaacattttcttcaatatcacacagttagtagcaaaacctgaattcaaatccagactacctggcttcagcgtcgattctcctaaccactaccctccactgcctctcaagatttttttgtctccttcacctttctaactcactgagcacccagtagtgggcacgacgtagcaggtgctcattaaatacttgtttgaacaaaatgattttctaattttaatattatgttgtagttgcttagaatcttaaatttttatagtcacttgggtgtgttttccaaactgttctttttttttgtttttaatgtttcaaaaatcctacctcccagtctgactgttcatttttatactttttcaccttcatagctgaatgtttagtctggaaagcagcatccacagggtcaaatatccagggttatttcctggatatcttcattggacatctccaatgttacctagggaagtgatactgcaacaaaaaatacttctcattgataggaacagaaccagttatgattcttgaagccttaatattattgaggcaagcagtctttaaacagctactttctgttgtcagtctgctattgatggcttactagactttgaaagttttacatagatgatctctttttttcttttttgccttttaatagttgagacagggtctcactttgttgcccgggctggagtgcagtgacataatcatagctcactgcagcctctacctgtccagctcaagcaatcctcccacctcagcctcctgagtagctgggattacagaaatttgccacaaatccaggctaattttaaatttttttttgtagagatgaggtccccgtatgttgcccaggctggtcttgaactcctggccacaagcaatccttctagctcagcctcccaaaagtgctgagattatgggtatgagcccctgcgcccagcccataatctcttttaaatgcccagtacaaccctatgagcttcctgataaaattttccaattcacttactttgtatccttttttgttacccagttctttttccaactattaccatgtcaaatttcaagatgaagaaacaggttcatatacctcaaccagtaagtcgcagaaaggggatttgaactggtatctgtctaactacaaaacttacagaggtttcagtgaaactcaataccccataacatgaaatcatgctgtgatgagggaaatgcagcttttccttatgatgcctgagaactgatgatgcttttttatgtacacactgtacactgatttcataaaacactttaacctggaagatatgagtgactccctttacatttttttttttttttttttttttttttttggagacggagttttgctctgtctcccaggctggagcgcagtggtgcgatctcggtttaccacaatctccgcctcccggtttcaagctattctcctgcctcagcctcctgaatagctgggattacaggtgcgaaccactgcgcccagccaacttttgcattttatttatttattttttttagtagaggcagggtttcgcaatgttggccaggctggtcttgaactcctgagctcaggtgatctgccctccttggcctcacaaagtgctgggattacaggcatgagccatcacgaccagcctacattctgaaaaaatgacctcttgagaggctgggtgtggtggttaatgctgtaatcccagcactttgggaggctgaggtgggtgggttgcttgagcctagcagttttggactagccaggagaacatagtgagacattgtctctaaaaaaaattttttttaattagctggcatggtggtggcatgcatctgtggtcccagttgttcagggggctaaggcaggattgcttgagcccaggagttctagggtgcggtgagctatgatcatgggaccgcactctagtctgggctgcggagtaagacgttgtctctaaagaaagagaaaaaagacctcttcaggccacagagagcaaagtaaagcatctgaaatacatttacctttttttcctttagtgaggaaaaacattaacaaacattttaaatgtaactgggaaagaacatttaagaaattcatgcccctctcttgtattccagctttcttctagttgggttctgcatatgattgtgttattagggactatgcctttaaaaatgaaaaaataaaaataaaaaggccatggttagcctgtgagcacatttttttattctggctctggccacaagaaccaagtttgactaggctctgtatcaaaataaaatccagagaggcattcctaaacttggaccttttgtccacactcacttcctgttgaccgagtgacatcccttcagctggccctccatcaagctgtttgcacagaatagggagcagtgttttcaagggcagcaaatcttgcagcttattaaaagtagcatggtatgcaactcagatgccagttctctttcctttttgggtttccttgagtccaaaggtcaataggaacacagaaaagctcagtgtattggtttgtaattccactcccactatggctcaatagtacaatatattcagatccttgtctcattgagttcttcaatcttcaatctttgttccctaaacacaggcttgtgtgaacatgctattagctagcagggttcaatttcagtattaggggttacattcagtttcaagctcctcacagttgtctacactgggtatgaatctggaactgctgccaattttctttgagggcattttagtatcattatctcagtgcttatgctattatctctgaagtgttgttttccagcgattttctgcctctaaaaagacaggatggtttagccattttatcaatgaaatttaagcatgtagtgtcgctgactcttgtgatttccttcacttcttttgttctactacctacctgaggaaatactttaatatttccagtgagaaggcaccttaagggagtctctaaccgctcaaaatgtggtctatagagggacagcctgggcatcatctgggagcttgttgaaaatgctcaatcttaggctccagcccataagtgctgatgtagatctgaattttaataagatcccttcttgtttcacgagcaaggtaaagtttgagaagcaggggtcgggcgcggtggctcacgcctgtaatcccagcactttgggaggccgaggcaggtggatcacgaggtcaggagatcgagaacatcctggctaacacggtgaaaccccgtctctactaaaaaatacaaaaaattagccgggcgtggtggtgggtgcctgtagtcccagctactcaggaggctgaggcaggagaatggcgtgaacccgggaggcagagctttcagtgagccgagatcgcgccactgcactccagcctggacgacagagcgagactccatctcaaaaaaaaaaaaaaaaaaaaaaaaaaaaaaaaaaaaaaaaaaaaaaagtttgagaagcagtgatctggcccacatctggtcttctaagcaattctgagagggattttagagcctctttttaatactcccaataatagagatgccactggtgtaaaatttgctggacagctaaactctgcctacttataatttctacacttagtctttatttcatctctttagagcaaatggaataagtctaatatgacccatctaatatttaaagatagataacgtttcccaactcctcacctccaattcctccctctctttctctttctctctcatgtctctttcattgcctgttgcttactcttccctcacccctccctttatctcttttcatgctaagcatttattttcagccattctctgctttgcctggcttccaaacttttcaacgtgaccattcctattttattaatggactctagttaccaacttgtcagtttattatatgtgttgtaaaaaagtgcaggggctatttaaaattgtagaacagagatctactgtgctgattctgaaatatttaaaagcgttctcttggtgtctaccaggccatgatatctaggaggacccaacgagtgacaatagggtttcagacgtgattgttaggtagagtaaaaaaaaaaaaaaaaaaaaaaaaaaaaagatggaaagtagccacttaaatgagaactatgctaaatagtactaaagcttcagtactaaaatacagaattacaatttgaacttccattagctacattcactacctaatgccatgtaaacaagtaaagtcctaaagtagaatttaggccattcttttcagatctagtgcattgcactaagatgattaaattaagcttcagaatcaggaagcagttggccggaactcagatatttgtgtgaatctgggcctgaatttttgctgagcaactccataaccaggggctcagtatgtatgaggcatatcttaatttctatgtaaaagtctgctgtacacttttcatgttctgcataaatccatcatcctgaagtcctaggttatatcacttttcttaactgttggtttatatttggcaaaatgtcactcaaagaaatatcaattgataacaccactttaatttaatgtaggaatgcttcctgatttataattagacttttcacacagaaatagcagatacattggtgtgctgcacccattaacttgtcatttacattaggtatatctcataatgctatccctcccccctccccctaccccacaacaagccctggtgtgtgatgttccccttcctgtgtccaagtgttctcattgttcacatgcaacaaacctgcacattgtgcacatgtaccctagaacttaaagtataataaaaaaataaataaataaaaataaaaaataaaaagaaatagcagatataatctaaaaattcttagtgtattttttttaccctcaaatactcaagcactgcactggtgattgattgtaaagaagcataaacaaatcaggttaagtgatcaagaaatgctaaacttgttgaaacatccacaaatgcaagcaagattttttttttttttttttttttgagatatggtctctctctgtcacccaagctggagtgcaatggcatgatctaggctcactgtaacctccgcctcacaggtccaagcaattctccttcctcagcctctcaaatagctgggattacaggcgccagccaccacacccggctaatttttatatttttcgtagagatggggtttcaccatgttgaccaggctggtctcaaactcctgacctcaagtgatctgcctgccttggcctaccaaagtgctgggattacaggcttgagccactatgcctggcccacaaatgcaagcaagcttaacaaatacctttaagtgctatatgtagtactagatcttctaaaaatgtatactaaccacatcagcacacattattcaagtgtctttgatatgtcagatgttggtcacttagaatgctcctgaccttaggaatattatcaattacattttcatgatcattttatacttgtaatttctacagcattttatgcttactccagaatttgtttttaactttaggtatttttgtttagagatttaaaacctgacttttgatggagtaccatattgaaaaacatctgaaaaatttaaaaattgctttcttatattattttattttgagatggagttttactcctgttgcccaggctggagtgcaatggcgtgatctcggctcactgtaacttctgcctcccaggttcaagcgattctcctgcctcagcctcctgagtagctgggactatgggtgtgtgtcaccacacccagctaattttttttctttttttcttttttagtagagatggggtttcaccgtgttggccaggctggtctcgaactcctgacctaaggtgatccacccaccttggcctcccaaagtgctgggattacaggcataagccactgtgccaagcgaaaattgctttctagaaattgttttagtggcagaatagtcatttgctcttatgttgtcttcgagaaaaaataaaatctgtcattgatttgctgctcatattttagaattgaaaatgagtataaaaaatgtgagcttatgggagtgtatttattgatctattgtaactgttcagacaaggggataagcactttgtgatagaagacccaaaaacctaccatatttgagaggttttctcataaacaggatctaatcttccaaattgtgtctataacttctagaattatcatgaacgtagtttatggccatgggggcaaaaagggatggagagaggcaaaatttggagacagaaagaaggaaaaaaaacagatgagcacaatttgcatacacgttttataaattcataaaattttacttttttgaaaacgcatgattctgtgagaagaatttagtcttttttatactttatttaatctaaatctaaaaaagagctttctgttttaaagagagcagaaactcagatatacatagagtatatatatcccatagatattttgatttttttaaatataaaatacatttcaaatttttcatataggccattccactgggaaatagtaaaacaacatgagcactatagatgtgagtgttttggtgaggtctaaggatcaattccctaattgtgctttatctaagaatggataaagtttcattttctattctgtgaactggaagcaaaattcacaaatattacaatggtgaaattacgggattttttaagttaatggcatctatggcattgtttgtaaaattccagtagcccttcataactgcatatggataattattggaagaagaaaataaatatctgaaaaaaactgatatactacaggatagacagagaattgatttcacttcccaatactctaggtagggtggatggtatgctttattggatagtaagtaaatattttcttcattccaatatatttcattgtcctcttgagatttgcattccctctgctaggcatcccctgccgtacacactctgggaacttgttcttacacctcaaaagccttttttaccccaatactcatctaagctgacctatgtatagccggatccagagccttttccgttttaggctgtttgtctgagaaataaatgcaaaccctcttttataaaattcatatttgtgcaggaattaatcaacaccgattctgacaacagctgaaacagcacattgtaaacattccagaaaaatcaaataatataaaccaaatttagaattgtgaaatttccaccccagaaatttggatatgtggaagtaatagctaccaaagaaaatcacaatgataaaacttgatgtggactaaaaaaatacaatttgtaaaatgtgcatgaaaaataactgacccagaaaataatttccataaagtgaaatgaaaatgttttgatagcacgtatgtaaaattgataaagagatggacttggctaaatgcagttgattttggaatatactttatgaaagtgtttctgcctggcacggtggctcactcctgtaatcccagcactttgggaggctgaggcgattgaatcacaaggtcaggagttctagaccagcctggccaacatggtgaaacgccatctctactaaaaatacaaaaaaaaaaaaaaaaattagatgggcgtggtggcggctgcctgtaatcccagctactcggaaggctgaggcaggagaattgcctgaacccaggaggcagagcttgcagtgagctgagatcgcgccactacactccagcctgggtgacagtgcaagattccatctcaaaaaaaaaaaaaaagtgtttcaatgcttacataatctgatctaaaaggttttgtatccataaacatgtagttaaaatgtcccaaaaatggtgggatcagaataccctttcctctcaagagcttaatgggttattcctcccagggatacttatgtctttgcagagctcagatttgttaaatgtgagagtttaacaaagtgaaaagttaacagtgaaaattcaacagtgccatccccgaggacagtttcatccagtgaggaatggaaacttcgtattttgttaccaggagaatggtggtcaattcccttgctactcaaacgtctacaaaacaggagcatcagcatcacctgggggcttgccagacaggcagactttgtatcaaaccaagtgtactgaatcagaatctgcattttaacaagatctctagatgattcttatgtacaataaaatttgagaaggaccgttgtagtcaaatgctgtgtaagtcaggcttcaaccatgagacttacatggattgttttcatttctgtttatttcaactaatgactccatggtgatgccacccacatttatgcttgttatgagatacgtcttttattcttcatttgctcaattttttcacttcatttatgaggaaacacaaatgatatgatttgaaaagaaaaccttgtcatctctttcagagcggaattttgtagctagaatatttatagaatacgagacactgatgttccatgtgtccttgtttgcggcgtctgatgtttttgttgttaataaccgcccttcccttggtgtttgagcatctcaagtgttcttgctgaggcagcaaggaaaatgcagttctgtgcatctgcaggatgttttcctggtaatgactatgatgctaagcctctatccctctcagtatttatcaaatttggacataaacttcaggaacaaaaatagaacttggaccatgagagttaagccacatttggttaacccatttggggatcagtgtaaactgtcttttgtcacgtagcaattccctagtattttccctctttttccattacttgtacattcatctaggagcctgactgactattttggtctccagtccatttacagtgttccttggaataacagaaacggagccgttctaagtcttaggaggcttgagttagcatagtgcctgataacattgcagccattcaatacatgtcacttgtttcctctctttttttcttaatattaataactagatagtcactttgatgtactgtttaggtcttctatctttcacttatctgcacaatgaaaattagacagaaagatcattcctgatctatgtatatatgatctttcagtcttattttaatttcgcatatatatgtatatatatatatatgtatatatatatatatatatttccatagacctgttatgcatattattcatggtgctttttaagttggtacgtcctaagacaagagtcccttggactaccagttttcaacatacatttcttaggtaccattctgctttgggggaaactgagtgaacagggatcagtttcctccttgccaacactgtgcccactgtacatattatggttctttataaaattttgattggaaaaagtttccaagctcttacaaataagtgtgcaagaccagcctgcaaaacatagtaagactctgtctctacaaaaaaataaaatttaaaaaattagccaggcatggtggtgtgtgcctgtatcgtcgctactcaggaggatgaggcagggaattgcttgagcttaggagttccaggttacaatgagctatgattgtgccactgccctctagtgcggacaacgtagccagatccagtctctaaaaatagcaacaagaataattgtgagacctgattctttaagaagttaaaaaatcattagtgcaaagcaactcaaaaacactgtaatgggaagtaatgtaacacatttatgtgtgtggccttttcacttctgtgaagtgaaaaaaaatcagaaaagcatggctcctaaaatgtcttttgaatgaattaagccactggatacctatataagtagtattacttcgatttttgaatttctacatagatctttttttttaggtactgccttaaaagtttctgattacttttctctcacatgcctttatcctattttgaatttttaaagtgctatgttttatgccagtcaattatgaagttatcataaaccaaacacatttagcctaaatggtcgatagaaatttcttctttccaggttcattttaatgcagttatttttaactactattacctattaaatgccccttctgggctaggtacagtggctcatgcctgtaatcccagcactttgggaggctgaggcaggaggatcatttgtccccaggagtttgagaccagtgtgggcaacataaacaagaactcatctctgtgaaaaataaaaaaaaaattagtgaagtgtagtggcatatgcccttagtctcagctacttgggaggctgatgtgggaggatggtttgagcccaggagtttgaggctgcagtgagctgtgatcatgctattgcactccagcctgggtgacacagtgaggccctatctcaaaataaaaatagggcccggcatggtggctcacacctgtaaatcccagtgctttgggaggtttcagcaggtggatcacgaggttaggagttcaagaccagcctggccaacatggtgaaaccccatctctactaaaaatataaaaacttagtggggcatgatggcacatgcctgtagtcccaggtactctggaggccaaggcaggggaatcacttgaactcgggaggtggaggttgcagtgagccaagactgcaccactgcactccagcctgggcaacagagcgaggctccgtctctaaataaataaataaataaagccccctttggagtttatacttcactcatttcttactataaagtttaagaaaatctatttctaacctatttgttctgctgaacattaaatgccctgtgattaaaagccaagtaagtattcaccaagtgtttcttgatcaacattatgggccactccttaagtgactcctaaatccgctgcatgttcatgtccattttgttcatggaaatgtaaacacaagagtaattaaacactgtgactcaaattaagaaaggtgaccaggctgatgtctgtccttgtaacttcatgagtaaagtttcctatttatcttaggctccaacttcacataataatagcacctgccacctgtagatgcagcaatgtttctgaaggatatagtcttctttcttctcagcagtgtggggacaaaggtcacgttgcagcaacatcctgagctaagcctttactaccaactggattctactttgaaactcaatcagttatccttaaacaagaaatctgagtttctgcggaaggaaagagagtaatagccagatacgtcatgcctccaaaattggtaactgaagtggctttccctcacatttatcttggttgggtgaaacaaggtcataggtttacctcattattttaagagttatctcattttgtaattattatttaaattcatactctgtaatagggaagaaaacaataaaaatgttgtctttcttacaggcatatcacaggtgggagataatttacatctgttaaatatgataattttttcctaaaggttctttacaccttgagttagcattaagatatttaagatggcctattttagatttatagattttgttggaattagtttaaccttttggatcatgaagatatttagcagtggggatttagaataatttatatcaaatcttctagatggtgacaaattaattatactttaaataagccctgatcattcatcagccttcaagttcagttctatagctttcagcagcatagctgacatattatccactcgtgtcatatgtcatcatgcaaacttcgtgaattataactgtaacattaattggatgaaagttttcttgatgggaaagattattgattaaatggagtaatttgaagaaaataaagcccaacacaaattgagaaaagaaaaaaaaaacacagtcaacaataggatatatggtagcaactggttttatggacactgctaaactaaataccaaaggtgtattttattcctgtgaataaaactgagtgcaaataatggaggaatttagcagaaaacttacaaggtcatttacctaagggttctttatgatggaattccgttgtcagaaaaaggggttcatgagtttttaccaattttccttaggggtttttagagcaagtttgaatggaagcaataaaacgtatcatcttatatagcaaaaatatttgtgtgctagagatggtaatgactacattacaataaagattttgaaaatgtcactttgtgtttgttttcatcttgataatttgtgtgagattgtaaatgcatcattctgtaatctcattggctggattgtaaaatcatttcccattaaaagtttttcattatatgttaaactgtaatgaaactgttcaaattctttgactatggctaaaaaggagctaattgccatcaccagtaaattcattctgccttttgggtataaaattctcctgattaactttttctaccctctcaagatttctggagattcaggataatggagttttcttggatctggagtttgacaaaacctagtctacatcccagttccttcaacattctctagaagcactagttgtaaagaatttgtaagacctataaaacagatgtctatcaaatcaggcatttaagtatgagttcaatgattgagatcattgctctttttttttttttttttttttttttttttttgctggtaaatagcagttaaattgcaactgatcaagaggtattcaggatggtgagtttggactgcatggctcccttcatggactcatttataatttaaacaagtgttttattagagttatttcccatttactagttaagtgatttatttatggtctattcagagtctattaattacatacatttcagaataagtagcaaatagtcattgtaatagtttccatagtgtactaatcttactcctctttaaatttcgtctgaagttttgaatcttcacagaattagctagacatatatgttacccactacaaatgacgtctgaatctcttaacaaggatgaataaaaagacctgaaaagttagcatggtgggtactctcaaactattttgttttttatttgcatagctttcctaagtaaaaaatgtctgggaaaggcaatgccaagaatctcttggtagacaggcatgctccacacatatacagtaggagccaaacagtcatttatggtaatttcattaaatggaagcttgatatgcaagggaaaaatttttgtatgtgcatgtgactatttttcaataaccaagtaacactagtattaataacatgctaaatcagcatgtattaattttttttcagactggccaaaaaaaatttacttccaagattactgaatgaatattaagattgcttatcttgaccttccttatcactgcgtcatgtgctgcatcagttttgttattgttctttgttctgttctgatgtttactgacttggaacatatgctattataactacaccacaatctctcttctatttctctaccataaccttgcaaggggttaggcaaacttggagacgtgtcagaagaagagcttaccaacctcatatgttagccgtattgcacagcagtactgcagaaatgagctgcaaattccaagcaacatattgagtttgtgatttatttgttttccaggcaggccaattaattgttttgctgtgatgctgccctaaattgtaaatagaaagagcaagaaaatgaattgtcacattctgtgcctgtgtctcttgctacttaggatgacaaaagcagtttctgctccgactgcaagtgatattgtaaaatatgagaattaggctggacctaaatgtgttggtcagtgtgtttcagaggtgcgttttagaatggctttaaagacattgtactaagactttactaccagtaggttctggagagaatgttataagacaggaaaaaggaaaataattcttatttcatgcctatcatgtgtgctttctttcttgaaatgatggaaaatgatggcttccccatatttccaaactgattttttcaaatagatttggaatgtttattatattaataaaaataagtgtttttagatttttactaaaggggaatgaaagagaaggtaaaaaaggtaaaactgacacatgagggaaagtagtttgtcagctgaatggactattggcacattttcattagttccagtggaatttgaaatggtttgtcaggactctaactttggccctaaaggcacttggtgaaatactgttttattttacttggtaaataataagtattttaatggaagaacattttggctttcacatctgctccctcgtggcaacagcaatttgaagtcagtacatgctactgaatgccatgaactcttaagaaattaccaaaataccttaaactaaatttcttaggtgaaagttgtttcaaagaacgattgagccattgtcacaggaaccaatgcaggaggctttataaaaacacatttttggtcgggcgcggtggctcacgcctgtaatcccagcactttggcaggccgaggggggtggatcacaaggtcaggagaccgagaccatcctggctaacatggtgaaaccccgtctctactaaaaatacaaaaattagccgggcgtggcggcctgagcctttagtcccagctgctggggaggttgaggcaggagaatggcgtgaacccgggaggcggagcttgcagtgagctgtgaccgcgctactgcactccagcctgtgggaaagagcgagactccacctcaaaaaaaaaaaaaaaaagaaagaaagaaaaaaaatttgccccgataccatgactttgaatcttttccatttcatcttcacattgtgagtcatgatgaactactaatacaatatactggcaatatttaaagccttgtatttgctttttgcatatatatttaagttttgcaaaattttggaaacagggagcaaataattttatatcttggaaagtaacctgggcctgtcatattaacccactgcttatgaatggccctagggtaacatgtcattcacattcttgggcagcttgtcacatgtcacagaaagcactatagacttacattggatttgactcaagaaacatgaataaagataaatgtggataggtagaagataatcaaatactggaacatttatggtgctatcaagcacataaacacatttataaactgttttggcctctgtacaatttatgcgccctggattttcccacagaagttctgaagtaacttacaaaaaatatactttacaatgaatatgaaaaactcgaactagaaatagtaaaccaagagcactaacaggaagaggaaagagatatatacgattattgagtgcgaagtttcctggcaacccaaacaaaaaggatacaaataaggaacatcgttatccttattataactgaggaagtcccttagcagatgccaaagtttttcctggcagaaatgtctaaaagatgttcttaatttgtttaagcaagagttgcttagaagcaagtgagtttgaatttgtctggtgcttaaaaacagtgttatgggtagatttatgtttccaaattataagctttggattttctcagtattacttttataaatgccatcatattacaaagagaggataataagcatccagtgggtcactttggtagacttagtccttgtggttaatgaaggcacatgttgtcctgcaggcagtatcgtgtcaagccaacctggattcatactgagctgtgtgtcctttgtcaagttctatgacttctgtgacattccgtgatttttttatttctgtaaaataagaatgctcaattacatagttattaagattacatgataaaatatatgtaaaagagctaaggttatcacagtactgtcttaaccattaacagctaaagatgaaataaccccatttttttgcttattttcccttcttgtcactaatttcaacttatataatggaggaataacatatacaaagaatgaatataatcacagaaattataactgaagtctgggcttctgactcagttccattctgcatacactattacagctgtttgggtcttacaggaaatgagttattatggagatataggcttccaaagctaagcatctacccttttggaaacaaaatacattgtcgatgcaaaaaaataaaggtaactatttatgatgaaattcagtttcaaattggattgcagccttccttgtttttaaaggtgaatggaccaagcaaaaataaactcctttgtagcaatttagaatcatcaggttttattctgctttaatatagagcaaactctgagtactttatggtccttgaaaagttggtcctacacaagtagcctcagcgtcttgtgcatttggttatttggaggtcagtctgttccatttaccagcccttgaagcccttttacctccctccagcttattacatctaatcttctttggactcaagatcagataactaagctaactttaactgtgaataaaagaagaatcaacagaatctggtcatccaggtatcaagtacccgagtttttaatacatgaactctgagacttctctcttagttctttggagctccttttgacttttaattgctagttttcactgtgctccaaaaggtgaaatgttattctatttttccccaggagttattaaagactgacaagacatcaggagtaccccacatgcacaaagttcaacattatcaaaatttttgaatactcaaatattcagttatattcactaataattatagctctcttactaaagtttactttggattattcacagaaggtatcagtttatttcttgaagaatttgagagaaggaaatcatctttttcttggtaggtttgctcaaaggtttagcaatacttatcattcaaacactctttcttatgtctcacctaggtgcctcttggtaatattctgttgcttttttactgggtttcattcacggtaaaaatgaaagatattttaaaacaacccctaaagcattttaaattaactatttaatgtctaagttttatgtttcattttaactaccatgcacttaagtatttccttgtccataggccatacttcctagtacacataaaggggatatttttatatctcatctgttcttcaaatcaaaacagtaataagtgcttcccaaatggcaaacaaattctaaggatgtaataaactgtatacttccctgatatattatgacaacagaattttttatttttaaaatttgtttatatttctttattgcaacctttgttgaaatttccattaggcagttaatttacctcttttcatttgactctactctataaggctctgtattctatacaacatttgttaattaagaagcagtggttccacctaatatttctgatgtgtttgtaacatcctggatagtatctagaattcttctagttctctgctagctaacatatattgtttttctgatctgtgctgagctctggaatcaaggctttacatacatgatgttactatattgatatagtaactctcgaacacagattaaattataatcctcctcgtacagatgaagtaactgggtcctgagaggttaggtaacttgtatcacttagcttagtagatgtgtgagctaagattgcacccaggctgtgtggactttcccctttatgccaatactctgagtggtgctactgacacaggcctatgggtttcggttgatgtctgggagcagaaaactgctagctatacccataatatttctttcagaaagagcagtggtgatgcagctttgggctcatcgcaatttaacatagggatggatttcttcacaatttttgagttttttcgggaagtgtttccctactcccctaaattgccttattactctcatgcaaatacccgcagctaatcttgtatttgcccctgattttagggtaatgaactgagacacagaaaactacatagcccattgtgtgcctcacacggatgtgaagtggcctaaccgaatttacccttggtgtcacctgtaactgtttaagtgggtaggcctaaattttatactattaagcactaaatgaatataaaatatgactttaaatgccatctacatgtgaaaaactcccaaaaatgtattcggagctcagacttctccccagaaatgcagccacacatgcccaactgtccagttagcaattccacttaggtgaccaataggcctaacaagccaaaacccatctcacagtttttcttcccaaaccggctcttcttggaagctttcctaacttagtaaaagtcaactctgctcttccagttgcttaggcctaatgtctcaagttagcctcaaatttctttcattctttttttcattgatgcccttcccaccacagtatagcaaacaacaaagcccactggtcttaatttcaaaatacaagctgaatctcacctcatttcagcaccttcactgccacaacctcgtgtaagcgcaggtgtctgtcacctgggaccttgcagatgcctcctaaattggtgtctggcttcatcccttgcccctcttctttttcttctcaactgacaacctaaggggtcatgtcaaaatgtcattcctgtcctcaaaacaactccagtggcttcctgtctcacatagagtaatgcaaggcttatgccatggctggcaaggtcttacatcttctgtcccccacctcctctgccccttgacctcatcactttgcccccacctcacctgctctattcactgccgcagccctcagccctactgtctcctctgcttcaatgcccctccttggtgtacatgcttgctccttccctcttctaggtggttcctcaaaggggttttcctcacagtgagtcctcctcatcccaccccagctaaaggatcaaatcttgttccatttctcactatctttttccccttgaaaattatcacaaatatatgtttagcatatccccattatcagttgtctgggttcccactgtcatgtaagttctatgaaggtaaagacttctttctgcaacagaccctgtatgtccaggatgtagaacattctggaaagtggtgggttctcaaatatttgttgagagaacagtgaacaattactgggtgagattaataattcatcagaaaataataactatccccctttttgcttaaaataaatgtagaaagtgatgtcttttcatttttaatactttgcccattttttgtcccttatcctaacaagcaggtggtattattcttcacccaaaatcaagaattatcatctccaatttttttttgtttgtttgagaaagagtctcacccagtcgcctaggctggagtacaatggtgcaatctcggctcactgcaacctgcgcctcccgggatcaagcgattctcccgcctcagcctcctgagtagctgggattacaagcacttgccgtcacacctggctacttttttgtatttttgtagggacggggtttcaccatgttggccaggctggtcttgaactcctgacctcaggtgatctgcctgccttggccttccaaagtgctgggattgcaggtgtgagccaccacgcccagcccatccccaatttttaaatggaaagggatgtgacagttttctccctattaaatactcagttccctctaataagtcttgaactatttctaggttgactgacagttgtaaagtttaaataattcttcctttcttttattttaacatcacctaggggcatttatgtcaaagactagcctcttgctttttgtaaaaagatcagagaatctcttaagtaacctgtaaaatactgttcaccatccttggcaaaggtaaaatttaatagttcataagagttttcagaagcaatgcaaatatttttaaatgatttaagtttaagagaaatgataaaacatgggttatagtcactgtgggaaagaatccactgcatagcgtcccctctttgaatgagagagactttctagaaaatgggcagaggacagagaccaccacatatggggaaggaagcagagtgaaagccatgtttctctttgacctccaagagacatttccatcaagtttaggattagaggtgagtattaatatccaaagataaacctaagttctgttacacaaaccaggcaaagatttatattttctgaatgcaatttgagataaaactagaacaaataatatgaagcaagaaaaaaaaaaggccaataaaaccacaattctccatagtctttgaacagtttggattgtcttttagaaaaaaatgttctgaaaaaaatcaaatataatttgacaattcatatttacaaaataaataaaaggatcaaaaacacttagatggctgggcaaggtggctaacgcctgtaatcccagcactttgggaggctgaagctggtggattgcttgagctcaggagttccagaccagcctgggcaacatagtgagacccccatcactactaaaaatacaaaaagtagccaggtttggtggcgcaagtctgtaatcgcagctactcaggtggctgaggcaggagaattgcttgaacccaggaggtggtggttgcagtgaactgagattgtaccactgcactccagcctgggtgacagagagagactctgtctcaaaaaataaaaaataaaaaagtaaatcacttagttgattctctgctttgtcacagaaaatgtcaccgtgcattgcttaaggtgtgttctgtaacctgatcctgaaggaactataaggtacatcgtttttttcaggctcttgtctatcttctagaatagttgtaatattctttaaaatagaaaatataattattgggataattaggatataattatttgggtaataaaagtattagaaggagattggtatcaaataactgttcatcatcctattgatatttaatagtttatttttataatcattatggaaatagtgaatactttttaaagtaatgtaattatttataataataagagaattgtcaagttgtcattgcttccctaacacagtatacaaaggaagaagaaaacgctgatccaattctatcttacattgtgactttagtattccaactagattgtaaaagacaaaaggttaaagattatctactaattcagtttcacttttgctagagtttaatatcacacatgtaatgaataaagtaatagaaaggaaggacattaggggaagtctgggggaaaataatatcttagaaattacttattaattcatgttcaattaaatttgtttttcactgatgataaaatcaagttgccttcttgagaagtcttacaaatttgtttttttttaggagatgtcaacccaaaaggtcacctattttttatattaaaaactaactttggaaattttcagaaataaaagaaaagatcactaagctgagaatccaaacacttgactttattgtgaaagtaattgttaaatgttacctgtctcagtggtattctctggatttcagtgatctgcctgtagaacaaaaaggtgaggctaagtcttcatgactttatataagatttccagtaccctctaattgctaggagtcccactcgagaatatccttagataagaaaaaagaagggagtgaaatgtaaatgtgtgtgtgtgtgtgtatagttgatgatagccttttatgacaaaagaatggtctgtattagtgttcagcaaacattttctgtatatttaagaatggtgtggctgtattccaataaaattttgtttacaaaacagataacagatgggatttggcccatggctatattttgccaactcctaactatatatgctaataaaggtgttagctggtttagccctttggataggcaatattgaggccaaatcagattttatgtaagttcctagcctttgacacagcaatctcacttctagtaacttatcctaagggaatatttggacaaatacataaagatattatctgtaaggacatttattataacattatttatgacagcaacacaatgaaaagaaactaaaagcctttcaataagaaataaattatgtatattatggtttattcctacagtaagatactacatattcagtaaatgatgtcacatatttatatgtactgatgtagtataatgtccataatgcatccttaattggaaagaaataagctataaaacattaagtataatactattctggatttgatgataatctccagattatacgattagaaataatttcattttcttaaaactctatgatgtttttgtgtatactatattgcttttataactagaataaaaaaacagcaaaggtatttcaatttgggaaaaaatgtgtaacagtaagcagattattaaattatgatgaagcagatactttcaataaaatcctaaaaatctcatagccctctaaataatcttacatgttgttaatttagtttttaccatgggaattcacacccttagactatcaaagaaacaggcatttcagcgctatgttgaagacaaccatcatgacacaaattattcaaaaaagaaatagtgtgttgtatttaacattacaatttaggctcctctcagtttgtcttaagagaaaataaaagatgcttcttgccttcttgtcttttttttgttttgttttgttttttgccattgtagctactgccaattgagacattctgtagtttttctcagattcagagaagaaaatatctcacaagtttgttcatccaacattgtaatatgagttcttcagattcctagagaaagctcaaaggctgtccaaatccccacagctatggccatctctagtcttttgattttaactatacaaggaaattcttattatgaaatctttttatgaattatttttaaacattttttaacatttgtaatgttagtttttccaaggaaaactttgttgttagcagcaaatttttccagaataaaacgctgacaaaaaaatcagtaactttttaaaaaggctttatttagtgctttatatgttgctggcactgtttgatgagacgggtttgtgtgtgtgtgtgtgtgtgtgtgtgtgtgtgtgtgtgtgtgtgtttcacatgaaatatgcacatacacatttattttttatttaatttagctactttagctcatttaatcttcatgacaaccctacaaggtgcatttgcttatcataaattatcattcattttatggaacagaatgaggcatagagaggtaaagtatattgcaaaaacgtacacagctagtaggtggcagagcaggattcaagcgcctgtaggttgtggtataaacattttcctcaactgcctcacaacacttgctatgtagcctccacaactgtatgactctaactgatgggatacgtacacatgaaaaatggttaagaggccatatacagcaaaaaagtttgtgctgtacgactgcttatatgcacctaaaacaaacaaacaaaaacactggtgtgcttaccttaaaataaacttgagactttattacagttctggaagaaaaaattgtttttcacagacctgagctaaatttttgacaatgtataaacatacatgagggctagtagcacagtggggatgccttgcaagtgtaagttttgctagtctatgattgcattgggctgggatacagaaattgctacttaggaacactcaagagatgtttggtttttgagtagactcatttcaccttggaattcaaggtgttttaagagactttggcacctcttcctacctgaatcagacatagttgatgacagcaagtctataacacctgtagacatggaatctatctagaaatcttacaaaatgtcttccggtaacaacaaattatgctttatttagacatttagacctcaatattttattaagttttatcttttatattattactgtattttttagagacagggtcccactggtcacccaggctggagtgcaatagcacaatcatagctcactataacccagaactcctgggcacaaaggatcctcccatctcagcctttcaagtagctgggactacaggcacatcaccatacctggctaatttttgtagagacagggtctggcaacattgtccaggctggttttgaactcttgaccacaagtaatcctcctgcctcagcttcccaaagcactggaattatataccccctttaaattttgcagagaatttgcccttcttcatcctaaatgacattcagaaagtcatcaaattactgtgggtgacaattataattatcattcattatcactcattatcactattcaccaatacattgtaggtagtaacttgcttctcactttcagaaagatcctgagcagctgatctatcattactcttctatcaatcagttccattaagcaattggaaaataaaaaaatcctccccccgccccaccattattataagctccattaggaaagacaagaggaaagaaaatggaagtatccaatccttaatagtattatttatatttaattttttcatattgctgagggatattttctgattcaggggattcactggccataattacatgcacaaatagctaaacagactccaaatgaaaatttttaaaaatatatattttttaaggaacgacttttcatttcttagtccaagtcttcagagaatagtctgtacagatctgctaggagcagagtcaggtcatactaaattcagttgattgataagcttgtttgtggattgattttttttttttttttttttttttgacagagtctcattctgttttccaggctggagtgcagtggcacaatctcagttcacacaacctccgtcttctcatgtctcagcctcctgagtaacttggattacaggcatgcaccaccacccctggctaattattatattattagtagagacggggttttctatgttggccaaggctggtctcgcacttctgacctcaagtgatctgcccgcctcagcctcccaaactgcaatgaggattacaggtgtgagccacagcactaagacagattgaaatttttcttaggaaagaaatccatccataaaaagttaatgaaggtgaccaggcaccgtggcctgtagtcccagagcttgggaggccaaagcaggaagattgtttgagggcaggagtttgagaccagcatggacaaaacagtgagacgcttgactctacaaaatagcaataaaaaaaattagctgggcctggtggcatgcctgttggtctagctactcaggaggctcaggtgggaagatctcttgagcccaggatttcaaagttacgatgatctatgatcgtgccgttgtactctagcctgggtgacagagtgagactctgtctcttaaaaacaaacaaacaaacaaaaaacaaaacgacgttaatgaaggatgtaagtaggaatgcttataaagtttattaaaataaatatatatgatatatgattaaacataaaatactttttaaaggaaaaaaccaaaatgacaaataagaacaataacaacagtactttataagaaaaaggaaaactgtatcgaacctgaaaaccaagcaggcttctataaacttattgttgaatatcacatgctggcttccaaaaacgtcatctagtattaaagcttcaagtcaccagtgcatgtaacctctctccagtcctcaacatccaactcttcattctgcaaccacttcccagaaaagaagtcttctcagtttaccaagcaaactcttaacccaatatttctaccaccaagaatatagaaaaaacaatatgccaagcttaagaaagagaattttggccaataattgttattttcacagtaaacctaattctcaaatgtaaaaatggtaaaacagaatgcaaattattttaaatttgagcaagtcttttcttttgaataaaaaatcaccaaacaaataatcaagaaaacaaagatatgtacacaagcccaaattctccttttccctcctacttctgtttttttttttttttttttttttccatccctctccattccaccctcacatctatacttatatcttccttatggcttacttgaattttcttgctttccttttatatttttctccttcttttcccccagttctttctattgccaatatttgtgccttctttgtgtctctcagtgacatctggaattgtactggtggcagatgcaaaatttagggatgaataatatatctgtgctgtgtttacagaagaaggtgagctaggacaagactgcttttggtcctctagtcctggtcattttgggctcagaggaaaatcaaagaaaacaaatacaattggattgattttttttttttttttttctgagacggaatctcactctgtggcccaggctggagtgcagtggcatgatctcagctcactccaacctctgcctcctgggttcaagcaactctcctgtctcagcctcccgaatagttgagactataggcgcccaccaccatgtccagctaatttttgtctttttagtagagatggggtttcactttattggtcaggctggtctcgaacacctgacctcaggtgattcgctcgcttcagcctcccaaagtgctgggattacaggcatgagccaccgtggattgatttttaaaaacattaaccagaaaaaatattttaagctagcaggaatatatggaatgcttaacaaggctggcagctatgctagtgcacagagaaaaaaaaaatctaatatatggttcttggacttaaggcagtaaaatatttttttctagctttacgtgacccaacaacaaagttccctggcagatggtcatattatatactactctcttgtcctattgcttattctgtgcttgtccttgctcttatatatatataggcattaaaaaaaatgaaacaaaaacaaccaaacataaaattaatcagctctggtggtgtcagttctcatttccaaacattcactgcttctcccttgctccaaagtaaaatggaaacatctaacttgccagttgaagctctcaaatatctgatctcattcttcctttccaacattaagctccattggttctgttttagttaggacagcgtaggctttgcagcagtaacatttcagtttttttctgtgaattcaaggaacatttatttctcaccaacacaaagttgtatcagcagatactcccttccatctggtaagtcacaccgtgaagttcttaccactttgtaatgttacatttcatagggctgccagatttataaaatataggatgctcaattaaatttgaatttcaagtagacacaatgtttttagtataagtatgtcccatgcaatatttggaacatatttatataaaaagtattcattgctcatctaaagttcaatgttttagaaaaatgatttagtgtaataatagtataaaaagttttcagtattcaaatagtataatagtaaaataattcagcgtatagtgtataatatttataatgtaacataagactattatatagtttataatacagtgtaatatatagtatacagtattatagtgtaatagtgtaataattttgtataataatttttggtataaatctgtttcatgcaatatttgggacatgcttacacaaaatttttttggtgtttatctgaaatttaagtttaaatgggagcactgtgttttatctgtgaaccctgcatattttggcaagtgtatttcaaggttacagaagccaagagaataaagaaatggagcatcactgacactttatctgccttgacccggaagcagcacacatcacttctgctcacagtcctttggacagaactggtcacatggcctaagtataactgcaatgaagactgggaatgtagggcagatcatggagaagtggtgtccactaaagtctctgctacattctctctatgacatttatacatcaagagagtgattacttggcagtagagaggtctgggagttctatggacatttaaagaaagaaacaatgtctttcacgtgagatgctatcgtggagatgaaatttaagccttgatgggcaggtaggaagaagtaaaatagtgtaaaccttgtcatggaggtaagaaaggcagaacatagaaatgaagtgaacatttttctgatcacattttgattgacatatagatcttttgagatttgtccatcatctctactctcatcctattaaaaagaggatttaattttagattgacagatgatgtccttgaagatgatcaggaaacatgggagagagcattgcagattacagataaatttgtcaagagagttataatacataacaaaataagatagtaagccccaaattagatgtattcgcttatgctttcatccataaaaaccagggaagatcttgtcagatgaacaaatctgaagttcttggaagttttgggtaaatgctttaaaaattagaaaaataaaatagggataaagaaaataatcagtctcgattgtatgtaaggtcttacttgcatattcgtcataaattcagcaatttgtaagtggcaagttttcattacaggacatatgtcttgttcttattgaaatgtgagaggaataatatggaagatgctaggaaaaaacatattttactttgtgaaaaatttaaaaagtaatctgacaattcaagtgtgacgaggtatccaaatctatctttttgtttctggaaacattcagtgtaccaacataaagtaaaaggaattatcatcacagacaccttataagatgtacatgtcactttatcctgtgaacacaggccctttgctcctggaaaagaaagatagaaaggtttgccttcccattccctgctgcacacgcagtacctgctgaacctaatgttagtttgtcttagtaagatatatttgcagtcttcacaaataaaaattgttctaactcacaaatgcttaaaaaaaaagaaacactgcatgacaaatttacttcaagattaaatgcaaatttgaatcaggagtatatttcagggattaattgatggagttctgaaaatcaagtttaaaaataaaaatcttgatacaacaaaccatggcttttggaggtgaaaggaatgtttactcttgctgaagttcgttggcaaatctcctcagaacatcatgaagaaaacatatttcaggactcaggactatgttatcttgatgtttcacattcctgcctctttgggaagttgtagttattattccagagtctcgggagatttgctgtaagatctaaactgccacactctccctttttgaactagacatccatagtcagggtatgtattttaagaatgcatatctttaatgaaaacagtctttgtactctagaatcttccccgcagcctgactctgaaaatggcctggtcttcttttcatttgatttttacaatccaagaagtgttcagaggaagcgttatatttctctttaaaacacactgagcataaatttaattggtaataaaatgcatcaaccgtcttctctaagcaaaaagtgaatagcagtagtgttattccgatggtttctcattgagcttttccttcttcacaacttttattggatattgactgaagaaaagaaaattaaaaaaaatataatcacaatgctcaacacctcagaactgaagggttttgttaatccctaagacattataacaccaaatggaaatggtgaacacaaaatatatgtgttctctttgcttgttcaacttcttagggcattacactctggagttagtaaaatgtatctctaggtagtatctgggtagtaaatggtatctctaaatactatctagagatagtaaatggtagaagttcaatgaagctatatgaccctgagttagttcaaaaccttgttctgccactagctatataaccctgggtaggttaacttactactctaatctcagtttgcaacctgcgaataggcctgatagtgaatagtatcagcctcataggcagttttgagcattaagtacgttcatatctgtgaattgcttggctctttctgtgtcttgcccataagttcttagaaaacatgaaagcatattgcttttattcccaagttactaatgtgtatgttagaaacatttttcctatatatgattattttcaactttttaggttttaggcagatttagttataaatactgttttaaggtcaagtttcctgggaaacaggctacgaggcagagatttgcagttgaagtttattatggagtgtaatttggatcaacagtagtagcagagagtgaaagaatcaggaaccagcagaaggagagcctgagctgtcacaatatctcacaatcccttgatctgatgggttggaatggctcttaaggttgtcccagtttagacagaggggatcaggtctttttacacccctcacattgatgagtccttgaatgcaagatgcagctctggatgggaaggggaataatcttgggccaggtggctcttttgggctgagggtgctgcccagatggtgactcatctggcagctgacattcaccaaaacgatcaagagctggaagagtgagtgtccagtcccaaacagggcacctagtgatgcaccagtgtaccatcacatgtgcatatataatattatttgcattcattatgaatgtctcgatttgttttgtaatagatctcccaggctcagattgagaaaaacataaaacaatttttattacaataccaaaattaactggctaattaaaaaaaaaaaaaaagcattttcctaggcatttgcctccttatctcctgaaaggtacactgtgtgaattttaatgttttagcttgtcatcttttaagtgtggatacaatctctgaatttgtgagttaatgtttgaacattttataattactgtaaccttcttccaaatctagcttcctatgagccttttgttttcatttttcatggcatagatagcattataagaaaaataaggggacttttaaatgaaacttcattattccatattaagatatcaactgtatttattttttctaattaccacgttctccttcctagtatgctaatgtaccttatataggcatatttatagtaagtagtttatattagtttttatttaacttaacattacatcctaaatattttcatgtgactaatttttacaatagtaattttaatagaagcacaagagtccaatgaattgatgtgctatctattgcttaactattctcttagcctttggctttcagcctattaccaggttttgcctacaaaatcatactataagttatacattttctaactcagcaattcagttagattcactaagcagtaacagtcaatgctggctcatgctattaaaaggaggcagacataacaaacataaaacttaatctttccctcagaagtacttatgaatgaaaatgagagacttatttactataaatggaagtaaataagtatccacaaaattaaacatgaccagtgatatgctggaccagagataggagcaattatttctaattgtgcaggaagaaaagacttcatagaggaggaagattttaagctaggcttttcaggatgtgtaaaatttagacaaggaaaaaggatgatcagggcattttgagctaaaataaaagtaacagcaagataaaaggatataaaagcaatttacagatataagaaactatgagtcatctggtacgggtggcttatatgagatgaagaggtgacaggaaagaataatttagagtcatatattccaggaacttgacctccatactataaagagtttcaattcctctgtaagcaaaaatataattttttgaaccgaatagggccatgattagattagtgcttcagtagaaagatggttgcattgatatgaagcaaggtagaagacttatatccctgttagaaagatattgcccaagttcaaggaaagtttattaacttattcttttattttttgttctttccttcattcataattcatgagtatataatcaccttagcagggtgttagaccttggggctgttaagataaaaatcaatatctatttaaaattatacatttgttcaacaaatataaattgagagcctactttgtgctagatgaatgaatcagagcagaatttacttcagtcattgaccttaagttctgagtctgaatagtgcatagcatttggtgattacagaccaatgtgttagagatatgaatagaacactaaagtccttcactatgtgacatttcgcagaagagattatacagaccctctaaatgatccttcatcccaaccgttctcttcaatgaagcatctctgtttgcttatatttcccctcttgtctacaaacagaaacaaagttgaaatctggaaatccaaacttaaatgatacagtatgaaggccaagtaatccgtctgcttgaggatctagaaggaattagaatactttgagacttttcatgctgtgttgctgagtttattgaaacatttctacttttgtgagaaaacaaggtgcaagaaatcaagccatcaaaatgcaaaatagaatctcaagaaatcagaatgtttatccagtagcaaaaatctcaggaatttattgagattctgttgtgcattttaacagtgttactcctagtctaaagtggaatttggttctgtctcctgctcctcccatctgtgggttgccctcaactttgttctcactcagacatagaccaggataccatgctattgttactctatcacttaggtttcataatcatgaatcaaccaatgctccaaagaaaactgctctgagaaaagacatatttcaaaagctttttcagaactaatgtagtaatagtaattcattcttatatattacctgctacggctaaatcgaatgcttgataaaatataagaaagctcaaaccagattacatttgaaatatatcatttgggaaaacatgttttaatttgaagacacattgaaagtgattagctacattaaagatttcaaaatatgcattgtattattctgccgtatcataagtggtctatcagccacaataaagtttaaaaaaaaagcttatatccaggtaaatcatcttttgctttgaaaagacaaaattatttctcagaattattttctaattaatgtaactttatttgataggtcaaggcaggagttaactacctttctgttggtgtaattagcttcccatgtctctggaggagctaagtatatgcagataagaaaatgaacaaggtaagccgggcgcggtggctcacgcctgtaatcccagcactttgggaggccgaggcaggcggatcacgaggtcaggagatcaagaccatcctggctaacacggtgaaaccctgtctctactaaaaatataaaatgttagtcaggcgtggtggcgggcacctgtagtcccagctacatgggaggctgaggcaggagaatggcatgaacccgggaggcggaggttgcagtgagccgagatcatgccactgcactccagcctggacgacagagcaggactccgtctcaaaaaaaaaagaaaaagaaaatgaatgaacaaggtatttagagaagatactctcagtgctctgcacagatccccttgaacaacttttaggtcttctgtgagcccctccccagacttgagtgtatttctgtttccaattgctagcacctgtgactgttcttcctagggcagttcttaggttactggagctgctttgcctgcagacaaacagagccaagagcctctagaagtccaagcatctctttctttcccagcagtggctcataatgactgtctattgcctgaatatgaaagctcagctaccttgcttgggttgggataaactctgaggtatgacgtacactccacagctccctgcaaaattaggccaaaaccaccctccatgaaactttgtttgaaagtgtacccttgcttgactgcttctctttctctgtctgcttctttctgtcactcaaagtaggttttcctggaagtatttccttaataaatagctttaatataaataatttgttccagggtatgcttacagggaagtctgagaaagtatttctgcttaaaacatctttttcctgtactccacattttgcagatatgttctgagttaataaatcttttaagctgtgtaaatataccctctgagagagaagaataacaaaacagaacattcccaacaaactaaaatgaccacagatccagtaactaaaattcaacaaccagattgcctgtgtgtatgttgtttttcaaggtagccaaggcatcatgagcatctctatcaatgtcattctttccatacccaaaggagtgcaattccaagatgttgaaactgctgagaccaagctctggctggaggtctaatttccacaagtaagacgcttaggtagcaagatagaaaaggagacttagtaggagcatttgcttggaacgaaggattttaatgtgtttgattggttcagagatcagatgcagagcagaggctacaagagcaaaccactgttcaggatactcacacaaagggactgacactggagctgatctagctgcagttcagctacaaatctgattgggattttaatccagatatttagagcatacaggtggcctaaaggaaacctactaaccctgtctatttataaaaaccaagtctgggtaattttctcctaattttggataaatggtaaacaaacaaacaaaaaacatagtaccctatgaaagccatccagtagcaaaaatgaaaaggaacaatgtcctgaagacaagaggaagagcagacctctgaagattatttataacaggaaccagagaaaatttaaaagactgtttatcatacttaatctgatttaagaagtcattgcttttagtaaacaggaaaagaaagccacaaaatagacaagctgagataaagggacaacaggatgagatgaaaagaagacaggatatgaggccaaggcaacaagctgggatgaaatgggagctcacagtgagataaaggaggtgccgagggagtccagcagaaattcaaaattaaaaccattttcatgtcaattcctccatatacatacacatcccataacggcacatagaagaacagaagaaagtaataaaagatatacaggacaagtgaaggagatacaaacgaaaaattttgagtttctggaaagaaactagattaactggaacagaagtagtaattaaagatgcaattgaagaaaactgtcctaaactagggggttgaagaggaaaggggtgggggaactagcaatgcagattacaggggctgaccatgatccaggcaacattatttaaaggacaattagacatatatcctgatatttttaaattataagaaaatagattgagatgcattcagaaacaaaaaatacaagttatctataaagcaattaatatttacttggccccatagaataacttgtaacactaaatttcaaagaatgatgaagcagatttagagtagtgttcattcattcgacaaataagcttctagtgtgagcccagcattgtgttgggtactgaaaatacaataatgtaaactcttagaacctgaaatgatctgtatatggaattaaaggtaattcgtcatcacaattacataaaaggtttatgtaaaggtataagcatcacaactatttatatgctgggctctaccctgcagtttctgactcagtaggtccaggacaggtcccagtaacttgcgtttctaagttcccaggtgatgctgatgtagctagtaccagaatcacacattgagaaccactgatttgcattaacaaaaatttgcgagggaatagaacagaaatgttccactgcagtggaattattacatcattttagtcactgaaataaacagccttaaagattatttaatactgtataaaaatcacaatcacacaatattgcatagataagtcagtgtgtgagacttgacatattaagctctttacagaaagtggttaaaaaaggaagagatagctatccaatgaacaaagatagtgaggaaatccaaaaattgttgccagtgattatctctagactatatccttatagttaaatattttcatctttttactgtattttctaaataattgtgcattaattttatattgagaaaaagaaaaaaaatctccagaagacccagttcaaatattgtcttcttggtaaagctcctaccagtcccctataccattaactcaagtgccagctatgaattctgttattgcaccataaaagcattcatcaccttctttgtctttcattaaaaactaactattctaatcccagctactcaggaggctgaggcaggagagtcacttgaacctgggaggtggaggttgcagtgagctgagtttgtgccactgcaccccagcctgggtgacagaggaagactctgtctcaaaaaaaaaaaaaaaaaaaaaaaaaaaaaaaaaaaaaaaaaaacctgactattcatgttagtactttaaaagttctgaagagtctcagtttttaaaaaggcttgtttattcttgcttgttccaggattttcaaacttgtctacaaaactatataaaccatctattaatgttctgcaagtaagtggtccacacagtggagttagccaccaatttgcatttattgaatgaatgaatgaatgaatgaaatcaatgaaccaatgaatcattgcctaaaatacacagaatacctatttattaatatgtttcctagtggtgaacctaaataaagagctttctttcaaagggcattaacaattttacttgtgtttacttatgcttctcatttccaaagtactcaagatagagtgtctcctgggtgcagggcattctgacatacaaaagcatcttattttacatggtcttatgtcagccaagtgttagtgcattacatcctcacttatctcagccttcaaaaatatttaaatcacttgtcatagatgattgtgtatctacatgatcattatttaaatttaaccaagagtgataatttcatacaatatgggcaaaaaatgataataggagaatccaagcatcctcttacagaaacatacaaataccagatggagtttcctgcattttgaaagttgatgacactgtatttccaaacaaatattgtatgccaaaaataagagcccatctggaattttataattaattattttctctgccaaaaaatttcttccccactttagtggctatattccatcccattactaactcggatcatgggatttcttatggtcctttatgtttttcaggagttacatacaaatattttaaaagtatggaaatatttgataacttagcaacaaaagtaggatggaatgcaatcagatgtaaacagcatgcttcccagcacaaacatacatcaccaaagacaaatagaaacaaaagtctctgacataagggaacagtcattattaaaatttaaattcactgttattttcacgtaagggttgcaaaatgcttctcccgcaacaccgcatatacagcaagtggccccaagtagtttgttcaataacatacaatggaattaaagaatgttgtgattttgaaagagaagaagaatccgggggtgactgaaattaaagatggtcattttgttgtataaactctgttttttaaatgtctttcttttaacttttaagtgcaggaatacaagtgcaggtttgttacataggtaaacttgtgtcatgggggtgtgttgtacaaattattttgacacccagatattaagcctagtacccattagttatttttcctggttctcttctttctcccaccctccaccctctgaaaggtcccagtgtgtgttgttaccacctatgtgtccatgcgttctcatcatttagctccaacttataagtgataacatgcagtatttcattttgcattcctgtgctagtttgctgaggataatggcctccagcgtcatccatgttcctgcaaaagacaggatctcattgctttttatggctacatagtattccatggtgcctatgtaccacattttcttatccagtctatcattgatgggcatttaggttgattccatgtctttgctatcgtgaatagtgcagcagtgaacatacatgtgcatgtgtctttataatagaatgatttttattcctttggtatatacccagtaaagggattgctgggtctaatccctttagaccaaaggatacttctttagaccaaagtatttaggtctttgaggaattgtcacactgtcttccataatggctgaactaatttacactcccaccaacagtgtataaagttttcccttttttccacaaccttgccagcatctgttgtttttgttgttgttgttgttgttgttgttgttgttgttgctgagacggagtctcactctgttgcccaggctggagtgcagtggcacaatctcagctcactgcaacctctgcctcattggttcgagcaattcccctgcctcagcctcctgagtagctgggattacaggcacacgccaccacacccagctaatttttgtatttttagtagagatggggtttcaccgtgttggtcaggctggtctcaaactcctgaccttgtgatccgcccgcctcggcctcccaaagtgctaggattacaggcatgagccaccatgcctggcccttgactttttaatagtagatattctgactggtattagatggtgtggttttggtttccatttctctaacaatcagtgatattgagctttttgcatgtgatttttggccacatgtatttcttcttttgagaaatgtctgttcatgtcctttgccaactttttaatggagtcatttgtggtttttttcataaacttaagtttgtttttttagatgctggatataagacctttgttggatgcatacatatgagaaacacagtgtagtattaactgataataaagagaagcctttgtaaagttagtgttctttttaaacatgatttagttattcaactttagcatcctgtaattctaattttcagagctggaagccttagaatattagaaatccaagattttgaatgatttttgtttgtttacaacagccagacatatcccaggcaagcaatagaatttagcgtggctggatgggccctgcaataaactgatataagcatgagcaaactgaagaaaacggcagcccctactcagtgatagttaactattttcacccaggcttactgctgcccgatcttctgattgttaaagagaagctgaaaatctgattcttatctgaaatttctcaactttgaaagtacgtttcagagaattaaaatgcatttaaaaattttaaaaatagtgctgaccaaagagatcacatctgtacactggctctactacatgggccactggtctacaaggaagaaactacgatgttgattatggagtcacctgtgtcaagtgaggacttgctacctccaaggactattctaggggtctacctgaaccaaggaataacttattttcccttcgatatacttgatatatggttacttggttatcaagttccaaatatactgttagaccttttgaggatctatcttgagttgttaattgccttcagggaggatctgccggtatcacctttcctccttctccatagattgctccttgtgcatgtatcccagcctagctatatcctgctctaacccatactcactcatcataagcataggttatctttgagtagaagactaaatcaatctctaggcaaaattattgtgtgttaaaaatataattcctacaggggaagccattcttgaaatatcaacatttctagatagttttgtgtttttagcttaaagatgccacttaaagtactggaggttggagacatgtctggaagaaaagcatagaaggaaaaaaaaggcagaaagaggcaaagttatggggtttatatggttgtagatttaacgctttgatctggaaaagacagtgcaggacatggtctcctgtgattctggcctatgaattgatagataaacctctagaatagcaggtcattgtaaaagactgccttttcccagtcataatctttcttctatcccattcccaaaaaccttcctgaaaagtaacctataggtctacagaaaagaatgttattatttcataaatctgagccagaactatttccattactttgaaagatgtagaagaagaaagacacatattaacggacaaaacactctcctaaattgcttggatatttcaagctttaattctattgtcaattacctaaaatgactgtgaccagcatgggtctgttcatttattcaaccaatatttctttagtacctgccacattccagacatttctgcagtgggtaaagacactgtagagattcaacagctagctgaaacctcaaccagtttcaggcaattcttacatctttgatctttatcatcaaaaaaggagcccatagtactaattacacgggaacaaaacactttgatgtatttttcacctatttattcaattaatatttattgagggcttacattataccagttactcttctaaatacaagacaccaaaaaataactttttaaaaaaacttcctgtttccattatgtgtaaatattataattggatgtatatttaatagaaaatgttgactgggcgtggtgactcatggctataatcccagtactttgggatgccaagacaggaggaccacttggggccaggagttaaagagcagtctgggcaacatagagatactctgtctctacaaaaaattagccaggtattgtggcatgtacctgtggtttcagctcctcaggaggttgaggtgagagcatcatttgagcctggaagattgaggccgtagtgagctatggtcacaccactgctctcaacagtgtgagatgctgtcaaaaaaaaaaaaagaaaaagaaaaaagaagagaagaaaagaaagaaggaaaggtagaaagaaaagaaggaaagaaaatgtttctacatttgtgattgagtcttttaaaacatatgtatgtcacatgaaacccacctgcataatttcacattgcatatgtagctaatctatattacaataaattttttttaggccaggagcaggggctcatgcctgtaatcccagcactttgggaggccaaggtgggtggatcacctgaggtcaggagtttgagaccagcctgaccaacatagtgaaacatgtctccactaaaaatacaaaaaatacaaaaaattagctgggcatgctggtgggcacctgtaatcccagctatttgggaggctgaagcaggagaatcacttgaacctggaaggtggaggttgcagtgagccgagatcgtgctattgcgctccagcctgggcgacaagagcaaaaagttcattaaaaaaaaaaaaaaaaaatttagttctctgagactaggttaccttatgtacaaattggaagtcataatattaataaagttataggacttaaatgagataaactaggaaaagaaattagtatatagcatatagtatgtaacctttatttttattattatgtaaatattgatatgtatattttggacactggagtttggttttgtctacctcaaaccagaaggtttacactaccttgcagaaacttcgtgggagaagagttggaatatttccctccagctgtaccttatgtttcagaatagaattcatcctgctgtaatgtgtcagcttaggcaggtcagtttctttaaagacaatgccatagtttgggcttagatacaagtcaattctatcaattccaagaaaaaaaaaagaatatctttaaaaatcaatctcaaaatatttcatcgaagctgttgctgctttgcttcctagacaaggatgctttaggcagcaggagtttcctttagattttttcatcctttcctttctcctaagggcagaaattaagcattcttaggttgatctttttcttccttgtgtaattcaagaccagagggaatttcaagcttcctgttcatcagcaaaataaactgatataaaatgaagagggaaatttattctcccctcatcaccagtttaggaaaggaaagttaaattatgttccaaacgtttatcttgtatatggtatttgataagtggttgaaggagcttattgtacagtgtaaaggagagctctcaaaaacttagagggaatgagttattaatgtgttataaatgcaccataaagaaaaaacttctggcttgtgacactgtttgtgaatttttgtgtgtttgaaaacatttccaaggtcatgtttttaagggcaggacttgaaaacagtgatttcactatggaattctggcattctctaaacaggacttctttgtgagcacccttgatcttggtattttttgtctcttcaagatgagctatgagctcacctatttttgttttccttctgctgagcaatactgttcctgggctcttttgttaagtcacaataaactaggcaagcaaccaggaggtccttgacacaaagtcctttattgatctgaaaaccacactgtgctaacctcaccttaaaatcctatagcataaatctctagttcctcaaaaacagccaaagtattaacaccaaaacactagatatccttgttttcaatgcatatttgacaatttagaaaaggtagttctttatgaaaaaaattgttttctttttagttttaaacttttatgtccaacatcttccaggtctctcttgaagataaatgttttgcccttttgtgccaaagagcacaaaaatacagtcaggccaatgtcatgattgtagggttggagttgcaaatttaaaagattctatgatgctccttaaattataatataaaagtattttataataagagaggcaaggaattgtgtatcagagagttatgagaattataatgcctgaagttatatatgtgaccaaatgaaaggcttttaatttgttaggaatttgctcattcattcacttacttattgactcgttcattcaatggctagtatgagccagaatgtgtggtaagatgatatagttacaaacaaaaccattctgttctctatgatcttggcacttacagcctcttagggtaaaatataataatcatataaacaaataaaataatccacaaattatgcccactgcaatgaaggacattaacagcatgctgtgatagacactaatggaggagaagaattcagctcctgtacaatcctggggagtgagtgctccagtcaaaagcaacagcaggtgcaaaagcctcaatgtggccaaaatatagtaaagcagtagaagagtagcatgcaaattgatgtaaaaattgtgaagctctacgtaacacataggtgatgttgcctgtcctgcactgttctacatgataccttccccagtgtctccactttggtcaagattacatgtccccgttaattgcttgaattcaccctttacttacctgtccccaaatatttgttcatacttgaatgctatttctccctcatgtctaaatgttgtcattctgcaaagcaaaatgcaaaaaaaaaaaaaaaaaaaattagggaaaaagagtatacattgtgcgattcaattaatggaagattctagaaaatgccaaattcatctgtaatgacagatgcctggttgctgggggtgtgtgtggaggtggctgcaaagaggtacaaatggaatttgggggatgatgaaagagttctgtatcttgatcgttatggtggttatgcaggtggattatctgtcaaaactcaacaaactgtacactgaaatggcatttatcatatgcaagttatatcttaaataagttgattaaaaagttatagaataagaaaaacaataaaaagcttaaattcatcttctccattatctctctaataagaaataacctttctttctatcatcatggcatgtactgttcatgtgttataggtttttgtatttgtgataagcataccacatagagccctcagtgaatgtcatgatgttaaagtgactatttcttcattgggtttgcatattaccttatgagagaaatcacgtctcatttgtacttttctccccccacagcacctagcttagaatacataaaagaacctcactgagcatttggtaaatcaatagcaatatttttatatttacatcctgactggttcccaaaaaggatgagcaggaaaagaaattgatttccaggagttgataaatgaatagactgttcttggcactggagcccacatcctgtctccatatgtaaaaattggtggtagaaaagggttttcaacctaccttcttcacactcatgcttacttactgatttaatgaaatgcttgtgatggtttctgtgttctccagtaggtaaacgctatacagaccctctgcattatccttcttaatagtccattattcctctgtagagagtccagtggtagaatcagcgttgtcaagctgcaaggaggggacacaaaagtgttataggaaggtgacatttatgccccattatgagtgaaggaaaatcgaaggagcaatagtggtctattgcataactgcccctgttgggttgttatgaggagaactgtgtaaatcagccctcgtgcttatccttgagaaattctttttcccctttcctcatagcctctctctgtgcaatttttggtgttctcaactggccgattacctagaatattagcttttcaaaatatgacacagaagttcaccaattccttccaactcataacactttaaaattgcaattccaaattattcctgtaaaaatagctgatctttatgactcctaggggatttcttattttaatctgaaaccttcagaaatggttcagttttgtgaaaatgatgggggaatgtctgcccttagcagtttttgtgttcaagggcaaatcaacctctgtgcttgctaactttaattttccaagggttatgagactttaatttgattctttatccagtgtgcataaaatgttcactggaatttgcataatacatttattgtataatcattcttcacattggttacctgcttcctcaaatgaacattacttttttaaagagatgaattaatgtagggccaatttgaacttagtaactaaacagaattaaatatatctctgatgaacaaacataaaagagacagggaaggagagcagatacttgttctgaaataggctattatgagaaaatagccccagtcctgtatttttaaatattcattttgtacatataggcaggagaagaattgctgtctttaaaaatataaagatttgttatgtgaagaaaggaatacatttgtctggtttctcttagaatgtatttaaaacaaacgaattaaattaaggtgctaaatttcagcacagtctaaaaagatgagggagttggagagagaaaatgcctttggcattaggccaggtgctttaaatgcacttaaatttattcaatgcccagaaccgacatagaatttaggtagtgttattattatccttatttttggttgagtgttctgtgcctgaggactcattgctatcaaatagtggagctagtatttgaatctagactgcatgatggcaacatctgtgcctttcaactacaacagttttctctgaaatacacttatctctcatggactgccttggaagactgtgtactccctaatattagaattgtccaggtggagtttggaggagtgtttggcaaagagattgtaggaagattggaagatccaatagaggttcaagaagatgacttttaagattcccattctctctatagttttatgagagtagcaggtgcagtcctgacttgctgagtggcttgttgcagtccagggagtctcaatctttaatgtgcatatggctttcttggggatcttgtcaaaatgtacagcctgattcagtagacctagggtaggcctgaaattgtgcacttctaacaagctcccaagtgatgccaacattgcttttccacagctcacatctgagcagcaaagtagaaaacctctcaggcgaggtgcttttgatttctgcttgcagagccattttcctagtttttcaggtcttgaccgtagttgggacaattatataaaaacatcctaaactaaacagttctctaaactgtatctgaaccaccatgtcctaggatcctgaaatgctgttttccttatacaattaggatactgcctagaggagagatttcctctgtaagtcatgaacctccagcaatttaaagggacacgaaagagctgataccatcagcaagcatactaatttacaaattacatcaaaatgttcttggagacaacatatctttgttgaaaaaaaaattccactttcaacttataaataaatatgtaatcatggtacaattacatgactattcaaacttttgatatcctttttgaatcacagatctcaaattttgtctcataagattctgatatatttccaaaaatcctttgagatggatccaacttaattacaatgaaaagaaaaatgggcttccaatcccttgtatttcaagagatgggtgtttgaatttgatctaactggcttctgatatctttggcttgcaatgcatgaaagtctttttttaaaaaaaagatctttgaatgaaacaaaaaacttaggaaaaatcattctctaaagtctaggaggctttgaaagcattgcctatttccatttcattaattttaaaaatctttccaaatcttggaataaaatcagttttgcaagttaagaaacatttagctaaggcaaactgtatagctcagaaatctttcagaaagggttaggcaattggaatgctgaaaatattagattgatgggattatagagatccatatttaccgaccaagaaaagcagttgcttagggaaaaatcagatgttaaaattgtatgtataatctgatatcattttggctaaaataaggaaaacaattttattaaaaatttattatcttggatggtggcatcatagctaatttctctttgtattggctgaattactataataaaattacataacttataaaattagaaaaaatcaatagtcattttcttatttttgaaattttaatttttgtgagtacatagtatgtatatatatttatgaggtataggagatattttgttacaggcatgtaatgcataataatcactttatggaaaatgacgtatccatgccttcaagcatttatcctttgttttataagacatccaattcttttagttatttaaaaatgtacaattaaattattttgactgtagtcaccctgttgtgctatcaaatactagatattatttattctttcaaactattttttgtacccttcaaccatcctcacctccccctcatcccctgctacagttcccagcctctggtaaccatccttctactgtctatctccatgtgttcaattgttttgatttttatatccaacaaataagtgagaacctgcaatgtctgtttttctgttactggcttatttcacttaatgtaatgacctccagtttcatccatgttgttgcaaatgacaggatctcattctcttttatggctgaatagtactccattgtgtataagtaccacattttctttatccattcatctgttgatggacactgaggttgcttccaaatcttggctgttgcaaacagtgctgtaacaaacatggaaatgcagatatctcttcaatatattgattttccttcttttgggcatatactcagcaatggtatttctgtatcatatggtagctctatttttagttttttcagaaatccaaactcttctccatagtggttgtactaatttatattccctccaacagtatacaagggttggttcccttttcactacaacctctccaacatttgttattgcctgtcttttggataaaaccattttaactgggctgagatgatatctcatcatagttttgatttgcatttctctgatgatcagtgatattgagcacctttccatatgcctgtttgccatttgtatgtcacccttgaaaaatttctattaaaatattttgcccatttttggttggattattatattttttcctatacagttgtttgagctctttgtatttactgattatcaatctgtcagatgggtagtttgcaaatattttctctcattctgtgggttgattcttcactttgttcattgttttccctcactgtgcagaagctttttaacttgatgagatcccatctgtccgtttttgctttggttgcctgtgtttctccaatgttttcttttagtagtttcatagtttgaggtcttagatttaagtctttaatccattttgatatgttttttgtatatggtgagagacaggggtcaagtctcattcttctgtatatggatatctagttttcccagtaccatttattgaagagattgtccattcttcaatgtgtggctttggcacctttgtgaaaaatgagttcactgtaggtacgtagatttgcttgtagattttctattatgttccattggcctatgtgtctgtttttatgccagtaccatgctgttttggttactatagctctgtagtataatttgaagtcaggtaatgtgatttcttcagtttagttctttttgcttagaatagctttggctattcagggtctttgtgattctgtagaaactttagaattatttttgctatttctgagaagaatgtcattggtatattgatagggactgcattgaatcagtagattgttttggatagtatgcacattttaaacaatattgctatccaatatccaatccacaaacatggaatatttttaattttttttgtgtcctcttcaatttcttttatcagtgttttacagttttaattatagagatatttttcttctttgattaattcctaagtatttaattttatttttgactatagtaggtggaattactttttaaatttctttttcagattgttccctgttggcatatagaaatgctactaattttcgtatgttgatcttgtatccttcaactttactgaatgtttatcaattctgatagtatttttggtagagtcttttaagttttttcaaatatgagatcgtatcatctgcaaacgaggataatttgacttctttctttgtcatttggatgccctttatttcttccttttctgacttctctagctagaatttccagtactatgttaaataacagtggtgaatgtgaatatccttgtcatgttcttataggaaagggtttcagtttttcctcattcagtataatactagtcatgggtctgtcacatatggcttttattatgttgaggtatgctctgtctatacctagttttttgagggtttttattatgaagagatgttcaattttttcaaatgctttgtcagcatcaatcaaaatgatcatatggttgttgtccttcattttgttgatatgttgtatcacattgattgatttgtgaatattgaatcattcttgcctccaagacgtaaatcccacatggtcatgatgagtgatcatcttaatgtattgttgaattcagtttgctagtattttgttgaagatttttgtgtcaatattaatcagagatattggcctgtagttttcttttactgatgtaacttttttctcgttttggtatcaggataatactggtctcatagaatgaatttgaaattatttcctcctcccctatttttcagaattgtttgaggattggtattaattcttcttaagtgtttgatagaattcagcagtgaatctgttgggtcctgggttttccttattgggagactttttattatggattcaatctcattgttagttattggtctgtttagtctttggatttcttcataattcgatcttggtggtttgtgcatatctaggaatttattcagttccctttgattttccagtttattggcatatagttgctcacagtagccattaatgatcctttaaatttctgtgacataagttttaagagctccttattcttttttattttttcttttgagatggagtcttgttctgtcacccaggctggagtgcagtggcacaacctcagctcactgcaacctccgcctcccaggttcaagtgattctcccacctcagcctcccgactagctgggattacaggtgcttgccaccctgtttggcaaatttttatatttttagtagagatggggtttcaccatgttggccaggctggtctcaatctcccaacctctggtgatttgccttggcctcccaaagttctgggattgcaggcatgagccaccatgctcagcttcctttttcatctcttatttatttctttatttaggttgtcttccttttttttcttcattagtctggctaaaagtttgccaattttgtttatcttttcaaaaagcaaatgtttcatctatcttttgtattattttctttgtttcaaatcatttatttctactctgatcctgatttcttttcttctaactttgcgtttaaatcatacttgcatttttagttctttaagatgcatccttaggttctttatttgaattttttcttattttttgatgtaggcacttataactataaacttccctctgagtactgctttttctgtattccataggttttgatatgttatgtttccattatcatttgtttcaagaaatgtttaaattttcttcttaacatctttattgaaccactggttattcaggagcatattgtttaatctccttgtgttcatatagtttccaaaattcctcttgttgatttctagttttatttcactgtggtcagagaagatacttgatattttttccattttttaaatgttttaaggtttgttttgtgacctaacacataatctatcctagagaatgatccacatgatgaggagaaaattgtgtattctgttgtctctggatgaaatgttttgtaaatatctattaggtccatattttctatactgcagattaactctgatgtttctttgttgagtttctatctgggagatctgtccaatgctgaaagtggattattgatgtcttagctattattgtattgaggtctacctttctctttagctctaataatatttgctttatatatcagggtgctccagtgttgggtgcacatatatttagaattgttatgttcttatgctggattgacccctttatcattatgtaaggacgttctttgtctctccttgcagtttttgtcttgaaatccattttttcttatataagtgtagatacacctgctgttttttggttttcattgtcatggaatgtctttttttttccatccctttattttcagtctgtgggtctttatacgtgacgtgggtttcttgtaggcaacagattatggaatcttattttttcatccatttagccattctatgtcttttgattagagagtccatttacaatcaatgttattattgataggcagggacttattctttccgttttgctatttgttttctggttgttttgtagtcttctcttccttcttaccttcctttcagtcttccttttagtgaatgtgattttctctgacggtatgatttaatttcttgctttttattttttgtgtatccattgtgtgtttttttgatttgaggttacagtgaggcttccaaatactatcttataacctgttattttaaacagatgaaaacttaacactgattgcataagaaaacacacacacacacacacacacacacacacacacaagaaaattaataaaaaccctacactttaacttcatcccctgctttttaactttttgttatttctctttatgtcttattgtactgtctgtatcttgaaatgcaattgtagttattgtttttgattggttcatcatttagtctttccacttaagagtagtttacacaccacaattatagtgttatacaattctgtgtttttctgcatatttactattaccagtgagttttgtagcttcagatgatttcttcttgctcactaacatcttcttctttcagattgaagaacaccctttagcatttcttataaggcaggtctggtgttgataaaatccatcagctattttttcatctagaaaggtctttatttctttttcacacttgaaggatatctttgtcggatatactattcaagggtaaaagtttttttttttttctttcagtactttaaatatgtcatgccactctctcctggcctgtaaggtttctactgaaaagtctgttaccagatgtattacagctccattgtatgttgtctttttttcctcttactacttttaggatcctttctttatccttgacttttggaggtttgattattagatgccttgaggtagtcttctttgggttaaacctgcttggtgttctataactttcttgtgcttgaatgttggtacccttctctaggtttgggaagttctctgatattgtccctttgcataaactttctacacataactctttctctacctcatgttttaaggcaaataactcttatatttgcccttttgatactactttctagatcttgtcagcatgcttcattgctttctactcttttttgtcccctctgattgtgtgttttcaaataggctttcttcaagctcactaattcttctgcttgatcagttttactattgagtgactctgatgcattcttcagtatgtcatttgcatttttaaactctagaatttctgcttgattcttttaaattatttcagtttctttgttaattttttctgatagaattctgaacttttttgtctgtattatctttaattttttaaaatttcctcaaacagctattttgaatactctgtgtgaaaggtcacatgtctctgtttctccaggattagtccttcatgcattatttaattcatttggtcaggtcatgtcttcttggatgattttgatgcttgtaggtgttcataggtgtctggacattgaagagttaggtatttattgttgtgttcatggtttgggcttgtttgtgcccatccttcttgagaaggctttccaggtatttgaaaggacttaggccctcagcccaatatttctgtggtttttgcagactcatagaggtaccaccttggtggtcttgggtaagatctggaagaattctctggattaccaggcagagactcttctccttttcctttactttctcccaaacaaatggaatctctgtctttgcgctgagtcacctgaaactggaggtgtggtgatgcactgggattgacccagtgtggttcctgtggctgccatcaatgtgactgctggatcagacctgaaacctgcatagcactgagtcttgcccaaggcccactctaaccactacctggctgtcacctatgtttacaaaaaacccttggcctctacaatttacaggtggaaaatccagccaagtttgtgtccctaccttcaggatggcaagtttccccaggccccaggtgggtccagagatactgtctgggagccagggattgtagtcaaaaaccttaaaaatttgactgatgctctgttatactccagctaagctggcactcagtccacaatataaagttctttccactcttcccctttccacaggcagaggagcctctccctgtgggcactgccaccactggcccattgaggggttctgccaggccactgcccatgttcccttaaagcccagtgactcttcagtcagcttgtggtaaatgctgccaagcctgagactcacccttctgagaaattggatctcctctggcccagggcaggtccagaaatgctgtctactagcctaggcctagacttagtgaccctaagagcctgctttttgctctatgccacagtggctgaactggtacctaagacacaagacaatgtctcctttacttttccttcctctacatctcagagcccaaggcccatagcaaacaacctgggttttgctgctggttattcagggcccaatggctctttagtcagcaggttatgaatccttccaggactaggtccttcccttcaatgcagcaggttgccttttggcccagggtgtttctacaaatgtcatctgagagctagggcccagattagggggcttagtattctgcccaatgccctattctaccacggctgagctggtattcaagacacaaggctcctctttactctttgctgtctgccccttaggcagaaggaaggagacactttcattgctgtgagctgccttacttatggctgggggagggatggcacaagcattcctttagctgccccggctggtgtctccctaggtctcatgccatgccaccctagtcctctggctctgagcccagtccagcactaggagttgcatatgagttgcagtccctgtgcccttgactgcctttcagagtttacctaggtccccagagcactttggcctgtgatggcaaggcttgccaggaaacttgggtatcaactgatgagatggatgattcttctctggctaggtctggtccaaatgctccctctgtgtgtgggcattggctgagcccagtatagctttgctctccactgtggcagggcagcactgagtttaatgtaaagtcccccagttgctgtattctccctccctcaaatgcacagactctttgctgcatggctcactacctgtggtgttggaggggtggttttgatgcttcaggactgtctttcctgttctcctcaatgtctctttcaagatatgaagttaaaattaggtactgggattgctcacctgagttttggtccttgagatgatgcttttctgtgtgcagatagttgctaaaatttggtgttcctgctgggggtacaaactatgtaggtttctattctgccattttgttctatcctttatcaactatttattttaggaaaaggaatgtgtgtacaattggagagccatttacaaaatctttactacaaatgtttttgattttataatttgtgataacaggaactatacttttataactctataaacctctgggtgtccctaatacatagaatagtgagagctcgagagttagttttagttgcctttccaggtaggaccatcagaaggaatgacagagcagtttgttttgaaggtagactaaagcaccaaggtctaggtgtaagggaaattacgttttactgaattgtgttttgtttggcttgtttttgtttttaccgtgtacatttgttactctcgattgtgcatatatacatataagtgctttttttatttttaaaactctaatacttagttaaacttgtatttgatatgtcaagtgggatggagaaaagtaatctggagtataagaagatgtagaatccaccgtgtctcatagtgacagggacagtatttgaggatatttatttaaaatatttgaaataaggcctataaatgtgtgactgaagagcatattcaatcaaatatgagtataaattaggaagtgcacaattgtagttagatagaaccttttatcaaagattttgaagggggaaatcatggatggaaccctgtcccaggaaaatgctagtgtgcaaaagcacacacggctctataaggaaatttagatcaagtgacaagttggcggagggaatatacagaatgtacagtatgacaaaaacaaagaatcacaggtaatacatgcttcttttttttttttttttttttttgagacggagtctcgctctgtcgcccaggtcggactgcggactgcagtggcgcaatctcggctcactgcaagctccgcttcccgggttcacgccattctcctgcctcagcctcccgagtagctgggactacaggcgcccgccaccgcgcccggctaattttttgtatttttagtagagacggggtttcaccttgttagccaggatggtctcgatctcctgacctcatgatccacccgcctcggcctcccaaagtgctgggattacaggcgtgagccaccgcgcccggccaatacatgcttcctaaaggggttaccccatatgtagaattcacttttcttcttttctgctctgaactatttcatgtatctttccgggttgttgcccaattttattataatggtctatcctctaaagatgaataggtggtaaaaagaaggatgcttcggttgtggggaagagtaagtagggatgagtacaagcatgcttcccaggccatttgctgaaactattgagtgtgaatatggattaaagtacctgggaagaggtagggggcttgtcctccagttgatacactgaggtcattacctctattccttgtatggaggaatagtctattgttctacccatctgtaagtctagagcaagggggagggaagaatgggacagccaggaatgaaattttagttaggtttgcctatcctaaattggggctggggtttctagagctataattaaagtgttcagtcatagcccacttttgtcataattataaacttgttggaattgttttattaatatgttgggcttgctcatgcagtcaccattacacacttgtacctcctgctgttttgatggtagagacacacaggaccaacagctcaaacaagacatatattttatttgtatatttgaacactgcatgttagcaaagcaaagctttgctagatggttcccagaggttaatctgcccatttactgccaagtacgctgctccttaatctgtgcaatattataataaaataatggttggtctttggcaaatcagtaagtttctttaatctcgataaagcatagtgactgcactaagcccataaataatgattctgatactcattttgactttattcagtataaagaagcaatttctctcatttaaaaatcaattgaacatgatgaagaggaaagtgagttttgggatttgaatttgtgtttagtttaataagattttttgtgtaacataaatggaatgagaaagtgttccattttcaagtgccgtactactaaatactttgctctctaaatttgtctgtctttgtaattgttttattctgctaggaaataccattggggacctattccttttccccagtccttatttttgtcatttgtgtgcaaaatatattgagttttcccccacctggaagaaacagttgccattttaaaatactagcacttttttcccacaatttatatggtagtgattactctctatatcttgtacttaatttcaaacaaactgagagacagaaagatagactaattcatacatatatacataaatttagaatatggataattttaccatcatggcacttactgaatggaacctggctcagttgttcagctctgttgaccagagctgtacaccctaagccatacatactatacggtataaaattagttcaataatatgaagataactgtgtctatatgccatttaaacataaactccactgcatttaaatttatttatcaactctactagacaataaactctttgtcaagaaaagccatgttagagtttttttttccttacagcatctggcactatcttccttgtatgtagtagatgcttagtaaatttaataatataataataataataataataataataaaaggaagatctcattgtggttcaaaaatgtcactaataataggcaaattcttgttccaaaagctgatgtcttattttagtatttctggcacacaaatttcagaatgcttaggcaattaaactggaatatgaggggactccagtggagcaacctgttttctgtatagtggatattgttacccatgttattttactctgtttgctaagtgtctgaggctgcaaccctccctgttcaggcagtccatatgtggcttcttttctgtatcaactccctgcattttatatttttaagacatttgaaagcataggtgattcagactataatggcttagaatttttctcacagtaagctcttttgtctctggcttttgcttttcagcaggaactatcttttgcctttattttttcacaaatctaaggtagaccatatggctatcatattggttcccctgtggtatcccggctttactataatgatcactcacagtaaatggatacaaaagaagatactgaagaaatgagtaggttttcttgttgttttaaaagaaaagttgcaataaatatatcaatgctgttatttcattatcttctgtgatcacataatgcaaagaactaggaaatccaataaggaaagatagtcagcaataactgaatagtttagggatacagtagaaatacagcagaaatacagaggtatggaggcagtctaagtgccatcagacttccaggcagcctgcaaaccacccctctctccctgcaactcagtcatcctattctgagcccagacaacagccacagagtattgctaagcccaaatggaaggtggggaaggatttatggaaaggtgattcattgttaacatcttcaactgttaaacttaagtagaatttcagctgaatgtatatataattcttagcccaaatgtttgctttttctgtttagaaatcacatttgactcacggttggattgtctttggaagaatttgggtgctacaccaagccatctgtgtttcaagcgagattttatgacagtcattctgaagaggtggaacaatacaaatgtgaaatttagtgtgcagttacactctgagagcaagtctccttggctcactgttgatggccctgcaaatctaaagcaggagttctagttttatcattactttcccccaatacaccccaacacacacacataaagaacaatcccaatgttggtaaataaataagcagtttaaatagagaacttaaggagcccacagcaacacagaagtataaaataagcttttgaagatggtaaagaaacatttaatgaaatttcaaatggattgtcacgcagtggttcaactgaatggcaaaggtctcagggaagatgttgccagcaaatgcactaaaggaaacaaataagaaccatctggacactactattctttgtagaattccattatagatagatagatagatagatagatagatagatagatagatagatacacacacacatacatacagttttttctctacagtcaccaggcttgtagtgcaataaaaatagcaaaactttaaattaacacacagggtttaaaacatttcaggaaagcattgattatatctgccaatggaatgagtgtatttggcaaatgacctaattatcacagagctggttctttctcattgctctacttcccgctaattgcagaactgctggccttctccccctgacaaggaagaaaaacaaggacaggagtgtgtggagaaaacagtgacattcagttttaattcatttgaacctgctgccaagcttaattatgtaattgagagagtgagacgggtgggcttacagccacttgggccagagtttctgatggttagcatttgccagtgttgtgttgaggattttagcagttaccggaaagcattattagctgaagctgaactaatctcccttacccttctcctcaccagatgtaggtacagaggttgctgttcccagacttgattatttgtcattaaggaaaacaaattgaaagcaaattaaagtggctttattccttgctaaatccatcattattctttaggggcagtctcctatttcattttgctttcttctgattgtgatgtagtatctgctgtcatgtaaaactcagtaatgcaatgtttatttctagaatgggagtatttttcagggttacttgagacatttttacataaacttctattgtaactagtgaaagtgtgtatatatgaaaaacacataatttggtgagatatttctgatttggtagcttatcccctatttttaattttatttatgaagcctttatcccccttggcttggaaccatcaatacagatattttgtacaaaagggccaacctctctctcctcgctggcagaatgactctttataagtacgcttttttcaaagtttagccagaacatccctgattcagagaactctcagggtgtctcctaccctcacagaaatgtcctccgttcagattgaagtttagtcctggaggtcaacatcttgattttgtaatatcctgtgtaccatgtgggggtggaaaggaggagaagaagccagagagaaggcacgctagactaaagggtgggagccataaaataagaggctgcctgctgggtggcagcatggctgaaacagaaccatgaccacttagcattatgtgttctttatagcccaacagtattaatagacacttttatcagttaatccccatcataattccatgaagtaagttaacattttttaaacgtgctttccatttattttcacaaatatttattaagcataggctagatgttaggtacagtcccagtacctggggtaatacaatgaaacaacacctggtaatggagagtgctcttttttcttccaggtacaatgggtgaaggggaggatccttgtctggcgaagggcaacactttcatgaagtttctagatacgcccacccttctactctctcaggaatgttattctataaattatccacttgtcctcctgtagttttaatctattttctgcttgatctttcctatcaatattcaacattcaaaaatgccaagaacagtatctgtcctgtagaaagtggtcaataatgatttgttgaataatttacatgaatactcagcagtttcctaccctagcttcacactggaatcaggtgggaaatagacacacacacacacacagacaaccatagcatctcctatcttaaagcaaacaaacagaaacaactcagttgaccttagatcccctgctagctaaatctgtttcttaattcttcttcccagccaagataactgcaaagaggcctgtaaatcctcctcctcatcttgctcatactcttcaactactccagcagacttcaatccccatcacttgcctaaagcaaatcatgatagtgacatcatgtttctaaagacactgggcatcttgaagctatcttcttgctcaaactctcagtagcatttcacataattgatctctccctcctcagaatactttcttaccttggatttgagacatctgattcccttttcatttccttcttcctctctgactctccagctttctttgcagtcttttcttcttatgtaatgcctaaatgctgaagttgtttgagttctaatcctggacctatttcttttatacttactctgggcatttttgactatttcctattaataacatctatatctttgtgctgttgtcctcctatatttccaatttcatctccatttctgagcaccaaactaatatatccagctgcgatttgacatttctatttagatgtctcgggcatttctgactcaacatgtctcagaccaataattagattttccttctcccctgctggttcttccttgagtcttcccatttcaataaattacatatccactcacccagtggcttatggcaaaaacaaaaccaaccaaacaaacaaaaccagtggtaatccttgtctatgtctttatgtcttccttctttccagttcagtcaatccatttacaaagccctgttaattctgcctccaaaatataactcaaagcatccatttcaccctatttcattgccagctgcctttcctctggaatgttgcaatagcccctaagtcatctcctgatcccattctagcttcccagctcccccgcaacattgcaatctcaatttaaaaatgcagatcatttcacaccactgcttctttaaaactttcaatagtgaacaatcaaaaattaaaatctatattatatgctgtcatttactttcaaggaagatctgcaattttgtaattatatattcatttgtatggttatttgttcttatccatctcccaactcaactattagttgcatgcatgggaactgaggttttctcccaccactatataccctttgcttagtgcagtgcctgaaatagaactttattattgaatgaataaataagccgatgaacggatgaggaagattggccaacgtgtaaggtacaaggtggttcccatgtcaatctcatcttaactcatcaactgctccattgacaaatgtacgattaaatgagctcaattaaattatcttatatggaattgttttattccatgccatttaaggaattttcaagaattgagtcctttctctgatgggcttcagaggctactagcatagtttacaacgtagggatataaagcaattcatggtatggtgtatttgaaaggacacatgcagactttacttcaaatcctggatctgctcaatgagtggcttgtgattcttgtcaagttggatcaccttaccctaacctcagtttcttcatgtgtataatggcacgaagccagtagtacctgatgttattatgacttcaccaagtgccaatgtgtcaactacctagcacagcaaccgacatgtgagagatgacatccagattatagttttgctttcttctccccttgaccctatttcttgactattacttccactttttttttctatcttactcatcttactgggtagtaatacttacattacccatttagtttgattttgtagggagagaagaattagcagtacttacagaacaggcttccttttggattagaaatacaaacttcacagcttctctgcccagcttttcaagagcattttacagtacactgctgtgtaacaagttcattttacgataacatgctgggagggagaaaaagaagacgagattcgaggggaaaaaattaaaaagttaattaaaagaaacaacttcgtaattggattcccttgcactcttctttggttattttggggtgagaggaggtgtcacagtacacctccttagtaggttagtaggtttgcttcagtggctcacctcaaaacttctaaatgagataagtataagaatacagatgattccctgcctgacagatgagaagaagtataggatacatatggtgagcttgttaagcatgccaaacaaagctgtccttatactcactcttgagcatttatatttcaaaatattcttggcagttaacattactgttaggctaagccttggactattagctagcttaaggacatacaaaatggacttttcattgatgccgttttactatttctttgctttcaccatatatagacatccacacaagcacacaatcagaatagcataggaaactcatatacccttttcagactgtacactagaaacaaataagcaacatagtatttcttatttttaaaagaaacatgaatatttatgtatttaatcattctttttcacagatctgtacgagtcaaaataatttaagatgctatcattgagatagacaagataatggaagagcatgggcttagtaatcaaatggaactaggttttaaaccctctcatccacaatatttacttattcatgaagtcaacatgtatttattgaatgcctactgtgtgccaagcactactgcagttgctgataaccttttgcgagttcttatcatggtttttgttaacatcaatatttgaggttttgaaaattaactttagggagagaattttctatattttccagcactttgtgtacctcacttttgccataatccatgaagaaagaacacggttaaacagtctattatcttactcaccaaattaggttaaattgggttactgattctacacccaatctccaaaacaatggctagaaaataagagttactattttatgtctagagacattatgatgttatctctcccaaagcattaaggaccactaatctaagagcctaatgttcaaccagggtaatatgtcagaagaaatgaatgcaagtctatctgtaaacttgtacttcatcagtgaagatagagattcagctttttgtgaatattaacaaggggattttgtgttttcacaggttatggttttgtagattttgacagtcctgcagccgcacagaaagcggtagcatctctcaaggcaaatggcgtgcaggcacagatggctaaggtaagattgatgtttaggggtgttttttttttttttttttttttgtgtgtgtgtgtgtgtgtgtgtgtgtgtgaaagagagagagagagatcaggaggaaggaagaaggagagattaaatatttctcctttgctctgagctcactcaaacgtggagtttgcaacaatttggtttatattttcttgttagggaaagtaagaaactccacattaggtttggcttaggagaatctgtctggcttatttcattgtttctttgcctatatttattattgtatcttttgttatggtaacctcattagagacttaaggacactcgtgaagtgctctgttctgcttgagaaagatggggtgtgtctgtgtgtatgtgtcttggacttctactggtaaacagttttagagtagtagaattatcagcaacttgtctttgataaactgtgtgctaaaaaaagtgtgtgttctcttagctggggagagctgattgttgaatgatggggttgtctgatctgtgcagggaaatgagtttaactgaagtgtaccgtgtctgtactgctagaatttcactttggcctttatatgtagagttttctaagatacttttaggtattaataattttcaataattaagtatcattaaatagaatatgtattctagaaccttctacctgaaactgtaatgtattttattatctaagaaaataagttaaattatttacaatccttttgtgtcctgattgcagtggtggttacaagaatctatacctgataaagtaacgtagaactatatatacatattgcgccaatgtcagttccctggttttgatataatcatataaaatgtaaaatttgtagaaacctcatgaagggtacataggctctctctgtactatctttgcaatgtcttataaatctataaatatttctagctaaaaagtcaaaacaattgtttataacatggatgcttattagatgtctgctttaaaatgatggccatttaggatttattcacctgcatcctaagtctttaaatattctttctgattgataatagtgaacttatttatctctagattctataaattttaggtggaatggccaacagaccttgaaatcctgatctaatgtattcatgctctgctcgtgtatacatttaagtattcccataagagttgagtgatagaatgataaggtagtcagattttcagttatttagattttgttgagattgctaacattatttgataacattttccaattttgacctcaaataactagaggtaagatatttggtttcttcatcttcagttgtcttctagtgaactgatacagaccatatctgttaaccttttgttgcaagtcacttcccatatagattactttggtgaactcattgtcctttatgacacatgactagttgttcaaggcagaataaatttgaattctttcagctgtgtaatgtattcttcatcaagattatgcctagaagctttggatttttttcatggactaagattgatgaagttagcatttttaattaataaggaaattatatacatgtcttggtttaaaggttacttggcaaagagtcaatggcattaagtagtgacttcctatacccacaaaacaaatgatgaaatgtagctgttaggtatatgtaaaataagtaacttgaatctggactgaaagtaacacctacttccaagaaaatgaatagaaaaatgcttaacgaaaaagttgttattggaatttcttgatctattccattggtaaactcccaaatctggaagttagcagattgtagcactttagaagtaatgaaaacagcatgcataatctccaccatttcaaatgtcctcagaatatgtatagttagttgttagataaaaaccactgccatcttgtgtaacaggaaaagaaagttgacactgattttataactactggggaaccattatgaatattttccctcagtttcccagcattctgctgcactgagaatccctctttctctctctctcttacccactcccccgcaccctctgactctttcattctctctctctaatcactgatatctcacctagtcagaaggctatttgatttggggaaatattttaaagacctcctaaaacgattatttttcctagccagcattttggccattggctcacgcccactgtacaaaaaatgagattccaattggaatgtttaaagtcacttttatttctgtagtctgctcaaagattttaccttattaattctgctgcctgtgaagttaattcttattctcttagctttagactcatatctgcctactggaaaactttcagcaatgaatgactctgtaatttaactatctataagaaaataaataggctccctttgagaataaaataggacaagcttgaccaccactgtattagcagatttctcactgagctattggatttcatggcattttcctcctttgtcctggtgataactattatttattatcatataaacctgcagtctgctgggtgtgtgaaacttgcactatatttttggccatttaagtatctactgaatcacctcttgcatccttgttcttatcaatatcctactatgcaggttgtggtgtcacatttagtgactccagcattttaaaataaaaatattaccaacactctagtttcccaatagtaaccttcagctaacataaaactctccaagtgaattgtcttatttagctagcttattccagtgtgtgcatatggaaaatccaactgatttgtcaaccaatagcaagttacccaggaagtggtaattgattaataatgaattaccattaacggagatgaacatttttctgtatacttactgttctgccacaaaggagtttatttatttttttttggtatcaaaagtcatgtttcttttaggaaatcagattcagaatattttagtaatacatagtggttaggagcatagatttggagagaagtaaacttggccttgaatcctggctctggtaccacctggctgtgtgaccttggctaagttacttaaatatctctgaacttctctaataataactcttaggttagagaactgctgtgagaattttaaaaaatacattaagtatttagcatagagcctagatcatagtaagaatttagtaaatgttagttattcaataaatattgttatacatttaattcaaatttgctactaaaccttctataaatcataatacatgttttaaatgtgttattccaaattattttctttaaaatatataataagtagcatcagtcagcaaacattttttattgcctactctgtctaggcagggtactgaatattggagaatgaagattgaataaaaaattctttttttttctgaatgtttaacacttattctatctcctgaattgctacagctccagactatgaattttggctgttactgttcttggcaacttcaggatatagagaaaaaacttattggccaaggaatatgtgtctctataagcatgaaaaaaagtgaagaaatccctgctaacaataagttaacttgcagatatttattttactcagtaggaagaaggccatagatagacagcagaggccaattctttggggtgccatcaaggatcaaggcagctctgccatcttttatccctggcttttatgtcacacatttataagatggcttctaaagttccagctcttgtatccacagttaatccaggaaaaagagaaaaaagcaaatagatgaaggagcagtatggctgattttgtccttttaaaggtttttccagaatctcaaatcagcaatttgtgcttacaactcaaaagccaaaactgagtcatatgatttcccgctttcttgtaagagagtatgaaatgatgagtgtttcgacttctttgcctctgcaagcagagaaaattaataatagtccatccccttggctatccagcatccatgacatcaataaaggtgacatgcatacatacattttaggtggcatgcattaattctttcccaaaaagaacccacctcaaagctgtgattgcatctggtgactcggttatctccaacaggcccatggctcctcctcatagctcagcaagtcatacctttaaaagagaagttatctgtctgaattcccgcaatgtagaatgacatagaaacaacaggatacatgcacttaaaggaaaatgactatttaggaaaggagaaaatgggaagcaagcctaaattattgatctcaaatacatatcaaatcctgctaggtggaaatagaattcttgagttgtcagtgcaataagttccttggttatccaatcacataacccctgattctgtcatccagagggatcttacttgccccttattctctgtggcctcattgaggcctcgctggagaactgcacagctttggaggcttttcctggatatatttagaaacactagaatgggtctacatattaaacagtcatgaattattaccagccagtccttgagtaatctcaggcttaacagacatctttcttatttgctttctgtcgattccaaatatgagtaaacacagtatatcttattctagaggaaatgtccgcagaaaagaagtcactccctctcagggccttcagataagacttcatcaggtgtactaccagactgccattacagttcccaaaggtgattcatttccagtgggatttgtagagtaaatctcagttaagcaatcacaaaagagactaagtgtcccagaggatgtcaagtagcttgaaaggcataatgtaaaaatattatatctaccatggcagaaaaccagattgagaccagaggaaaggacttcacttataaatcaatgaccttgacagtagttgtcttcgaaaaaaaaataaaaaaaaccagtggattttttacttgacatataaaaagatgaaaagtcaaaatcaaggaatatacaaaagaaaatattttaaattcaaacacacatacacacacacacacacacaatgaatttacaaaatatatcaccacagtgaagccatatcagttatattccagtagaagacttttagttaattaaggaagggtgtataatttacaagaaaaaaccaaacaacctcataaaaaaagtgggtgaaggatatgaacagacacttctcaaaagaagacttttatgcagccaacagacacatgaaaaaatgctcattatcactggccatcagagaaatgcaaatcaaaaccacagtgagataccatctcacaccagttagaatggcaattattaaaaagtcaggaaacaacaggtgctggagaggatgtggagaaataggaactcttttacactgttggtgagactgtaaactagttcaaccattgtggcagacagtgtggtgattcctcaaggatctagaaatagaaataccatttgacccagtgatcccattactgggtatatacccaaaggattataaatcatgctgctatgaagacacatgcacacatatctttattgcggcactattcataatagcaaagacttggaaccaacccaaatgtccatcgatgatagactggattaagaaaatatggcacatatacaccatggaatactatgcagccataaaaaaggatgagttcatgtcctttgtagggacatggatgaagctggaaaccatcattctcagcaaactatcgcaaggacaaaaaaccaaacaccgcatgttctcactcataggtgggaattgaacaatgagaacacttggacacaggaaggggaacatcacacactggggcctgtcatgggattgggggaggggggaggggggagggaaagcattaggatatatagctaatgtaaatgacgagttaatgggtgcaacacacgaacatggcacatgtatacatatgtaacaaacctgcacgttgtgcacatgtaccctagaacttaaagtataataaaaaaaggaagggtgtattcaatagaatattctagaccattttaccaaagtgcaactattggcctcataatgtggcttgtctaccaaagctactcttctgaatgcacaggtatatgacaggcattgtcagccacactcctgtagtataagatcgtattagtagtttttgtttttatcattcctaggtaaagcagaagaaacaggctatttgctatttattggtcactacagtgggatggagcctcctggtaaacatagaggcttctcaagggctccctatgtaggaaggaaagaggcattgttccagggtaacttgagcaggcgattcgagagttgtttcctgagactgggtgggaaacaatcaatactttatatagtgatggacaagggctatctggggatgctaatgttcctagaataatgtccatgtctttttgtttgtttgttttgcaataagatcaaaggatcagaaatccctatatgctatcatttgtttgtatcccatttttcccccatggggacaagggctgtaggctcaaactgaagcaggaatctctcattctcctactttcgcaacacatttatgttgaacacctgctatccacaaggattgttctacatgctacagacatagcactgagccaaacaaagtttcatgaagttcacatagggtattacaaaaagtaactgttatacaaagagatataatttattagattgtaacaattggtttgaagaaaattaaaaccagttacagttacaaaataggagatggagatggtggttaaataggatatggagatggtagtattttaggtacaatggtcaggaaaagcctttctaatcacgtgacatttgaacatgtatctaaaagaaatgagaggagaaaactatacttatatttaagcaatagttatgaaaaatttctatagtaatttaaaatagaccagactctttagtgagatagcatctttgggttttattattgtctatatcctgcatcttcataacaatagaagagttgcataaactaccatcatttccccccttttttgtgggagttgtctggtttcaagtcatcctaatattgcactgtttggaatttttttttcatgtgagtcaaattctaattgatcagtaaatttttatttcaacacttaccttcttcaaatcgtgttgttctattgttgtaccagtgggtgtaagaatatgacaagacaccttcctctacagttgtggaatgcactttaaataactgtgattccaaagaaaatcattctgatgttgcttttaacatagttcattactcttgaatgactgatgcaatgtaatgtaaaccttgctctatctcatttcctaaaatgaatatttgtatcatttgctcctgtgggatacatcttcaacagacagatctctctaaaaatatataagtattatttttctcatgattgaaaattttaaaattttctgtaaaagaaatacttactggctggtcttttacatgtctataaaatatttgtgaatatctgctttgttggctatgtcaatttggctcagtttttttcctgatccaaatgctgaatgcagggattcaaaactcaatattgaaattgtcagggttgatcttaatcctattcattaattatttgaagtttttgaagcagactcatctaaagttaaatatttgtattagcttatatcgaatgatttccataatctgcctgtgggtactaccctctgcttttgcaaggactctactatgtcatcttaagtgaaacagtgcatatgtatactagtaaaattctctgctttcctagcattggacaaaaacaaaaatcaacaaaagaattgcctcagtgtcttaaactgggatccctactagttgactaggcacttagttactgaaggatatgtgtggaattcaagttcttttcaacctataagaaatatcggccaggtgcagtggctcacgcctgtaatcccagcactttgggaggccgaggcaggaggatcacaaggtcaggatttcaagaccagcctggccaacatagtgaaatcctgtctctactaaaaatacaaaaaaattagctgggcgtggtggtggggacctgtaatcccagctactcgggaggctgaggcaggagaatcacttcaacccgggaggtggaggttgcagtgaaccaagatcgcaccattgcactccagcctgggcgacagtgtaagagtcagtctaaaaaaaaaaaaaaaaaagaaaagaaagaaagaaaagaaacatcaacactttcaaactttcatcctgcctctttgaagagaatgtgtccacaagctgatctgagtcaattactcatttctggatgtactgttgagaaaaccaaataatgaatagtcttcattcatggctttaataatttgttcttaaagttgaaaggaaaaggtattttctctaaacaccattgttgtccatggggtgtgcctaactaaaagtactgctttgtcccacgtagattctgatcccactgaaaaagacaaagaagtatgtcaaaataagaaaactattggttgtatgactgctggtgttacattaggaaaatgtgacttaggtttgtgaggaaaatgaatctttcaatagcgaatgtcaaaatttggtttagccattcagtcacagggagtgccggacaaccatgtgtctccccacccatggatgagatctttacttcttatgatactaggaggaaatagtgaatgtgctctctattggcagttagatcccaaggacaagggagagagcaatgagccacgcttgctgagctcttgctctcaaactcacaagaccggtgagttattatttctcccatttggaagtattatgtaagtggacaagtaagagaaggaccaggagtgttacaccactatctttccataagaaagtagaagcaatggaagctttcctggacccaactatgtaaccaactataattggctttcctgctttcctggccccaacttttaaccaactataattgctttctgcattttatttttatactgtactctaaaaatgattggatgaattggaatggtggaattatataatatatgaattatgctaaatggttgaacattttaacactgagaaaactacagactaccgaggttcacggtccaccttctgtttctgtgtaatttacttctggtgtgctctgagatgctcttcaagtcctttaactatatctattctgcaaaaaggcaaggagacagacaaacggatgcagggaataaaggagattatttcttgaacatcagccttaatgctggtgaataggttaagtgcttttataattattatctcatttaattcttactagggtccttggaggtaggtattattattccaattgtacaggtgaaaaaataggagatgtcccacattcactaagatagtcaagtggtcttgaacccaagcctttctggttccaaagccttattctttccaaggagatcataagtctgttaatgctgttttctagtctcttcagcggagcttggcttttgaatttctgaaacggaataacagactggataaaattattaaatcagtgaactgcagaatctattagagtccctgatatacatagtggggcttcatgaatctttgtggaattaatgaatatgggaatgaacaaatgaataatcagtactggttatattttaatggttttcaattctgataaatttttgtgacctcaaactgaattttgcacagaaatagtcctttaattcactatcctaatgaattattcagaacctaattcctgagctcacaaacaatggttcaatttaatccttctaactattgactggtggaatgggacaagatggacatctttgtttcttcagaaaatagatgacaagaatttggaaatgaagaccaataactcttatattttagaagtcttaaagaaattgggtatacacttgcatatatttacatgtgtatgcacacatatacattcccaaaatacatgtttttttaaagatgtttaattatcacaggtagctataatttttccatggaataacacaataactaaaacatgtttgatagttcctcagcacatctgacttttattgaaagtgaaacctaaagataagtaataaacaaacttgaatgataggcctctgtgatctctggttttgtgtgcatgctatatttattacactatgatgtgtatcacttggacacttgtgagagctgttcacaaatgcatacagtggacacacaaaaacaaaacagaaatgtgagtgttgtgaaaaagaaggcagcatactcagtttaatcctcttttcccaccgtgtccaggacacactttttaactgctatttgaatgacttaaccacaccgtgaaacttagagtctgctggctaaatcagtgggagttgacattccaacatctgtaagcacattaactccttcttcatatctaagaagtattccaaacttaagagaatattcaactttagaaaatggtaaaattcaaaacaaaaccagactttttttccctattgaaatggatttttttttcacttttctgtgaaaggacattagcaatatcatacctttctataaaggaaataaagttttaaatgacgcaatattaagagctcattttttcatactcatgaattacttttagcctaaggatccatttggaaattatattcacatatcaaagataaactgtcttccctggtgttcatatttaaggtaactgaacaaagttgcttgatgagaccagcacaaaatgaattttactcttttctgattcaaaggtaaatttcttgtaagatgatagacattactgaaatcatcaccgttaaaaaatataaatcacactccatgagaagaatgacatattacttgtggacgaacacttaccagtgtattgttagatatctggtttcggaaatatccatagttagacattaatgtaagaaatgtcactaccttataaagacacaatatcaaacaaagttaagtttattggataccagaatgcagcacacagaagtctgtgttttaaattcccagaaaatattgatttgctaatgtaacatcattaaaactgtgtacccagcttctggctttatatattcccgaggaagccactcccaatttccccatgaaatatgcaaaaatacagtaaagaatgatcaacaactacccttgaaagaccaaggttaataggcaacggatttccagaaagactcaaggattttataattactgagacaatcttagagcaaaattgagattcttaatatctctttagtctatacttaattattttatacaaaagtcctgtttttcttattctctctcccttacttaacttctagaagataagattacacacaaacacacaaacaaatacatatcaaccatatcatattgtcaaatataggcatctgatattgcattcattcctgctgagtatgattcatttgaggaggtgccttcatcatcttttttatttttctcttcttctgtctccccacctccgtctaagagccatcagatcagagtctctaagagcacaatctgagaatgtgtattttaaaaacatttctcctataatacctaatgcttaactgtattttttataaacttagatttttttttaaaaggaacaaaaacctacaaggaggaagccagcttcagtgcaaattcagtagggcaaaatgaagaaacattaagctaaggagcaaagagaactaagtgaagtgaagtattagaaagaataaaaattgtgcagtaacagaactaaattccatattggtgatagtcggggcagaattgacaccacagaaaatcaaattaatgtcttaaagaactgattaaagaagctttcccagtatgcaggaaaataaaggtcaaattatcaaaagaatgagagaaaacatggcaagcatggtgggcagagagtggagattttttttttttttggtaaagctactatttgataacataatagggtatctgtagccaataataactttattatacattttaaaataaagaatataattagattgtttgtaacttgaagcgtaaatgcttgaggggatggataccccattctccatgatgtgcttatttcacactgcatgcctgtatcacagtatctcatgttctctgtaaatatataatcctactatgcacccacataaactttaaaaaaaaaagataaatctaaaaaaagaaaatagaaaaaaaagtgagtggcggtctaacataacagtgagtacatcatccagaagaagaaataagaatagctgaaacagaagcaataagcagatacataaactaaagacatctttccagagatgacatatcctttcatggagattgaaaggactgaccacattccaatcaacatgaaaagacacacgtccacaggtgtgtaggcttattagaaacgtaactaaatttaaaaataaaaatgtacaaacattcatgtagcagggaggcttggttaactaaaaaggaacaaaacctagctcttcgtatatattcaatatagggttaaaactcagaaaaggatagaataatgattgctgattatggaagatatgatcacagaattgtatactcagacttctgcgtgaagcacagaaagactctccatttgaagtgcaaaaactgatcttaatccataaagtattcacccaaatcaggaaatatactaaaagacaaatatagtaaacaaaaaaagatgtaagcatacaagtcacatatgaaaatccacattataaatcatcataaatattactagtagtaaaataaatgtaaataaaaaaccaagatactatttttactatcaaatgtacactagttaaaacaaatagagtaatgatattttgataaagttacgaattgttgtggaaatgtgaattggtttgacttttctgaaaattatttttagtgtttgagctgttaatttccttctagaaacccaccttaaaatcaaaggtgcagaatgccaatatttgcacgtttgtcccttcaaacctcatgctgaaattcgatccccgtgttggagctggggcctagttggaggtgtttgggtcataaaggtagatccctcatgaatggcttggtgctctcctaacagtaataaatgagatcttgctctattagttcccacaaaagttggctattaaaaaaagcctgccactttgaccttctctcttgccgtgttatctttgcacagtctggcttccctttgctttctgtcttgagtggaggcaacctgaggatctcaccagatgcccagtcttccagccagcagggtcattagctaaataagcctcttttttaaaaatataagttatgcagcctcacgtatttcttttaagcaacacaaaactgactaagacacagatcacactcagttgtagcatgagttgtaaatggtaaaaatttgagcaacataaagtagccaaaaataatcctgctcgacaaagtctctgcagtgtagtagcttgaaaattatggcaaagccatcaactgctgccacttaaatagcattttttgaaagcatattcaatcttagggaaaaatggtcatagtaaaagtcatactaaaattctgtaggtagggaagtggggtcatttttttcttcaataatcatatctgtgttttccacctctctagaatgaacattggtcactatgtaatgtaaaaatgacaatatcataataaaaaagataataaatgtgatctataaaaagttacctagctgattattcagaaaccaaacctgtcacatagcatgtactggttaatggattgtcagagcatgaacagtgatggaaccctgttgatcaaatgctgaggcaaatcagcctctttaattaggtactgattgtgacaattgagttcatcctaataaaatagcataacatacaatatatatttattacttattttacataataaagatgtataaatatataagtacatataaatatatgaaaattatttacacaatgctatgtttcttgagcacatattatttaggaaatgtaattgtgatgtttgctaataaccatcacagaaactatgaaattcatataattctttatgctgaatctaagtaataaaagtgtatatgtcatcttcgaaattatgaaattggggggccctcctactctatttagtaagctgttaggttctaaaggatgtctaagataatgaataacattacttataaaggtttgaaacttttcaaatggtctccatatagagacagacttttgggctggaagagagcataaagaaatactcagtatgatgaagtgatatgccaaggtcaaatgatgaacactatgcattctaaaaattaaaggacttgtgtttgccttaataaaatattgccaataatcctcgagtattaaaaaacagactaccctcctattttactgttctaatgtttcactgtgcaaataatttctaattgtaaacaaagttgtcacactatcttgcacattaaataaaccattaattagaatactgtgagggacaaaatgctctggtcacttaagtatttaattcagactctcagtcttttttgtttgatgatgtactttttaatttatgccttgaagtcaccaagataaaacagaagaggagacagtggtgacatttgcttatgagtgagcataggctgtgaggtcttgagtagagttaagagggaccatatgtattccttccccaccttgggaactctgattagccagaaagcagcatttgtagattagaaatgaagaaaatgacaattgtcattcatttggacacagtctgatctctaaataaatcccttaatgctgtgtgggagtttcctggtgattagttctgtttcatactcctcttgctgcgggcaactgagtcctccaaattttaatagagttttgccagcataattgcacggtacactgacacaagttagtttttcttttttacacattttccttcacttgaactttctggccattttccacatgcatttgacagaagaattacaaatatagagtgttattatatcttagatggaggaaatggtccatggacccatgtctgaaacgttcagtcttggcaatcaaggctctcacctcagcatttgctgggacacaggaaaccagctaatggctgataacgtccaggaaattagtaacttgtgcatatggtaaatgctccaatcccagccaaatgatttgtttaactgatggctggagttctcatagggactgttagcacagtggaatagttgggttttattaactggactatgtgctaatccttgttgttccctagttgaagaatgtaaccataatgcaaaatacaatgggaaattgtatatccagaaagtaaagatgttaaaggcaccaacattctatactccaaaagaactgattttttttgcgtcaacattattagtatcacaattttcttacaactattatcttagttcagaattctataaaatgaattatgcatacctttttgttatggtaaagacattaaatacaatgtcactttgcttaacatcttattcctatctgttaattttgttagggacagtgatgattataacctattgcttgcattcattgattttctacagagtatccagatatcaggacagccttgtgctttcacatgttgtctccctcaggcccaaggtcaagtggcagttccttgggaaaatcttactgacacccaattctaggtcacgttcccctttttatctgttctcatagaaccttcttcattatcatagggtttatgtgacaatttgtaatttaaattttgtacgggagactattggattactgttgcttttccagactagagtataaaatataaatgcaaagatcataactgttaccactcccactgtatatcttctgaaccaaccacagtgcctatccagcaagtagcaagtaataatacttgttgaatgaaataactccatgtggtagtcgttaatgtcccagttttacaaatgaaataattaaagctcaaagagcctaatttattaaaatcatacagccaactggatgtcaatatcctatctcatgtctaactccaaaaccattaatgtattagagctctttctttttaattgagtaggacaaagaaagaaagtactgcaaaattcatatttccttttataacaaggttgaaaccttatctgtgcaatcttttagaacactggttctcaactagaggcattttgcccaccatagaggacatttggcaatgtttggagacatttgtggttctcttgactgagaggaaaattaatattggcatccactgacactatatgatgcatgccagagcccctccacacttcattggtcagttcagctacctccctcttttgtttcctttctttctagcttcctttattgattcattcagcataaagcatatgcatagactgcttagtgtatagaaaaccaataacaagtaagatacaattccagacctgaggaaacttatggtttataggaaagtgcagataagtaagtaggtaattattacccatggtaaagagctacctagaggtgtacattcaactggccactatgttaatactgaagctaacacctgaaccactgctttagagccctggttctcaactacaatatctataaacatttgtagtggtcacaattagggcacaagttgctttagagccctggttctcaactgcaacatctataaacatttatggtggtcacaactagggcacaagttgctactggcatctgttcggtgggtagaagccaggatgctgctaatcatactgcaatgcattaaatagtgtctcatttttgctacaataaagaattattcggtctaaaatatcaataatgtcaaggttgagaaacgctattttggaataataaaaccagatcattgtggttttgccattgcattttaaaaaatcaatcttaattttcttgctctccataattattttttacatattgtaactagcaatataattgtgagtgtataatatttcatcttataagtgacaagaaactatatgattacttattggaaacaccatttttaatatctttaatgacatgtcatactaacatttgtagtttattgtacctcctttcttttaaacttctatcatagtccaaccttaagcctttgtgacacttctattttttaagtttagtccttggatgctattccttttggaggcagaatccaggcctggtgcctcatcatccttcctatagagttctgcacatggtgggctctcggatttttattgaatgtctcaaagcaagttaattctccttcagaggctaggcaactaaatgtcgtgggaaagaagaatccaactgactaaaatagatatcatgctacagtacctgcaaatgagctcagatattaaatttttgatcactaaaaattccttcaattagagttggaaaccatatatgattatgcttctggataatttgcaatggatgttcaatttttctttcaggaaacagctctgttcctttagtttttaatatctatcactcagtagatcttagcagttagtgatcattagttttcctccagggatagactactagaagagtggaaatttggttggcatttgtctaccagcatatctttttaatggggttagagcatgatagcaattaaaccttaggtgctttgagatatcttttggcatattggatatgttgacatcctcctccaaaataaagcaaaaataaatcttataatgactttcttttctttattcatacactacaactttctcatagcttgttttgtaacttgcattgaatattatggttccattccttctttgtatatttcaagcataatatttatattctccttatatttttgtaaattgtttatcctcctttgcttttcctcctttgaaatacaatctgaaaacaagttatggattaaaggaagccactgtgcagactaaaaattcttaaactgaagaaaaaatgaaacattttacgattgtttaggtattataggcattgactggctagtaaaaaggtcaatgcaccagcagaaggttgtatacgctgttaacaaaggcaattcctcatgaaatgttgtacatttcaatatatagaatcatattgaataatactatggaaattcctttgagttttccagaattttaaatgaagtaaatttatacgctttctatgttgctcttaatatcgatgatcccagattattgtgtagattagggaaccacctacatactttctgtacttcatggtagatcctggtagaaaaagaaatgaggttgagagtgaatgcagatagcaagggttatccaaaagaatatagaaaaagtagaaatggaagataatgtaatattatttcataagttgatgaacttgtgaggataaaaatgaatttcagttatgcttgactttggcagttcagattctacaaggcggggaacagtacagctttgggacccttttttaatattctccctaagttgactttagtgggtggatttagtataccatgtcaagaatgctagtactgatgatttgtgtccttttgtactaatgttgctaacatgttcattgcacttccaagaagatcgtcacaactatttagaacctggtcagatatagcagtttgaccttagtatgtggttttcttgcattttcccctctttctggctttgttaagacatgaaacaaggtagtttttttttttttttctaactccttggaagtgtatatatatcttatgagttataccatcctagctttggtgaaactcacagtttacagtttgacctttcttagtaagtaggagttttgctgaatcatactccagtactgtgaggttgcagattgtctattccttaagtctttaggttgcttaatgataaattaaataggggatggctgtcttttctcactcctagattttattcaccacacactcagtggtgtaataacaatcccttcgcattgtcatatgattgatgtttaaagaccctattatttggaacctgattcccatcaaggtttatgcaaatatttatggatcactacttggcttacaggatgctagacattctgacatggtcacttgtataccaaaagattttactgacaaacatttcaagtgtgtttgacttattttgaacatcaacataaaatttactggatcccagaggatttcaataacaaatagaatttggaatcagagctggagttggacacattttgctcatgtcattagaatcttcctcagacttctcagactctctttgtataaagcatccatgagaagctgtcatgtctaatttcttataataagtagggtcaatttcatgagcagaacatatgactgtattttatatatgcaatataaaatcacaaccagacataagtggacatgggaaaaaaaacagcaaccagattaaacattcacagctgtttctgagtttttctgtattgttcctttactatttgtttattcattcttttatcttctagtgctcacttgcagacaaatgttgcccatgccaatgtttcagaaaatacatgagataaaacatagaaaaaattctatccatcaatgtgctatttttttctttgaattgaaaatttttccattgtattaatttagagtgaaatttttctcatgtaaagcattctataatatgcaatacaaacaacaggcaaactatgccagataaattaataaataaaataatctgacagagaaaaaagtactgtttgcttcacagtttcactaaacctaaatattctattaaagtcagtgtatggagtatgctggaaaatggcaaacattctgtgtgggtttcagaattgctgtattgggtacattttaaatatttggttatcatgtcaagttattacacattttagatatttatgattattgagatttcaataataagctattaaatattttatttaaagttccattctattttttgttgccttagtcccattgggctgttatagtaaaatgccatagactaggtagcttataaacaacagaaatttatttctcagagttttggaggctgggaagtccaagatcaaggtgctgacagattcagtgtctgttgagggcctggttcctgtctcaaatggagccttccagctgtgtcctcacactgtggaaggggcaaacaagttctgtgcctattttataaggatattattcccatatatgagggttctgcctttatgatctaatgattcccaaaaggccccaccacccaatatcatcatttttggagttactatttcaaaataagcattttggggggatgcaacattcagaccatagcagctgtacaattggcaaaaggattgcctgtttttaaatctctgaatttgattttttttcccaaatacctttactagaaagaaaatttaaacattttacatttttactttacatggagaaaattcatgtcttgctctgttgtaagtttcatattattctctgtttaaagttcccaatcagaacatattacaacaaaatctaaccaattaattaattgttttcactatcttgatcataaattttgtatattcctttacaatattaattctttgctgctagtcttaagaaaaaaataagctttgtggaaaaagataggtatatgcatattttgtgtatattttgcctttactatagaatttatgaaacatacacaaaagcagagaaaatagtgtaatttacatggtacgagaaatctcaacatgcccatcatccagcttcaacatttattctactatgaatcttatttcatccaactattttaccactttctcactcttcaagaatacattatattattttataatatttatagataaaataatatgtctgtctatatcccagacatcatattatttcacctatatatattttaccatttgcctctaccagccaagaattggtatgtattcatcatccagattgaggtatttttttaaagcagcattaacttttgtggaagtatcgtaataagacggaatattctgagttaaaatcaaacaaatctttccaattaaataattgagaattagctagaaaaatgacttaaaacttagtgtaataaagctagtagaatattaaagataaggcataacacatttcttcttacattcttagtttcattgtgatataaggattagttatatgctgcttaaagtcaagattatacaattacacagaaaatgttccaagctaatcccttggggttgattttggctgatagtctattatttagatgaccaaagatgacagaatatacttcttaatttacatgaattactcatctaagttttatacatagtttaacacatgctgcatgcatgtattaaactgcatgaacgagctgagatgagagaagaatatagtcaaggtaaaaatgaggagctagatacattcaccaaaactgcttagggaaagtatagcttaatttaccctttaactagaatagctgagagggcaagagatccaaatagtccctgagtgaatgcagaaactgaatgtgcttaatggcatatttttgtgtgtaaatacgtctctcttctgtgctccttgtttgcattagggagaatagtagggggaggcagaagtcttctcttatgttaatagaaagtgtggtttatgtattccttataaatttcattcatattctttatgggcagcattcactgcagaatgttggatgagtggagtgcttacttctcactatctgaatgttgtagaactagttatttttatttccaaactgttgtggactgatgcttttataaaatataataaaaataaattaccagaaaaataaaataaaggaaaacaaagatatagacataaaactcatctatcaaatgaatataaaagtttctaaatgcttactctgcatttctgtccctgtttcttctgagacaggttaacgaacactttaagtgaagatgacacttaatgtagtactggtccagactgttgatccatatgtagaggtgacaactgcagtattggactggcagtatggcactgtcaatgaccaggaagcacagacctcaatgaaagaactgatgaaagggtcctgggtgccctcttatctatcctaggttttaactggattgtacagtgattctgggcatcctaagggaggagtcaggtgaatgaggcagtccagaagacacttggtagggggagggttcagtcagcagctgttttccaacaggtatgggtggaagtatttcactatgtaaacaaccagcataaccatacacaaataatactagtgcctatcagtggagaatctgtactgctgtcatctctacatttatagatactggagaacagggagcctcttgttgcctctgtgcctggcaaaaggcctgatacatggtagatgctgagtaaatatttgttgagttgatgggtgactgattgaaagaggtttgtagaaggaattcttcccttttaaaatttgtattaaactgtgataattcagacactcaaataaggtgtgtatatgtcagtgtcaggatgtgcagagcttcctttctaatcagatgcaaggggattcgtgcacaaaaagggaaacagattattattgaacccatgtccaagtcaaagaattattaatatacatttgctttgaggtgcacgtagagcttttctgttcatttgacctaatcctatttgcatgtatgctgctaaaacatttcagccttttctcataagtagaaacattaattttaaaaatcaattttactttgaattaaagcctattctaaaataagttccctttaaatctttattctaaatattttagatgacttattttttatttgaggacaaatatccagggagatatggggtattaactgatgaaagatgatacaagataaatgtggaccctgtcgtgaatacaggtacactctagaatgaatatgacagattaatgtacaaacatcagctagaaacagtagcaaactaatgtaaggctaaatacctacaagaaataaattttatgcagtagtcaccataatttgtcatgttctttctcaagtccaggcctatggataagactgactctcaccaccctctgttacccaccttgatgaagtaacacaaagtcatttttcagatgtctgtgtagatgccacttcttgcaggaccattttgagggacagtgcctccacccatattcacttatcgccccttctttgagccttccttgatcctttctagcttcttgtaattagcctgtcaaaggccttaaagcatttttgcattgactctttccttctgatctctcccacactgttagcctcataactgctatgcaggaactgaaataatagataccaacagaaagatacatagtagattgtggatctgttaatgagccttcaaaaaactgaatggtcttatttaattcctagaaaacactcgctggtctcattcttgctgaccccagctgtgaatagagcatgacaccatatttttgaaggagaagtacttctgtaagagagtcatgcattctggtataattttacacatatatttttaaaatgacacaagcattaatgtatctacacacatattttctaccacagatccctgacctttctgcctttccttaagggaaaaaaaaaatcatccttcttcttatacagttaatgggatttgtcaagtctttggtgcagacatgtcttatttcctgagtaatgagatacttccatttgtggtagggcatcttgttctgccccaaatgagatatgccaagccaaacatgaattagaatgctgaacattatgtcttgtgtgtttgtcaggtgtgtgatctatttctgaaaacccaaatgcagttcaatgacatattttactatttgtgaactttaccttctgttaatatgattgaagcaactggaaatggaaattgtcagggcaatttaacaaagaagccctgtaaaacttattaaagtccaggtagtaaaaatccgtttagaaggcatattcttcaaacctgagttttatttggtaaaacacgttggtgcctgacctttccagaaacataccaaaaaggagtcatttagaggtccctgttgtaaattgtaaacagcagcctgatcaaattcggctgtattctgctcacagtatatgacagaatgtatgagtacaccaaacagacagctaaatgactgggtatttggatgagtttgatgtgtattttatgtaattgcatactgtacaaagcaataaaaagtcaatcttgtatgccagaaaaaaatgcaggtattgagtgagtcaaagaatcttcataagttcgtaattcaagttaatctttcaatggataaagccagagggcaggagctccgtattcatagacaattttaaaaattctgtagtcaaggtttcagggtagaagaccagaattgttgcacattttgtatattaaaacatatttttaggaaatacatttccaatgttaaaaaaaaactaaaagtttttagagtgtgaaatacaaagttaaacttcattcctcatccatctccagaggtgatcaatgttatcaggtctcatatgtggatccagacactttctgtatttatccaaacacaaatgtatcctccccaatgtacatatattaatggtagtacagtataacggttatgaatgcaaggcctacagtctaattcctgggtctcacccaccggctgtgtgatcttaagtatgttactgaacctcccaactcctcaatttttttgtttgtaatgaagaaaattataatatctatgtcatagggttgctgtgagaatctagcttagaagagcaccgactttactgaagaagtattcgaccaaagttaactattgattgttattatgaataacaacataatattcatttaaatcaagagaataagcatatatatgtaaatagtgattgcacatatatatattttcatatttatacaaatgtatacctgtagatactggtctgcaacttgccttttgacatatatcttggacatgttgtcatgctactatatataaaggtttatttgtaatcactatacagaatcttagtttatagatatgtcataatttaattatgagccctgtattaatgaatatcaatttttcccaatcctctgcttcatgtgaaatgttttagtagcatctttgtttgtacatgactgtgcttttataaaactgtatgtgtaggataaatgcatagaggtgggtctaagggaatatgcctttacattattggtggttaatgacaaacattctacaaaatttgtgctaagtttttcttctaccaccaagatgaaaaagtagccatgtaagggagatgttttgagaactgctcctttaaggccctttttagaataaatggttatgaatgaagcaccaagatagaagaggccactatggagtttatgaaatcaggcttaattagtaacacatgattgcttttgcctttttggccagtagtcacacatcataaaccaaagcttcagtggagaattatattccaaacatacaacttcattaaagtcggaaagaaatattacaaatgacaattttcacaaccttaatatgctattttaaaattgcataggtatcatattagtcttataattattgtaattaatttttaaggacatgaaataaggaatttggatcaagcttagcttatttcatgttcttctctatctgccttgccttattagcaccagggctgcattcgtgtgtgtatgacagagctccatgctcagtagggtcccacacatgaacaatgcttcattgttttcatcttgaaatacttaataatttttttaatgtaataatactgcaatgaacatgagagtgcatctttaacatactgatttcatttcctttggatatatacccagtggtgagattgccggatcatatgttagttctgtttttaattttttgaggaatctccatactattttccataatggctgtcctaattgacattctccctaaccatgtgcaggtgttcttttttctgcacatcctctccaacacttgttatcgctcatctttttgatgacatgatcatcacatgaatgctttttgatggaccctcatgttcattttgcaatgggtcacacaattttcctatagccagtcctgatgagcaataattacatttcctactaattagcctggctcagttgaaacacagaatatttgtttgtcttttgagaaatgccttgtggttgtgctcatactttatgataaaatagcattatttaaaatatatggaatatcagcaaaggagtgtcactcaatccaaaatatataagaagctcaaacaactcaatagtaagaaaataaataatcaattgaaaaatgggaaaaggacctgaataggcatttctcaaaagaagacacataaatggccaacaggtatattaaaaaaatgctcaacatcactaatcaccagagaagtgaaaattaaaatcataatgtgatatcacctcatacctgtcagaatggctattctgcaagttttggagagaatgtgaagaaaaaagaaccctgtacactactggtagaaaagtaaattagtacaatctttatggaaaacattataaagattttttgaaaaattaaaaattgaactaccatgtgatccagcaatcccgctgctgagtatatatctaaaggaaataaaatcagtatgtgaaagagataactgctcatgttcgttgcagcattattcccaatagccaagatacagaatcaacctaaatgttcatcaatggatgaatggataaagaaaatgcagtgtatatacacagtggaatactattcagccttaaaaaagaaaggaatcttgtaatttgcaacatggatgaacctggaggacaatacattaagtgaaataagccaggcacagaaaaacaaatactgcatgatctcacttatatgtggaatcagaaaaagcataagagcagagagtagaatgatggtcgcaaaaggctgaaggagggtggacaggaattagaaaggcggtggtcaaagaacgcaaaattttattgacaagagaaataagttctagttatctattgtacaacatgatgattattgttaataacaatttattatatacttgaaaattgctggaagagtagatttgaaatgttctcaccacaaaatgataaatatgtgaggcaatgcatatattaattagctttgtttagccattccacaatgtatacatattatgaaacaaaaataaaataaaaatttattaagttgatacaataaatcaatgggagaaggatggactatttagcacgggaacaactggttgaaaactgtagaaaaattaaattaaatttgctaatagccttatctcatatatcagtataaattctagcttgttaaagagataaatataaaataaatatgtgagatctctggaaactatgttttcaaagtgtgtcagtcaaataatacagagctgtgagaaaataattgtggatgagacttgatatagatctattttaaagggatcctattctgtgaaaaatcaaaatgacttgcatttacgtaactgtttactctataagggagtagtagaatatcactatacataaatgagtttattttcccactcaaagtgttaggccaaatgagaagttgctcattttctactgatgatgtatgctttagagatctaattatccaattattccaatttgaaaaacaaaactgaagctcagggaaatgtaatgatttgtgttcagtgacagcacattaatagcagatcttgaacttgaactgagtcagcttcgccaccttctctttcttcaccaggccagattttcctgccacattttgataactggttccagttggaagcaattaccaccataatattccatgactggattctccttcctgctatacaaatcaaaagcaattaaagatctttcaaacaactgtggaagatgagagctgctcatgtcttagaattagaatacttgggttcaggtctcctgtctgtgatcatgaatcttaagactacctctgaacttaactttcctcatattaataggatgttaataaaatctataccataggcattttttccaaaaaatttaatgagattatctatatgaaggacttggactacagttagcacacacacacacacacacacacacataaaatgattgtttaaaacgatcaaaccagaaaaatgatgcttcacataaacaattttttcatatatcataaataaaatacaataaaaagatgtattttaaatcagattttgttgttttaattaattacagcgctttggggtgctgaggtaaaaagactacttgagtccaaaaatttgagatcagcctgggcaacatagctgtggtaaactttagcaacgaatatagagttccataattttgaattccatttcctaagtgacccagagatattcagcagaagatggcaagctcataactaaattcaatttttattttcttgtatcactcatgtaaataaaacatctctcttatgtctttacttttggtttgttttaatgttaagagacataacatgatgagaggaaataaaaattttcaaaatgaggaatagaagttcttgctatgtagactttttaatttagggctaagggaactgaaggaattcagttgagggaaagatagtctgagcaattatagaagccactcgttgacgaccatgttcacatgacagggagacagctcaaggaggaaatgaggggtggttacaggagaaaagtacagaaaatttgagccagttctcctttcctctagttttctgttttaaggctaactttattgaagtctaatttgtgtacaacaaagggcgtttcttaaaaatttacaaattgcccgggcggggtggctcacgcctgtaatcccagcactttgggaggctgaggtgggcagatcacgaggtcaggacctcgagaccatcctggctaacatggcgaaaccccgtctctactaaaaatacaaaaacttagctgggcatggtggcgggtgcctgtaatcccagctactcgggaggctgaggcaggagaatcgcttgaaccggggaggcggaggttgcaatgagctgagatggtgccactgcactccagactgggccacaagagcgaaactctgtctcaaaaacaaacaaacaaacaaacaaaaattacaaatcaatgcatttgtgtacaactgtgagaccaccaccagtcaatatagtggatatttctgtcacccccaaatgattccttgtgcttctttgtagccaattccttcctccctgatgtgctgtagctacagattaggccttgaaccttggagcccaataacacctcttcgcatgtccctcaataaatttacctgctattattccctagggattttgtttttattcagtatattctttacattcctgggaaaataaatagaatatgtttcatcaataatcgtccagctttatttaataattagaatcaattatgtagaggaatcaatgtttatgatttaaaatgttcaatagtaaagccaaaaaacctggttccttattcaaaatccaagctggttgggagaaatatatacaggtggaaaagtcccaggaagatcagtttctaaaaatatgagtcatagctccctgcagtatggtgggagtaaaagtcatttttattttcactgcagtgcataaaggggacatcactaaatgaatgaaaagatggatagatggatgaaaggaggaagggagagaagaccacatcaaagtcacttaacttgtgataattcagaatattcagagactggaagagaaagaatgtctttgtaagactatactgcctgttgggcaggaacacagacttaacgttgacgagcctcaggttttaataccagctccaaaactaaggttgctgaacttcatttttgtgacttgtaaaatgagcaagatgatattgatattgcagacttgacttaatggttaaattaaatcatttgtgttaagaaggtggtacaagaagccagacaaaaaagaacgtacactatgatttcatttatacagctaaaaaactgtcaaaactaagctggggtgatgaaagttggaataggtcctacctttaagtggaggattgttactaggaaggagcatgaggaaggcttctgggttgttgatgttttactgttttatctgaggagtagttcactcacttagtattagctccaatcttgaaactgggatgcctaatctagtctttgctttgccatataggaacctatatacacttacagaaatcccatgatgttccaggcactggcaaggtcctagggatgaaattaaagataagatttgggttttgtgttgttcatttataagactatagtaccttcatttatgaaatgacaggatctggtgaactctaaactcttccagctctaaaattctatggaaaaaatcaatgaatatattcatttcttcttcctacaaatatttattatgatttaaaaactgtgctgtaggtgttgatgatggagtaaacaaggcagagaatgtccctgcgcttatcggacttatatccagggaagtgaagtcatgggagcgtgtatgtatgtgtgtgtgtatatatattcactacttaaatgatacatgctacctttttagataaaagaagtagggaggctacatccatatgttcatgtatgatgctgtaaaaccacctcaaagatatctcttagaaaatacactggttgcttgtttgggtaaaagagatagaagatggggctattcatagactacctcagaacatttatccctatttcaaggatataaatgtattagctatttaggaaattaaataaaaatctaaaaatagcacagagtaggccgggtgcaatggctcaagcctgtaatcctagcactttgggaggcggaggcaggtggaacccctgaggtcaagagttcaagaccagcctggccacaatggtgaaacctcatctctactacatctctaccaaaattacaaaaattagcctggtgtggtggtgggtacctgtaatcccagctacccaggaggctgaggcagaagaatcgcttgaacccaggaggcagaggttagagtgagccgagatcgtaccattgtactacagccttggcaacagagcaaaaactctatctcaaaaaaagaaagaaaaaaaaaatagcacagagcaaagcccatttctcctccttgtcatttctcaatcagtgtggtcctttgtgggtggggataggtaatggtataatgatgagcctgccttgaagttcttgttccaaaaaatcaactttttgacagaaaaaaaaaggcttttttcccttgtgatccataatattagtaaaaatactttggcttccaggggcgtctatgaggaatgtctgataactcaacaattctttctaaatgccgtaataattttggaaaatacctaccgtgcagcccatagcaactttctggaatgctgctttaatttgcttctctttttccctattccaacaagaacaatgacaacaacaaaaattaacttagagaagcatctgctggaacaagtggtgattatttccaagcccaaacaaaagtaggtagggaaagaattattcagagaaaacatttttcaagatcttctccagtgtgtgagagagtatgtgagaaggaaaatgcacatgtggataaaatgttttcatttgacgtcgaaaatgatagggaagtgagagtctgaaaacggtttcacaatgagaacacatggacacagggaggggaaagggaacaacacacgccagggcctgttgtggggtgaggggagaagggagggaacttagatgaagggtcaataggtgcagcaaaccaccatggcataagtatacctatgtgacaaacctgcatgttctgtacatgtattttatgtaaaaaaaaaaaaaaatgaataaagaaaacagttttagtttaaaaaaagaacaaaaatgcaaacaaagaaaaactcctttaaaatttgtgatgtacttattagaattatggatagctgtaaattgcaaaaatcacaatgataggcatgatagtgtaagcttctttatggtgaggaccctgttgtcaatttcttttgtatctctcttagcatggatataggcatgtagttgggagatctttttaagacaccagatgggcaatgtggcaatagagaaagcagtacatggagaagcaatatgctctctgctgaacttggaataatctcttatctcaccaagcctcagtgtatccatctatacaatgggtacaatgctctgattaacctctgccagttataaaatatgactcacttgattcagttgaacattccaaaatttctgtgctgtgagatttgggaacatggatttttttgctgctggtctatattattaataaaggaaagttttaacttttatacctcctgttaaaaccactattggataggatctagtttatacaccacttacattaagttgtcgagtctggcacgttctaacagtgaagtttttttttttacacgtgaggctgtttgttcttgtcttcctgagtattttcctgttgaatgttttatgctcccaaggaactctggtatgttgaattgtatttattgaaagcttgtaaacccttgatcttagagaataaaaatcggggagcaggagaaaaagcttaaaaatgctttgaatcctgagaaaatatttctgtaagttaaaataagggtgaataatggtgaggatagcttacagttccagaaaacaaatggaaaattttggagatattaaaggcaagaataaatttaataatttttttcttggctagcatgaacttttatattttggattggatcctttaatgcttagattaacatgccatccttatttttattgacatatttgtatgtgccacttacaattctaggatgttacaacaaatttttttatacattccaggttgcatattctatgtaattggctacttttcaatgacttgtttgcacaatttttgagtcttcactttagcccctgatttctctttcatatattgaagtttaagcttatatctcacttctcattgaagtcgccagtaactttaaatcatgactaagagaatcttaggggctacaattacgataaaactcttatgacatgggtcactgttctttaattgaggtggtccacttactgtgtaaatgttttaaaaaatcaattagaataatatttatattatctttatgtacttgattttcatattggcatttaaaagtgtgttttaactaaaattttattttgcaccaattccataagttaactttggcatcctctaaagaaatttcacttacagagaaaaaaaaatgtgtctaattaactttttccttagagttgtttgtttataagtcatcctagaactcattccctggctattttgaaattttttcagcaatctaaatttactagtttagtctttttaaaaacgttatctttttagggaattgaattttacggttttactaataactgaaatactgtgattaaccaattactttattattgtttttaattgtgataaaatatgcataccaattattttaatatctgaacatatctattaagactaagaaatagaatatttcttgtttttaaatgaagtgctctattccatgcccttaagtcatacctaggaaacccatagctcataaaggctgctggaacatgcaggcccatgtcagaattaaaccaatagagggtctctgaaacttgaattttcatcttggtgagtcttctggggttatttattcatgtgttcttgctccaaatgtctgcttcttttttttttttgcttttattgggtgaaagacagcataataattctatgtatttaaatgcaactgatataatacataatggggcagaactttaaactcttatgccctctgaaaacattgtaaaggctggaatgaaaacgtaaatgcaggcactcatgtagttataaaggatgaactttcgaaaattgaaacagtcttctcttcagaaagatgctcagtgatttgtgtgcaagatagggctggaacaagggactcctgactatcagggactctgcagattatttgtagttgtctctctgttgttgatcaaataatgaatgtaaaagatggttgttatatctgtagagagcctcattgtattttgtattaaacctttcaataaaagtgaatagttttacttccattagttggaaaggacaacctataacttatcagaagtctcctgacagcataataccaagttctagaatgaaaataaaatgcctacaaatatttggtttggttaagattaaagatgcctggttcaagcatgctactttgttgtggcagtaaaatgtatgcacaatgccatttaaacaacagaaaaaaaaggatgaaagaaaaaaaaagtttctcaggtaacagaggaaatctgaaaagatatcatatacctgtagaaaaaagaaaaaaacccactttatggaattagctccaatcttcaatttgggatgcctaatctagtcttcgcttttgctgtaggagaatctacatatacttgtggaaaacttatacttcaggcactggcaaggtcctagggatgaaataaaaaataagatttcgcttctgtgttcttcatttataagaccatagtgccttcatttataaaattaaaggatccggtgaactctaaactcttccagctctaaaatttcatggaaaaaaaatcaatgaatatattcatgtattcctcctacaaatatttattataatttagaaactgtgctgtaggtattgattatagagtaaacaaggcataaaatgttcctgcccttatagggcttacatctggggaagtgaagacagagcctgaaaaaatatccaaataaatataatataattttgcattgtaaaaaatttcgtgaagaaaaagaagcacatagggtgatgtgatattcctggaagatctatgtgtattaccagaatacagattggaggacaagctctgttctgagcttgtgttgttgagagtgtgcatgggcaattagtttttataatatgaatctaaatatagtttataaaataaatgcatgaagacattttgagagacagccttacataatatactcatgagaattattcagtaaaataatcttctatcagatgaaatgtacaataaaattggcttgttgaacgtcattgtcctatatagtggtagcatctatgatgtaaaacattgtctaggagaggacctgaatcttaggtgaatagtaagtgccataaaagtaatgccaaacatgaagacacaatgtgtagtgatggagggcacagactgtggagccagactgccccagttcacattccaactctgccactgtggaagcttaggggagtaactttatttccttgtgcctcagtgtgctcatctgtaaaatgggattaaaaagtagtcccggacaggagcggtggctcacagctgtaatcccagttttgggaggccaaggcggttggatcacgaggtcaggagatggagaccatcgtggctaacacggtgaaaccccgtctctactaaaaaatacaaaaaattagccgggtgtggtggcgggcgcctgtagtcccagctactagggaggctgaggaaggagaatggcgtgaactggcaagcttgcagtgagccgagatcgtaccactgcacttcagcctgggagaaagactccctctcaaaaaaaaaaaaaggagtccctatttcatgaagtttctgtgagaattaaaggggattaaattaacttgggggggggggtctaaattattattaatagcgtattttaatctatttaattttaagatggctataatgtaattaaagcactactttaaatatacgccgagtactaggcaatgagtaaacattataaaagtataaaagtcggccgggcgcggtggctcacgcctgtaatcccagcactttgggacgccgaggcaggcggttcacaaggtcagcagatcgagaccatcctggctaacacggtgaaaccccgtctctactaaaaatacaaaaaattagccaggcgtggtggcgggcgcctgtagttccagctactcgggaggttgaggcaggaggatggcgtgaaccagggagatggagcttttgcagtgagccgagatcacaccactgcactccagcctaggcgacagagcaagactgtctcaaaaaaaaaaaaaaaaaggtataaaagtcatttctcttcctcactacttccaacaatgacattttgagttacacaaacaattcatttttaaaagattataattgaaagtgtatgaattgtgctgaagaaactaagtaaacttcagctagaggaaaaaaatcccaaatgcccttcatcatcttactggacaatggaatgctcccttcattatagatatcaatagactaatagataatggaaagataacaatggactatgaatgaagtgtaacattttctcaaacttcccagtggaagcaaaagaatttttaaatatatgtctggcaaattaattttgtggagtatagtttactagaattatggggaaaaaaaagcagactgccagtatggctattattctagctatgtgctaaaatatatgcctataataatgttttaatttaaccctaacatcccaggagttacactgatatcgaacttgaactctaaaaactcatatttgcgaagacttccaacgtatacctcaggttacctgtaaatatgctcttaggcatgtgtacatgagtcccaaggaaacttttgccaaaatgtgtaattgttttatatgagggttttaagaaagcacttttaaattattttaaagtaggattacaaattgaagttattcatgatttaattcccttggctagtaatatggaagtctagctccccaaaactttgaaaaaacaaaaccccctgaaatttataaagcaacagtttttttaaagctttgttgctacaaagtgagactgtgagaatgaaagttaaaggcctttgctattccatccatattcagtttggatatcctcaaagtaattgaaaatttacttttgaatatgctgaaaatcgagtccataagtatctagtagaatagcttttgattggccagattctatctctgactcttactatgctttagaattcttttatgaactctttttctgatcactgggaagaagaaggcagtaagagaaaagagcaatataagaaattgataactccaagggccatagttcgtttatgtttctcatagttatatacgtcttatgttcattttaaaattttaaaacaataaaaggagcacatatatgagcataaataggtataaacatattctttgtttcccaaagaattttcagtatatgatgataccttttgaaggaaaggaatatagaaggttcagtgtatgacgatatcttttgaaggaaaggaatgtatctcttggtcccatcaaattttttcttgacttacaaaattgttgatatagtttgtctctgtgtccccacccaaatctcatcttgaatagtaatccctatgtgttgagggagagacccagtgggaggtgattggaacatgggggtgggttttccatgctgttctcctgacagtgagtgatttctcacaaaatctgatggttgcaaagtgtttggctgttccccactcccaccctctctgtctcctgcctccacataagacatgccttgcttcctttttgccttcacctccccagccctgcagaactgtggttcatttaaaactctttctttataaattacccagtctcaggtagttctctatagtagtgtgaaaatggactaatacaattgactacaaattttttaaaattctccgtactcaagcaagctgtggcattacttaccacagttatttttttatatttctgtggcatttttgtaacagaccacatagaaccaacttagaacaagtgtaagcaaaacctttgatcctgtagaagacaatttgatgcaagaagtcttttcttgccaggcacagtggatcacgcctgtaatcccagaactttgggaggccgaggcaggtggatcacctgaggtcaggagttcgagaccagcccgaccaaagtggtgaaactccatctctactaaaaatacaaaactaactgggctgggtgtggtggtgtgcacctataaacctggctacttgggaggctgagagaggagaatcacttgaacctgggaggtgggggttgcagtgagctgagattgcgccattgcactccagcctgggcaaaaagagtgaaacgccattaaagtaaataaataaataaataaataaataaataaataaataaaaataatcttttcttggtgaagcttctttagagccaccatccatcagctttgacagctttttgtgatctatggccagtaatctctgcttaatctataaagtgtataaactcttccagaacagcaaatgtgctgcccaggggttaggaaggtcaccaaattagttcattgctgagatataagaagacggccatcctggggatatgcacctcctttgaagttactgggaaaagaacagttccagaatatgactcaattactaattttagtggcaaccaacaaaaagccctttaaaaatataacagtgtgtatgtgatgggtgcctatgcttaattacatgagcatttgattataaagaaggaagaatggctctcaggaagctgttttcctgatctggaaacaatgcatcatgtagtaaaatgtaaaacgggcttagcagctctgcactagctgataatttgttctaggacaagtcacttaaactctgcgtttgggagtcattagtaaaatggggagaccaatatttggcctaccccattcttaaaacttagtttgtgattcaaaggagaaagaatgcaaaaaatgataataataacaggagactacaaaaagtcaggaacatctgattgaaagtaaaagcctatgaattttggcaaaacgtgatcaagctctcctaattctggatatcaatattagccattctaacctgtggaagatacaatttaaggataaatattgcagtgtgagtggcaaagtggcaatgagtggcctatatctaaatattaggaaataataatttatccagaatgacctgcaagaaaaatttttggtcagcatatgaatagtattttgctaccatttttgtttggcaatcattgagcaataaaatgggaatatacagatattgtagtggaaacatcaatatgaggagttaaaaaccacaaagcacctgcatatcggcaggatagatataaatgccaatgtttaataaatattacaaagtgtaatatagtaaatagaacaaggacatagtgttgagattcagggccctgaaacaagaagtcctgatatctcagattcattaccaactaaatcactgatgatgttacttaatctttctgtgcctcagtttctttacatgtccaaatgagaacagtaataaaattaagtgagtaagtatatgcaaagtgccaagggcagttcagaatgcaagaaaaaggtggctatcatattatatagaataataaagcctgggttgctaccctcgttctgtcactttttttctctgagtcttagtttccttatctgaaaaatagtaataagaatatctacctctttcattactgtgacggatttaataagatgaagtgacttcagttgcactgtagctctcaggaactatccaaatgttagtttaaaaaaatatttattgcagcaattggcattaaagtgctgacaaggacatctaccacctctccccatggatgaacatctcacctagtataaagtgagtatctctgtctctctctctctctctttctctctctcttctctctctctctgtctctctctctctcttctgcctcgctaactttaaagcagagtttcctaacctcagcactattggcatttgaggctggataaagcctggttgtagggggctgtcttttgcattgtaggatatttagcataacaatccttggcctctacctaataattccagtggtacagcattttccccaccccagtcaggatgtcctaggaggcaaaattgtccccagttgagaaccactactctaaagcattgtttatatgttagcttagatactacttcctccaggaaagcattctgtgaatatcccagaaggaatttaatctctcctatgtgctcctgaatgtacccccttgaaataagtgtttgccttttaataatgtttacatacacatttcctcctatagactgtgagtttatcttggtcaggaattgtgtcctacttaccatctgttttcatgtggtaagcactctatgcatatttgtgaaaagaagagagggagagaaggaggaagagagagaggaagcaagaaagataagtggttaatcagctgatcttgatactgtctaatgctccattatgtatctttcaggtccctctgctgtgtcagatatgagggggtaacttgatttctaaggagccagtgtagagaaaccaccatgtactcccaagcagaggcccagcttctgcaaaagacctggtccattattgtttatatggaaatcaatcctatattgaacagacatattaaattaccggattaaaaacccaataccatcatcagtcagatataaaacagaaactgatactagcccttgttttagaagaatgtggagggagtgatacatctgttatgagagggaactcttgcacaggtcaactgtagttggctaattaatgctcaatataaacatgaaacagagggatgcttcagctataccatgagttcatgattttgtgtaaacaacaatttaaaaaatgggctgaagtccacattgactgtcaatgaaattgaaacatttccctgctagataaagggagggatagaggctttcctcttataaaactggctgtgtcagtgattctctcctcagattaccttttccacctacctctcagaatggacttcagtgggagtaaacttcagaggggccttgtggtttttatagggggctggtacttgccgtatccaactcttatgactacagaaagtttgaatgagtacaccaacgtctcacctgaaaccctcacatttgaagtgtttaaaggatgtgattattgtacttcttatatgcatcattatatatgtaacttttacatgtaccattatatatgtacattattcatgttcatcagtatacgtttcatatgttcatcattatttcatataacacaagaaaagaaaaaacattgtttttacgctgacagcacactgtttcataacttaagatattttcatatagttcctttagatttatttaggtatagatttttaaaaatcttttttgtgtgctcataaaaaggaaagcataagcaaattaaggtaaatcattctaaactgtttttcacaattagaatctaattctaagtgattttttgactgagaattgtcattgtccatgtgttttccctcacacagtgtgctcagctgtgtcatcaagaccatcgttgacacagcattgcttggaaggatgctctaccgatgtctctggggttttcttccaaaccacccattcttgatgttttgaagtgcatatgcaggccatcatgatgacataatgattgtatctggttggtagctgttttaagaagaatcctaatttcagagaccattaaaatgtgaaaaaatgtgcattttagaattgatgaaataagtaatttacatcctaatgatgggactatctactttctactttaaagacttgaaaggattcaaagtgaaaagtgctgagaatccagagccagatggagctaaaatcacatttctctgctatctgcaggctattttaatgagggcaaattatttaactcttctgtgtctcagtttcttcatttgtgaaagctgcctcaaaggaacattggtgatgataaataaaaataaacctctttgccctgagtagttatacaaaaatatattctctttttaaaacaagagctcagttcaaactggcattttctctgtatttgaacattttatatgtaatgttctaagtggagactgctaaaattggtaaaaatgttatgtcttaacaatgaattggttacatttcaagataatgagcagattcagatagcatggtttttaaatacagtttatctaacagggaactcatccatagttgtcttgtgaactattttttctttctcctatcaagaatttgaattttctctaaggccaaatggtgaatcagcagctggtcaataattgattttattttatgtcctataccctttttcagtccaatttttaagtcaatgttaactcagaaactaattcacagcttaaaatacagttgacctgacaaggctgctatctattctagactaacgtgaatttctcagtgtaagcactaatatcttccagtacaaatcttgaaaattaaaaccaaaggattagcgttatcattactgatgttaattctgtattaaattcatagtaggtcacaggaaatcatccctttctcatgttatgaaacagaaaaagataggatgtcagaaactaaaaaccaatatatgtttgtttgtttttttcctagaaggtggctgaaacttagtagccacactctacctttgcagtttttatttttctctttgaattctgttgcttcttccatcttgccagcccttgaagaatctggaaaaagcatctcattttccatggaacaagaaataggttaatagtccctttcacaaaatgtagagtaggactttcattgaatgccaactcagttttgttttttaattctgtcgtacagcatagaaaagctggtgaatgatgtcatagtcactaacagcaactgttcaagttaggagaattttagagaaatggatattgtcattattcattcacaagtgttttattgtgttatagatttctattattccaaataatgagccatctgagaggaagaattggggaccaactcattgtcaatttcccccagtgcctactacagtgcctgctatacataggaaactcagtcaattcttgttgattgccacaaaaattagtaagaattggaaggaaaaaggaagagagagaaaacaagctcactagagaagattcttgaatcctttctgaatcatatcaacacagtatagcaactggcttaatcatagatgtcatcactggcatttatggttagaaatataatgtttaagccccatcccaggcctttgaatccaaatcctcaagagtaagtcttggaaatctatatttataattatcactcttggtgattcttatgttcaagcaaatttttaaaacactggaatactatgatgctttttagaaaatgtttaagttggtcaaacaagtaatgattcattttagaccaagttagcatttgaacatttcagaccaatgggaatattagaatttggtgctgggtagccaatgactgggaagggagttttcttgttttaggattggtttcaaaaccataacttcactcttatttcagagctttctattgcccattattgggcagtagaaaaatattgtttttattctaaactcaggacctaatatcctctaatgcttagcaaaatttgagtattttaagaggtatttagttggtattaagagaagtgactcagaaagtcagaaactttttctctttctcctaattgcattataactatcactgtaaagacaataaataatacaaaacttcttaaataatgtgaatatatgagcacataaaaataagaacattccttgaggctctacttttttacagctttctattacactatgataaatagatgaataataaccttgccaagttatatttgttcttttatttgtctctagacatgtacaattttggtgccatcatttcatctctgactgcttttctgttatcttgagggtctcagtcagataaagcattataaataataaatattcttgagtcatctgatagctcaatcccagaggaaataaggcgttcaaatttccatagaagatttttattaaccttcatataaatataagtataattatttttcaatagttttagaatattattactatcctttagtaagacatgttgacacaccacaggtcaaacaccagaatcccactagaacaaaatttgaccctaaccaaaataatcacacatgtccccgtattgctgatgcttattgattcatttgtaatgagattttctacaatgaatagcctagtttaagcatgtttttttctagtctttgtaaatcactatttgtctatctggaaacctattttgttctgtttgcagagtacctttcacttgctaatgatctgtgcaaattaaacagaaaaggggaggagaggcatggttaacttttcaaaacttctttcctctgggtggatggtaagcaagaagcaattatcctctgactctcctcactcccaaaaaacttcacaaccaaaaagaggaacaagcgacacatacatgtgcatttgcatgccaaccagaagagcaaaccagtgtgcagaaagtgtgtttacaacacttccttgcaaatgaatgaccgttagattagatactttccttattctgtataaactggtgcctgttgtatttctctgtagagctgcttcagttcagagcctgggcatgtgctttgatgtgagttttaccaatagaattccatttgagtagagaaaaatactatattaactaacttttgtgcagatgcaggcacagatgattcaaagtgttagcaactttctaaaaaccatcaatcatttaaatacccagtatgagaaataaaaattttgatttttatgtagttatctttgttctgcattaaatctcttttgtcatttttcaactttaacagtcctagggggagaagagagtaggagaactgggaaaggacttagtgtgtgcaactgaatctgattataattgtttaagatttattggttgataatgacaagttgtttttgtacattgaaattctagaaagttttaaattctatctttcatttaaaaactgagagctactaaatatttgggcatttgagtatcttggcacttgggaatcttattcctgtcttgatttgtgtgggtcgcgtttttgatgataattacaaagaggattttgtggtggctttgaaaatcctcagtcttgtaaatagcattttgtgatccaaaagccaagggaaatgactaaatggatctttgtgacattttaagaacaccaaaaggtaacttctttgaacgagatttatgaatgtagaaaacttaataagcaaagaatggatctttgtgttttttcttcccaacattaaatctaagaggttttctgtggacagtgcaagaacaaggccctgcagatccttcctctgcttatttccccacacctgatacagtttctactggcactttttaattattctaagtaactggcacaatgaaatgttttcgtttttattctaataaggtttagtatgtgctaaaagcaattttataaagatctctaagcaaatattgtactgtacttgtatacattacacttgagaatgttccaggcaagtaagttctaggtttttgctgtgcttatcctactgaagtatgatccctgcctctgctgcttttttcaaatacataaccataactgcctttatctccatatatcaatatgcagaaacaatagaatgcttgtatggctatctgtgcatatcccaagagaattatttgtactgggggaaatgcagttgaaaaaaagcaggaaaattaatagataggcatagagccttatatcttcatatatcctctaataatggtagaatttggttttgttttatgattcatccaataaaactatataatttactatgcattttaaaattaagaaacttatgcagaaagagcaccatgagatataagaggggctgtggcatatcagattatttttatatagtataatattactgtttcattgtcttgtattttggaatccagagttaatgttagtgctaaatgcaagtttactgctatcttggggacctggatctcacctacctatttatccccaatgtacatcatcacagaactttttagggcttccagcttgttttttcttgggaaactactgatgtggctaatgggcacaaacctgtttctaccctaaaaatgccttgagccataaactccagcccatagtacaagtagaggaagacatctttgcctactcaaattcccagaaacagagagaggaatccacagatgaatgccctgccatgttgttgtaatcagatcaaagatccagcttttacttttggccaatttccttaacagatcaagattggataccaaggtttctgacttccattccacattttatctgctgaatattaataattatgagtatataaagacttcatttaaataaccccactcaataatctcatctttttttctaaaagagcatttagcaaaatagagtcaactaacctgccaatatcttataaagaaattttataaagattggtttaatacctgcagtactaatttttgcttctgacaaaggaagatgtttatatcatcagaataactaaaaataaataatctgataggtattttgttgatcaccaacagtgttttatcatagtactatgcattgtgggtatccaaaagagggagaaagatacattcattccttgatgctgctcttctttgaggtggatttttactacctagcatttgtgaagtacagcatgttgtctcaacattaaaattgctttcatatgcagaaacatactatgtgcaattgtctgtgttaatatggacacatttctcatttagaagagagatcatgaactatctttatacaccaagtttaccttccccaacaatttagtaactttacagacacatggatattccagtcatattcccttgtcttttacctctgtacatggaaaatagctggttgcgaacatgggagcctctacctgcaagccttgtttttctggaaacagcagcccctcatcactaacaaatggcaagtaggtaaataaatgcccctattttggaatgattttaaggcaggtgttctatactgtgtctcagaggtctctagtttcccacagtggtaacttacttgataatacgctctttattgactttcttcctttactgaattattccccctttcccatctaggtgtttcctagaatcacttcccaaataaaccacttgtagttaaatccttatctcagggtctgtttctgggggaaccataaccaggacaataacgttttctaatacttcctattcctttaggttagaaaaacaggttcttccaaagcaccaccctttccttctccatgtttagcattttactcctcactgacactggcctatcgagccccatctttctgaagtacactagtttgaggcttctttctcccaggcctggagttccacagaagtgctctaactagaagcattctgcagaagtactctaaatagaagcatttctacttctcacttgtataattttcaggcaatcttacaaatcactaccagacaagttttactaatcttctattgtatccatggttttagcatttataaaacttcagaggtttctgcattcactaccttagtaatgccattcagttttatggctttatatattatatatatgccacagactcccaatacttatatttccatatcaaatctttctctcattccagtcttttagataccactacctacttgacatctgcacttagatgtctgttagacatttcacattcaaaacatcaaacctaaacccctaatctcctcagacaaacctgctctttctgcagccttccccatctcagttgatggcagtaccatccttctagtggctttggagagatccttgatttattcatttggctcttaaatataccctgaccgaatccattaggaaatccttgtgttcataccttcaaaatatattcagaagctgaccatttctcctcctctccaccagtgaaactctggcacaagccagcatcagctttcaccaggaatgctacatctcctggttgttctccttgcttcagtttctgctgccttctatcctcaacactaaaggcagagacatccttttaaactgttgggtcacagatcatggccttctactgcaaaaagccagcatgcgatagatgcatgtctcactcgggtaaaagccacaggaactggggttacatattgatcaagatacacgtttcctattctcttgaaacgttagggtttctagtagcttttgaagtataatagttttaaggtataatcctaattaactgtacttctcagctctcctcctccgtccctttccactagaatccatgtcccaaatctcctacctatgggtccaggtggaagaatggaaaagaatcaagcaaggaagaaacagtgcccacagaaagcaaaactaagaaatcctgttacaataccataaggccactgtagctgcaagggatcctgggaaatgcaaatatttagaagggtctgatgctgtcatcaagaatgtgtgtgtgtgtgtgtgtgtgtgtgtgtgtgtgttttcagttagggagaaagaatgtacactgtgtagataaatagtttctaccacagatggtgaaaaaatacccatggtttacactaagtctaggtcttgtccagttctgagcattttaatcagaaaagcattactatactcacttgtgtttatattaaaataagggctatttattgccaccagctcaggaaatgacccagtgtggccgtgtaagacagaattaatttgaagtgactccagctaaaagttggctgccttttaacttaataacttgagaactgtcagtatcctttgaagttaatgatagttgtaaagtgcaaataaaaatttttctaaaggaaatcaaacacactacagccaataaatggctgtcactagaatgctctgtcactgaaactattcaggtatgtgcgaggggagggtggaaggctggtaatctgtttagaatttcattgttattttgtcttgttttgttttggcttttggattatagaatgcccaacaagttttccccttggaaatgaaatttaagccatttaatgggtttctagttgttgggtagcatgttagaagcaaagttattttgtatgagcatttgtgttggaaatacttgcaatactagtgtcacctcaggcataaatgtatttgcgcagcacgacttcacatggtaaatgaaagcattattacttgcttgtctttctgtcatgggaggcggttttccaaataggtatatggtgcaccatgttaattaagttttattttcgttaatgagtaaagtaactggctgaacaaagagtaaaagatttatcagtatggaaagagcaggcaactgtttgtctaagttatgcaaagtagcaaatgggtcatctcaactaagcatcaggcaacatatcatgtatgtgtgaaatgtaactgtttctaatttcagacccaggttattagcagcatggaagctcctaatgaggctggagaaagtttctcacataggagcatcctgccttttatttacaatgatgccactcaaaatttgtttcagcaggaagcaacactttccatttttttcttgttgctcatttgtgagtttatttctacttaatttgctgatccaaagcgatgccagattgacatccctggggactgctgtttcctgttggtgcctgtgcaaatgaaggcagcaagcagaagttctatgttttctggatttcttggtggttttaggttgccataggcagaaactaaaaaccatatagaaaccttagttgatatgctctacccaccaccacctccgaaagatgcagcagccaagttaatttggttaaggttggttaaagggaaatgaaaggatccttcctctttacgtctttcttaaatacaacattttcagaaccccaaactttgctataacttgatgcttctaaaatagtctgattacaagacatatgagcttattaaaatgtggattttaagtttcttatcttggagattgaggcctaggtgatacccaagtttctatacttttaataagcatcttaagtttctgttatcatcaggcaagtttaagaagcacctctcttgcatgtacaggcagcttaatggactttatattaaaacactaagtttagtaatgtattaactttgtaagtccctcatttcctcattatggagtatttattaccaggatacatgtataaagcatttagtgcccataacaacatgggcactggaggaaaccatttctctctttatcaaataggactaatagcattaaaagcaataaacttgcctgacaacactcaaattatccaagcattgaaagacccctaagaagccactggtagtagttagatgccaccttctttcctctttgccaatgcaaaacaaaaccaaaaccaaaatctattcatctcctttgaacatccatccatttggaagaatcatggtttgtaaaaggatactatttgtcttaaacagctatgtttatttcaataggataccacataggtcaaggtatgtttgagtgtgttaagcaatttggaaatatgttcttggaaagcacaggaagacacgtccccctatccccaccaaataagaagacatcagagcccaaaacacaattttaatatatcagagaaggatatgctaatgagttttcttgtagtaattttttttttttacatattgtatctatcttgaaaaacatgctaggacaggttcacaaggaatatcatcctctggaataagaacatgtattgaatttcaatccatgtcaaggatagattatgagcctatcttacagtatatgatggctatatagttaaaattattaatccaccaaggctgtaactcacaactcttaatattctgatattattctgagaatttcatttaatctccctggatcatgtggcttataagattttctctcacagctgaaaaattacttgatagtttattcatcaccatcttctgttacttggcagagctcagaaacttttgatgagtgtatcatggtcactatttgcagtacaattcgcaattcttgccgtcctggaactactaaaagatagcctcaatcctgaaatgctcagttgcattttaggtgaatgttttgtaaagcatttgaaatctgcaaagatctgcaaggaagatacaggccaacacatcccgtaatttctcctactctaaaatttcatcgtagacattacttcacttgaaatattataggaaaggttgaaaaactgttattctttaggcattactgtattaggtatatttttgttgttgatcagacattgcttcgagctggaaaattttcttaatgtatatcgctgtaaattaagactacattttttatttgaaatattagaaaatattttgattcctgtatctgctataagtgtgaatcataataatcctttctttaagagttaaaagtttcttttatcgtattgtattttgaaatcttacaaatttcaaattatttactctggtttacttacaaaggcacaaaaatgacattgtaaggaatagttcaatttgagggaagaggcctgggtgaggctttaggcacgtttacatggtctaccttggctgaatttccaagcgatttaacttaatctctttctgaaagtttccagaaattaatagtatttatctacttttacaaaaagttagaaatgactttcatgtctaagggaaaggagatgatcatatacaggaaggataatttggaaacactttttgcaaactatggatttttaggtcctatcccagacctaccaaatcaaaatatccaaggggaaatttttgaaaattgtattttttttataaacacgcctagtgatacttttatcattctgcaaactttggaaacatcacactaatacatctgtaaggttgaatttacttggccattacattctgcttccatagtgtttgtactaagatgagaaaatgttcactgtaaaatactgtatggcaaaaaccagaatatacactatagatgatagatagaagatagacagagagagagagagagagagagagagagagaatgatcagaatgcagcacagaataaataaaaagtgtcactgtaaaagctggccttggaagtcctctttttgtttagaaaaacacttgcatataaatagagaagcccagtatctgcctgagagaaggatgagtgtgagacaaagcataaccgaagagcaacagcaatttttacttccctggtttttcttggaagaaggccagatattttttaaagggaaaagaagagacactgaacaagagattaaagttccaggagaaaattgaataactgttcaatgaggtattcagatgacggggagatataaaaaaaagaaggatatctgctattgaaacataaactttttgctataatgtgttgtcctgaactctgatataatcccctcctatgccctgaccatcaggaagcatgctctggaagggcttaagagaaaagccactgctatgtcactatattctacctacaggttgatacaaggctgagagaaaggaatgctagcaaatcagaatggcatatgagcagatacagatgtgtaactatgccaagtatttccccagatgtactaggatgactccagaaatctaaaatatctggataatctcatgcagtaaacattttattgacattttggttacacacacacacacacacacacacacacacccacacacacacgaaagacggaaagaaaacagcaaaaggtagaaagtttatctctggatgttaaaattgagcatatattacctgcataacaatgaggaaaatgattaagcttcggggatcattcttagacattttaaacaaacacaattctaaatttaacagaagataagcgaagtttgataatttaaaattctataggaccaagagcttgcttcactagttaatatttagaaacatcaattggtcagtctgttgtaaataaaatccctgggttcttgaaggatgatgtgttacacaaaataatttacactgaactatttgatcgtgcatagattccactggttcaaagtggaggaaaacattttaatgattttacattcatctgtacaattctttctgctatcaatcatatagtggtccttggcattttttccttgttttaaagtagctttttaccctatataaagaataatacatatgaaacagtattgtatttaaccctaaaatattccatttctgctgtcagataaactgagtttgaaggctatctctaccccttactcctgtgtgaccctgggtaagttatttactgtctctacagctgtgtttacccatctttaaaaatggggataatgattcttcctacttcatagggcttttgtgagaattacatgataatacatgtaacaaacttagcatagtccttggccaattgcacaaaataaattagctatgaaatgtatttgttcataatagaaacttcaagaaaaataactaggaaagacataaaaatcctctatagtctcacctccgaagcaagcgataactgtcattttggtatcttttattcttccttctttatctaaagacaaattacaaaaatgaatctattcatacatattgtattttaatctgataagttgtgtataaactaaatcattttccctgttactaaatattgttcaaaaaaattattttcagtggccacatgctttcccatttgtaaagcagtatcatactgtattttaaaaatatattgctgagcataatggttgtttccaaaccaccagtatttcaaagaggctgcattgaccatccttataagtaaatatctctacatattcataataattggtttagaatcgatttctaaagttagaattgctgaatcaaatggtatatcttaaatgtatatttcatacacgttttaatgtactgctaaattgccttccagaatgtttgtgccaattattacttttagtagtatatcaaatactttttaaacaatagatacattcactttaaaaagaaatggcaatgacttttaattttttagcttattttattgagtttgaaaaagatttggccacttgtttttttctctcttgtatactgtatgaacatttgaatttaaaaaatgtatactgcactgcttctttaattgtcatattcactgaggtaacatttgttgagcatctactcaagacaggcacactgcacagggtgagagatgtaaagaccaggacacttatgctaaagtcagtggtgtccatgaagagcagaggcacagtgaaatttgcctggtccttctaggggctttggagatgcatattaaacatctgaagccaagggattcttcttagagctgtcctcccaagaaagagggaaccaaacaatgaggagatttggcaagtcctacccaaagagaactgacatttcttaggcattttatgaagagatacatagaactccagttccacttgttaaaagcaataactgctttcacttactgaacatgcacgctgtggcaggctcactgctgatattttacaactttctgcgatcagaaaggttataacccgtagatctgccaatgagtggattctgaccctgggtgaagtgaatgaactagcccaagagtttgcaattctaagtggaaatgctgggattcaccatctgatctgatgctttgctctgtcttctcttatttacacccaggtttctcagctttccacctttgttatatttgcattttgccatacctgcctgttaaccttttcttaaaacaaattgatcatctatgtttatttttgaacactttgttgttagtttccttaaaaaggaaactttgtatctctattataaatagaaaatcagttatatttgccatataaaaataaaataagtaaaaatgtatggtttcatgtgtaccaccaaaaagcatttcatctttctatcccctttcccatctcttgccagaggccaggctataacacctgaggaaacactgccccagtcactgcaaacatttagtcactagggacagcagaacaagactgtgggaacttggtaagaacctgggaccctttgtacctttcttctgttggtttctttattctcattctcttctggatggtctccagaataactggggagacaacacttacaggaaaagcgcatgtgttcttgtctcagagtggaagaaagaagagccgccgtgttccagctagtgctcagagaaggtgctctacatatcttgttgaccttgatttgagctataaaaggctgctgactcagagcattaaaacagaaccactggcttattctctgagtaattcaagtctgcctttccctcagtcgatcccagaggtggctagtcaagcctggcgatgttcatttaccatcagagattaagcctgtctggccaggctttgtctggtagcattttcttaatcaaatataatgacaatttgaataaactcaagtccattgaacattgttcatgttttattattaagaaaaaataggcactttgattcttggaacactttttaaaaggctcctcgctgtgtcagtctctgtttgttattttggggcatgacagttatctaaagagaaccagccagatttaatctgacagccacagtcagggaagagcgctaccaatctaattatccagtaatctagtcagaatgggagtaattctaggcctttctcaggcagctaatcacatttcctgtgcattagcagccacacatggggagcttttaggaacaaggtttttggcctgcacgggcttcatgagcctcatagtggtataatttctttgttgacttcttcccccagagtggtttcttcaggatttttcattttgttctcattcctacttttcccctgcattgccgagggtgtcttagcttagcttcaagttctaagtttgacgagcttctgactttcctttcagaatgcagcagaggaggaagggtacattcacggatccatatgcttatttcttgtgcagggacaaattaaggagcgtaacacagtctgcagggaaaaaagggagaaaaacgtgaaagttgttttcttcaaggaaagcgccgttgtttgtgggccatttttcatgtcatttctctatcaatgtgggtgatttgagggaggtttctagagaaaaggccggagaaaagagacagttaatggatatttagttctgtcgttgtctctgaatgtcaagctgtaggtaatattgatctcgtctcatttctgtaatcacaattttaacatggaaaaaggaaaacacacacacattcagggagtgggagcattaatgaatttcctgccattttctttctctgaaaacctccgtttaggataatttcatattagtcctgtaaagcagaatgtttttcgagtgcattggtttctcacactccaaaattgaggtttcagtggcagtatgccgcttctacccccagctttcaaacatttctccagcttctcataatcacagcttggttagtctgaatccaaacatttgaatctaatagaggggaattctagtcactaacaggtttacaatatagtaattttccccaaagttatccatgataaatgggcttcccaaatagcctctagcaatcacagcataacgcattagatggaacactccaaaaaaataaaaaaaaggaaatttgaaatcctgtgttaaattgtcgtgttacaattttgaacgggtttcaatcacaatttgcatcctctcaactgaaatttttgtgggcttaaacaatgcttttattccagtaattgtgggaggtatatgccactaggggctgcatagtttgggtgtgcctccatgcacagacaagaactgttgctgaatcataagtatatttgagcctcgtgtctgaagcctgtggacctagagcctaacgtgtctcagatggaacacgtagactggttccagtgcttcttgttctgtttctaattatgtcgtgtctgcattcattctaggtttagatctcacaaatgctattgatagaactttgcctaaaaggttcagtaaaactacaaacaaaccctagttttgaactgtcatccaatatattataatagtatatgaattttagtctttcattgcaggcactatattgtttgactctgattgtattgattgcacaggcgaaagtaggattatagccgaagagtagttcatggctgacatttttatcgatggttccatgaacctgaatgtgtacttcaatccactaaggtcactgattaaaatgtttacccaataaaaattacatttaaatatgtcaatagtacatcaacttacataacatctttcatctgaaaatataacaacatatatgagaaattaatggcatagtcactaatccctgtagaagtattgcttaaccatggttcacttctcacagaatcaaaaagagagaataaaaatggtatagcaaagacttttaatgattccagcatctattagggtatcattgtcacaaataaaaagaataccagttcctacatttctcaaggctatttctcaatacaagttaaaatgattcaggaatgcaggagatgcaaaaaaagaggctgcatattaagagcttgtttgagcaatggaacctctatgtatttacaaatgtggcacttttctctctgctttaaaacttagatcttgaattactcgagtgattgtgatctgcaaatcggtatacattgttgatttctctgttcaaattaatatctgctgaatgagttgggctttgtaaaagttcggctttgtgtcttattcattctctgccagggtgtctggtgctgtccaaggaatgtcccaggacagaagggtctttgtataaggaacaataataaattccattattgccatttatgaattatcaggctgccttgatctagttaacttctgtacaaagagtgctatcaacttcaaactttagttaagtcatcatgaggcaatgattccaagttttgatccattttataagggatcttccattttactgtatcattctgaatactgttcattttctgtcatttttaatttggtttttcttttaaaaagtcagcttctgtaacacgttttgactttgaggcagagtctactttgggtttgtgctaattttttcctcttagacaattaaaactttccaagaggacatttgatgttttgcagcatggatgtcatacatcccatattggcattgtgtaatgtttttggtaatattaaaataattggtagtttaggtgaattaccactgggtcactggcctttatcacccacccatatagatagccttttaaatttatattgtctgtttatgtgatttgccctggcccatatttggaaatacctacaaagccctacattacctctaatctgcttaggcaatcttgctggttatgcattggtattttatattggtaacatacaagcctgctatcatcttcgatgttccctttaatctatgctgtccaatagtgtaatcatttggctgtatgcctgtttaaattgaaatttaaattcattcacattaaatacaaattcagttccttaattgtactggtcacagtttacatgctcaatagttacataaaggtagtggcttccagactggacagtacaagtatagaaaattgctgatattgcataaagttctggtggacactgccttaaatgtctgataaacttatcaaggagaatgtctacattggcttagaggcagaaaacaattgtggctgtacaatttcaggttcaatactagaaacagcaaagtcaataaaagtggctgagactctcagaaggtgcacacttgtaattgcatctcatcatgagtgcttgctgcaattaaatgaaatcattcaaatgttggttttattaattctttaaaaggaacagggaaaatggccacttgagagttctttttgtttcactaccgttaatatgttacctaatgtctcttataagtatgtctacatttaaatactggtttaagtttcttaacaatttttatgtttttttttcataccaaatcatttctatgccatgccagccaaaggctcattttttctcctttttttttttcatcctaactacagttttcccttctcatttttcttcccttcccttccctgtctcctattcctgcgattctgtcttgatgatgtctaggtgatagagggaaaaaagggaggagagtttaaaatcttttaaagtagatattctgtttttggaatctcccacgtgatttgggtaaagtggaggagtctttgggggcaagtcagctatcttgcatatgtatcttcctcattcggaatgcgtgttagataagtgcaggataatctggaggcaaataccaggcttcagaagcatccttctcttttctttcttttcccttgagacagagtctcactctgttgcccaggctgaagtgcagtggtgtgatcttggctcactgcaacctccacctcccaggttcaagtgattctcgtgcctcagcctcccaagtagctgggactacaggcgcgtaccaccacaccgggctaattttttgtgtttttagtagagatggggtttcaccaagttggccaggctggtctcgaactcctgacctcaggtgatccgcctgcctcggccacccaaagtgctgggattacagacgtgagccaccgtgcacggcctcttttcttttttatcaaatgctgaaatctgaatgcccagggagattggtggcccttgccaggaagtgtcttaacactttgtggatactgctgcctgttgtctttaaaagctgggactcatcaaattaaaaacaaaaacaaaaacaaaaaagctacgattcaaagttttcccatgagacatttacatggcagatgcctaaatgttccattgtcatgtttctagatagaggtggaaaccataacaactaaatatgctgaaataattcagtgtggaaacaaattcacaaactaaaagatgttgtgttactccatagtatcttaaggcttaggattttcaagaacttggtatgattggaacatatctctcgcaggctgggtattcagagcaggaggtaaccatcttaaatacatgtgtaggcaaacctgaaagtttaagatttggggatttcatagcactctgatataggcatatgattcctgccatgatgttgtttaactaatgtgtgtgatagtcacacacatttctgttaaaatatagataaaagttattaagagtatttttaaaaatcctcaaatcttttgtgaatgtcctgtccaatctcaattataaagaattgcataagaatggttaagatctactgggtctactgaatgaaaaatcatacagaggtgttactgtaacaccatatatgaattcctgaaagacttcatgttctgcaaaatcatgcactaaaaataatgagacatggaaaccagtgggatgggcagaccacataaaacatataacaatttgtaacctgaatatttataaatacatttgcaatacaatcttaaaccctgatgttgtcccttgctccttctggatgtagatgttggatggcattcaattctcctagagactctttttattagatttttaaaaattatattcaattatattttcattaatctcttgttctaacatagggaaaatagaaaatgtctattttttttttttttttttttttgcgacagggtctcgctgtgtcacccaggctggagtgcagtggcatgaacaataatggctcactgcagactctctgtcccaggctcaagttatcctcccacctcagacccccggagtagctgggactacaggtgtgcgccactacacctggctaagttttgtattttttgtagagacagggttttgccatgttgcccaggctggtcttgaactcctgagttcaagccattctcctatcttggcctcccaaagtgccgagattacagacgtgagccaccacaactggctaggggaaatgactttatacttcttaacatgaactcacggcttatgtgaattagcttaaaggaaagcaaggagattcttgaaacttcttgcactaaaggaaacattttgcactaaaggaaaacaattctgtagaattacagtgtttttttttcctaaacatgtccaaatatttttttatttacttgtaaaaaagcttacccccgtcacttctagacattaacaaacttgaaaaagtctccaagaaaccaagacttccatgttattcttacatcattctcttcattttcaaaggcatatgagctaattcatgtcactgaaatatccagtacagcagaacaaactcattgtttccagctttaggaaaatcccctcagaaccaatgcaacttcaccacctgttttggggataaagaaggcgcccttaagccttttggcctaactaacatggtaactttgtcctcattccctgcttcagaattaatatgattttaataagtataacttctttggtctaaggttttcaaagtctgttaccccttcattccatttttataagcactactttttcccatgttattttttctctacttaattaatttttaatttgcaaatttatttagtttttgaataggtaacatgttcacatggcaatacatgaaaagatgagtctccttctcatctgtgcccatcattaagaaagtttcccttaagaatccatggaatcttgctctgcagctctggggcacaatttccatttgatggagttgtacaaatgtcacgtgaatttatcatcacatttcaggctgtgtcatcaaattctaacacatgacattttaaaaaactcatacaagcatattcttactttttttaaatttttcactaacaaggcaagctaactaagtgaagtaaatatatgatttttggcctgtgaaggtgtgcattacttaggctcttacaagtcataagggaaaaagtgctgtcatgggtgatgggtgcttattataatcatatgtgggaactgaggaagcataatgaaccttctaggcagctgcaaagtacctctgagtctcagaggttcccaatctgaaatgtttatcaagtaactggagaagttggagatgacacattgtcattcatgaaacaaggacaagtttacttgccatattttcttaacttccacatgaaaacatttttactatcttttatgtatatgcatatgttctccaaagataaaattttaatgtactagttagtatccaatgtggagatactcagtattgtctctcatcatactataattatgtaaatgccatccatatctattggatgccacaaactccacattaaactggcaaagatcattataatcaaggagtgtcacatcgcacaaggccaagtgctcttattcggaaggactgattccctattggccacgcccctcaggatgcaattgtggtgagcaagtcaggaagatcaacatttcagagactgtccagagaagagtggtttacattgtgtttagtttcacatcctcatacagagatgttacttgatttcatttgaaaaggattgtctgagatattttcttaaaaagcaatattttacaaacagaaaagaaaacacccagaaacgaagtgtatttgaattctttctatgagatgcctaggcaatcttttaaacccaaataagtcaattactcctttctttcttttttttttttttttttttctgagacagggttttgctctgtcacccaagctggaggctggagtgcagtggcgtgatcacaactcaatacagcctcaacctctggggctcaaacaatcctccttcctcaaccttccaagttactgtgactacatgcccatgttatcacacccagctaatttttctgtattttttaaagacaccatgtctcattttgtggcccatgtaggtctcacactcctgggctcaaatgatcctcctgcctcggccctccaaagtgctaggattataggcatgaggcaccacgcctggcctccttctttgctttttctttttgaagagataggttcattgtggcagccaaagtgtcacttatatgtagtgcctgacaaggtacttgcccggttgacaaatgaattgaattagataaagcaatttaattactgggtaagacactgcttaagttattaaaaggcagcactaaaataatctttcaggtatgttagctaaaagtacccattttattaaagctgcattcttatgagactaatgcttcaaccatctatttgtatggaaaatctaagggtcttaaccacatttcaggaatttaattaatatcatgttgtgtttaggaatgctggtttattcactagggtataaatgcaatttattttacagagcctgaagtctttatatgtttctatacccctggataaatctcaactattttagttgttgattttttttgatgttgcctttaaaaaatcaaaactatatttattactttatcaaaccaataggccatcaagctgtcacatgaaagactaaaagactgacttaatcacagcatcttcagatcaacaacaaatgctttccctgctacagaggctactgatttcaggacatgggaatcagaatagaggtcttgcataggactctacctgcctgagggaattaatacatgtaaaacatgttcagtgtgttctatcttaattagaaacagcatctaatattgcacttagaaaattagagaaaactcaagaatacatttttgaaagaaatcagtttgctttatcatggactggaactcaggagtgtctaacgtgattattattctttgaacaagttaaattggtggattttgacataatggaagaaaaccttcctctctcttatctcatgataaatttaaagctgaaaggtcacttgtggtttgtacatgcatattcagaattaagcaaaaaattcattttgatttttatcagttttcaaaattaagaaaacatacaagtgtacacacatacacacaccgaaaaaccacagttttttattgaaagttggttagtttttaagtactgcccatcctgaaatagtaatgttttccctaatcctaaatagaaaactcttttcgttcattatccatcagtagtacttcagtgatataaatcctattactacaacttagtttctcccagagcaaatagctgaatgatttacaacaatggcagtttggatggttgatagctttgcaagatctcatccaactcagccatacatacaagttgtcatgcatcatataattttaaatacattctagaaataaataaataatataatttcacttaccatacttatatttttcagcctttgcagaatacatggtagttttaaaacattttttatcaacttaaaacttaactgtagcatactccagcttatacgcacataaatatgtaactatattctcctccttctctttggataactactgaccataaaattctgaagagtagaaaatccacctttctgatgatggtggcagtcagaagatgtctttcatcccgaacaatttagaaatgtagaaatttcaacgtgttggcaaattcccaaagtttttgtaaacctgtgaaatgtacagagattaatgtggttatgatttcctcaacggtaatttcaatttcagctgtctggtttttatacatataaattcttatgttaataaaaacttctcccttaccttgtatacttgtagggaggtgggagctgaagtaaagaaaaagtaaaaaactcatataaataacaattatttaagcattattaggatgctctccaaagcacgtagaacctagataaacactgaatattagataagaaaaccaatattatttataatttccatgcctacatttacccatttaatatttatcacaaatcaatggttttaggccctcctgctagtgatcttggggaggagttgactaagaggctatagcagaattgtatttctcacatgcatagaatcagagacaaaattaaaatttcccaaagaaatttccttttggaagtttctaaattgatccatgcaaaaaaataaaaataaagctaagggtgtttaagcaggcaaaatgtttggaattttgtttcttaaatgtctttaaggtttgtttttgtgactaaagctctctaatctcggaagtcttgaaggaatctttttaccaagccacatgctcttttgtgaatttctgaattctatggaaatgtaaacttcacaagtattgatgttctgctcccagaagtgtaaggctgacctctgaagttcaaagtctctttcaatttctttggtgtaaacatccaagaaggttagaagagacaacttttagaaagcaaggaaatgggtagcagcagattttatatcaatggtaatgtagaaatcaacttctatagtcaaattccaaataagctgattaagaagaattaactggagatattgatgggaaagagaaattgttgggaaaaataaaatgaacagccttggtgaagaattccattcgttgttaagatttgctcagaaattgtggtggtggtggcgccatggtggagttttagatcaatacaaatttagcatttaattctagatctgttgcttattagccattagatctcagataagctaattaaaattctgagtggcatttcctcatctgcaaaattgggattagtatacttatattgcatggttgttttaggattataggttttgagtagaaactattaccctcacacctggaaagagtaagttagatctactcttacttcactttcttatcctcattgtcgtcattatcactgaagatgcataacgctgtttaaagtctgaaggatgatacagaactgacggtaaacctctctgaaccatgtttaactgcctaaggctagacacgcagtgatatcagaattaatattgttttctttcaaatgaaggattctgagctgtggaccagagtgaggatgtgtatttatgggcttctaggtggtaactgttcttgtgtctaaaccttaattaacataacactctttcacacgaataaaactttcattcattatggttttggcccataaaagttgaagttttttgtttttgtttttattttttcaccaaatcagccctacagcgattcctccacccccattagcaaataccgtaatatatgtctctagtaatcatcctctcacaattctgcttttcctaattttgccgtgagtcaagtttcttgaccacaatgttatgctgaggaagatctaatgttttccatggagcagaaattgttagtcctcaactccaaggtctgccttgtcaagccctgttttccgtgtcttcataaaccttgtcaggcatttatttattcagcacatatctactgttctctgcacaagaattcataaggatctgatgaattatgtcccttctgagtggaatttattcccttctacatttctgcaaaacaggaaattggtagtaagtcaatttgaaggtactatttagctggcacttctgccctttcttttttaacagctgcctctatagacagaacgttgaaatgaaaagatagggaaaattggcagaaacactctgcatgtaattcctatttagacagttttaaacctattttacaaatgataaacctggaatatagtagggagagatttggtgatgaaagaatctagatttcttaactccttattaatacgtactttaagtattggactacaaacttgcatatgtcactggtaatcattgaacacatgttatcatgtaggcactatcaaattggagcctataattgatgaatgagggatatcactactcatctacagtaaagggtcctgaaatgcagaaatatggaactggtgtgactgtatctttggatatttcaagagaagccagaatacatgaattggattcgtgtgtgtgtgtgtgtgtgtgtgtgtgtgtgtgtgtgtgtgtgtgtgtgtgtattgggcatgtatttgacttttaaactttttttttttgagagagtttcattctgtcactcaagctggagtgccgtggtgcaatcttggctcactgtatcctccacatcttgagttcaagtgattctctcacctcagccactagagtagctggaatacaggcacacatcaccatgcccagttaatttttgcgttttttttttttttgtagagacagagttttaccatgttgaccaggctggtctcaaactcctgggctcaagcaatctgctcacctcagcatcccaaaatgctgggattacaggcatgaggcactgcacctggccaaaatattaacaactatttttaaaggcagtactagccaaagaaaacgtgacctgatagagattgtgacttcagaagtttaaggttttacctcctaaaccacatgcttcatttcatattgcattttaactgatgcccttttgttttattctgtagcctcttccccttactctttcttcctcagtgtcttcatctgtgaaataggaataagaacatttattttttgccttcaaacgaccaaggattgtggtgcatgtgaagattaatgaggtcatctggttaagctcttctccctgggtggaagaacaatggcttgtgaatactaagtggcatttgaatcatgtgtgctttcatggaaagagagctggtccatttagctccccgtctgcagggagttataaaagaagaaactagggaggaagaagctgaaaatatttcttcatgactatttcctctggtgaagcataaagtagcaatgagaattctgagatttgtttgcgtgatactttagtcatgcaccacataaagatgtttcggttaaggacaagttacatatgtgacggtggtctcataagattataatagaaattaaaaattcctattcctaagtgacatcatagttgccataacatcacagcacaatgtgttactcacatgtgcgtgatgatgctggtataaacaaatctattgtgctgccagtcatatgaaagtatagcacatacaattgtgtatggtacataatgctaatcatgataataaagattatgttattggttgacatacttactatcctatatttgttattttagaatgtaccacttctacttataaaaataagttaactataaaacaacctcaggcaggtccttcatgagatattccagatgaaggcattattacagagatgatagctccatgtatgttattgcccctaaagacttctcgtggagcaggatgtgaatgtggaggacagtgatactgaacctgaccctgtatatgcgtggattaatgtgtgtgtttgtgtctttttaacaaaacagcttaaaaagcaaaaaaaaaaaaattagaaatgtaaaaaatagcagaaagcttatagaataaggatatgaagaaagaaatatttttacagctatgtgatgtatttgtgttttaaggtaggttattataacagtcaaaaagtttttttaattaaaaaatttataaggtaaaaaagttacagtaagataaggttaatttattattgaggaaagaaaattttaagataaatgaagtgtagcctaagtatacagtagtctacagcagtgtacaacgatgttctaggccctcacattcattcaccacccagtcactggctgacccagagcaagctccattcatgtacatcatttcaaaatcttttataccatgttttcactgtacccttttaatgtatagatatgtttagatacacaaataagtatcattgtgttactggccacaatatacagtacagtaacatgctatacaagtttgtagcctagaagcaataagcaacaccatatagcccagctgtatagcagattatgccgtctaggtgtgtctaagtacactctgtgatgtccacataaggatgaaattacctaatgatgcatgtgttagaccagatctctgttgtgaagcaaagcataactataaagactctgtatgcaatataatgtaaagagagcaaaaccctcacaatgtgagttcatgagtttatacctgttagcaggtgtgtgtgggaaataacctgtctacctaaggttctgtgtagataccttaggacacaaggacaggtgtatgtgacctgtctacctaaggctctgacccataaccgttttttatgctctaatcaaattgtctttttaatcactggactctccctctctctcgtacattagttagggtagactaactactgaaacatacctcaacatatcattagattaacccaatagcagttcatttctctctcagatgtttctagctagtgggtgacatttcatataatgattcaggaaaccaagccttttccatcctatggctccatcatcctctgggcctccccattagctagcaaacgcgataagaatgcagtgaattataggtggaagatgattatgagcgaagtctgagagtggcacatgtgatttttgactcacatttcctaggctagaattcagtcacatttccacacacaggaggctgggaaatgtggtagagctctgccctaagaaaggggacctgattttggtcagccacagacattgtcaagcataaagtgtttccagtcatttgccctcccattttataatctaccaggtatatggttaattcatttaacagaagatgctggagatggaatttgtcattctgtttactctgttgcagctctgcagctattatactagcttctcgattttcattaaatatatctcacactattttgacgggtgctttttaacctttctgttttctccatatactaactgcattctccaccttattacttgaaagggagatttcttctccactgagcattgaaagtgttcaactttgaaaatgtttattgtcagtaagctttgatggtgacaagcatgcctgtgactgtctgtgatttccttaggaatgtcctggtggaacttattaattcctggatagaaatctaaaaatatgtttgttatttttagttttttattctgagactctcaagggaggggcagggttctctttggaatgatgtgtaatataacgataaaatgattgaatattgtgaaattatggagtgactttgattagtgtaggcagtcaatactaatcaacacacacaaagcaatacaaatgttcttgctcttttaactcaatgttttatatgatgtgactcttaatgattgataaatgatacgaaagaaaagataaatacacattcacccaaactgttacttgtcacaagaattgccaacccaagtagccatgaaaagcataggtttatttaacctttgacaaaacttctcaaaccattcatgaaaatggaaagcttcaaggaaaataaatgaacaaaaatatcccccaacgattgtctgtctttaggccgtagagtgtagtgtttaagagttctataaatggactacccaggtttaaatcctaggtataccaaatgctacctgtaattcttggcaagttaattctgaaacttattttcctgttttgtaaagggaagataataaaaataggacccgtgatgtcttagcaggaattaataaaatgatgtttgtgaagatcttataacattatgcatggccggtagaaaacacttgataaaggttagttgtggtaatcacagagagaagaaaaccatcttcttacagagcaaaagaacttaaaacaatgcttctcaaaattttgtgggcatagcagtcacctgagtgtcatgttaatatggcagattctggttctttaggcatggcatggagcctgagattctgcatttcttacaaatttccagatgatattgattttgctggttcgtagaccacactacgaatatcaatgaattaaacttcagttatagttatatctttatctaaatcttggattatctgctctttagctatgaatgtaatcattcgattcctggcaaatgatgagaaggaaaaaattactcttcgtgatgcaaaatacttgagaaatttccgtaagtaagcaaaagatgctgttgagctagatgtctgaggaacaaaagaagttatccaaattctcattcatgccgtaatttggtgacaagaattattatggcctaggaatgtagttttaagagccagtgaagtaagagtaatctgcctcaatattaatgaggctttttgacattctgatttcttatttatttcttatttgctgttttttgtttgtttgcttgtgtgtttgtttgagacggagtctcgctctgtcagccaggctgaaatgcagtggcacgatctcggctcactgcaacctccgcctcccgggttcaagcgattctactgcctcagcctcccgagtagctgggactacaggcacgagccaccacactaactttttgtatttttagtagcgatggggtttcaccgtgttagccaggatggtcttgatctcctgacctcgtaatctgcccgcctcagcctcccgaagtgctgggattcgaggcatgagccacagcgcccagcctttattcactgtttttaaataaactttattgagaaataagttatatagaatgaaatgcacattttaaatgtacagagattttttttccaattttttatattggtaaaatataagtaacataaaatgtaccatcttaaccatttttaaatgtatagtttagtggtattaagtgcattcataatgttgtgcaaccattaacactatttatatctagagcccttttcgtcttttaaaactaaaactccatacccattgaacaataattccctattcccccattccccagtcactggcaacagccattctattttctgtctctgtgattttgactacttttcatacattatataaatggaatcatacagtaagtatcttttgtcgctaatttcatttatttaatgtaatatccccaaagatcatgcatgttgtagcatacataagaattttcttcctatggttgaatactattacagtatatgtatatactacatttcccttatccattcatcagtcaatagatacttggattgcttccatgttttggctattgtaaataatactgctatgcacatgggcatacaaaatctctttgaggccttgctttcgattttggtgggggggtggttacagagagctggaattactgcatcatatggtaattccatttttaatatttttgaggaactgccatattgttttttacagcagctgtaacactttacattctcaccaactgtgcaccaagggttcttatttctctacatcctcatcaacacttattaccttctgttttcttgatagcagccatcctaatgggtgtggtgaaatcttagttttgatttgcatttccctaatggttagtgatgttaagcgtctttaatttctttcagtaatgttttatcgtttttattgtgcaagactttcacctccttggttaaattaattcctaaatattttatttattttgatgctattgaaaataatttttttataattcccttttcagtgtgttcactattagtgagagtggggtattggagtctccaactatgattgtgcaactgtctaccccttcaattgtcttttttttacttcatatatttgatggtctgttattatgtgcataaaagttcataatcattaatcatcttgctatattaaaattttagtaatatgttcttcgtctcttgtaaaatttttaaaatttagtctatttagtctgagagtgtagccacaaccacccttgcactctttgggataccatttgcatttctttcatcctttcactttctatctgtgtctttgaacctaaaatgagtctcttatagacagcagatagttggattatgtttttcaatccattccaccaatctatgtcttttaattggagagcttaattcgttactgatacggagagacttacttctgtcattttgctatttgatttctatatgctgtgtagcttttttgttgcctccccagggttagctgggtttttttttatctcttccttttggttttttgaatgttgtagtttaaaaatattgtctctgtaccaaggattagcctgatgtgtaaacctaaattctttccagatcttttctgcacttgcacctttctcagggcatgtgtggtcactttctgatattccctatacatgcagtttctttcaaatttcctagtctttattgtcagcctcctatgcacagataaagagaaaaatgaagggaatagggataaggcactggaaatcattcagctggagggaagggggcttccaccaatgggaagaagtgcaacagttatgacagattctttgtctgcacttttgtaatcagaagcaataatcagcaatcagtgcacggatacccagtatttggagtacgtgatcctttttgcccactctgactcttactagctatctgcaggttgctccaggagcatgcgtacagctacctgccacgaggattggggtggggaatgggtagctgctattgagtatatgctggaatttgctgaaattaaccacaatttatcatccaagccttcccctggaagttgcaagccttcaacatacttcagagttacaaaagagttgtatcagacagattctacctgtgcaattgttgtccaggtggggagacaaattcttgattcttcatattccaccttcccagaatcccctatctgctggttgtgtatagaatctctttgagctgttgcctaccattttggcattattctggcattattatttctcaatatgctaaagaaaagactagagatttaaacggtagacaataactagcctttaagtttgtatagtatttttttgcctcctgtttttgatagatctcattgcactatttttcagagcagtgtcttaggattcctgctagattatttaatttaggtcactactgtttctgttaatatcatttattttttccccttaattgtccttttaactatgtataatcctgctgaatgtatgtcattgttgggagtgctctaatattcagattttgaatccactggtcatttctcttttgaatattcattttttcttatcttccttcaaagtacgcttatctttatttttatggaattctatagccaagccaagacgtggtacatgatgtacgtgatggcttgcaggtaggctttgaagtctctcaagagggttgcccttcattctccttgcacctatcctgctgctgtatttccatagtaaatggcatgatgcccccaacttagtgaaggtggatggtgaagctcccagagcctggaaacccagagcactcacctgatcaacatctcagttcccacttcttgtcacaatgtaccgcaaacattgtgcatcctcagtgcacacgttttcagtttttacaaccaacagtcctatttatcattttattataattgtcagctgaatgatctatgcacattttgtgacaacattgaccttttgggaggaaaaatagtctgtacttaagggttcatttataggggattgttctgttaaaaatacaacacatagagaaaaaagaatgtgataactgattatatttagtgatgcatgtataaatatacatatgaaaacttatgaagtcatggctctttgggaaataaaaatgttgaaagagagcccagttacacactttgacatctcctagtttttcaacagaagaaccattctatattacctgtttatagacactgaaaagggggaaagggcattaagattaactgacaataaataaatgtttaatatttttcgaaaattgagcatcaccttatatatgttaactcagtccatttcaactgtatgtagtagaaaaagctcatattcttgtgttacaaatattgacaaggaagaagaggtaagctttgatgcatacctaaagtgaccaaaagttagtgacagagccaacctgttaacaaaaccatgctgaattccaacactatgagaaaactgggattgaaagtaaatgctcacaccccaaagtgctctgatcatacttacttgatatctctgcttgtctccaaataattatctttgaatcctatccacgtgattctactctcttcttaaactgcccttctacagatttcttctccatgggaaaccagcagtgagagacatggcagtatagacatttcaagaagaatgagtgatagccaccaatgatttggtaatacaaagcttgtgctgcccatcttaatattttattaatatgaaaataaatgatataaaacatccgtttcttctaagagtatctttagctgtgaatatacatctaagacagttttaataaatatgtggggatttttggtgtaaatgtgttatccagcaagagggaagacagtagaatccttggaggcagaggttactgtctgacagaaagttatttggaggtaaaagttctatttttcttgcttgtttgtttgtttggttggttggttggtttttaaacaatgtcagtcatacaatgcctctcatagagtaggtactcaaaatatatgtgtgaaattaatgttgcctctccacaatttctccttgtggaataaatttttttaaatggcttttagttttaaatcatcttcatgaacatttcctgaaagagagagagagacagatagtgctttaatttctatcatctcctatgaagtatacaaatggtcaataacctctaaaattccttagtagcctatgttactgtcatccaattataatttcttgcataacgaagaccttgactctggattatcagtaatgacatttttggacatgtgtgaagaaacagcaactttttgtagttttgattaataaagtggccatggagatatctttgtggcctttaatgaactttcttttctgattcttcttacaatttgatagccttcttccaaaagggaaaaataagctcctcttgaagcctgggataatgcaatagcattgaggattaaattgatgaattaaaggtaagaggcaatttggggagctataattataccagtggcctcgagaagactatactatctaacagcttctgttatttttctgactacaccatggcatcactgggaggctcctcgcaatctactatgatcagacattcgtagattgtttcttttttaaaaaaaaattatatttcagatacagagaatatcatggttttggctaactcatatatatggcccttggaagtaaagttttgtccattagttcaaggccatgttcccagtgtcttgaacagtgcctggaggagcaggaactcaatagatattttggataaaggaatgaattaattgctcaattgaaaaatgtctatggcttcaattatctattattgtaaacctttaacaatagaggtattgaaagttttctgaatactatcattgaattgatatataagtatgaaccccttgaaaatagtaaaattatctggtaatcacttctgatcatgaatttcaccacttttcagatggaaagagaataacgtctctaatttggatccagaaatctgagattctggatttaagggaactggtgttaagtgcatttgttgataaaagttaatcttactgggccaggcacggcgacgcatgcttgtaatcccaacacttttggaggccaaggcaggaagatcacaaggtcaagagatcgagaccatcctagccaacatggtgaaaccctatctctactaaaaatacaaaaattagctgggtgtggtggtgtgcgcctgtagtcccagctactcgggaggctgaggccagagaatcgcttgaacccaggaggcaaaggttgcagtgagccgagatggcacgactgcactccatcctagagacagagcaagactctgtctcaaaaaaaagtaatcttagtgacaagtcatttactatgacttgtcatggttttccaaagttgaagcaatggttttttataaatatggtagatagccagtcaaatggaaatggtatgataagcattatacaaaaaaatagaactgaggcaaacacctctgcccaaacaccaacctgatagtaggctcagatgattaaaaaaaaaaaagtactttattttttttagagcaataggtattaaagaaagaagtcttttgaagatagctaaacattttggatgttaattaaaaccctattctatatgtgggttgaagcatagtttaggacacttctaggtaaatgtggtttatttctaaacaccaaatagaaaagagttcttagaggacacatttaagattattcaagatttctgtacagtgcaagaatccattgcggaagaaaagaaagagaaatttcttatttaagttaatgggaggaaaaagaaaaaagaatatttaaagcccaataggaatgggaagaatagaagaacttatgaagaataatgtttagtgaaaataacattctagctttctatataataccagctaaaggagtgtatataataaataatgaaaatgctagtaaccagaattaagcatatccagtcttttagaaaccaattcttaccagatttctgaaagataaatatttaactagtttttctatgtgtggtggactatgtggattcaaactcttccttactaattttactgttactttttaaacatgaggctgctgaagaataaccaaattctacattgtcctcaaggaagacacagccaattatatacgattgatttatttaattttgtcatttttttcttctttcataaaaaatcaatatagtttgaaaataaaatagtttacataacttagctttaactgaatgtaatattcaattagatttcaccaaataactatttcaataattcagcgttctttttcctcctcccctttccaaacactatctgtcttttctcctcccagtcaaactagttaatttgtcaggaatcgtgtcacgaacataaacattctgataatagtccctctttgcaaacagaattgatggcaatataaacaattgctctaagtaagtcagcatttaagtttgccaacattgcccttttaggctctataacttaccgagaactcatttcattttgagaacaacttattggtaaccagttaaaactagcttgatcttttttatttcaaatgttttatatgctcccagagcaaaaaaattaattaattatcacttgcatctggtacagaggtagggattctatatgaaacttaccaactgtgtaatgcagataaagtttctaatcttaattaaataccagttccattatctgaaagtaccagttcatatctaatgtttaataaaattccttacaatgactcctcatctcacttagggtaaaagccagtcagaataatctaaaaggctcgtctacagttaaccctctcctcaccttcttgcttcctctgttcaattcactagggttctctgctgtctgaaaatttccaaggcacgttgtcatataagagcccgtgtgtactggcatttcctctgcctggatgggtattctcccgaatatccatttgcctcctttatctctttcaagcatttgttcaaatgtcacttgataagttgaccaccctgaccatcctatggaaaaatatgtctctgctacttcagtacttcctatctttactcccattttatttttcattacagcacatatattaagtgctttacttttcaaattgtctgttttcaaccactagaatgaaagcatgatgaaggcagggatttttgcaattgttactgctgtatgcccagggcacaaaacagtgtctggcacctagggaggacccactatatgttttgatatttgcttaatgaatgagtaaatgcacatttactgcatcttatattttcacagggctttcagactttttctttctgtcagtagaaatgtgtacttttgggttccagaatcttatatggctaacatgtgggttaatgagaaagctaactcctttttatacttgaatggagggaatggcacatacataatcaaatatacgatttgattatgcaaaaccaatttttatcattaaaccattctattaagttaatattaatataattgaaagcagtatcatttgcatcatcggcattaatttcataactttttaggaaaagctatatgaatctgccaaaaatatttaatttttaaaaaataactggttactttgtatagaaataattttaatatttagcatgcttatacaaatgggaatgagcttatcacagttgttaatgagtagccttcaatttgttagctttgaagttcaatcatttacgtagcacctactcacctaatttattaatctactattaagttcaaggattatcttgctaccaccaaatagggcgaaaaagaataaaaacagttttactgccctgtcttgtactcaataagccaatgtttgaaattatctaaaaatgtaaattaatatttaatatttaaccaaattgtttccctgctgcaaaaatatctgggaaataatgttcttgccctcctttccccaaataaattgtaaagataacaaatggaaaatattggtgataattggacaagctatggcaatctgaatgagatgaaatatgattttgaatagattgctacctactgtcaagttgacattgacatagattggaaaatatccatttttcttgtgtaaagaaccattacttggcttcatttaattctcgggcattctctaatctaatctatcccagtggtataaccatgtagtctctggaccaaacaacgtcagtatacccctgagaacttgtttgaaatacaaattcttgaaccctaccccaaacctattaatcaaaactctgagagtggggcccagtgatgagtttttaaacaactatttcagatagttctcatgcaaatagtttgagaaacactgattgttcctgttctgtcaataaatatgtagacactattatgtataagatactatgtcttatgcagaacagtaagatgcaaaatatatgtttcctcccatagaagaaattatcctgaagattactataaagattctgaaggaaagtcttctgaaatgacattctgctagcaaccatgaatattatttgttgaagaaatgaagcactgacccagtctttctctggcttttgttttatttttagaaatctctaagcccatatttataaatttaaatttgggagataaaagagtttaagtttaatataaaaacattagtaatcctgtcaggatgaaaaatcatattcatgtacaattgtaacacaaaacaaaataattcttttttatcatacctccataaattttgacttagaaaatcgagtaagaagtaaccaatcagaataaggataggagatgttcaccaagacacttcctttactatctttgaacgatacaattaatcactgtttcaatttctttcatgtcattctcattgtaaactatattagcttcttcatggataggatacatttgatattatatgtcagttgtccagacagaaaaacacaaaacactctaggtatttcagactaagagcctttaatacaggaattgtttacaaaaatgttaggactggaggagaaaagagcaaaggatgacataaatcagacattagaaaaaagaaattgctacttcccctaaggttggccaaccaaaactgaggagcttgtcttagcagatcttagggttacatacctgtctaacactgctgtaggactctgctactcagaactgccaccaataccactttgagagctgccaaatactactactggcctaggctggccctgccattttggtcagcagtgctagagcaagctagcagctaaactggaactgcaggtttgctggaacgtgtagctgcctactgatgttgaggacaaatctagaagccaagaaaaaaaaaataacacttgccttttttcctatctttcagtatcccactagtaactcccattatcagaagtaaccagaagttagctggaaaagtgttgtttgcagggtctcggcccatggaatacaaaataatgcacaaaagggtggaatgaagctaaaagaaaggaggtacaatacttacacagatgtgaggacatatttttaaaaaatcagttggacttcacagaatcacagaatttaagagcttgcctgatccttgatatccttttgcctgtgctattttttgaaattttaatacttttcagttatataactgaggttttgaaagaaaatctgaggaataagttcattgtaaaatagataaaggcaaaactgtgtggaaactgatgttgaaaggttagatccctgcctgtagtgggcactattgggatgccattgtaccccatcattttcccctttgccagattgactgatgcgtttcccacttagttgatggaagtgttggtttcttctggctcacagctgccctgttctctggaaaattgccctgggctgaatggaggtgccccacgccctctgggtaggcttgctgctctgacaaaaagctattctccttgtctcaaggcagagccagcctgtggtgtggagtgtgctcccgaaccctcatgggagagaccaaagctagactttaccttaaactatattgtcacttggctcttctttcttccccttacggctttacctcacctacttcactccctcaataaatcacatgtcctgaatccttgtctaaggttctgcttctaggtactccaacctaagatggtatccatactgtttctcctcactctcaaatttgagcttcacatgagttgcctcattttacagtagacaatactgagtcacagaaagtcatctatctaagtgccttgtccaaggtcatgttgctttaaacctagtgttccagccctagattcattgtaccacacggtttttaagtctcattaaaataaaaaaatcaggatatttttgtaatttcccttaagatccgcaaaatgaagtccggagtgactggtagataaaaattattgatttaaaaacaaagctgtcattgaggtgttagattaaatgactcctagaaacattgtgggggttccatgggtgatttttttcagccttcacatgagtgtacattctcttcctcattccactttcttcctcctttttgttgttcatgttccttttcatgttcagtgctagttttgttgttgttttttaaaccacctgtgctgaaggaaggactggtttcttactggggcgactgcacacatgagtatgcaataactttgattcagctagcaagtgcgctttcatagaatcatgcctgggaatctttctgaataaatcttacactggtgtcctttgccaaacttcgcattttcaaattgcaggtcttatataagggctttcaacttaacatttgtcagtttttgtttttgtttattagcttctgatctcttttaacaaagagatcattccatgtaatcattccttataatatttgataggtctttggtgctagtcaaatacttttctacacagtaaatgatgtttaacatattcctacctacataaaaggctaaacggacccttattatgggttaaatggcgttctcccaaaattcatgtgttccttcccccatctataaatctgaccttatttggaaatagggtcattgaagatttaattagttaagaaactagtaggcttccagttccaagaaggccaaataggaagagctccagtctatagctcccagcatgagcgacgcagaagacggatgatttctgcatttccaactcaggtactgggttcatctcactgggacttgttggactgtgggtgcagcccacagagtgtgagccgaagcagggcagggcatcgcctcactcgggaatcacaaggggtcagggaattccctctgctaaccaagggaagccatgacagatggttccgggaaaattgggacactcccaccctaatactgtgcttttccaatggtcttagcaaatggcacaccaggagattatatcttgcacctggctcagagggtcccgtgcccacggagccttgctcactgctaacacagcagtccaagatcgaactgcaaggcagcagcaaggctggtggaggggcgtcctccactgctgaggcttgagtaggtaaacaaagcggctgggaagctccaactgggtggagcccaccccagctcaaggaggcctgcctgcctttgtagactccacctctgggggcagggcatagctgaacaaaaggcacagaaacttctgcagacttaaacgcccctgtctgacagttttgaagagagcattgcttctctgagcacggagtttgagatctgagaatggacagactgcctcctcaagtgagaccctgacccccaagtagcctaactgggagacatctcacaataggggccgactgacacctcacaaggccgagtgcccctctgagacgaagcttccagaggaaggatcagacagcaacatttgctgttctgcaatatttgctgttctgcagcctctgctggtgatacccaggccaagagggtctgtactggacctccagcaaactccaacagacctgcagctgagggtcctgactgttagaaggaaaactaacaaacagaaaggaatagcatcaacgtcaacaaaaaggacatctacaccaaaaccccacctgtgggtcaccatcatcaaagaccaaaggtagctaaaaccacaaagatggggagaaaccagagcagaaaatctgaaaattctaaaaatcagagtgcctcttctcctccaaacgaacacagctcctcgctagcaatagaacaaagctggacggagaatgactttgacaagttgacaaaagtaggcttcagaagatcagtaataacaaacttctccaatctaaagcaggatgttcgaacccatcgcaaagaagctaaaaaccttgaaaaaagattagacgaatggctaactagaataaacagcatagagaagaccttaaatgacctgacagagttgaaaaccatggcacaagaactacgtgacacatgcacaagcttcagtagctaattcgatcaagtggaagaaagggtatcagtgattgaagatcaaattaatgaaatgaagcgagaagagaagtttagagaaaaaagagtaaaaagcaacaaacaaagcctccaagaaatatggtactatgtgaagagaccaaatctacatctgattggtgtacctgaaagtgacggggagaatggaaccaagctggaaaacactcttcagggtattatccaggagaacttccccaacctagcaaggcaggccaacattcaaattaaggaaatacatagaacaccacaaagatactccttgagaatcagagcaacccctagacacataattgtcagattcacaaaggttgtaatgaaggaaaatatgttaagggcagccagagagaaaggtcaggttacccataaatggaagcccatcagactaacagtagatctctcaacaggaactctataagccagaagagagtgggggccgatattcaacattcttaaagaaaagaattttcaacccagaatttcatatccagccaaactaagcttcataagtgaaggagaaataaaattctttacagacaagcaaatgctgagagattttatcaccaccaggcctgccttacaagagctcctaaaggaagcagtaaacatggaaaggaataaccggtaccagccactgcaaaaatatgccaaattgtaaagaccatcaatgctaggaagaaacttcatcaactaacaagcaaaataaccagctaacgtcataatgactggatcaaattcacacataacaatattaaccttaaatataaatgggcgaaatgctccaattaaaagacacagacttgcaaattggataaagagtcaagacacatcagtgtgctatattcaggagacccatctcatgtgcagagacagacataggctaaaaataaagatatgaaagaagatctaccaagcaaatggaaaacaaaaaaaagcaggggttgcaatcctagcctctgataaaacagattttaaatgaacaaagatcaaaagagacaaagaaggccattacataatgtaaagggatcaattcaacaagaagagctatgtcttaatatatatgcacccaatacaggagcacccagattcataaagcaagtccttagagacatacaaagaggcttagactcccacacaataatgggagactttaacaccccactgtcaacattagacagatcaacaagacagaaaggtaacaaggatatccaggccttgaattcagctctgcaccaagtggacctaatagacatctacagaactctccaccccaaatcaacagaatatacattcttctcagcaccacatcgcacttattacattcctcagcaaatgtaaaagaacagaaattataacaaactgtctctcagaccacagtgaaatcaaattagaactcaggattaagaaactcaataccgcacaactccatggaaactgaacaacctgttcctgaatgactactgggtaaataacgaaatgaaggcagaaataaagatgttctttgaaaccagtgagagcaaagacacaacataccagaatctctgggatacatttgaagcagtgtgtagagagaaatttatagcactaaatgcccacaagagaaagcaggaaagatctaaaatcaacaccctaaaatcacaattaaaagaactagagaagcaagagcaaacacattcaaaagctagcagaaggcaacaaataactaagatcagagcagaactgaaggaaatagagacacaaaaaacccttcaaaaaatcagtgaatccaggagctggtttttttttttttaaaagatcaacaaaattgatagactgacagcaagactagtaaagaagaaaagggagaagaatcatatagacgcaataaaaaataataaaagtgatatcaccaccaatcccacagaaatacaaactaccatcagagaatactgtaaacacctctatgcaaataaactagaaaatctagaagaaatggataaattcctggacaaatataccctcccaagactaaaccaggaagaagttgaatccctgaatagaccaatgacaggctctgaaattgaggcaatagttaatagcctaccaaccaaaaaagtccaggaccagacggattcacagccgaattctactagaggtacaaagaggagctggtaccattcgttctgaaactataccaatcaatagaaaaggagggaatcctccctaactcattttatgaggcctgcatcatcctgataccaaagcctggcagagatacaacaaaaaaagagaattttagatcaatatgcctgatgaacatcgatgcaaaaatcctcaataaaatactggcaaaccgaatccagcagcacatcagaaagcttatccatcatgatcaagtgggctttattcctgggatgtgaggctggttcaacatatgcaaatcagtaaatgtaatccatcatataaacagaaccaaagacaaaaaccacatgattatctcaatagatgcagaaaaggcctttgacaaaattcaacagcccttcatgctaaaaactctcagtaaactaggtattgatgggacatatctcaaaatgataagagctatttataacaaacccacagccaatattatactaaatgggcaaagattggaagcattccctttgaaaactggcacaagacagggatgccctctctcaccactcctattcaacatagtgtcggaagttctggccagggtaatcaggcgggagaaagaaagaaagggtattcagttagcgaaagaggaagtcaaattgtccccgtttgcagatgacatgattgtatatttagtaaatcccatcatctcagcccaaaatctccttaaactgataagcaacgtcagcagagtctcaggatacaaaatcagtgtgcaaaaatcacaagcattcctatacaccaataatagacagagagccaaatcatgagtgaactcccattcacaattgcttcaaagagaataaaatacataggaatccaacttacaagggatgtgaaggacctattcaaggagaactacaaaccactgctccaaaaaaaaaaaaaaaaaaaaagacacaaatggaagaacattccatgctcatggataggaagaatcaatattgtgaaaatgcccatactgcccaaggtaatttatagattaaatgccatccccatcaagcaaccaattactttcttcacagaattggaaaaaactactttaaagttcatatagaaccaaaaaagagcctgcattgccaaggcaatcctaagcaaaaagaacaaagctggaggcatcacgctacctgacttcaaactatactacaaggctacagtaacaaaaacagcatggtactggtaccaaaacagcatggttctggtaccaaaacagagatatagaccaatggaacagaacagagccctcagaaataataccacacatctacaaccatctgatctttgacaaacttgacaaaaacaagaaatggggaaaggattccctatttaataaatagcgctgggaaaactggctagccatatgtagaaagctgaaactggatcccttccttacaccttatacaacaattaattccagatggattaaagacttaaatgttagacttaaaaccataaaaatcctagaagaaaacctaggcagtatcattcaggacataggcatgggcaaggacttcatgtctaaaacaccaaaagcaatggcaaaaaaaagccaaaatagacaaatgggatctaattaaactaaagagcttctgcacaggaaaagaaactaccatcacagtgaacaggctacttacagaatgggagaaaatttttgcaatctacctctctgacaaagggctaatatccagaatctacaaagcacttaaagaaatttacaagaaaaaatcaaacaaccccatcaaaaaatgggtgaaggatatgaatagacacttctcaaaagaagacatttatgcagccaacagacacatgaaaaaatgctcatcatcactggtcttcagagaaatgcgaatcaaaaccacaatgagattccatctcataccagttagaatgacaatcattaaaaagtcaggaaacaataggtgctggagaggatgtggagaaatagcacttttacactgttggtgggtctgtaaactagttcaaccattgtggaagacagtgtggtgattcctcaaggatctagaactagaaataccatttgacccagtgatcccattactgggtatactcccaaaggattataaatcatgctgctataaagacacatgcacacatatgtttatggtggcactattcacaatagcaaagacttggaaccaaccaagatgtccatcactgatagactggattaagcaaatgtggcacatatacaccatggaatactatgcagccataaaaaaggatgagttcatgtcctttgtagggacatggatgaagctggaaaccatcattctcagcaaactattgcaaggacagaaaaccaaacactgcatgttctcacttataggtgggaactgaacaatgagaacacttggacacagggtggggagcatcacataccggggcctgtcgtggagtgggggaaggggggaaggatagcattaggagaaatacctgatgtaaattatgagttgatgggtacagcacaccaacatggcacatgtatacatatgtaacaaacctgcacgttgtgcacatgtaccctagaacttaaagtataataaataaatttttaaaaaagaaattagtaaacttaatttttcacctgttacgcctctcttccagtttccaaattcaattattcatattactgcttctacattcagttttataagatttacattttattaaacaaccatcataaccaaaattgttcactttagttctgtatttaaatgcaatcagtagtaactttgaatcattttatataatgactgtgcaatccttaaattctcatattgatatcacagttttctagattttgtcaaccagtagcttttgagagaaatcatatgagtgctatattctaatatctgtgcatatttttaaataccttttaaaaaatatacatgatgataactttactgggtgtaaaacacatgccattttttccccttcaaaactaattgcagcatagttttgttttgtaatttctttgcttgctgtattagtccattcttgcattgctatgaagaaatacttgacactgggtaatttatgaagaaaagaggtttaattggcacatagttctgcaggctgtacgggaagcatgacagtatctgcttctggggaggcctcagggagcttttactcatggtagaaggcaaagcagaagcaggcgtcttacatggccagaacaggaccaagaaagacagaaagctacacacttttaaacaaccatatctcaagagaactcactcactatacagtactaagggggatggtactaaacaattcatgagaaaccaccctcataatccaatcacctcccaccaagccccacctccaacaatggagattaaatttcaacatgagatttgggtgaggacacaaatccaaaccatatcacttgctttgatgtttgttttcttccgatgatagtgttgctaaagtgagtaatcctgaattactatctgatcgctaacaagctagatgccttaataattttttctctgttcttgaaattaaatagttattgcttgttctgcaacaaaatttttctaaagtttggtagtcaattttcatatgtagatttatgaaagtcttcattaatttttttttagaaatggctttttaaaatttgaatatttttgtttggtgttatttttttgaaagcctgtgcactttataggtgactcattttcaggagtatctattcaaacgctcattgcaaatttctccacatttgacatatatacttcaacatctgctctctgaacttgtggcatttttccagttttactgtagacagcctcagattctgaaattttttgtccttttcttctttttattgggttttctggaaaataggcccttttttccacaggcagtctaggactattttcctgaaaattagatataatgaaggataacctaataagagttgttacactcttggggttagtgtaatgtaatagaaaaagcaccagaatgtgagtcagacaagctgaattttaactaggattctgtcacataccagctctgtggccttggttaaatcaccaaatactctgagcctcagtttctttacaaagtttttgtgagaattaaataaagaacctgcatgaaatcatgagtaagttacatgagaagtataaatcagaatgctagcgattatttatttaaaatgaactatggggctaaagaaagtaaggttactacattaaggaactaggaaccagtccttccatcatgctcagctctggttaggcctgtgctcaagttctctgccccatttgtcaattcctgttaatacatgattcattgaaaccttggttgatataaaatattctagtgacttggggatggtgggagataagaagagaagggatttcaaaatatatgttaaataggagttttgctttcaagtatttacctttgaaaatttgaaaataattgaaaataattcagaggagatttatatatatattattaggggttaggaagtagttcttacaccaaacagtaaagaaaaactgatggtatttttctttgaggagaaaagtctgaaagaagatttaatattccattacttgtgatacaatggagattaataaccaaccaagattctttgtctccaataattatagggcaaatgaaaactggctttagttgcatcagtagtaatctccagagagtgaaaacagggtcggacatctttgtaaggaagagtcacccacttgtgatctcagggattgatgccataatttccatatacaaattttatggtttgacaaaaaatattttgtcacccatgaggaggcagtcacccaagaaagagatagtataacaattaaaaatttgagagaatgagttactggagaaggctacgggatactggattcttgaagggggaagaagtttatatcaggtagaggggaaagattcaacatatggagtccaggggcccatctacccctccattttattgagatccaaccctcagtaggagctactagccactgactggctattgactgagatgatataatcacctttcggcacactttaaaagctgaacaaataatttacaggtatcttacattatttcccaaacttcctgacaaccatttagtatggtggctacatcaaaatggtttgagcaagcactgctccagatagtcctagaatcacagcttcagaatcacctgggagcttgtcagaaatgaaaattcatgggcaccacctagacctgctaaattagtgtctctgcaaatggagtcccagcattctgtgtttccatatgctctccagatgagttttatgcatgataaagtttgaaaaaccactgatattgattactctttacttgtgaagaatatatatgagcttcttgtatttatttttcgactcaacatatacccatgtgcaaacaaccaaaaagcagagtaaaatggggttttgcattatccgtcgatttttctatttttgagccaatctcttaatagcatttattagagtcacttttgccatacaatagattgccaagatcatgattaagaagcttattaaaatgaatttaaaatgtttaaatggaaacgacctggagatgtaattgccaaaatttaatcaagcatttaatttgtagctcataccagccaaatggattttcctttttttcagttccctgtttgtacaaggaaattaaaaagtatggaatcacaggccaagcagtgaacccttgatactgcagtgtgctcacttactctcattagccgtattatatcatcctactcctttggaattttagtttcccaagccagtctagaggatagataacaattgactgtatatatacacaatgggtgagttaatatgctttagcaataatttatactacttgactgtatatatatatatatatattatacatagtgttataaattactgctaaaacatattgactcaccccatcagcattaataaaataggctaaatattctgatcttaattctgcttgtttaaaattcccttgttttagcatgcctgtctagctgcccttaaattgctaaactggggagaagtgtgatttagaattggaacatatttcatgtgaatttgatgatggccaccgctgataaaatacctttgtgttgcctcttccattctgccagtgataataggttttcactgagctctttgcacttgttttacaaaggctcaagccttgaatactttgtgcctcacagtatccatcatttagactctgaaatccccagtgtcgatttgacagaacagtcgtttatcagccacggtttgccaagtcagcattaatgcctatgtggcctgaggaaaaaaataaataagatcagtgatgttctaatcaagctcagacaaacatgtttttatacttgcatttgagtgatgttttgcctaacagaagtgctgggttaagatacattaacttgggtcccattctattctctcttgctctggatgtgatgagcatagcgagttctaagcaaaatagtgcgtgtttttctcctctgagtagagttttgttggcatttcctaacgcttctttatgaaaaagaaaatcaagactttccagtaacaagtcattctatctaatttcacttggtgcaaacagtgactgaaatatttcttgattttaattagaagaaagcaagagaaagacagaccacaagagtttcatgaagagataggcatatattgtaaaatttccctaacattttattataaaattcccaaatacaatcaaagatgaaaaggagtttacagtgagctcactgccttaactctacaatgaaccttttactattcttgttttattatatgcccgtcactctttcattcatcctatttttttcaataaggcatctattacaggtatcagtacacttcacttctaaacattcagcatgtatatcatcaactagagttcaatgtttctatttttcctcttttaggatggaatttcaatacaatgaaatacaggaatcttaagtatgctgtttaatgagctttaccaaatgtatttacctgtgtaacttaaaaccctattggagaaataacattgctgtcaccctggaaattaattcatgtatgtatgtctgcattgatgcatacatactgctagacctctgatacttttcttaatttaataaagagagtccactagtacattacagggtagctgtgggggctgacatgttcatctctctgctatctttctctactctcttaatgaaaattacattctgctcagcctacttgttggcctatatatcctgcacttactgaatgatttcttaaatgttcttcatgaaatgtttcattaaaattagtgtaagaatgaaaaaaatgtacaaagagaaagctaatcagcttcttctcctaccaacacctccaacataagtaaatagcctcatgctgactgatctataactttatttttttttcttcagcttttattttaagttaatgggtacatgtgcagcatgtgcaggtttgttacgtaggtaaatgtgtgctctggtggtttggatcacatattatcccatcacccaagtattaagcccagcatccattagctagtcttccttatgctctccatcccccacacaatccccccagacaggccccagtgtgtattgttcccccttccatgtgtccatgtgttcaatcattcagctcccacttgtaagtgagaacacacagtgtttggttttctgttcccgcgttagtttgctgaggataatggctttcaaccccatccatgtccctgcaaaggacatgatcttcttcctttttatggttgcatagtattccatggtgtatatgtaccacattttctttatccagtctatcattgatgggcatttgggttgattccatgtctttgctgttgagaatagtgctgcaatgaacacatgcatgcatgtatctttataataaaatgatttatatttctttgggtatatacccagtaatgaaattgctgggcaaatggtacttctgcctctaggtctttgaggaaccaccatactgtcttccacaatggttgaactaaaatttgcacttccaccaacaatttaaaagcattcctttttatctacaacctcaccagcatctgtcattttttgacttgttaataacagccattctgactggtgtgagatagcatctcaatggatccacaactttctttgtgctcaccaatcttacgaaaggatggcttgatgcaggaaggcaattagatgtttgtttgtttgtttgttttgagtcggagtctcgctctgatgccaggctggagcgcaatggtgccatcttggctcactgtaacctcctactccctggttcaagtggttctcttgcctcagcctcctgagtagctgggattacaggcacacgccaccatgtccaggtaattttttgtttgtttgtttgttttagtagagacgggtttcaccatgttggccaggatggtctccgtctcctgacctcatgatccgccggccttggcctcccaaagtgcggggatgacaggcatgaaccaccatgcccggctagatgctagtttttaaacaagctctgattcattgataatgatttttggctgcttggggtgctgtgttaggaaggatcctgtctatacttagtggaagagtaccaagatttcttacagtttttgccacaggcaggagttgaaactggaaagcaagggagtgggtggcattcctttcccattgtaggtttggggagcgaactgctgcacctggcaactgaaagggccagaagggcacagagtaccactctataacatttctattctggttcatttttgtgtcctattaaaacagctaatgtttctctgcaacagtgctattcacaaaaaggctgtccaagtagggtttggatacacaaagtaggaaagagagagagagaaggagatagattggcagaaactagcatattctatcattctaagaatgcaaacgtgtcaccatttgccttaaagctgatatactctaggaattactcttcctatgcaaagtgtacaattctaagtgtttaagtatttggatcactgttactgtgggataataatgtccagttcaacttcactgcttttctcagagaggcaaatagatactgggtcagtcaagattattcttagtgtgtcgggggcagaatggtggggtgaaaaatcaagctttgctttcattttttactacccggcttcctacataacacttcagcagatgtcaagaccatttgtttggttcctcatagcctccatgtgatctttctcttcactgcagtgttccccaggtgtgagttgctttgctcaagatcattttcaatgactcaattttcaaagcaaatgtacacacaagacagtagtattttcaaaaacacaggttatcacattttccaagggggatagacaagagaagggaggatgccgagaatagagtgtgagtttatttcacatagcaggtctcataaagattgcatccataaatgtgctgccaaattgaacaatagcagtggggaataaaggggaggagggaagagaggactcagatgaaggcaaagagaaaaaacaactttaggaaagtgtgaagtttaaggagacatgcctataacactggctttctacccagtctcatgctaactcctggctagaaatatatagggacacagacacacacacacacaaacacaccacctccttgaaggaagaaacattttatttaatcaggattgctaaggaatgttgctgctgataaggcgacagaaaatatttctgggagtgcattttcggaacttgggaacagagacagtctgtctgaacccagctcaacttttctttcttatcactttttaaaagcatgttatctttaagagccaaattaacttttcatgatatggtttctcagcagctgacacttgggcattacagggctggacaggaatgactaagcagttttgtaaaatgactatccccagagctgctggcttgctggttttggtgtcaatcatatatttaggatcttttttcctgtctagatttatgtagctctttaagaatagaattgcttggtccaggaaaggtgtgactagtataataaacaaaagaagccacagaggatattcttgtgagaaaccaattaattattcacaccaatatgttataagtacagttcattttctcttttgactattgcattacaaagaattttctcaatgcattcaggagatataattaataataccctaaacagtaattttaatagttatggtgttgtactgggaggcctatcaactaaaattcaaaaataaaataaacacagtccctacttttaggaagacaagagtcactgtatttaaatttttacttttgatgtctttattatttgtggacactctgaaaaacataaaatgtcatattataacagactttaatgttttaaaataagtgggattttcaaaaacacacagttctggaaaggtgtatttctttatgtacctatctatatgataagaagttttaccacatggctgtatcatttatggaatcaattaaaaccaactgtggtggtaaaaaaataacctctagtggacttattcaactgtatatggaattttatttagggagttatggaatgaatagtttttttccctgaaagcattgttttgttagttttctgattgtttgatagatagacataaaaattttccttataagtccttggatataattttacttttcacatatgattgatcccttctatttattttgccatcagaaaccaattttttaacattgcatattatccagaatttgaatgtcacaaaattcaaacaggtaaaatgtaaggtttgttatgtacacacacacacacacacacacacacacacacacacagacacatacactgagctaaagaggatggtctttgtgtacagaaaaggataacattttttccctttagtatgtttattgatgaacacaaacagaattctgtttggtttatgttgcatgttttattgtttctttttttagattttaattttcctgttactatgtgtgtatgtgtgtaagtataagttttatatttttcaggggtaaaacagtttccggtaaacaatttttttgttttgctttgttttgttttgttttgttttgagacggagtcttgctctgtcacccaggcgggagtgcagtggcgcgatctcggctcactgcaagctccgcctcccgggttcacaccattctcctgcctcagcctcccgagtagctgggactacaggcgcccgccaccacgcccagctaatttttttttgtatttttagtagagatggggtttcaccatgttagccaggatggtctccatctcctgacctcgtgatccgcccgcctcgacctcccaaagtgctggcattacaggcgcgagctgcagcgcccagcccggtaaacattttttttatagagggagttttaatacgttctgtattagtttctctgttttttcatttgtatatttgatgtgatactcaagttgctatttaagctctattctacctttttttgtcccatgggagtccattccatcctctaaaaaagggaagaacatcagttctttagccattacttggtgcaaaacaagttccggtttcctccttccctcaggtgtggataagagcagaaaagtagatacacaaagaggtatatacttattagaaagaaatcacttgcttaaacaataggcaggaactgtgcgactcgacctggaacaaataggcataaataagcaggaaaatgtaatatttgtttgagagcttgaaatgcagtcttttaggacatatctaggacatccctgcatcatcactttggtaagaacttcagtaccttgcctgccagtcatttatatgcacgttccgtcacagttagtcccacctctccccacaccttctgcaccactgctgccaccaccatcactgtgcctggcagctgggtgaatcaggaagacttctaacgttagttttcccatatttaccaacaagtcttccaaagtgggcccaaattaaagttgtgtaacaacatcgctttccctctctggatcttcattactggagatggaggcaagcactttactatggtaagcacttttgaccttagacaggtggcctaaaaggtgggtaccaactagcctttaggacatattcaggagggcttctataccaagactctctggccaacgtaggctaacagttcttttcccttgagttttcatttgcttcatcttaaccatatctctattactctaatcagtacattctaataaaattacttgtatgtctctcagtaaaaatatggtcttcttgagtccccccatttcaaaattattttattagatctttttaggcttactgtgtctctgaagggcttggtgtatattcattgtttgatagcatatcatggacagttctgatattttaaacaaaaaataggccgggcatggtggctcatgcctgtaattccaacattttggggaagatgaaataggagaattgcttgaggccaggagtttaagaccagcctgggtatcataagagaccccatctctgtaaaaaataaaattaaaaagccagatgtgattgcatgccccactagtcccagctactagagacgctgaagccagagggttgcttgagtgcaggagttctaaattacagtgggctgtgatcacactctatcctggaccacacagaaaaaccctgtctgtaaaaaaaattcaaaaacaaataattacaaagaataggaaattaattaaatataagaaccaatgattgcttacattttcatacgtctttccttattttcctttatcttggtacatataaactctaaaataataggatataacttaacaaatgtttattgtttatttttttcttcaatttctatgtgtaacaaaaccttaggattgtcagaaataaagtcattattttgtttaaggaggagggtcctgctagccttagtaaacatagcccttatctttcttctctaagataaaatggcaggtactggctagatgctgcactctacaagtatatcatcagttttgttttgctttcagactagtactaggaaagaatgaggtcatgcattttgaaagtgggtttttgtgggttttctttatgtgtggtttctttttgagtcagataagtttttttccttccttttcaggtcacacttatacttttatgcaaaatattctaagttgtgtcaactgaggacatggctacagataatagaagtgattttaaaagccacttaacataaaaggattgttccaatttcccagaacagccaggtttctgtttaatccaacccctttagaatatagcttatatctctgatgttcaaagccatgtgttcgtcttgaaataatcaaaacaatagaatcctcaaagaatccagtgcataggcaacatgtattatgttatttagttagttttgacaaggttatctaggcagttaaacattattatctacaggatttctttttccttcaacatgaagacattaagttcagatttgtagagcagagaatatctgtttcatatttgacacaagctatctcaatttaatccccattttccttcattagacaagcgaagctaattattttgagaaatgaatgataaataactactgataattagacacaaaggttttcggggtatgctgtgttggttcatatagggaatgttcataaaacattataacagcaaaaacattaatttgaagaaaaaatttggacccttcaaattttgctttcctgttttcccatttccatatgctgagaagataccaatattttcacaattgtgacttgctagacataagttacgagggataataaaataatatcctacctattagttgtagcaactagcttcaaggggattattagacccatgaactgaagtcaagtagtatagaatgataattacatttattacagtatgcccagattatagatattttgatatgtcttgccacaaaggacaccagagtcatattatgtttcagtggtactagaggaagctgcacgaataattaccgttagtttcatggaacatctaaactgatattattttcacccagctctactccaattgcaaattgcttttcccaaagcaagagctagctttctcatctttctgcttgatgaaggtaagttattcagccctgatttgccttttcttctcttctcttacctcctgttattcttagccagtaccacatcctgaaacaatgaccaatcttccaatgcttttatgtgcattgatttcctatccccattttcttgagggtagagagattatttgcctttgcagtgatccaaaaaatacttatcgcaagttgaagagcttaatgcactcttgttaatagttattttgtcagtttagaagagggcaaagacaggggacagtttctatccacaaactataatccttctaaagacttcatacactctcatcatccacatctttctggaagagggtagatcccacattgtgaatttaacctctggtttagtatataaatttgtttttcgttttgattaatgtaaatagtcacatcaggcacaaaagttacaggatttttttttttttttttttttttttttttttttttttgagatggagtcttgctctgtcaccaggctggagtgcaatggtgtggtctcagctcactgcaacctccgcctcccaggttcaagcaattctctcacatcagcctcctaagtaactgggactacaagcggatgccatcacaccaagctgatttttgtatttttagtatagacagggtttcactctgttggccaggctggtctcgaactcctgacctcgtgatccactcacctcagcctcccaaagtgctgggattacaggtgtgaaccactgtgcctggcctaggatatttcttgctaaagactgatggagagattttttcttaaaaaggaaatcagagaggtgggaatttgtgaagagattatgatttggcctttgcataggacaacttcacgatgctgttatctactaaacctgtaccaaaattcctagggctaatcatttaaaaaaatacacatctatatctatttctatgtacctatttctatatacctatatagaaatagatatagatatagatatagatatagatatattggcttcttgcttcctttagagcttgtatatttcatcaaagtaatttttttaaagataaactgctttagaaatttaaacttatttattataatgcttcttggatattatccttgccttaaattaagcaaaattcataatttcataaaaagatctacatcttttttctgtcattaattatgtgctccccatacccataaagaattaaataaaaattatttgactctttttctttattcattttttaaagtacataaatgtacttatgaaaatatgtggttttaagcttaattttgtgacatacattttgaatatttaaaattgggctgacaaagcagtagatattctcaggagtttaattttacttgtatggcaagagttgataatttgtgagttttacagtattttattagagaaagtttaccagggaagcagagtggaaaatatataaaaatgtattctaaacctgcaaaataaagccctagatagaatttgtttacatgtactgattaattagaaggcttgctttgtaaggaagcactatgcaaattattttttctcagttattagtctaagaaagagacaaaaataacttttattacaaagaaatctctgcttgcatccatattttacatctttataaaaatgttttaaaagagaggtatggccaggagcagtggctcatgcatgtaatcccaacactttgggaggctgaggcataaggttcacttaaggccaggagtttgagaccagattcagcaacatagcaagatcctatctctaccaaaaaaaaaaaaaaaaaaaaaaaaaaaaaaaaaaaaaagtgaaagaaagggagatgctattactgtttctttcataatctagctactggctaaccaaaagaaatgaaacattgctgaaggtattgattttctggtatatgtggaaagtatacattttattaatcacatatctcacaatatatagaataatataaattatatttataagagatcaatagagatttttgagagaaagtaaaatgacatatctggccaggcgtggtggctcatgcctataatcacagcactttggaagcccgaagtgggaggattgcttgagcccaggagtttaagaccagcctgggcaacatggtgagatcttgtgtctacaaaaaattcaaaaattagctggacgtggtggcatgtgcctgtggtcccaggtacttgggaagttgaagaaggaggattgcttgagcccaggagtttgaggcttcagtgagctgtgttcttgacagaatgagaccctgtctcaaaaaaatgaaaaacaaatgatatatgtatatttttaaatttttctgttataactgattcaaattgttcttcacctctaatcaattatctctaatcaattatgtttctttgtgataactttgaaatgggttatatattttcatgactcagttttgacagtattcaagtgctaaattgaatctctacattcatgttgccaagagttttgaaagtaattgttgttagttagtatacttatcagaaattttagaggcccagaattctctttcaagttctgtgctttccataccagtattttagttttgcatttttgttttgcctaaacagtttgaactttgtgctctgtcataaactcctacttttacttttctgctttttgctacaatttgtttatttggactagtgttaatttatcacctagaaaagaatgttattttaggaatttttgtatcagtttaactcatggaactgaaaatctgtctcatgtctcagtgcaaaagaatgggaatatattttagatttcataattagcatgtgcttaagagggtttttatattctttgtgtgcaatgcttagcaaggtttatacatgtttggaggattaggtacacctagaaaatataatctaccagagggagttctattatcttatggttttcagcaagtttaactccatggaattgcagacagaaagagatattgtataaatatgccagtcatattttgacatcgcagtcttgtattgacactttcatcaaactgtgggagaacagagcatttcttgaggtataagttcttgtaagtattttgcagaacaaaagttttctcttctatttgtactaaatcttctaggccacaaagcgtcaagaagaaaattgactaaataattatgggttctgtaccttctcccagaatacttacccttgacctgaggaataactttccttcatggtaagattgacccaaaatatggcttgaaatgaactttctctgctctagtattaagaaataatagcacacactcttggtacttctcttttcatgacttgttcgtgggtttctgtcaacatcaataaagtggttctttgtaatagccaatcatttgtttaatgcatgcctcatttctactcatcttagaaagaaaagtcaagaagtcccacagaaatgccccaaaggaaaaaataaaataaaacaaaatggcttaattcatgacacttgtgatttattgagtcttctttcatctgtcatgtaagatgtacaagcaccaggttcaatttttatttttggttggtttctctgacagagactcataattctgccctagagttaaatcttatggaaaaaaacactgaaaataaatagcacgtttcttcctctagatgccatcttttctctgtcacataacaatgcggatttgctcccaatagtttatgtgcatagctttcaaatctaacactggtagcaatcaaacaagttaagtataaatcttatttatgtgtgacccttctctctctctctctctattttttttttttttttttgagatggagtatccctctgtcgcccaggctggagtgcaatggcacaatctcagctcactgcaacctctgcctcctgggatctcggctcactgcaacctttgcctcctggattcaagcaattctcctgcctcagcctcccaagtagctgggattacagatgcctgccactatgccaagctaacttttgtatttttagtagagatggggtttcaccatgttggtcagtgtggtctcaaactcctaacctcaggtgatccacctgccttggcctcccaaagtgctaggattacaggtgtgagccaccgcgcccgacctctatattttttaaatgcctcatgtttccattttaacttgatcttgcatatataaccatttaaccaagcttgctaagacttaaagaggtataattttagcttgtcaatattcattgttttgagccctgtttataatgaagtataacaataagcattattatgctttagtgagttgaacttgaatatgcttgagtgacctgacttgctcacattaaaaacggaacaacagaaccgtagaaaaagtggagtaatctcaagattttcttgtaaacgttacattaagagactttatttgacaacctaatcaaaaaactgaccatgtgttttcctcttcccatcattttctcagattccctttctatcattttctctcccatcatttatcctcatgatccatagcgattgcaaagcacatcgcaaatgtgaatagctatattgttcctgcatgatagtaatgagtatactgctacctccaaaggggctgaaagttaagataggtcttttacaaagcaggaaacataaccttaagcataattataaattatatatataatcatgctctcttttctttaggataagtgattagtgttcaagtttagtgcttatatttgctttaaaaatgtacattgtgctcatttatgttttggtacggacagatcctttatatgaccactgtgctaaatatttttttaaatcactgactagacatcctgatttatgtgtctagatttatatttccagaaacatacactgtaacttattctgtttaatggctaagacacttctgcataatttacattgagactaaagtggttttttactgagatacttttctctatgacaaaccaacattatgatatctgatagaaatacaacactcttctttacattttttccccaaattttagaatgaattaaagacaaatacccatcagaaaacattccttgaaaatgcataattgtgatgtgtgatgctgtacagagcaaattcagactaatacatagacctcaaattcatgactataattttctctggatagttagaaagatattttaaggtgtttcatgcctgaggaataatgtcattattgaatgcatatacatacatggatgcctctgaggatgtcctatatctaataaacagcccaagtcatgggcaaatatatatcttataaacagggggatgggaaaagcatgccaatttatttctattgagctaaaatttagggtccacatttatttattgactatgatcttgggtaaatgactgagttttcttgtgtctcagtttacttatttgtaaaataaatcatgttacttcaaaagattattgcaaagattaactactattagcatataagaaagcttaacatactttattcatacagtcattcttcagtttcataaatgtgcccttctcggtagagaaatgggtaacatcagtgaactaggttgagaccgaagctgtacataatgataatttcaatgatttgatcaataatttcagattgatttttgttcatcctaagacaaaactttgaattctctatcttttctgtttgtcccctcttagctaggttggaaatactactcttgttttgttctttaaaggcaaatagtaaaatgtttatccattatttttcaaacactgattactgtagacagtgtcaacatgatcagtgtttgagttttaaagcaatagttgaatcaagttgcttcacagtggtttcttcaaaataccacaaaatgacaggaacacttacgcagtgaacacttggatttgcttcttgatccttggtatttgaaacatgtatggaatgcatcctctgtgtcagccaagacagcctctggagagtgaggcaggtttgtgtgttgagggaagggggtgtgcaagggggtggccatggctacattagttgcctctgcttctgatatctgtttttcattacattttgatagattatgtcatctttttgtcacatacattttcacccaagtctggaactatatttctctttcatttccaacttacatcctcaaaatcattcatggaagcctttgtctatataacaaatttctctactattttgagggaacatgtcctattgtagaaagataaaccttttacaattgttcgtcataagaggaaatctgctttaaaaatatttcatagggctgtcttactcttattcctaaaaaaagttattactgtagaactagttagcaagagttactctgttctgggttacttgggattcactgttagcaaagactaacaattagtttgtatatccgtatatggatgtaggtggtcacagtaatttcctgcttgattttttttgaattccaattaatataggaagtttctgaatttctaggtatttcaggatttgcatatacttagagttcaattatgttttaaacacattatctgtgcaagtgactgtcctaaatgttgtggctaaagaggaggaagcataaaaaaataaaaaaaattaaaaactgttcttacccatctcccaccccagccccaaattttaaaatctagcaaagtaaaaagctgcatgcaaatttttttttaaaaaaaaaatacaaggcagattgttttatattcatgtaacaattgtcaggcacaggagcctaagcagacacattcctggtgtggttattcataacttagctaagcaatgtctgctatttatcactgcacttataggctggtgagagtctctcattgcccactgctgagtcactcaccttttcattttgaaagcaagtttggccattttttttaaacaacacttttgctcaaataacatgaaaaattccaagtccctttggagttttactcttactactactgtagcagtttgttcatattaggatctcgcagactatctagaagcaatgaattattatctagtcttgcaaagatctagtataagaaaggataaataaaactaacaaattttaaaatggtatgaattcaggttttgtgactttttccttattaataaaaaaggattagtgatactaatgctactggatttgtagaaaggttaaatgtaagaatatggacaattggttggagacatggtaggcattccacaaatgtaagctcactgcgaacttcttagaactctgtgtagagtatgtattcctatgtttgttgaggaggggcattttagttaatatatagatcctacttttaattattattttcactctttaaatgttagttcttcacttctagagttgttattctgttggcttctcattttttcccctttttttcttccaagtgcaaaattttaagtgaaatctcaggcagccctcatttaacaatttcatgtgaaaaaataaccattgtgaactctcagagtagtaattacaggaagttatgaaactttgctaacttttactaacagataaagcattttcttttgattgttaggaaatcgtgtgtggacagcacgggagaacacactctgcctgtacacattgccaactcttgcttcattgagtttcacaaacaatcccaagcttaattttagccaaaaatgtaaaccagttcccacagtaaaagttgtgctaatttccaagttgatttttatttctttttcattcctctgttgtttgaactggtcaaattgagcagtgagatggccaagggacaaagggtaaggccaggggggtcactaaaccaagaccaggctctaggatttcaatgtttctttcttctttcttgccgtcagtaaagatcccctaggcattgacattttaaaaactctccatgtcttctgttaactcccttaggatcctgatctctgtaacaaagatggatggtgacacttaattatggacactcacaggcatccaattcaagcaatcctggcttccaagcccagatctgccccttactagcagtgtgacttcacgtgagttaggctctcagtttttttcatctttaaaatggggattatatttcctgattatagtagctgattataatacagattatggtgccaatctcagaggtaagataaatgcacttagcatacaacatagaacacagtaagtgctgaataaatggtacctgccattattattgcaagctaattaaaaacgatcatttgtactaaattatgttttattcaaggaaggtaatgtcattcctcaccaattaatcatttgttgatgaaaggcccttgagtagcaatgtcacacactgtatgagaactggaaaggatagatcttttgttacatcagccaccctgtctcatagatgactgctggctcctcttttctgcacgaaggccagaacatgaaaagttagatatttataaaattgctcaattcataatatttgagagttgatgataatttctgttttagctcttgctccccaaggagcagatgcttctggggaggttcaggagcacgtgaagaaacaacactgatagatggcgatcgggacaagagcaccttattaattcagctaccactgtgggtgactgcaggtcaataccctagggcaactccaagagccagtgtagggtacacatcttagagtcatcatacacaaggggtgagggagctaggttatttatacaccaacccctgattgactagtaaaatgtctcccctggtcgtttgggttttttttaatttttaatttttgtaggtacccctagtagttgtgatttctccaaaacttctaacttgctacaaaggaggacaacagagattatccagccagagaagttcttacataaagaaatgcagggcctgtgtgctcagcatggtaaggacaaggtaatataaacaggcacaaaaagcatttgtttttatttcttatacagtaatatggatctaagtttgggaaaattttaatggaatcttcctgaacatatattcttaatgatacaattggtttatattaaaatttgctattgaaacaaatgtagttttggtaaagaaaagctatcatatacctatggaattttagacaacttcctccaaaccattaatctttgcacacttgcttcttaatgagcccatttgcacaatcctatttatcattttacttacatgcttgtccatctctctgaaacgttgggggaacatgaccagaacttcacccggtttacttttctttccattgtttaatccacctatctgagctaccttgtttaccaatgttacccatgaactgacaggagtttattttaatctaatattctgcttttcaaaggaagaaacttattacagtttgaatgtatcttgtccaaaatgcctgggaccagaagtgtttcagatgttgaatttctttggatttttgaatatttgcatatatgcaatgagatattctgggtatgggacccatgtctaaacacagagtttgtttatgtttcatatataccttatatacataatctgaaggtaattttatacactatttgaaagtaattttgggcatgaaacaaagttgcgactgttttttctgcgacccaccacataagatcagatgtggaattttgcagttgtgcatcattttagcgctcaaaaaatttctgattttggagcattgtggatttcagattttttatttagagttgcctaatctgtatacaaaaactttaagtactctcctgcctgatatgcttagtagtgcattcatctgcagattctaccaacttctgtccttttgttatactgctgataatcattattcctctgacatattccacgtgcacctgtcttaacaactaagggggaaaagcaacacaaaaatcttcatacttggtgcttcattttatgtgagctccctgaagggacaggcttgtggctgtgcctacattccagtgaaattaatgctccttcttcagactactgttattctatttatagccacaggacttcaattttataagagtccagaaagttctgagtaatgcacagaattctacatacacagcaaatgcagccatggcaaaatgtagtccctggtgagggaggcaaacagagaatcaacaatcctttgcttttattggaataataaaaccggagcagtttgtgtctgaatgtgctgtaaaccagattttttttttcatgtaaattctatagccaggatatcacagacattgccatgaaagtggtaaatggagaaatacagtctttggaggaatcttgacttctcagcactctttgtttattcatttaaatgtgcctatttttatggatggtgggtcaagatggcggattcaatgaaatagtatttcataacaaaatgagcatgaagagaatttgggcatgtctaccaaaacacgaaggacaagtgagtacaatcatatattgttaccatctcccaagtcttctcatttgctttttttaaagtattgaaaattctggaaagactctgtgtggactatgctattcttaatgtttattaaggagaggacactttacataatttatagagcttatttttaattattgttttgacccattggatgtaattacacattttttgttgtacgaaaaatttatataattaatactaccatattaaagactattataaaatatttatcaccatttattagactaatggtagcatactattcacttttattcacccagctttcttcacataacaacatatcttggtgctcctttataataacaaatgtaaacattttcgacaaatacataaagttccattttgtgaatacttcacagtttaataaaccatttcccaattgataggcaattggctttgttatgaaatactatcctagtgaagaggcttaaacatacacaaaaaatctttcaataagtaccttcttgaaagaaggtttcaaatgtagagctattttcatttttttgagatgaagtaccactctgttgcccaagctggagtgcagtgtcacaatctcagctcactgcaactccgctttccaggttcaagcaattctcctgcctcggtctccgaagtagctgggactacaggcaaatggcgccaaacccagctaatttttgtattttaaagtagagtcagggtttcatttggccaggctagtctcgaactcctgacctcaggtaatccacctgtcttggcctccctaagtgctggtattacaggcgtgagccaccgtgcctgtcctgtggagctattttctaatggctaaaattcagaatttgcaaaaatgaaaatgaaaatcaactataattttaccaatttattattaactctttccagcttttgttctgtttgcacatacaactctaaaagcgtaggaaattaggatgtatgtaactcatgtagcctttttttctcagttaacattgtgacgtaagtattacctatgtcaaaaataattctctataaacatgattttagtgtccgcatagtatggtaatattataattaaccacttatccataacgtacagacatattacacccccatacatattgctatattacatataagggaagatatactgatttgtacactaaaccacagtgcacatgtacctacattacctgtctgtgtaacctccttcagattatgattcagtaggtctgaggcaggacaagaaagccactgccacttatccttggatgaaacctcaaatagcaggggtataaaggatgatgatggcctattattttattttacttcctttaagactgaacaaagggactggatttgtcatatttaaattagatgcattggcaccctagtagttatatttattgaactctctaagagactttctaaggtagatgctcggtttaggctattttggccacatcccaaataaagtcacaatactggactatgtgatctctggatatccttttttctgaatcctttgattccaggaacacttttctctcacttttcagtatctgccagtagatctattatagatgtgttacagttaaacatcaaaatatggtggctctttgctgtgataagctagagagtaataatttattagtcaagacaggaatagtatggagttctttttcagtctcttccatatgttgcagaattaacgccaaactgtgtacggtctgaatcctttccattgaggcaggttgtagaacatgagcttatgaggctccagaattttcctggaatacatctttcctacatctcttgtagagctcatgttcccaaagtaatcattatacaaatactcagctggctggctctaggaatccaagtataaatagcaaattttacttgctctcaagggcctttgagtttaatagatcagacaggcaagaaaattggtaattatagaacatgtatggtaagtactatagtaagatatgaataggtgcaaaagagggaatcctaactcaattatttcagactttttttttttttcaggaaagtgaagacaagctataattagccaaggaaagtaatggggagttaggggagaagggaatatttttcaggaaagcttagaggttcaaaaaggatagaggaatttaaaaaaagagaaattagagagctgcaagtaatctggttagaggacacacgagggagattataagcatgtgtgtgtgttcgtgtgcatgtgtacacgtatacgttggagattggacattgcgctttttagaaaggtgaagaagttggaaaggtaagaaagggcctggacttgaagggctttgttaggctagctaaaccatttgaaattaattctgagaacaatgaagaactgtttaaaagttttaagtagtactctgcccgccttggcctcccaggagttcgagaccagcctggccaacatggtgaaacccagtctctactaaaaatacaaaaattagccggacgtggtggcgggctcctgtaatcccagctacttggaaggctgaggcaggcgaattgcttgaacctgggaggcagaggttgcagtgagctgagatcgcgccattgcactccagcctgggcaataagagcgagactctgtctcaaaagaaaaaaaaaaagaaaaaaagttttaagtagtgaatgttacctccgtaaaaaacaagctaggaaccagaatgtaagagctcactcactgcagtctagagaatgactgtttggtggcccatggtgagaggtaacagcctgctggcagccctcgctcgccctcggtgcctcctcagcctcagggcccactctggccgtgcttgaggagcccttcagcctgctgctgcactatgggagcccctctctgggctggcagaggtcggagccagctccctctgcttgtaaggaggtgtggagggagaggcgcaggtgggaactggggctgcgcgcgtcgttcacggccctgtgtgagttctgggtgggcgtgggctgggcgggcccgcactcggagaggctggccggcgccaccggccttgggcagtgagagttaggcgggccagcagctgcggagggtgcacctggtcctctagcagtgccggcccactggcactgcgctggaattctcaccgggcctcagctgtctcccagcggggcagggcttgggacctgaagcctgcgcgcagccggagtctcaccgaggagccccaccccctgctccacggcgccgcccggtcccatcgaccgcccaaaggctgaggagtgcaggccctcggtgtgggactggtgggcagctctgcccgcggccgtggcgcgggatccactaaggaaagccagctgggttcctgagtccagtggggacttggagaacttttatgtctagctaaaggtttgtaaatatgccaatcagcactctgtgtctagctcaaggtttgtaaacacaccaatcagcaccctgtgtctagctcaaggtttgtaaatgcaccaatcagtgctgtgtgtctagctaatctagtgggacttggagaacctttatgtctagctaaaggattgtaaatccaccaatcagcaccctgtgtctagctcaaggtttgtaaatgcaccaatcagtgctctgtgtctagctaatctagtgtggacttggagaacttttgtgtctagctcagggattgtaaacacaccaatcagcaccctgtcaaaacagaccaatcagctctctgttaaacagaccaatcaggtctctgtaaaatggaccaatcagcaggatgtgggtggggccagataagggaatgaaaggctgccagagctggcagtggcaacccgccggggtcctctttcactctgtggaagctttgttcttttgctctttgcaataagtcactgctgctcactttttgagtccacaccatctttatgagctgtaactcaccacaaaggtctgcagcttcattcctgaggccagcgagaccacaaacccaccaggaggaatgaacaactctggataggaggaatgaacaactctggatgagaggaacgaacaactccagatgcaccgcctcaagagctgtaacactcaccgtgaaggtctgcagttttactcctgaagccagcgagaccacgaacccaccagaaggaagaaactccgaacacgtccgaacgtcagaaggaacaaactctggacacaccacctttaagaactgtaacactcaccgcgagggtccgcggcttcattcttgaagtcagtgagaccaagaacccaccaattccggacacaataggaagctgaaaagattgttggaagccctagagtggttaatgatgactaactttcgttaagtgttcatgttagcactagatgatattattagatgtatctaatactgatgcagacgatgttttgagctatttcaaatattacttaactttcaaagcagctattttaggtgtgattgtttattacaataattctcacttacatttaagtacaatgaaacacaggcataattgcattacatttccgaagccatagaactagggagttgtaaaagtttgtagtttgtttcgagggtccactcacttcactacggagctgtactgtcttctccatggaaactatgatgaagacagtaggtataaaccttttgcttgaagttgattgacatatgtacatgtgttaattcaatgtgtggggaagaacttggctgaaagtctagtgaaattgtaagaaaacattgtctataggaaacaatttgaagagatcggttgccagaaacaacttaatgaatgctatttaaggagaacatctgaatatcagatgggaactattacggttgggaactttctatcttagtacatgtaggttcacatgtgctaacatatctgcaatgcccagagtatttgtacaagtagtaggtctaaagttctaccctggtagtgccatgttataacaaagtattttttattatctttccatttctatcaagttaattgctattgaagtaggtgcaaactcacctgattagaatggatttagaagatttagagccaaaattgatgattcccattcttattgtgaaagacctgtaaaatctttaaatattcatttaatccagggatccccaaccctacaggttgtgttacaaatgggccacacaggtaggaactgggccgcacggctggagatgagtgctgggcgagtgaatgaagctttcatctgtatttacagctgctcccaatcacccacattatcgcctgcactccctcctgtcagatcagtggcaccatttgattctcataggagcatgaaccctgttgtgaactgcacatgcaagaggtctaggttgtgtgttccttatgagaatctaatgtctgatgatctgtcactgtctctcatcaaccccagattggactgtctagttgcaggaaaacaagctcagggctcccattgattctacattagagtgagtcatataattattttattatatattacaatgtaatagaaataaactgcacaataaacgtaatgcgcttgaatcatcccaaaaccatctccccacacaggttcatggaaaaattgtcttccacaaaactggtccctggtgccgtaaaggttggggacccctgatttaatctttgcttctatttcaattacttaaaaatgaatcaaacacatgtgtgtattccagaaagagattggtatataaagaaggtttcattggataagtgtttccagtgttgaaatacagatgcattttggcccttacacatttccatttaaatgtctagttattttttaaagataaaaacaaccttccaggagcaagagaagcaactcatttctatccaattgggcaaatcacttaacctctcaaagtcgcagttgcctcatctgtaaaacggtgatactactgcctgttttataggattattgtgataaaatacatgtaaagtagcaggcatctagtgggcattcaaccaatgttggatcatttatttatatttcttccttagctctgcagttgcattatcattatttttaaatgttgatactagtttttgaattgctgtgttgatttcagactttctgattgaaataatttaaaaaattgttagatagaagggaagaatgcagatttttttgacaggaaaaaatgttattgaactttgtttcaacataaaagttggtagggtttacccacaaaaatactttttagagaaaagccaacatggcatttattagctttggccattgcttggcaaggggttagttcttacttccaaattcataatgttgtcaagatatcttgtcacatgatcactggcataattaaactgttaccgcatggtgttccaaggggaatgctttctggagtcagttcccttgtgcatgtgatgaggccctagattttagctaggggctttttgtttcaccaaataaaacgatagctttctcgcccatgtccacggtgaataacaatcctattacaccttaccaaccattacggccacattgcagggtaaggagttgaaagaccttccagcatttgttatccacagggtgtgtcatttaaatccagtatcacataaagcttgaaaaataacttttatgcagaaaaatgtatatgaaggaaactctccaatttacctttggaccagaacatggtctataaaagtggcacattatgcaaatgaagtttactttctcctcctttctttttgcttgtgtaatataaagaatcacatgttatagaaactgatccttttctttgaagccaggggctgagaagtccctccagagcataacacagtgcttaagtactgtacttaggcacagcaagtgaaaacataatgaaatggaaaatgtgctttaaaatgaaatataattaatatgaacattcaccaggtttattcttcttgttgtgaatgattatagtttattgattttactttttcagttatttttagttatttcctacattgactcacctgtccaccctcctgcacatctcctcttgtaattataccctcctatgcaacctcaattcacggagaagcattatcatggcataattacatcacagggttgtggtgaagaaaaactgagataacatatatgatatacaaattcatgcaaatattaggaattagtattggtattcagattaaagaactaaggtggcactaagtccatacagttgatgtcactattcacgtaacaaactgtggtaatatcaggtttgtttactgcctgaaaacaagagagtatagggtattggctgagttttcccttattattcaacaaaacagcaggtgtaccagcaagggctctgccttcccttctgtggctgtcattcacatcaagctggttctagcaattgtgagacactgaagctccaaggacatgttgtcacctgctgaaggcttccagtctgttgtgacagaataattggtccctggtagaaaggaagcatatgccattaggtgtaagaacactgccacttgatgtcaggaagagaatctgccatttacctacctttgtcatgaaaatccccttcacaaaggcattctagtcctgacattcataattacttgctttctatagagtaattccagtgttgtaatttcttgcattgatacttgtagttccctccctctaataaaatctctgaaaatcaagcatctataaccctgattttctttgctatgcaaggagggctatgatattgtcatgatgtcaatccaaagtgacacataatcaagacttccagatccaagcaggctcaattgctctgctgcattgtttatttcacagacggcactggagcaggaggtgaagaggggagagctgtctaccaaagacatctccaaggatccctttcagtgaagcttagactcaggatttggcagaactcatagtatgaaatcatgtaccccactacaccactctctcacaagaaactcttcagggagaacaacgaatgacatcttgaaacattttgcagatcttcagggataaagccgtgaatgaaaaagatgttcatagagtccatcaccatcatttaaacactctctatataacagaaggatgccttagcaaaaccacagtatttttcccagaaacctttgtgcacaggatatttttattattgcttttccaagttaccctaagaatagaatatggtgttaagagaactgaagtccccaaagatatcttgcatccattttcttggagtggaaggaaaggaaatacagacttttttaaaagatggtttgctacttatatgttcttgacacaatcctgaggtcttagagagatcactattgcccccttttaggatggcaaattaatggagaggggtgagctttgtacttttcaaattcaaatggggtctatacattaattgtctctgcctttgtgtgggttaaaaaatctaagagacatgaagaaactgcttgaaattaatgtctttcataaaagatgactttttcacatctggaaaatgttcctttatattcatatttctgtcccccaaaaactataaaattttatcatgtgtactttagatagattatgccaatgcctatttagtttctcttttacagatgattattgcgagaagtgaattaagatgtttgaaataaatcagtctacttttgtgcctgggtagattttactcattgggttaataaacacattcatcgttatagctagaacatgtagatgtaaaatcagggattaatgatgttccatagctattttaaattaagagcaatattttccagacctgttaattttgaaaatacggttccatgttaacatgatttttcttaagtgtagcaatgggttatcaccgtctttactataaaaacaaacaaaacatctgacaagaaaaaccaccaaataattcttttgcacacacaaaaaagctgacagtttttctgtcttttccataaggaaaaagtatgccttgctttttgtctatcctctcaaaaccacaaaaggccaagctagacacaattcatgtttacagaaatcaaagacacttttattttatggtcccctgccatttctctctgccatgggacaatttcttactgcgtttcttgccaaacgagggtaggaatggaaagactatcaagtgccagtaagtccatttgagaaaagacaggtcaaggcttttcattttagaaagcctacaaaatacggagcagcttatagttatatgttgtgatgctttcagtggacacttttattgtggagtgttttattgttaagtttcatcgaacatcaagtgattggctcagcctgtgggatggccctcaagtgtgacagagtcaaacattactggttactggtcgtaggcctgccgagggctgattgcaccttccgtttagagagtatcatgccttttgcaacaaaaagcaaattaaagcccctgctgattgacagcgatatatgctacttttgtttttaattatttaacacttgacactctcagatggtaccttatataagaagaagaccaatttccaaagcaaccttgctttagaattgaaaaggcaagataacagattgaagatgactttcactactgattatctcttgttttcatttaaatatcagatgaaaggtttagaagcatgctgattatgttgttaaatagtcactgccctatatcttgaaagatatagtagccaccatttcaggggcatggctatttttggctctaaatgtaggcaagaaaattaagaattaccccaaattattgactgctgcagatgttccatttgggaaaataaaataataaatcgtgtaattcctacagagttagaattagatcttgtaagaaacaaattgttttctttgctgaagtattaaaagctgtgcaaacttaatttctttttcattgtcatttcctggatttgatattcccacccaagatgctaggagaagtcaccagtgattggggtgattctagcagaggctactgctccttggcactgaagtgggtggcttcaattcggtcgtctctgatgggaagcagagactatgggtgggctccctacacctgtttctggtagatctattaggaatcatcataagaagactatctaactttggcagtattgaaggatgtgtgacactgacatgccatccacacatcccttcagtgaagaacttgttgtctcagctactgggaaggctattgacagacaactgtcaatccctaagggaattttctgagttgcaggaagctagttgacccaaggtcacgccttccatggggtaggccatatccaacaactgatcagtgtgattgtattttatgcctggccgtctcagcccaactcagttcaattaaggaccactctagctcccactggggcctgctgaagtccgatctgcgtcacagcttgcgttctcccttcgttcactcctgcttccttacgttccctttcacaggcaatgaccccaaaacctctccttaatacacatgactccctctaaactctgtctcagggttggcttcccaaggaaaccaacctgcagccaacgagtaatcagtcccacttagaattcttgtacttgattgcttgcaattacagtcacattgtaggattgtgaccctgctttatgtttggtagctcttgttagcaatgccagcaacttcacggctgacattaaaagtgcagaaatgttccgtgaatgagtctaagaaaagtcccaagccttcatcttttcacctgggaccaagtatcagctcttgatggaattggagaaaatgaaaagagtatattctgttttgtgagaaatatgttggctttagtgtaatgaagcttttatagtttttgagttatgtgtatggccttatgaatttttgtcttttgaaaaacttctctctgatttaagattctaaagaattattgccttcattatcagtactcactgatgctgccaattcaattatctacaatggagggcagtggtgtccaatataaacaaaaacaatgatttatccagaatctcttatgtttgtccccgaagtacattttacttgcatttgaatgcaaaggcctatataatgcacatttaaaaacctaacttttaaataaactgcctgtagataattgaaaaagtctatatttatatttaattcttcctctaagaaagctataattatatataatcatagagataaagcgttatcttgcacaaaagtctttttgatattttatcagtcataaagaatattaaaaggaaatagagtagatatagggtcggttaagtgaaggaatagctgaaagacacttgaggagaaaaaacacgttaccatttttcagatgacattcgtaactttcttgtgaaatggaaattaatcaaatggaaggagattattcatgtgagcaattggcattacctgttcaaacttggttgatacacatacgataatttttaaagaagaaaccgtttaggctatttccattttaaaagttcacctctctattattggaagtttttttgatttgcctttttggatttgtgaatagaaagaaccaggccttattaatgcatatttttatctttttctttgatgggtgatagtcattaagaatgctaaatttaaatattctccttctcctctatgtcaatagtaaataataatatatcagtaataatcacagctaaacttcattgcatatattctctgctcaggcactatactagcactactacatacattttctctgtgtttctccagaagccttataaggaagttctcagtaaacctgtgagagctaaggcttgaaaatttaagtaatttaccaaaggtcacacagctacacagtcgcaggcacagcattcggggtcaggcagcctgactggcactatactctttccaatatactgaacgtttatgggtgacagctctgagtcctcaaaaggaatagaatcagcttcaagtgaaaacatagtgtgttagttcagagactgaaaaccataatccgtctcatttcagtgaattcccttcatccagtttaactgtcaggccatgcattacaccacgtgtttttaaacctctgagattcagtttaaatcattaccattttctttagaggctttcagagttatcaggctgctctttgcatatctttttattacttgtcactgatttaatgctatacattatggaaatgctttaatttctgaaattttcagtataaataattgcttatacagccattactatacatgccaagagacattagttcatcataaaatatttgagcacctactatgtgtcaggcactgttccacgcattaaatatacaatacagtagctccccccttatttgcacaggatatgttccaagccccccagtggatgcctgaaatcacagatagtacttagccctatgtatcctatgtgttttcctatacatacatagctgtgataaagtttaatttataaattaggcacaataagagattaactaataataaaagaggacaattgtaacaatagactatattaaaagttgtcattgtgatccctctctcaaaaggtcttattgtactgtaccttaggtaactgaaactgtgcaaagtgaaatcacagataagaggagactagcgtagtaaaggaaatggacattgtgtccactttcatgttgttccttagactgttcctggaaatgattttctccatattcgttggctctctcagctgttctgaacaaatttgggaagagagtttctatggtttgactctgtggacttggcctgagtatgaataactgggtcatgttcttgacctccaagaaacttggagcacagcctaagagattgcctgatggatacagtcatgaaatttagaacttgaagggacattagagaccacctaatccgaccattttaaacagatgcagaaacttcagagccaagcagggtcagactactaacccaggatctcagaatgagcttgtggcaaaagccaggccagaatccaattttctccttcaagggtcactttcttcccatggctccatacacatgctctaatctttggcacaccctggtcttaacctagtaaatactttggatagggttataatgaggattagctattgccttttgtggttgagcaaacatctgggtcaatgctagtaactgaagaaaaggaaaataataaagcaaaccaactacattatttaccaatatgaaagtgaatgctagcataaccattaaaggttaaaaattcaatggatgacaactgctcatgtatctttggatagctcataaataacagagacactgtgcttttaagtgatcactttgctgctcctttttcttctttatgtgattaattatggtaggagagcattttcccctcgaataaagcctacagcttaaagaatcagacatttctccctaagtttgttcttttgcctcattatataagagaaaaaggttttctctgtttttccaaaatgagatttataatcatccctagctgtggtggatgattttagatctcaccttgactgggttaagggatactcagatagctagtaaaatattatttctggttatatctgtgagggtgtttctgggaaagatttgtatttggtttttatttttgttaatttttatttattattattattattttgagacagggtctcactctgtcacccaagctggagtgcaatgatgcaatcttggctcactgcaacctctgcttcccaggctcaagtgatcctcctacgtcagcctcccaagtagctcgggctacgaatgcatgctaccatgccctgataatgtttatagtttttgtagagacagagtttcaccatgttgtccaggctggtctcaaactcctaggctcaaacaatctgcccacctcggactcccaaagtgctgagattacaggcagaagccactatgccctgcagagataacatctaaatcagtagactgagtaaagaagatctgccctcaccaatgtggacaggctttatataacctgctggaagaccatatagaacaaaaaggtggagaaagggtaaattggctcccttctgaagctggaatatccatcttctcatgtccttggacatcagaacttcaggttcaaacttcagactctgagactgacaccaggcacccactaggttctcaggcctttggactagaaatgaaatacatctccagtttcccacattctccaccttgcagacagcatatcctgcacttctttgtttccataattatgtgagtcagttcctataataaatcccatttctttttcagagatagaaagagagagatatctcttattggttctggttctcaggagaaccttaatatattttccctgtgaggatgtgattttggtaatattaattcttcaagaccttcttagtgattgattattgtggctagtatctattatattatattatatataatataccacagattacatattccttgtagtatcaaactttagaaaagtgttcaattgcatgaaatttctcttcatttcccccccattaatgatcacttccatactttcgtagaatattttcaccctctctttgttcagtgtttgccctctgttcccatataaggatgattaaaacccttaagctgcttctcactgaaaagaaagataagacataatgtgcccttctcttaaactacctggcataccattcccagagtcaaagagaaaagtctgtaatggaaacctacaggtagcctagtacctggagaaaattatttcttcctggttctgtgagtatgccactcacctggctggctacatcctgtgctggctccattctagaaaaagactggtcatttctataccagaagaaaagcaataatatatttatacatgcactgatttagtttttggccaggaaacttctctagtcctgcctctccacattctcttcaaacattctagcaacaaatatgagtaagaaaatgttttatactttaatgcattctcatatacagtgtctctgcttcctccaagcatatatactgtcctgagagcagtggaaccattctatggtgaaaaactttgctaaaaatctgttattgggccaggtgctgtagctcacatcagtaatcccagcactttgggaggccgaagtgggtagatcacttaagtttaggagttcaagaccagcctgggcaacatggtgaaaccccatctctacaagaaatacaaaacttagccaggcatggtggtgcgtgcctgtagtcccagctactctggaggctgaggtggaaggattgcttaaattcgggaagcaaaggttgcagtgagccaagattgtaccactgtactccagcctgggcaacagagggcgactctgtctcaaaaaaacaaaagaaaagaaaagaaaacaaaaaactatttttaacaaatatttattgagcacccactataagccaggatctcttctaggggctggggccatatcaatgaacaaagcaggcaataatctaggaccaatgagcagtggtgtacatatgaaggaatggttaaattctgaacagttctgaaggtagaattgaaagatttaatgagtactttaatttgaattatttcacaatttatttgaatatgaaatatcaaagagaggagtcaaggatgacttcaagttttgtggcctatgcaacagatgggttaaagttaccatttataagacagaccggctgggaaagagtaagttggggatgggatgggacagtatctatgagacatccaagtggaaatgttgaatagacagccacgtatgtgagtctggagacaaggaaaaggacaggattggagatatgacttacagatggaatttaaaatcatgagacttggtaacataaccttgtagggatcacaggtaggagaaggaagacagatatacatgagaatgaatatttagctgtcatcttcctggaagcacaaagagcaagtgtagtaaattactttgtgttttttcccatttaacatgtaaggtaggattaggttgtagaaaatagtttagatatccacagatgcatgtgcacacatgtacacacacacacacacacacacacacacacatactctcaaacaatagctctgaaaagataaagacaatgttgaatgggctgctttagaaacttggcctgtaatgaatatgacagcagttagcagttacagaccttgaggtgaatctttttctcctgggccttagtctgattatttgagtagtgagctatatattttccatgtcatcaaacacaaggggatcttgtgtagtttcatccctcatagataatagttttaatttcttggaaaaaaataaaagcaacaacttcttgaagataattccattcttctttatgctcccaactcctatccaattagtggttttctttgaaattatggtttgaagatattttccagaaggtgatttccctgtcctttatgaattgtaaaataatttcctccagtcaggcaagatttatttctttaatgaactaatgtgaaatccaggggctacctcaggggtgctcatatgtgccaagcattctgtgggcatttcacaaatgtctgtacctaatttgccagcagctcggtgatattggtataatatgcttcattcatggctgagaaaagtgagattagagagacttagaaactggttaagttagtaaaatcagtttttgtaactcaaatcctatgctcttttctctgtatatcatactgcatcttttttataacttgaacttttcatgctcccctccaaatttccgccttcaatttaagccaagcagattaaatatatctactgttagttccctggaatcagtgcttactctcttccaaccatgtgactaagcatttaagagtgaattctattgacagcgtcttcccttggagaactcccttgtatgttcaatgtgaaaccaccttgatctcctttgcccatgaatggctgtttttctgattaacttcatttcatagacctggtaactgagaagtgaaaaaccaatctcaatgtcagaggtaaaagcatagagcctattctctagtgacaaatcgttttgttcagggtatactacctgctgagacattgtaagtgttcaatgaggggattgtccaatttagtgcatcaatgccttatcatatttgtgtacacttcttccatgtatatgctcatgtgacctgcacaaatcctaaatgggtctgattagcctttgatgccttttcatgttttgttctgccatattatttctgggaagttagaaaaagggaagagatgtcttaaaatatgacctttgaatttcaatgactcaaagagatgatggcatagatggctgttgagttcagcaaatagattggcaaagattaagaagatgggtcacactactatagtaggtgtgtgaggaaaacggaacttttacatattgttgatagaggtataaatttgtacaaatttagagaaatacctaaaacacattaaatttgtaattcctttgatctaataattctactgctagaaatgcatcctttagatatacttgcacagttaccacaattaagatatctgggcaaagtaactaggtcgaaatatttgcttattaccatacaatggtgttgagaagcaaaggacacttacatagcattctaaaacaaacaacaagtagaataagctctgaattgatattagttattttgctaataatgcaagtcatcgtttctatgttaaaaaatttgaaaccatagataaattagaaaaaagaagaaaggaggatattctttgtgccaccacccatagataaccattattaaaaatttgatgtgttttccttcagttcttttctgtgcaagagtgttatgtgctaactttgtaacactgccattttccttttattaaaactttaagaatcatttttaataagctcaagattccttgttatatataagtacagtaaaacgaaaccttccccttgtgtaggatacttagttgtttccggttttgctcaagtattataatggaagcaggcaaaaaaggcatctacatattccttttctattaattaattgtttctgtcccacttacgctgatagattctgggtttgtggaaacttagttaatagtctaagtcagtgtattctaatttgtttctttcttggtaaataatgtttatggctggtagagtaagtcagctagttataatcattgtagtacatgcatacgtattacacatacagacatatataatacgtattttctttttattttagcagcagcattttattttggcacatatattttgggagtagcacaagctacattattggcggaagtctggtatcctttaggagtttgcattctagagtgactgccttagtttgaaccttgactggtagctatgtgatttgaggtagatcctttacccgctcacagccttagttgcctcctctgcaaaatagtgatgacaataatacctacattaggggctaaatataagtattaaaggtaatgcaacgcacagtgctcaatacataataagtgctcaataaagagttgtcactgttactagagttacttgtttctcattattcacactgttcttttgatgttgttgtagtttttgctttgctttgtttcttgccacacgttctgtttacttctaggcaagtataattttctcagctataaattgtattaatcttatgcattcatttctgtaatgagcacattctcctttctcttcttctgtccctttttctaccccaactagtgctaaaatatgaattgtaaactgctagcattaaaatgaaatttttggcaaaaccatgagatcctactttcctttatatctatatgaattggtatcttttaaaccagagctactagattgctaatttttaaaaatctgttaacgtttttgtagaaggacaattattcagtgtgtacagtaatgaagccgttgatccattagaattgtgcagaaatatagggcttgaactcttaaaattctcttacttacctcgtaagtagtaaaattcagactcagtgattctagtataaacttcaaaatgcagtagaaggagaagcagaaaaatgacttagcggagtggcaaattgataataacccgtttagatctcttcattatgccccgtggcttttctgcatccttaacatcagattttgctgcaagcgttttgtatttctcagggaaaataattcataaagatcatgaatgcccacgctttgtgaagagacctattgtcattagcagccagattctcatgggaaatggaagtcacaggaggacaatcataaatgacatttctgattatgtaattttgtagtatacactgacatttggtttcctatctttagtatagagattaaaggatccctttttcctgatgtttttcatttttccttctgtttaagtttatgaaaatataaatcaataattgtaatgataaaaatagaaaaaatctgaagtaaaagtctcctgtcaatctacctccagagacaaacattatcattttcctatgtagactttttgttctttctccatacattcaagtctatatgcttctatatatcacatgtctatattacatacacttttaaaatgatactgcttttttttctttcaaagcagcccacgaggcaaaaattttagtgcattaagtttatttaggaagtgatccatgaaaacagaagtaaaggaatagggaaaataagatagggatggggaaaatgttcaaaaatcatgttctattaagcaagtttgagctccagcagaactggagctcaattctgctggaaactctgaggaaccatgtagaaagcaccgagatgaaaagtctggagcatttattgttcaacttccatactccattggttggaggttgccccagagtgttaactcccctgcaacttggactgcatgtgtgcacagctgagcaaccttctgcagctttggaaaaagcagggcagagagatccagcacatgcttggtatgtaactagtaacagtctatgactctctaccacagttctgttgtaatcaggtaggccaaggagatgtgctgccgcataccaggagcctctgcaatcctgacctgcatgctgttcttcaactagctttttaaaaaatataacaacgtatccctggatacatttccaagtcagtacatgcacacattctttttgtttttaatgacagcattcctccgtgaatattagagtgggctagctaatcatttaagtgagtacaatgccagcttttgtcttcattttactgtgtgaacatataggtatgctaaatattcctccataaaacaaagagtgatttttgcttctcaagcttttatgtacacatgaatcacctatggatcttgttaaaacgcagatctgatttagtatatctggggtggggcctaagactctccatttctaatgattcctcaagtcttattgatccataaatcaggctttgagttcatggttctaaaatgaaacaacgtgaaagaaacttgtacgctgtgaaaatgttccttataaaagtctagaaagttttccacaagctaagacattggactaggagctgaatctaatttccagctataaatttgctttgagaccttgggcaagtcttttcttaccttggttatcactcaggtgccttggccataggtagtattttatgatccaatatgttcattttttttacttgcaaagagaatctgctttttgtctactcagttccacgactgtgttgagccaaactaaggctataaaaccagatttaagaaattccagggttcctgcatgtttatatttatagatcatcactactcttattaggtgaaactagatgagtcagattgcaaaactagatgtttaatggatatatcaaacttaaaatattcaaagtagagttgtagatttcccccctcacatttggccctccatcttctatgataatcaatagtagctgtgggccaggacgcaaaagtcaaaaccctgagatcatccttggactttcttttctcaaattcctcaaattctgtgcatcagaaagtgtgtagaatttacctgcaaaacagatttcttaatccacttttctttataactatcttcactaatatatccagaaggactctcctcatccattacaacagcttcccacctaattggaactcggctccatttattggccctacattttcttacagatacattttttttttttttaggcaaatcagattttgtctttccccacttaaattcatcaatgtcttctcattgtacttagcataatcccaattcacagtatgtagacccacatggcccacaaggccctatgtgatctggcccctgcctacctttccaaagtcacttcatgccattacccgctagctccctctgttgcacccacattggccctttttatttacccaggatgcaggaagctcttttttgcctgagaaacgtggccttttcaccttccttgaaaatgttttggattttattaattttgtagtactttttagtaaaactgaaattcatcaatcctttttctatgtaaattgtatcatatgtagccattgtaagcattttctcatttacttgggaagaaaatatagacaggcacccagtgaatgtgtacagccaattaacaggaagaaaaggaaagatattaacatttacaaagtgtccattaatctttacagtaaccctatggtagtagtagtattcttgtaactgacagtgaaataaaaactcaaggaagtgaacttattagtctggaatgatagggtctacctatgtatgtatgtgtttatatatataaacatatacctaaataatatgttaaatgcttttggatttgaaagcagattgatcatccatgcaaatctctggcatttttttgttgtattggcattgttctcactaaagtgtgtggaaataatttttaagaattcatgagttccctgtaagaatctgtgtgtgtgtgtgtgtgtgagtgtgtgtgtgacttttcattctatggtaatcttttaaaaattatgaaagcatatttgagatcatctggaggatcggtcaacgacactgtctgtgtctgtatttatatctgtaattatctggtgccaaagaggcctgctgtcattgtctggggctaatgaggaaggaaagagaaaagacgctgactaaataagtaaatgatgcttttaaaccaaatgaaagctgttaccctggcaagctacactcagatgaaggttttatagaaaaagtagtggaagaatctgaatgtcatgtggcacaaagtatacagcctatgaatttcaaaaatatttagtgttgcagcagatactagcagattcacactgcaagcggcaatttagatttggcaaaataacattatctatgatactaaattaatattttaattgaattgttttggttatacaagttagcttttatgaaattttaaaatgtatttggcttaacagttgtactcaaactataacagaggcatttatgcctcgttacatccttgcacacatgtaaggactctttaatgataaaaatacccaaatcaacattggaagccttatgtatatttatataagatatatatgatatatggtgatgtaataactatataacaacagagatataatattaaatatgtatttttttctttcctcgtaagtggtctaatactagggtatagcaaccttggcatgacagattctttcacaggtaattctttgagtaggagacattcctgtgtgtgtagaatgccagtagcagcccctacagtgcagttgttacaaagaaaaatgtctccagatgttgccaacagtcctctgaggggaaaactgccctgtttcagggtcacgggtctatccatttctctaagatagtaaccactgccttattccatgttgtggatgaggttgtaaactcacaaaactatgatgtttccaactattaatgaggaaataattctgaaagtgcatatataggcaacattatgagaagaaaatctggcagagtcaggtgagcatggggatagtagaagagaaatatatctgtaattaaagagaatttatgtggctcttcttttatttactattgcctattgatgcctggaatccagtttgaatgtccatcttcattctctctgtacacacctaagcagaaatattgcctaaaacctttagtggagaccatgagcgagtggtatgcaaatgaaccaaacaaataaacactgtccaaggtactgctgagtatgttaattgtgcaatattaggagaagcagatgctgaatttcgtgtttggtattctttctgtctcaagggagggcagtttgaatgcaagacacaaaatatacactgtcttaaatttcttttataaggtaaagcacttatgaggaatacttttatatttttggattttggctatcaaaattaacagcttgtttattttattttttcagttttttcatgttatttttttgtaattttaaacttgtaaaaatgttgcaaaaataccataatacttttcacccaaattttccacgtactaacatctcttacatttgctttatcattttctctattaatatatacatattattattttaagatgtttgagactaaatttaggacatgatgccctcgtatccataaagagtttagttatatgtcctaataacaaggtaattcatttacattacaacagtggaataatcaacatcaggaaattaacactggtacaatagaaatgtctaatctatagaactgagttgaattttgcattattccataaatgtcctttataataaacaaaaaatttttttaggggagggtttgggatctaggattcaatctaggatcaaatgttagattcgtaagtctctcagtgtcctttaatctgcaatcattcttctgtctttcttcatcttgacatttttgaagattataggccaattattatgtagagcatccctaccttagatctatgggatgtttttctatgattaggttcgggttatgccttgctgaaaggaatgccatatagtgctgtgatgtccttctcagtgtatcatatcgagaggcacaagatactcattcatcccattctgctgatactactttgatcacttgtttgcggtgatatttgccaaatgtctccatggaaaagttacagttttccatggagattgatgtacatttcctagttcctatcagacttttactcactctttttttttcttttcttttttgttttttgagatggagtttcactcttgttgcccaggctggagtgcaacggcatgatcttggctcactgcaacctccgcctcccaggttcaagtgattctcctgcctcatcctcctgaatggctgggattacaggcgcacatccccacgcctggctaattttttgtatttttagtagagatggggtttcaccatgttggctaggctggtctcaactcctgacctcaggtgatccacccacctcatcctcccaaagtgctgggattacaggcatgagccaccatgtccagcctcactcactagtttttacatacactgatcgttctagcctaaataaattattaccattggggtgtcatgtggtgattttgttaacgtcaatattccttctacatttattagcttttattatactttaagtacaggtttatctttttcctcttttgtctagtaattcacttatataagaaggaactcatagattgtaactttatcatatgtgttaaaatcattaatgacattttatatacagatgctcagacagtttaaatagagctaagaaggtgatcatttatgcactagttgcattttcctcctctcctctcttctataacatcttagctaatattgttgtcctattccattattaggataatccagcagaatctgttgctgtttcgaaggttgggtgccagttctgccttagtgattcattgaggtggagctgaaagagcagaagtcaccctctccttggaagccaggagcattttattgtttttaacagtgctgagaatgccagtgactctaaagatgagaaaaaaaactctcttaatgagtttcagcattttaatgtactgcaggttcccaattgtatgagtttaagaagcttagcaattcggtatcttctgaataatagcatttattttatactgtaaatactcccagggaagtctgaataacactacagcttcttcggtgtaatagctttggtgagctaattgacttgaacagtggaattgctccttaaaaaaaaaaagccacacagttttgattaatgagcccagtaataaatcattaatctttgtcgctcacaaatgataggaacagtgttatgtttcccaccctgtaatatatttcttgattctcttgctaatacagtggccacattttaaggatctcattatcaatttaatatgcctacctccatataatttaatataacatctagtaagtttacacttatgaggaacacaatgggacacattctaaatagtgataattgttctgtaattaacatgacttatatttacttagtagctgtcctcttaaagtgttctaaatttccttatgtaataaaaattgtagaaatgatcatgatttactgagcttctgtattcctgaaactctgctaaatttttagtatatcataacattgaatttctacaataaccctctaaggttattagtattattatctccatttttcagtcaaggaaatttgctgagaagtgttaataacagttagtgtcagggccaccatgtcattacatgttcacagctcatgcctactcaaagttttctggaagcttaagaacaaaatcatttttattaaaatggaagtatatagttatacagtcaatccaaattgatgtttgtcattgttttagggcttaatgtatctcagtgtcttttacattttaaaatttaattttcatgcatatcatgtagctgagacaccgtttaaaaataatttagattgtcaaatcatcattttaaggaaaatggaatttcaagttaagggctataagagttaggggacagatatctaattcttcgttgccctaatgtgtcagctaacaaaaaatagcactttattattgaaatttagttgtgtaacatccactagtctgaactttctaaggcaggcagagatcatgtcctattacatctttgtcctcagaatttagctcaaggggtgacatacactagaagatgaaaaaactattgaatgagtgagtgaatgatcaagagcaaatatgaaaaaataagtggatgatccatttagtaatgtgcccaagtcaagagatggaaatcgacaagtgactttgagttggattagtgttgtgaccacgagtacctccatttgttcaggtgagctacttactgaatcacaagactcctgtagggagaaaacatataactaagaaaaactaagatgtatgcattactttttcattgatagcctaggcactctaagtaaaattatttaactcattgtcgagtcacattaaacgtaagacttatttctttctaacttacgagttttttaaaaattgcaaataaaaattcaaaagctaacagaagacaagaaacaactaagatcacagcagaactgaaggagatagagacatgaaaaatgtttcaaaaattcagtgaatccaggagctggttttttgaaaagattaacaaaatagagagactgctagctagactagtaaagaagaaaagaaagagagaagaataaaatagacacaataaaaataataaaggggatatcaccactgatcccacagaaatacaaactaccaccagaaaatactataaacacctctatgaaaaatctagaagaaatggataaattcctggccacatacatcatcccaagactaaaccaggaagaagtcaaatacctgaatagaccaataacaagttctgaaattgagacagtaattaatacgctaccaaccaaaaaaaccccaggaccagatggattcagagccgaattctaccagatgtacaaagaagagctggtgccattgtttcagaaactattccaaacaatagaaaaagagggaatcctccctaactcaccctatgaggccagcatcatcctgataacaaaacctggcagagacacaacaaaaaagaaaatttcaggccaatactcctgatgaacatggatgcgaaaatcctcaataaaatacttgcaaaccgaatctggcagcacatgaaaaagcttatccaccacaatcaagttggcttcatcccagggatgcaaggctggttcaacatatgcaaatcaataaacataatccatcacataaacagaactaatgacaaaaaccacatgattatcccaatagatgcagaaaacgccttcgataaaattcaacaccccttcatgctaaaaactctcaatatactaggtactgttagaccatatctcaaaataataagagctatttatgacaaacccgtagccaatatcataccgaatgggcaaaagctggaagcattccctttgaaaactggcagaagacaaggatgccctctctcaccactcctattcagcatagtattggaagttctggccagggcaatcagtcaagagaaagaaataaagggtattcaaatggaaagagaggaagtcaaattgtctctgtttgcagatgacgtgattttatatttagaaaacaccattgtctcagcgcaaaaactccttatgctgataagcaacttgagcaaagtcccaggatgcaaaatcaatgtgcaaaaatcacaatcattcttatacaccaacaagacaagcagagattcaaatcgtgagggaactcccatacacaattgcatgggagaataaaatacctaggaatacaacttacaagggatgtgaaggacctcttcaaggagaactacaaaccagtgctcagggaaataagagcagacacaaacaaatggaaaaacattccatgctcatgggtaggaagaatcaatataatgaaaatggtgaaaatggccatactgcccaaagtaatttatagattcaatgctattcctgttaagctacgattgactttctttgcaaaattagaaaaaaagtactttaaatttcatatagaaccaaaaaagagcttgtatagccaagacaatcctaagcaaaatgaatgaagctggaggcatcacaatacccgactttaaactacactacaaggctacagtaaccaaaacaacatggtactggtaccaaaacagatatatagaccagtggaacagaacagaggcctcagaaataacaccacacatctacaaccatctgatcttcaacaaacctgacaaaaataagcaatggggaaaggattccctatttaataaatggtgcttggaaaactggctagccatatgcagaaaacagaatctggacccctttcttacaccttatacaaaaattaactcatgatggattaaaaacttaaatgtaaaaccccaagtcataaaaaccctagaagaaaacctaggcaataccattcaggacataggcatgggcaaagacttcatgactaaaacactaaaagcaattgcaacaaaggccagaattgacagattggatcaaatcaaactaaagagcttctgcacagcaaaagaaactatcatcagagtgaacatgcaaactacagaatgggagaaaatttttgcaatctacctatctgacaaaggtctaatatccagaatgtacaaggaacttaaatttacaagaaaaaaacaaccctatcaaaaagtaggcaaaggatatgaacagacacttcccaaaagaagacatttatgcagccaacaaatattaaaaaaaggtcatcatcactggtcattagagaaatgcaaatcgaaaccgcaatgagataccatctcatgccagttagaatggcagttattaaaaagtcaggaaacaacagatgctgacatggctgtggaaaaataggaatgcttttacactgttggtgggagtgtaaattagttcaaccattgtggaagacagtgtggcgattcctcaaggatctagaaccagaaataccatttgacccagcaatcgcattactgggtatatacccaaaggattattaatcatgctactaaaaagacacatgcacatgtatgtttattacagcactatttacgatagtaaagacttggaaccaaccccaatgtccatcaatgatagactggataaagaaaatctggcatatatacaccatggaatactatgcagccataaaaagaatgagttcatgtcctttgcggggacatggatgaagctggaagctatcattctcagtaaactcacacaagaacagaaaaccaaacactgcatgttctcacttataaatgggagttgaaccatgagaaaacatggacacggggagcggaacatcacacactgggggcctgttggggcaggggggtaaggggagggagaggattgggacaaatacctaactcatgcgaggcttaaaacctagatgacgggtcgataggtgcagcaagccaccatggctcatgtatacctatgtaacaaacctgcacgttctgcacatgtatcccagaacttaaaataacatctaaagaaaaatgtaaataatgtatatgccaaatgatgccggcaatcgtgatgaaagacattcttttaaaataaaaaaatagtttaaccttatttgaacaccctcaactcactgttgcacctcttctttgctgtttctctaccaaagtcaccaggttaatataagaaatgaaggcaagacagtatcacctagttaggttccttctccagctaacatggcattaataaactgattttcattatgatatatacacacacagcacaccacttttctccaagctaatattaaggatcacagtttaccaaaagttgtgcagcctgttctctttggaaagcctctctttggaaagactaggatgaaataaatctactatatgccatccttcacttagactgacagaattttaatgtatagcagaatttttttttaagtgccaatgtagagctgactgcttcctctataacacataaaatgcatatggctttacagggccagttttctgtacaattgacattggacaatttaggaataaatgtagattcaagcaaaacagcacacaagagaacattttgtatcaaagttgtggcttttcactttatgtgttaaatatatatatatattttattatactttaagttctagggtacatgtgcacaacgtgcaggtttgttacatacgtatacatgtgccatgttggtttgctgcacccatcagcttgtcatttacattaggtatttctcctaatgctatccctcccctaccgccccaccccccaaccccctgacaggccccagtgtgtgatgttgcccgccctgtgtccaagtgatctcattgttcagttcccacctatgagtgagaacatgcggtgtttggttttctgttcctgtgttagtttgctgaaaatggtttccagcttcatccatgtccctgaaaaggacatgaactcatcctttttatgtctgcatagtattccatggtgtatatgtgccacattttcttaatcctgtctatcattgatggacatttgggttgattccaagtctttgctattgtgaatagtgccgcaataaacatacgcgtgcatgtgtctttatagtagcatgatttataatcttttgggtatatacccagtaataggattgctggatcaaatgctatttctagttctagatgcttgaggaatcgccacactgtcttctacaatggttgaactaatttacactcccaccaacggtgtaaaagcgttcctatttctccacatcctccccagcatctgttgtttcctgactttttaatgatcaccattctaactggcatgagatggtatctcattgtggttttgatttgtatttctctgatgactaataatgatgagaattttttaattgggaaaaactacttcaaagttcatatggaaccaaaaaagagccctcatagccaagacaatcctaagcaaaaagaacaattgaattatagaacaataagaagaacaacaaaaagaacaataagaattataacctcagctttctcacatgtaaaatggggctatctacctcaagggctaaggaatataaacataatgaatttaaatgattttaaagcatagtattttttcatatagtaggcagtataaatactagataatatcataccataaaaaggtaaaggtaatgatatatatcttacctaacaacaaatagtttatataaaatgatattaatgttaatcttatatggcaatggataattttagtacaagtatgtcttatgtattattcatgatatactaaaaatagtatttgttgtttatcaaaaatttaaatttaacaagatgtcttatattttattgggcagccttaatatatatgacacagtgtttgtcaagtgagctctgttgcataattccaggagtcatcatttgtgctgtgttctgggcggggggcggggatgtcagtagactacaatgagaatggttgtctttgagtggaactcaatgcccctaatatcttttacatttcaatggtatgtttttgtatgtttaccaaaggtgaatctaggtgagcctcagcaagcctaagctgtcatattctaggcagaagatataaaaatgttttgcatctgttctatatttgtatgtgttatggtgattatttcagaagtaattagtagtgtatcatagtaaacctatggctgtcttcatgtcatttccacagttccatagttgtttggggcatcatagtctttatcgataaatcagttacagctttctatctcagagttcatagcaggtggataaaatagacattcctggggaacctctttctgagcagtgaattaaactctgagatttgtttacaatattgagtagttctctatagttttgtttcctgttctcatttttgaccatcaggaccacgagtacaaaacaatatatatttgtgatatggtaatatattaaaataaaactatagagagatctcaatattgtaaaatgttaatttagcattttctcacaggagaaaccatcacatcagggctgataactggtgatactgagctcaagttcatgaggtgtatatggagggagaaatcaaggaaagccagagatccaatctggccacctgttccaggaccaaaggtaacttaaatttagtcataaaggctggagatcctcatggaatcattcactgcctaactcaattgaaggctcctcaattgatcttgaaataaaagccagcccaagccttaaagaatagcctaaatgatcagtggttcaacactgggcattgtttcacaatcaggtccctgctgagtttgttctccagaattaaaccttccaattgaacttgaggacatgaactccagttgctgacactgtgcttacattatatccgaaataagtaaatgcttctttttaaaaaagtatttcttggggacattgttcttagtgtttcttatcttagggaaattgttcttatttttgttttggaaggaaaaaattggcagtcaccttcctctaactgaatcaccatgcagaactaacaaaagagaaatcaccttttctcttttagtagagacagaagacaattgaaaatatagaggcaccttcactgcttagcaaacaggacagagggcatgtttttaggtaccatttaagggtgaaagcctacttctttgcagtccttctttactcttccctttggtctttaatgccttaccttggatgtttgcttctggagcgcctgtcttgaggtaaggcatcttactttgcctagtcagaggcactggctttgtgtccagggaatgcagaagtcctagtgggaagttcagagctgatcgtatgtcctcatttcttcatagcaatatagatttgacaaaactaacacattgtattagtcagggttcttcagagaaacagaaccaataggatgtctctacctcactccctctcgtgcactctgtcactctgtctccctctctccccactgcaagtctctctctgtccttctgtccatctccctctcttcctctatccctccatctttccctctgtctcccatttccctctctccccatctccccctctgtacctccgtccctttaccttaatctctcactccctctctttttctctccctctctccctccatctgtccctctcctcctccctctctgccttccttcctctctcctccacatcactctatcttacccctcccctctttattgtatgaacttgactcatgagattatggaggcaacaagtcctaagatcttctgttggcagctggagtcctaggagagcccacatggttgttccagtctacaggctgtcaggttcaagactcaagaagggctgatatttcagtcacggtctgaagacaggaaaatgtaattccagctcaaaggcagtcagacgggaggaagtctttcttaactctggggaggatcagcctttttgttttattcaagtcttcatctgattgggtgagggccacccacattgaggagagcaatctgtttcacacagtgtatcaatttaaacgttaaactcattcaaaaatagccccatagaaacacccagaaaatggtttgaccaatctgggcacactgtgtctcagtcaagttgacacataaaattaactatcacacaaatatataatactgaagcaagtatggctgaaacagcaggcttccatcagttctcatctagaggtgcagtaactatcaccagaaaagtgaggacatctttgttcgaattagtgttaaactaattccaaaatatctgatgcctttagggcagtttgttaacatggaatgctctgattccctgttttcaaagtgagaaaaaacatttagtttttattattattaatttttaaattgctgcagcatataaaatagactgttccattaaaaaaatcttgctcccttgcatccacattaattttcttttctacaggtgagagtcactgaataacgatatttataggcaatctctagaattggtgtagtgtagtaaaaagtactacatcaagtcaaacaatatcccttatgatattgcttattcacttactaacttaaaatataggacccagttttctcatttgtattttttggaataataactctttccctatctaccttatgagatagataaagggccacatgatataaaatgactctgaaacatttaaaatattaaaaactctgctccatgtaaggtaatattattatctttagtctatatatacatctttctcaatgtttttaaaaaatatctatagttgcatgcttgctttagagttgtttcatacctcttcagggtatttctaaatgttttgtcaccactgctcaagataattcatcttgagatagcattttttcacccagtagttaaaaaatttctataaattcgttatacacaattttgtgacttaaaagctcttggaataatcatggaggtgcacgtatctttttcatatagttatttccttttttttttggatacttagtaatgggattgctgggtcacatgttagtatttttagttttctgaggaccctcatactgttttccataatggctatactaatttacattctgactaaaagtgtatacgagttcccttttttcaacgtcctcaccagcattggttattttttattttttctgataataggcattctaataggggtgagatgatatatcattgtggttttgatttgcatttccctgatgattagtgatgttgagtatatttctcatatatctgttggccattatgaatagttggcagatgaatagtatgcaaatatttttgcccattctgcaggttgtctccttactcggttgattgtttccttttagttggatacagtcccattagcccgtttttgcttttgttgcctgtgcttttgaagtcttatccacaaaaaatctttgtccagaccaatatcctaaaccctttcccttatgtagtcttctagtagtttacagtttgggggtcttacatttaagtctttaagccgttttgagattttgagttgatttttgtatatggtgaattataggggtctagtttcattattctgtatgtggatatccagtttttatagcaccatttaaaaatttagtatgtgtacacacacacccacacacacacacacagtggaatactatttagtcataaaagagaataaaattctgtcatgcatgacaacatagatgagcctggaggatattatgttaagtgaaacaagtcaggcacacaggaagataaataccacatgttctcactcatatgcaggagctaaaaaacttgaactcatagaagcagagagtagaactatggttactagaggctaggaagagtagcaggaagtggggatatggggctcttttgataaccaggtacaaaattacagctagtgaggataaataagttctagagttttatggcactgtaggatgactataattaacaataatttattgcatatttttaaatacctagaagaaaggagcttgaatgttcccaacacaaagaaataataaatgtttgaggttatgaatatgctaatgaccctgattcaatcattacacttgtattcatatatcaaaatatcactttgcaccacatacatttgtacaattattactggccaattaaaaatgttttttaaaaagggttcgatagtatataaagtaagcaagaactaatcactcactgagacccatagggtgttccattatgaaaagaaatagtaggaatatattcccataaagcagttctactcaaagtttgttacttgatacctatccacaatgaaatatgtacagaaattgagagaacgcatttaaaatcttttataacaattaacattaacataatatcaaatgcaatatgtaatttggtgtccgttgagtgtaatgatgaaaagttggacttgcattttgcatatccttttattttattttctattaatttatttttcttatattctacaaatatattgatccatggcatattggaaataaaaacagttcacactccaggtagcttaagaaattactctaaaatctcaacttcatgctagtactgtagctacttccagagcatttaaatgtcattccatcaaatgtgaatgttagcagattgttgttaagttttaaaattgtgttctactaatagcctttttcagaattatgtttctataatagccataatgcatattcaaaaacccagacgtaacctttgatctagatagggcagtgttttcttgtcctctacaagtattcatttgcttagccaccttgaaaggttctgaagttctgaaattgtcttaaactgctcaaaagcaaatgaatgacaataaatctgattttgacagcatacatacactaaaaacctgagaaaaaggaagtcatttcagagaaagtaaattatttacatatttttgcgtaagatgacagatctgggctcccattaacaatggagaggatacttttctaacttttaatgagcttttgacaaaactaaataataaaccaagaaatccttgtacaaatgaaaaaatgtagaaacagaccaaaatgggggagttacttatagtgacatggacagttatatgtaatagatgtatgaattgtagtcatatacttttacaatctaatatacactgcaaaatattcattcaatgactgtgtgtagaatactagctaaggctaggaactcttttttcatagccttcactctttgactcaagcttattgacgaataggcaaaagtgaataaaacaaggaactcagatatatttatttttgtctctataatattcttttgaaccacaacctatttattaatcattggattttaagaataaagtcagtgttgtaaattggcaataacatcagattatcatctatttctagcctgttcctctagctgagtggccttgggcaagtcataatctcaccactagcttctgcttttttccatctgttagataacaagattggataagatgccaccttaggtccattcaggagatttggccataaaaatttaagttaaaaaattataaaaagatctttttgattgcagttatcttgtgaaaaacttttccggaaaattaaaaggaaagagttctttgtttcatagtgccaatgaaccttttgaaaatgaccatccatttacataaacctgatatataaataaaattgaaagtaaaaatataaatgtatgtactattttaaagtttattttatgcataatttaaattctattttcaaccaatatattcaagactaatactgcattcatttcaaagaacagaattacttaaataacactccccaatgtcatattctttctgtgaatacaaattaaagaacgacactatccaatgtgctactgtctctgtgaatacaaattaaagagttggccttgttgtttgaatttggattcagaaaatagcttaccaggcaatcccttatgtactaagctctgcgtatttatggtacaccattttgagcagctgcaatgcattcaatactcagggaatttggaaatgattttgaatttggataaactggtgcactgatgcctggagaaaattctaaggtctgtacagtaccctgagacaatggcgtagactgtaattattaacctgatcaagggcaaaggggtattgaatattgagcaaattccaacccattcataggactgtcatgtgctgtggcccactcattggtaggctctgggttgatgaggaactccaaagctctggggcacgtatttcttgtataacttgagtagttctagacatgtgggactcagaaatcacatcataagaaagttgttcatttctcaattcttctttaattctgattcttcccagtaaaaagactcagtctggtgctagtgtgcttctaacacttccattaattatgaattccctttgcaacagagagtgaagcgggagcaccaaagccttctgcaaacagtatctagctataatttgaaaacatgagtttgttcactgtttttacagtaaccttctatttatggcaagtaatactggccttttagttatggtaacaacacaaagtgttttttttttgagacggactctcgctgtcgcccaggctggagtgcagtggcatgatctcagctcactgcaagctccgcctcccgggttcacgccattctcctgcctcagcctcccgagtagctgggactacaggcgcccgccaccaggctgtctaactttttgtatttttagtagagatggggtttcaccatgttagccagggtggtctcgacctcctgacctcgtgatccacccgcctcggcctcccaaagtgctgggattacaggcatgagccactgcgcccggcctacaaagttattttttaaaatagatttatttaagccccagaggtatgtttatttagaaaaattttaaaataagtaacaacctatgactgtcaaaaatttctaacatttggtgtttcaaataattgaagcttgagaaacattggacttgtggaaaatacactgagctggaagataggaaaattagtcactaaatctaattttagccctgtcactaattattagattgtccttgggcaagattgaatctttcatgtctccatttcctcattatccagtaagtgtagtaatatttgccaaactacttttggagcgacaatgtgaagattaaaattaaatgatgaatggtgaaatactatgaaccttggaagttatacgtagataaggttcattattatgtaactgaaatgtcccctttttttttatttaccacttcacaaaaacaaaaacaaaaacaagatcaaaaccatttaaagaataataatattatctctgttttttctctaggaccattaacagttactggtggtgatattgatgatggtggtggtgatagtggagtgtgtgtgtgtgtgtgtgtgtgtgtgtgtgtgtgtgtttatatgtatgtctgtgacagagaaagagagggagattaacttcactcattcagtttctatatgtaaactattcctaaatattaaggctctagtcatcttttccagattgattatattttatttttgctatttcccacggtgctaaaaagcttgaaaagtaaactgtgtttaaaatgaaactaataatacatcatattcactccaagttttaataaaaatatcacaatctatctgaatatttagttgttaaaaatacagaaatttagttgcatacaaaaattatttcttgacctgaaacaacatttggattcttgtttattctacttgtttattgtttttaaaaccgtaaatatctaataatatgatatcttttcacaaaagatattttactgttacataataccattttctatagacttcaggatttctttttctaatttaatgtctggcttatccttgaagctaaggtttttgtttagttaaaatataatagttcaattaaatatctggtacattttgatattaatgactaatctgtcaagtttttgactgttttatttgagacataaatacaactaagttctaaattattaattcattatataaaatagagaaaattgatacacacagaaataatgctagtaattgtggtttggtttcccattctattaagcaaaacttatttaagcattattggtgctgaattaggagatgatagacatcataatcttatttgtatataaatatttaggcttggtctaggatggcaattctcaaacttaagctgtcatcaggatcacctggagggcttgtcaaaacacagatttcttggcccactctcagattctgcttcagtagttctgtggtgaggcctgagaaattgtgtttccaataagttcccaggtgaggctaaggctaatgttgcatttctgggactatactttgagactcgttggtctagtggaaggcagtagaccagagcaataaatcccatggactttggtgataggcccagatttcagccctgactttggcacttatgagctgtgtaacttggataagttagggatcaattttgtcatccataaaatggtaattatatctattaagaatattgaatgaaataatgcatgttaagtgtttggaacaatgcttagcatattatgaactctcattaaatgcaatatcagtaactaattgtgatggtagtaagagtggtagtcatagaagtagtggttaatggtaataaaaaagaatatacacatttgccttagttcaattgcattaaaagtttattggtcggccggacgtgatggctcacacctgtaatcccagcactttgggaggccgaggtgggcggatcactaagtcaggaggagatggagaccatcctggctaacacggtgaaaccccgtctctactaaaaatacaaaaaattagctgggcgtggtggcgggcgcctgtagtcccagctactcgggaggctgaagcaggagaatggcgtgaacccgggaagcagagcttgcagtgagtcgagatcgcgccactgcactccagcctgggctacagagcgagactccgtctcaagaaaaaaaaaaaaaaaaaagaaaagtttattagtctttctaaggaatgatggatggagagcttggctttcattgatcattttgtctatgataaacattctgcacaagacatcagtaaaaagaagtaatgcccctagtgaaagcactttcaagagcattttggagattattatctagattgcagtttaaacaaaagtttctctatttgtacaatgtttctcaatactcagaacttaccatatttgttactttccttcccttagcaacaagagcaagacccaacaaacctatacatctcaaatctccccatttctatggatgagcaggagcttgagaatatgctgaaaccctttggacatgtcatttccacaagaatactaagagacgctaatggagtcagcagaggtgttggctttgccaggtaaaattctttctttgtatgtaatcgttctttcctcattgttccttttaaattccattccttttttagtactagagcccaaagcaatagaatatgcaaaaaaaaaaaaaaaattaaaagtagcttatcaaatctgtcatccctctgtgtctttgcttggagctaaataatttcaatgtaattataaataaactgtgcttgttcaaatgtacgtagaatgtgtttatgtgtcttgagtcataataacatacatactcagttcccagtcctctctgtgcctgtggatcaacaaaatcagatgctgccaatacctgacagagacaataaatgcccagtaccccaaagcaaaagagcccatgtggtgaacaaagcatctaagtgtttttgcattgatttccaaaaaagggtgctagcatttctcagtaaagagaaaataaaagaaaggaaacatttagagaaacaggaattactgagaagacccagcaaactcagaaatacaagggaggtcaagaagccatttgcatttaagaggccctggctatgtttttgatattttaggcagaacaggggaaaaaaaaatattcctttcattgtaagaaaaggaagagtaattttcattttaactttgaaggaatgtttacaaaagaggatttcagccaggaatggagtttaaatagttgtacctgctgtgctttcatgaaaaacaaagctaaagagaccacagagtaaaagaaactgctcaatgacaatgaagaaaaataagtcttgtctctatggcttggtacatttatgtgtgtctccagctgatttatcatggatgaatggatggatgttaagtgttatgtggaagtcagcccattgcagacaagtttgttcatctagggccaggcagggtggctgacgcctgtaatctcagcactttgggaggctgagaagggcagatcacaaggtcaggagttcgagaccagcctggccaacatagtgaaaacccatctctactgaaaatacaaaaattagccgttgcgtggtggcacatggctgtagtcccagctactcgggaggctgaggcaggagaatcacttgaacctgggaggcagaggttgtggcaagccgagatcgcgccactatactccagcctgggcaacacagcgagactccatctcaaaaaaaaaaaaaaaagaaaaaccattccaaactaacttccgttaactcactttagaagataacaaatcgtcatgtatatgttaactaatctctaactttatttccttggagttgtggttgtggaccatgtgtgaaaattcttcttattctccataatgtatacatagtaaaccaggagacaaatgcaaggtacatgcttgatgatttgaatagaaataaacagaatgaagaaaatctccctgacttgaatgtgtgcatgaggtattcaggctttcaggacattgacaactgttgattttcatggccaaggcagagcttatgacactacttggatctctgaatttagccaatgcagtcattcttatatagtgtgcaactagctattggaggcctgagcgatgtgggagttcactgaaccaactgtcatgttttactttacataccatacacattcctttggttcttcccccatcccttgccctccaaaaactctccaataaattagtttctccttcatttggactcttgctgggaaataaatgcatttcaaattcattaagagcacatatttccaagaagacctacagtgatatttttttctttaaacaaaggatgtgttcgtacaaagtatattagtttcctaggtctgtcataacaaaatgtcacggaacagtggctcatacaacatgaatttattttctcacaattttggaggctagaagtcagaggtcaagatgtctttatagctggcttcttgtgacacctttcttcttggcttgtaaatggctgtgttccccttctgtcctcacatggtcttccttctgtgcatgcctgtgtcttaatctcttaagagcaccaagtcatattgcaatagggcccaccctaatggcctcattttaacttaattacccctttaaaggggtaattacaaatacagtcacattctgaggtattgggggttaggacttcaacatatgagttttgtcgggtacacaattcagttcataacacaaagattgaactattcatttctctcccatttatcttttctatacaatgagagtttgcttaaaatgaggcatatttttcttaagtacagagtcaagtaatatatattctaaaaggcagaactataatgctggtatatgagatcatgaaagaataaaacttacaaagttatttttctttaggaactgagggagggtgggaattttacattttagctctattctgaatgcagcctctctctctcctctgttgcattttgcatatagaagccacagtgagcccttcaatattcaaatctcatcatgtcagggtcctgcttacaatccttcaacatttcacttgccaacctctccagcatcattcttgatattgctcgccttcctggctttgactctgtctcatgttcaggcacaagctgcccttcttgcctggttatactttccatggctcttctcctgacttctgcctgctcatctctcaggcaatggcttaaacatcttttcttcaaagaatttttcgctgacctccaatctttggctttggacaaagttaggtgctcttgttatagctcctataaaagttttgttttttctttcaaataaaatatatcacgattacaatgaattcattgtttaatttctgtcttcaccaaatggattgtacatttccttgggtcaagttttctttttctttgttggatggatgactagatatgtggctagtggatttcataattaccgttctgtgaagtttcagaatagctaaattcattggtcttttacaactttgagcttcaaatatgaattagcagtcacattccaattctgaaatttaggtatctgtatttcagaaagtgccatgtggactgaaaaggcaaacataggttcaagtcaagccactgatttcttatgcctaagaaataaaaatgaagtgtgagtctgactatcttttgaaagaagccaggaaaccaacacagaaaaagtatttcgttctccatgtatcttagattttaaattttgaggagcagaatcccatataattagcctaatttgatggggtgagaatatatttttagctgtaccataaatagatctgcccaaattcctacttccctataacattggctgtgcattttctcaagcaattatggcttttgccttaactaatttgatcattcacaacttaattcttgcacaaatgtttctccttttaaaaatattatcctgtcccttttccactctgcttttctcatctgaaattttccctctgaaccacaaaacagagatgatttcagtcaccattttcttgattcttccaagaatagcacatagcaagtgagagaaattattgtattacatgaggatgtcttgggacagtggttctcaaagtgtggttcccagatcagcagcttcagtgcttcctaaaaacttgttagaaatgcaaatttcctgcccccaatctaccgaattaacagtctggtggtgagggtgttcagcagtctgtaatctgtgtactaacaagcactttagatgactctaaaagcactctaaagctttgccttaggtcattagtacttgttcttaggaccacctgaatgatctgttaaaactctgattgctgggcccactcttaaagtttctgatccagttggcttggggtgagactcaattatttgcatttcttttttttttttttaaattttattattattatactttgaattttagggtacatgtgcacaatgtgcaggtttgttagatatgtatacatgtgccatgttggtatgctgcacccattaactcgtcatttagcattaggtatatctcctaatgctatccctcccccctccccccaccccacaacagtccccagagtgtgatgttccccttcctgtgtccatgtgttctcattgttcaattcccaccaatgagtgagaacatgcggtgtttggttttttgtccttgcaattatttgcatttctaacaagtttccaggtgatactgacactgctgatatgggaaccaccctttgagaactattgctttaaagttgtctgtgatttttccaggtggagttgattcctgttgatgcctgatttacattgttttactttctcaaaattactaataaggaactatcccccttcctgttcctcaagggtagaggccatgccttcttctttatatctgtccagtacttagaatattgacacataattgatcttgagcaaatttcttatgataaataaatgaaatcactttaaggttttgggtttttttaaatatagcaatatgcagaaagacatttgatgataatgataaaccaattgtgagatagagtactggaatattagaaaaatctgtggtagcaccaacccaactggtattagctcacaaattgtttcttcctctaggagtttacagttccacaggcattattaaaagaatatgccggctgggcgcggtggctcacacctgtaatcccagcactttgggaggccaaggcaggcagatcatgaggtcaggagttcgaggccagcctggccaacatagcgaaacctcatcgctactaaaaatacaaaaaaattagccaggcgtggtggcacgtgcctgtaatccgagctactcgggaggctgaggcatgagaatcgcttgaacctgggaggtagaggttgcagtgagctgagatcacaccattgcactccagcccgcacgatagtgtaagactccgtctcggaaaaaaaaaaaaaaaagtgcttatttaattgggagaatacctagccaataattgtgtctagtaaattgttgtacatatctcttgaatgtatgactgtttcaattcagaaaacctgaataattttttcagtggacttcattttgaatgttactattggtgacttctaaccatcatatgtggtccttaattcatgtacaagggattccaaaattcctttgactggaaagaacccccccgcctcaattattattttacttgcgactatacattaatcttctttgataaccatctcttcaaagtaaaaggagtatcttcattttatatttaaaacgctgaatttcaaagcattgatttgaatgccagtggggcgcacagacagcaaaattacaggcttttcaaagttccagaagcacaagatagtgtctgaaattacagacattttattttattttgtgtgtgtgtgtttttttttactctcttgtaacttaaaacaattttgtaagatccacccccctccaggcagcattttatagccaatttataaacctctaaaaaccgaagtttatggtgggaatgctgacagtcagccccactactgcagagctagtgaatgccaacagagtaccttgcctgcgagggtaaggatcagagcgtaaatcatccagagtctggagggccatgactgtgtgttcatgttatccatttcccatttccagaaacatgagactgattgtccagcaaaaatcacattgagagggtgttatgagaggccagtaaagaatgacccaaagtggggaagtgatgggtgggggacagggggagcagggggagcattcacaattaatccagcttcaacatctgggaacatagaacctctttaagcaatgcatttactatcccctggtgagctaaagagcgtgagagaccactgaacagagagacctttgtgttttgtagtattttttgcccttcctcaatactcttaatctgattctcatggagctttgtttgaatgacttctaacatatgggcagccctgtgttctacctctccctactgaatgtgcaagttttctaaataaataatttaagtttttctttcttttcattaagtaaaaaaaaaaagatgggtataggcatacaaatactagcctgcttactaaatatcaatcagtataaatagcaggtcttttttgtgttttctactaataactttgaatattattaaaatgttatttatttaccttctactgcctgatacttcttgttctcttcttccatctgctgaaatataatgagaccacagaaacagaataatcatatgaaaatacaggaattttaaaaaatatgttaaataacaatactttatttgaaggcaaatatatgactctttaaaatgcccatcaagtctatcaaatttttttaaattgtttggaattgtttggagtattgttttgactgtatctgtcttgaatccatcactgcagtaacaatttctccctcgctattttggcaatccttttgccgttactattttaaacacatgaaaccaggaaatcaaaagtgactaaggcaaatctctaaagtgtaaacttagtgattagtaatctccaaactacagctgtgtttgtacagaaacaggttacaactgtgttttctgagattgaagagaataaaggttgtatgtttcattctttttggtaattttaattcttcttctaattgccatcagatgtggtctgctggagagtatactcctggaccccctgcagcttcttcatctttgttcttcttttgtgtgtctcatcttgtttcttctccttgcctctttgtctttctcttaccatcagaaagtcaaaatcacagctggagagtgatgaacattctattttctttttcatatattcagagccctgggtttcaaaaccctaactaaccagtgaaccaaccaaacaaataaattgcatcaaataacttgttattctgaagtctccgagacggcagtcttgttgtatatatgcctttataaaaatctaacaaaggagatacaatatatactttattgctttattattataaaataaaaatgaccacatacgaaataatgccctctgtgaaatgcggagagagttctgaaaaattatttacctatataaaatggaactgggggagctttgttacctccagattagaaatggtggccattcagtatgctcagggctcataacatgtctttgacctgtacctgctgtaaacacaaagcatgtcaaggactattggagcatccagaaaagtggggacattggaggcagctagtctgcttctggccaatagaaaagtaagaggtggaaatatagcccaatatcatttgagcctcttttatttagtatattttctacactctcagctttctgtgaattgggccaatacatttattctctgtatctctatggttataaacatggttctacatgggtctgaaataacttagcttacatcttagttctgcacctcttacttgtgttcttggggcagttatataaactctctgagcctcttttcctgacatctatctatctatctatctatctaggtaggtaggtaggtagatagatagatagatagatagatagatagatagatagatagatagatagatagatagatgtcaggtcactattatccaatactggcttggtcaatattccagtaattgttatagatgaagtaattcagagatgtacatacacccacaaaaaaaatctgcttttacagaccaacattctactggattggggatgatgcaggatttttgctccttagttcaactaaatctgggttcttttctcatgaccaggaaaaattaggcatgtggatacactgaagtgtgaaaagggcagaatttattaagtgaaaggaaaactctcagcaaagaaaggggtagtatagccctaggtagtattggaaaaggcaacattcgtttggttaaaaggcattattcagaaagaatcaatcaggaaagagcgggcaaacaggggcagaagttgtccctctgggtcacaggtttcagttggaaccagcagtcatgtctttcagccttcaggctgttttaggcttgaaggtgatgtttcaccagggacccttccctatctgcctaggtaatttgtctgcctgctgcctctatcagggagatgacaataagtatgtaataaacaaataatcaaacatcagataatgaaaatattacaaaaacaccccaaacataggggtgtaatagagagtatggggcaataggaagcaagaggtaagagaatgatgttctgtcttcagagggaacattgaaactaaaatacaaatcagaaagaaccagccaagaaaatctcttagtgggagtagggaggcaagagaacaatcctggcaaagagaaaaggaagtagaaaacctaaggtggggccaagtttggcatgtttgggaaatagaaaggaaacaaaattgtgaaacattgagtaagggaaagaggtgtaataggtaataatgtcagccttaaataatgagattcagaaaatatgattaagtacagagtttatttgagctcagagcttgaagatggccactcaggagtgtagattcaagttgccctggatatacagtccaattagcagtagttacaagtgggtcttgaaaggaaaaaagaagcagtttttaagtttttgctaagaatatacattaaagtaatgtattgattggctattcatggttctttgtatcacagattccaagaacatgaagataatggtagaggcagctaattaggaacaaaaatgcctttaaaaaactaccctgggcatggatgctgtgaggaggggcatgatcaaaagtctccaactcatggctctctgggttggataaattttgcatacctcacatagctcagcctgatctgagttttctcatttccctccatttcatcaagatgttttgaagaaagcatagtagatgaactaaaagcattttgactccttagtcctatatcataaggaaggttcattcccaaatggttctgtcccactcaggtgggcgtgtggggaaggggcaggggagagaatacatctcagtaagaaattttaagtgtgcctaaagctgaattggaatggtatcacagggtggcaaaaatgagacttcagccaaatctcagtcaacttatttatatagttgctgtcacttattgaatcatcctggtctttagaatattatgactttaattttctcagaagcagtaaaacagtgagagatacatattgcaagtaaggattaccattacaaaaagagaacatgtattccaaaatgaaaaaggaaacctgttccactggtgagtacactgaaaacatcctgaagaaaattaaacccttgtcctttagagactcatagataggaaataattctggatttagtctaaaatataggaaaatcataaaaactcaaaaacagtagtcagtgctggaatctaatagcaggtgtgctatagttttcttctgaaacattatttttctctctccagttccccatgtaaaccaaggataattcttagtctgatcaatttatttgcaaaataagttttagtagtgctcttggcctgattatttgtataaagtgtaacaagaataatgaatggccatataggctcctttaagttggctttgctagaactttttcataaggaatctcaaattagatttttaaaagcctcttgaggctaggaaaacaagccaaggatttgctgtcaggttgtgcctgtaatacctatatgaattgggtaaagtcctctcttcttgaggtcccaaaatatcttgaggttcctggacctgtcagaaagtgatattctttacttatcataaggtcaggaaccttgtaagagaaccatgtaaaaatgtatcatgccagtcttttccagaggccttttattgggtttctaaagtcaacttcaattcctcaaagcaatctggtcatatctaaaaatatgccattccaataaaagctttggaaaaattaccagtgttcaatgtgtcctgataccaaaaaacaaacacattcttattgaacttatgcaaataactatattgccataaaacaagaatactcattattagtttccatattttgaagaaatcagctaaagagaaaagtgaacatttcaattttgcttgcaaatgtatactttaccccgttgctataagctatgaatagctgaaaagaaaataagacaaaatataaaagagtcagtaatgttgcaaacaaaaaagtcataaaaatcatttcagtcctctatcagttcagtaaattgaaataacttttgattgacgttgacttagcaatcttcattaatgtatcagctttttaattagagttctggcagattttacttcgtccaaaagtaagatctctaaatttatcagaaatctttattcaagaattcttgttgggattcttttccacgaattttttgaagaatggactatagctgattataaataacgttttgagaagacttaaagtaaaacgataattgtctgtggatgacaaaaagagtagccatggtcaaagatacaattgacaagaaatttaattatttttatggcataaaacaatgtaatataataatcataattatgtctgatagcatatatcaagacatatctgaatttaagaatctcatataattttggaatacatgttaatacatgtatactaatataactcaaacctatttttctaacttttattttaaattcaggggcacatgtgcaggttcgttatataggtaaacttgtgtcatgggggtttgttgtacagattacttcatcacccatatattaagcctagtacccattagttatttttctgatcctctccttcctcccaccttccaccttctgaagggccccagtgtgtgttgttcccctctatttgcccatataaacagcatttcttatttgacaatgcttcctatatgattttaacataccaaataagtgttatatgtctctcctggacttccaggggtttctcctttatgtccaggttagtacaaattaaaagataattttagaatttgaaatttaatttttggaaatatgtaaagtattaagggtttaaaacacttgatattgaaatttaaaaatgtttaaaactcatgatcaaaatagaatctgaagtcaatgcataataatagtcatttattttgtgaaaatgataattcaaaggtttcagaaagcaaaattttttattatttgatagggaagagatttaatacccaatcaagggacctaataaagacaacatgagggaaactctccctgcagcttaattattttacagtttactcaaaaagtaaacaaatcttttactatctcttattaatactacacaaaattcttgttctaaggagaaaaccaagttttacttttagtgtgttatcaatactaaagctaattttaataaaacattatgaccaaatctgtccaatctcaatcagctttgacctcacaaaataagatttccataaaccttttataaccttttgtaattttctattaaaaatgatcagtattttgagaaaaccctgtggcaacataggggcacagactgtggccttacatcagtgtgcttttgatattaatgctcagtttttagaaaaacatataaataatttctaattttagacaacttgaacacacacaaaatttctttcccaagattaatcttccacaaaccctctacaacgtgcttaaaatgttttgccactacctaagcaaaaattctatggataaatacataggtattttcctgatcagaagacagctattttcactaaaccaacaatattaaactagtcttaaagatttactcaaatcatgtgaactaaaaggcacttgagctggttttgagacaggatagttcccttggtacctttgtgggactcacaaaggggcggctcggttaggcagcccgcagcactcaaaccccttgtgggagggttagcacgcaggtgagctggtgcaggagccggggcaagtgcctttgggtgcctgcaggaacaaacactgtacaggcccatggcagcgcctaggggttgcctacgacccctggagccccagaggatgtgtgttatggtgtggtcctttagctttgtcatccatggatggcttaagtgtttaacagctcaatggggagttagtgtgacagcctcttccccctcacctcagttcttgtctggcatccaggaggagtgaggtcacacgaacaatttggagggtggtgaatgcagaggattttatcgtgtggtggaagtagttctcagcaggaaggggagctggaagggcaatatagtgggaagataatcttcccctggagttgggccatctgtggcagaactcttctatgaaattctgctgtcaagccatccctctgaagtcaagctgcttctttctaatatccagctggttcctcttttctccttccctgccagtggagcttggagtttttatgggtacagggtggagggtggggccggccagggtagttttggaaaaggcaacatttgggtgggaaaacagggatgtgaagttttcatttagggcattggttttgggcttgagggtggagccctcgccggggaaccaccatcttctacccagtatttccctgcctcctgtctgtatgtagtttctatttttctgataaaatatttgatttaaccacttacattttctttaagacaattaattggaggttcttcatatatgttgctagtaaaatgtcacatacacatgccacatttaaacatatagacatacaggacacatagaagcaaattttgtattaatagctttataaggttctccatttgccagtttgcaaatagtttctttcctctttagactctcaagccctaaacaattattagctaggctatcctaaatttacaatcacaaaaacatgactcttaggtgaaaatttacctcccaaaggcacagaacttagatctaaacacctttatttactgagacaaagaagggcataggtaaaggcccagtcaagataagattaccagcaaaaatatcttaaacaaaagtaaggttggttttataaactttaaggcactgtttttcctgtcataaaagtttctagtagcttaggtggagcaagggagatgctcctacaaatggagatttccgttatatatgtatatttattttacaaagagtttcaaaatagccacctaaatgccagaaagtcatattttggagaccaatctagtcagaaagctggtattttcaacttagcttatgtattgattagattactaacctcagggttgagccctttaatgaatagcaaaatgaaagcatttgcagtttttggggactaatgtttacatatgtgaaaaacaggcagtgcacctagatatttaaaattgaacgatcccacttttacattgaatcccgggtcccccagaaaagagaaatgccacaagaccggggtatgcaatgtttccacaatgcacctcactgcatacattccctcaagactggtaggtgagcaatgcccatcagcccactctgtgatcagaccaccctcccacaggaggagttttatgccttgaggggaagtgtttcctccaccttcaagtgttcaaacctgtctttctatctaaacaccggaaaaaatgagtagccccgtacatttataatcattcactgtaactgatttcagctgcttcagaaaccacagtttttgccagtgacttgtcagccattgcacacacaaaattcaagttgtatctcatagtacagagtaatccctggtaccctaaaagctaaagaggtcagttactacttctaacagctcttgcaaatctttattattagactcagttatggaagtacgattgcccataatcatatttcctttttgaatgataaaaaagacccagtgagaggaattttggtcacccaagaagaatgtttagatttgtcaattgaactgagctgtgaaatctgaccaattttaaagattacaaatttttcacttaagctgtaagattacactttttcttttcagagagaaactattttttccccgaccaaaattttaaatgagataaaagattgaaaaactctttttttttttttgagacagagtctcattctgtcacccaggctacagtgcagtggcacgattttggctgactgcaacttctgcctcccaggttcaagggatcctcttgcctcagcctcccgagtagctgagattacaggcgcccaccaccatgcctaatttttgtattttaaatagaggcagggtttcaccatgttggccaggctggtccgaactcctgacctcaagtgatcctcttgcctcagcctcccaaagtgctgggatcacaggcgtgagccaccgtacatggctaaaagatgggaaaactctaagaattaattcaaaataacactagctcaaaaagaaaaagtgaaagtcacaaatctgcaatcagcagagactctagagaataacaaatggaactcctaccttacagtagagcttcatttccaaccatgttgtggcaggaatgtgtgcagtttcaaaaagtgaattggtctgaatgttcaaccaagaatggagcattcaaatctgaggagggcttacccagttgactgacctccgctgactccagtgaggtcagatgaatgaaagttatgctcatatcaggactccagctgtcagcaaagcaagggagatcactgaaagtctgtttcaggtcccacctgagtcaccaaaatgtcaaccttaaataacataagtacagagattatatgagctcaaagcttgaagatggccacccaggagcctagattcatgttgccctgaatatacagtccaattagcaatagttacaagtgggtctttaaaggaaaaaagaagagaagttgtttatcaagacttttcgttaagataacataagctattaattggttattcattgctctttgtgtcacaaatgctaggaatatgaagataatgagtgagaaagctggtcaggaacaaaaatgccttaaacaattgcccccagtcatggctactcaggggagagacagccatgactgaagccctgtacttatgtctctctgggcctgataaatgttgcatatctcacatagttgacctgctctgagctatttttcttttctcaataatatctaggaatgaaatatggctgtagctaggagattgattaaaagtggtaatgtattccagagtcattaatggtatgacttttctacacctatgcttaattttcactttatctcagattatttatttaagtttaattttctgccatttctttatgaaaattccttctagaaacattggtctggctaaaaaaatatacttagataattatgcatctatgtgagtacatagatgagtgtccctactggggataatcaggtaatccaagtgaaagaagtagtttctagatggagtataaggcaaactttatctcttacatgcttcttgaaacacacagtctttgggataatttttttactcctctgctgttgatagctttatggtgtaggcatcaagatgctggctggaagcagagtttcactccagatgattctactgaagaaaattaaggagtatttaccaaatatttacagaagcagtgttaagggaactgaggtaaaggcaaagagatgttgatgttcccagagaggagcaacagagggaaacgtttaccaccctgagagctcaaggagcaaccacaagggtgtttccagagttcattgagagccagagcctcagaggagggcctgcttggaaggactgtagacagggagagatgcaacccctgctagacagaagtgccaaagcagggagacaaagagggaaaaccactcagatttctctctactcttgccttttgaagttctttctttcaagcttccataggcagaacccaatggaaaaccagtaaacaaaagaactaagattacacagtcgatagaagggtcacttccttggggcatagagcaggacagagaggacatttaggaaaggatgagcagaaatacaccactctccctgtataaattaagttaaataatttttcttttctcctaactattaaaaataaagaatgcaagttcagtgataaacagcacctactattttgccttaggattggcaattgatacagcttggtaggaataatggcaaagtggcttcatttaaagaacaaaactgctcttttactctgttccatggttgctgtgatgtctttttttctgacaccaaatgtgtgggtttttctgacatcaaataccttatttttgcatatcgattctctaattctctgacatcaattggatgtcctacaatttaactcagttttgacacaaactacctgatcatcatgagacttcacaggtgtaagggctcagttccacaccagctgcaaatggagtgcccaggtgtattagtccatcctcatacttctatgaagaaatacctgagactgagtaatttataaagaaaaagaggtttcatggactcacagatccacatggctggtgaggcctcacaatcatagtggaaggcaaagggggagcaaaggcttgtcttacatggcagtaggcaagagagtgtgtgcaggggaactatcctttataaaaccatcagatctcatcagacttactcactatcatgagaacagcacagaaaaaaaacccacccccatgattcgattacctgccaccaggtccctcccatggcacatgagaattgtaggagctacaattcaagatgagatttggttggggacacagcaaaaccatatcaccaagctacccacatttcttcccagcaactacaaaatgtgggagtacccacaactccccaattcaggtttagtaactcactaaaatgactctcaaagcactttatgtttatcagtttattataaaggatacaactcaaatgaaagaaatgcatatggccaagcatcagggaaggagtgtgtagcttctgtagcctctctgggctcactaccctcctggcatatatcagtgtcttcaccaaactgaaaatttcctgaaccttgttgtttagggatttttatataggtttcattaggtaaaacctctgggtttgattaattaaatcattagcccttggtgtttgagctcaatctctggcccctctccagttcttggaagtcagagagggtggggatgaaagttccaacccactaatcaagtcttagtctttctggtgaccagtccccatcctgaagctacctgagtgacctcattagcataaactcagatgtggttaaaaatagtctgttctgaataacaaaacatacccctatcactcaggaaattccaagggttttagaagctgtgtgtcagcaacctgagaaaaagactaaatatattttttattatgtcatagttgccatgcagaaagcatgggttaaactgtcccatctattaaaaggaatcacagatttcaattttcatgtgaaatctcccaagtttcaaatgttgacaaccatttcaaaatttccaaaatctctttgcagtccaaataaaacatacctgtagactgggtttggcccatggtttctagtctctcatacctgacacagaacttcggaacaggagttttcaaccctggctgcacactgaaatcacctgggtagctttgaaatctttgtgcctgggcctcatgccaaaacaattaagtcagaatctcctgggctgggccccagagattggtatttttaaaagtagttttctgataattttaatgtacagtgattttaaaagcttcttattttgcaataagtttaccttcacatagaagccataatgataatatagattttctatatattgcacacccagtttcccccattaacaacaccttaaattaccatggcacatttgtcaaaattaagaaactgacattggtatattactattaactaaactccagactctatttggattttgccaacttttttattaacattttctttctgttccaggatccaatccagttactatattgtgtttagctgtcctgtctcatcagcctgctctgatctgcgataatttcttagactttgtttgttggagtagtactggccaggtattctgaatgtctctagatctgagtttgtcagctgtttttctcatgataagacccctagttttcatgggttttgggagagaataccacagaggtgaaacacccttgacatctcatatcaggttatattccatttttgaaaacaacttcttgaagtaatagtggctgggtagagtggagctagcaggacccatcctactcttgaacagattgaagtacatcagtcagtagagaaaatcaggagggatgacatgaggccagcaatggagctgcatctcttgcaaataaatagtctcaattcaaagtcatgagacaacagttctattccaggctcatccactaactagtttttagggaagccaatcacagtcttctagtgttactttcttcatctgtacaatatagaagttgatatctgagtcttgaaattatgtgactctcaaactctggaatgtgttttcattagtcaaatattgtcatccacagtttcatttcctaagaggaatgtgttgtaatgctgagcaagataccctcaaaatttctggtttctacaaaagggcatgtaagggaggcctctctgcttcactgtttggtacttaagacacttgtatcctaagaatgtcaggtgcctggcaggaagaaaacaaattgcaaaaactgagaagaaaattcatcgcattcattcatctttgtttctggaactcactattttattccttccgttacaatggattaagaaggaaatgacataatttgtttttgaaatgtcagaagcagtgcagagtttagtactttaaaaaatagtttaatgttgaccctgtgcatacgtaaatcttaccagaaatgaggatgactggcttacaacgttagatactctaagttgccaataatttgtacagagcctgtgattgcaaaaccacaaacatttcacaatactggaaacctctaattaaccataataaatgacaggatgggtttgttttaaatacatggttaataatgcttactgctttaagaccataaactgtgtgattctctatggaggtgacagaggtaggctgcaaatggttttgcaaagtacgtttctacctctgcatgttaagtctgacccagaacattctactaatattggatcagcctctcatctgacgtaatttgcctgtgggaattgtatcggctgttaaactagctcctcttagtagctgtttgaaaaaaaaaaggaagaagaagcacaattctgtggtgtgtttcaaataactgaagccagtgtcctaggtactgagacaagaaagaatgtcaaacaggacctttaatgtgtatttatatttaaacatcagacctaacagaaaaccctgaagctttatacaatgattagagccttgtaagatcctaattaatgtattgtcaggtgaatggttggcctggcactcaagctgttctgagggacgcaaggggtttcaggtaccgcctaggaagaatagatgcagttgtagtgattcagtggcccatctgaaagggacatataaaggcagctgtgtctggtgtgctgtcttttcagactcacttgataatgctagtgtcagtttcaactgaagcgtgtgccagattccagacagcttgagctggcatttcagagaggttaattgtgaaacttgagaagaaaatgggcacattcttcctaagatggctattcaaatatagtctctttcctccccccccagagctttctgggtctcagtctcacttttgttctgcttccacgtaaaatgcatgaggaacactgagccttttccccttggcagctcctatattgccatctttgctgggactgctttgccttgttaaaatgtgccccgtgtattaaaatggaattgtcactgctgggtggtgcagcgtaacatggtttgacactaagcgccggcagctacagaaaacagacttttattgcatttattctttcagagacgggagtctctaaaggctcacagcagacattcacttagttaaatctgaatgaacccaaagtgaacaatctactctgctgtctttgtgttcatagaaacagcccccatccagcttgatatggctgtaaaacagtgttaagaaaagatgatcacacttagaatgcagaagggaggacttgaggctttcaaacagaacaaaaatattttaagtgggtggagtgggttagccacttgattttcttttttagcttcctctctattccctaaaatgtattatgtagaataaacacacacacacacacatacacacacacacccctacacacacacacacacccctagtattagtcttcatttataattccatgccattttaagacaaaggatttgatttgtaggactcttgcaagcaagctttagattcttaactgccttttatccagatgagtacccagagagagattgaacagggagggggctctgaggcataaactttgcattttgtagctctcctggaataaaaattccataaagtaacatctgtagtaattaagggcttacatttcctctcccattcatgtctctgctaggagagaaggttattttcccaaagagacaatagtggatcctgtgggaagagagaaagaacagagttagaattcttttcttcctggaaatggaaattttctacttaaaaaaaaaaaaagataaaaaaattgaaagacttacagtaaaaggttccactggaaaggaaacttgaaagagttaggaaaattgtacttagctgttcctaaatatttagaatgaggaaagattccgcttgcctttcttatccaaacatcttctgatataggggaacttgtgagtgagtagtaaacaaaatgctgtttttgtttttatttttatctattaaaattgcataaagagttttctttttatttggacatcaaattgattcattctgaagactttttttttcaaaataatacttatgtggatccattgggtcacctgatgatatacatactgagcgttaatgttaagttagtttcctacactctcttgtcatagcaggatcagctacttaaattagggtgaaatatgacaatgtagatccctttgttaaaacactgttaagaagttcaaggtggcaacagcagaactttaaaccaagtgcagggttgttctaagtgtggggctgtgtgtgaagacataggcctcattcctgtaaatttagccctgcttggcggtagagatttgtcatatccatcgatacagaaagatgcactctcatcacatgcttcataagaatgtacatctgaaaacaaaactttgtcagagaataattatagctcaaaactggaactcgttcctgatattatcttcaaacttgttaaacaagtgatacagatgccctgacttcctctctcagttaatttttaagaatttcccgggcaaaccttccactgagccacatgcttgctctctctaccacattgtaataaggacgcacgccctccaagctgcccagctcagccccctgccctaattacttcgccaaaagcctctcctagattccgtgcctcttctcagcatttctctcacttctgggattcctctcacatttgaattcttatagctgtaataaatatgtataacttacttgacatttgttagcatattttttttgtatcttgtttcctttgccatgtaatatggtcctataatatggccatgtaatatggtcctgaaatggacataaaatttagatgtaggaaagttttacaacttgagttgatgggcaccattccaagaaagctcatattaataacagcagaaaatccaaaattaaactttgccttttgaacacattttacacatttcacacatttcatacacattctttcatgtgtgtgtatgctgtttcttaaatgtatttttgcctctagtatactctttggaagacttaattttcttttatcagaattaatccttaattattatcctccccatccaattttataaaataaaaaaggccagatattatccattatttggaaactgctacaaatattactgtacttaagatatggtaacattgccaaaatttaaattatgttggtatggctcaaaatgttcatgctttaggttgtatgtgagatgccaaaatttggcacaagaataccagtttaggaatattgataagatagtatgaaaaaataggatattgtccaaaattcaatattgagaaagcatagaacctaaggtttgtgtatctataccttccttcaacatgtaggaccccacctaactctttggatgtcttacataaagtggattttcaataaaaatgtcataatgctgacgactacattactataccaatcagtcctttaggctgcaagccatgcaaataaaacacatcttgtcaacctcttttgtgaaatccatcagcagtatagcttagtagctatagcacaggctttactgttgcacagatgtcagttcaaatactgacttttcctcttattggaaaggtagtttatctgtttaagcctcagtgaccttattgatatgaatgacaataaaaagacttacccatcaggtttgctaattcatcattcaacagacatttgttgaacactttcaattgccaaatattgctgggtgaattaagataatgccgcagggttacctctgaacgagtgctcagaatagagccctccacatagacacctttcaaagagtgaataatactttctaagcattaatgagtttgtgatgttctcttatcaatctggtcatcatgttcatgaaaaaagttggcaattagggtacaattctcaaatcaagtatttctatggctttcttgttttcctttacttcttaagtttctttttcttgacaaccatatatgacctctggtttacctttttttcccagaatggagtctactgaaaaatgtgaagtggtaattcaacattttaatggaaaatatctgaaaacaccaccaggcatcccaggtaagaaattcactaataagtgactgaatgatgccgaggcttaaattgctcttattagaataagtacattgtaaagcccttgttgatcactgcagagttggggggtttgcttttcttaatgtgtattttcaaataatactgtgtagcaactcatctttctcaaaagctttttggtaattcttcttttgctttttgaatctctgctgctaactttctaaagtggattagaagaaaaccatagcaaagaatagttaaagaatgatgtgctggaagtgatagaattttatgactcagcattaatattaaaattccaatttccaagttacaaaatatccaaacaatgatattcacaatgaatcccacaaattgatgccagccctgaaacatttcttaccagtccatgacaagaaaagcacagaaactgagagaaagcatttagaaactagtatagcgatttgacaatgtcatgaaatctcagtgcataattttcttttacaaaaatatcagttactgacaaattggaaattttagaaaatactgtctatttatcagagctagtttgagaagccccaatctggactatcccagggcatttcacacttcccaaggcaaaattcctaaggttttatacacattataaagtgttctaattttatgctattaagaattgcattaaacatgaaataattggatttattatgtgtatcagagctacaaatgccagaacttgaggcagtagtgtatgtggaaggttttaatattaactaagtaaagttttaaatataattccaatataaaaaattaacaatggaatgaagtattaaactaagaaaaattacgtaaagattcatctgaataaggcagtttggtttatttgttggtcttttatatacagttattctcagaggagactaaggcgacttcttccatcttacaatatgtgactttaatctttttaagcttgatttcaataccgtttgctgtataatgcatctactatttaaaacccatcagagagttcagaggttgagcattttagttccttaaaatatattgagtttatagataagaggaagcatatacaaaaagagaaatatttttgtggagggttttgtaatgacttgctttttttaaggggggatgtcaagaatgcagaaagacccttcagacagacacttgcataatctgaaaacctaaagtagctgattgctggctaatcagtgagtcaacatacagtgaagactgtgccttgatttggttagcttccatgtgtaacgttcccttgggaactgactgcattatgatccaattggagacatatggtgttgttaagaaaagagttagcagttttcatctcagcatgttagctgcccttgcattttagcagaaatactttttttttttttgtataaacagacattttaagacactttactcaaatccgtcatcgagtaaaggagttgcattgtttgtggactttcctcttgtttgtcctatttcatccaacggatacctatttatatagaagttgttcaaactaggtgtaaattatataattatataaaaataaaaatgagcacactgtgtagaaattatgaatgattcaagttttagcacaagtctcaattttttgatttgttcaaaatattggtatgtcaaaaagacgtattgaaagccttcttgccctgattgatttgaaagtattttatttggttttccccaatgaacatattgctgactaatacaatttaatgctgaagacaaagaaagtcactacaaatccccaaatgtctgggcatccttccagaatatgcaggctatgatattaacctatctaatatcatagctacacccaatggaaacattgtgaatagcaggaacttggttatgagttttctcactcatttttatctcccgggaacaagaaagacaaaataattatgttcagttataaaactcttaggagagacaactgtatgcttctgagatttccactcatcataatagaactaaatacagaatattgatcatcatcagtgcttgaatctgcttatttataaattactttgaaagttagagttgaataaaggcttcaaatgctaagtaaagacatttaatctttgatacttaaattaggtgtggaagaaaagaggatataatacaagatatgggtattttgcaaggtaaagtagtaatttgcccttgttgagtataattactaagtcataacaggtataattacaatttgggtatatgctgtctgcctttattggtcctcattacttattacctggaaatagctgaaatcttactttcagaaatgtatgtcttaaccaatatttgattccatatttaagacagggagtaggatatcactatgagctatggcatcagatatttatactttttttaagtggccaatttccgaatctttttcattactttagagagtgtgtctttgcttgtgaatatgctcaactataattggtgtgacccactgaaaactaaaatacaatttttaaaatttgaaaaatctcagtgttctgccttatcaagatttgacatatttgaattcagaagtttgtggttttatagaactgcacattgattgtttaaatacattgctttaaggtcatgtagatgagggactcacagggatccaataatgatgacctgagatcctcgggtcttaagaaagctgtggaaagattgaatatgatgtcaatcatcttcttctcatactagggccctattgtattagtttgttttcatgctgctgataaagacacatccaagactgggcaatttacgaaagaaagagatttattggacttacagttccacgtggctgaggaggcctcacaatcatggtggaaggtgaaaggcatgtctcatatgacggcagacaagagaagagagcttgtgcaggcaaacttcccattttaaaatgatcagatctcatgagacttattcacaatcacaagaacagcaccggaaagacctgcacccatgattcaattatctcccactgggtccctcccacaacacatgggaattcaagatgagatttgggtggggacacagccaaactatgttgcctacatttaatataactctaagcaagtactgagcaattggtgccatattcatacggtctacgtctctgtttaggcacagtgtggggaaaatgtgcctgtgttattgggcaaatataatggcatttggtttctgtcactgttgacaatgacaattattcttaaaggagatgcaaagctaattattttcctgagatgatcatctagtttccaagtcccctactatgtcatttctaaaaaagaacaaggaaaaaatctatttcaacctaaaatgttgacattgctctgaatttcaaattctaaaaatttcatagttaaggaaatttgcaaggacatgtaacactgaccacatttatgttgctgccccatttcgatttgagccattgttggaataatttgctaattaaatatgattcatgttggtattgggttctaattcctgacagataagtgagttggaagagaactttacagatatctttttggaacacgctttatttctctgggctcctcctatttattcataaaagatctttttttaaatgaatacatcatggatgattgatgtcttttagcatatcccagaactacctctgttcattttagattataatgttatccccagattttggttccctggatcaatgaagctaaatatacatgccaaaaatcaaattattgagtactagtatacaggaagttaacaaagatcagtcacatgtattgctgctagcagatgagaaggagagaccaaaagcatgtgttaaatagtgtcaatcgtttgagtgttgtagccatcagcagaaagagatcattcagcgttttctcccttacctagagggaaaagaaaatacagcattccataaatgttgcatgtcctacatatcgatcttgatgtttttctggacaaaatgaaggatcattagttgcttgcctgcctaaccccagacatttctttgtcccgtaatgaattacacagcaatgttgtatagccccaaagtgttccattttcaaatctctggcaaaagcaaagggttagttcccagacacttcagggatctgtggggcatggacttgaaaggctcactttcaaagagcccccagagcagaatgatacaccatgcggaaaaggttttcacatgtagggacatgtattgatgaacagaacatgcaggccggtttgtaaaaaaataaatcatgttttgctcccaaactagacatttgttttttcctgtaagcacgtgctcctatcagtggagcaatcttttcagaataaaatggaataactaacttctggtatgctttccttactctttacataattgtttctaatcttaattgaactctaagaagtaaggaaaatttgagagaaagcctaccacattatgggatctttaaaaatttaacaactcttgtgactgacagaactttgcacaagtagttatgtatcagaggaataatatttttcgaataaataaagcatggggctttttgatgctttgacatagtaattttagtgttgtgtgttgatgtaaataacaatgtgtatgactatgtatgtatatgaatactttatgggagcaagcaaggaaaaatatttacaaaatgattttttaaatgatgaacacaaatgtttgtataaacttaacattcctgccagagtaaaatatcgacaacatatttaaatgcaatttatcttaaatttatcttatgtgattcaaaaatcagaatatttaagcaatagatttacaaatttttatcagtgggaaatgttgcagagctttgcgatctgtgtttgctcaatagtaacagtctattaagtccacaaatacaactatagctgagaagaggtaacaaataaaaaatgctatggtatatagttgggcaaaaaatatgtcttgattgttctgctcaggtggcgcattgcttctctccaaatgttttatctttgtgaaactaaagcatcacttgtataacatgctttgtgaacaatgtaatccccaattgggtatcattttagatttttcactggaaaaatttttgtattcttaatgttggtgatgtcttcagattatttctatgcatcaaacatactttgttgcttcatgatgaagaaaacacctttaaaatattattagtgaacttcacagagcagctggacaacatcatggtcaatggagtctgagaatctatgtgagtcctatggaatttgatatggtcaatcagttttcaacctttctatggagccacatctgacattgtgaaggtaaaaaagctgtgtgctggtaactgattagatatataagacagagagaagaggtgattaaatttctaaatctttgtatgagaagctaaatagagaaggaaaaagtttcatcttcaaaagaatagaaataattgaaatgagttttttgacagggctacatctactctacccacctgtgatttcggctgcatatgagatgcaacctagaagcatcttaccttatgtatccacctagtttcttcacttttccacctcaggacaaaatttataaaagcttgctcaatgagacagacaaacgtcttctacaaactttgggggagttatcaccccctgggatagcctccaatcaacagggtataggagccagaagataacattgggtctctcatcctttggaaggataattctgagtcacattctacagggttccttgagaggttatctacagtggtcacaagctcaatgaggtttcctttattagcattttcccccttccctgtcttttccttttctatcatctcagcttcctgacatcagctcccaattaaactaccttgtcccttgctctgattttggggaaagtcaaattcaagttgggggttctagaaattgtgttagggaactactttttgatttaaaacctttggctataaaggaaggtattcacttcactaaaatagtaaagtgaatttcatggcccaaatgtactgtttttatgactttttgtttttttaaagagcagagattataaatcccatagtagggttaatgaaggtgaacattagaggtagtagtcaggtagcaagccagggttgaaatttagcaagagaggtatggaaaaagacaagaaggacaagaaaaagacaagaacggtggcatggccaacttgagaacaactgaggacacaaagagttagatggctgataaaaatggaaaagatttagggcagccataaagccagtaaagtgaaggtgaggtgcaggcacagaaaattatcaaacagaaggtattttttgaggttttggtcttggataaatgtagaggtggacatcaaatatgacatccaatgtgtgaatgcctacagctggctgaagtcaagtgaaaaagatctttagtcgagcagctggaggcttacgattagaaggttggaaggtctttcactattaccttaaattttattacttaatgtcatacttgccttgattgcctcttgaagttctaatcttggtaggagcaggttaagtgaatagtgacaaagagggttgttttttttctttatttatctgattttgaattttccaaaccagagtatttttcattttttgtagctcaagggctgtatgcttagctctgtacattctcactaaatactctttggagttgtatagtttcatgaattaaatgacaatcatacatatatttgcttttaatgaactttctgaaggtatggggaggatgcacagctctgggtaaacaagcatgcaaccaatttgggggaaaacattgaggaaaatcttaaaatatttttaaatgttttaattaaaaatatttccatatctaaatagagaaagaaagcaagagtgagagagagaaaaatgtttgtaagaataagaaacttatttgagaaaaatttcagttacattttggaaagcctaatttttctaagactgcttttcaaggtgtatactgaggacctaattgtagtttctttaaagaactcattcttgaacagtgcaatgatgaattctgttttctggcatggcaaatggtcttgcctaattatactggaataatgtctctaaactttttgccactggagctagttaagcacaatgattatgcagcacttttgctccccctgccacgtcttcacatagaaagataaatgtcttgagaaaaaacaaaaaagagaatttccagtctctattatatcccttttggcataatattgttgctcatttctgcctagagaaagtaccacattaacatattatttctcttataatattatataacatactctgtaatttttaatcaataagatatggttaatgctttcttgaccatattttttctatagttacatatgaagcaccaataagtagcagcataatgtgtctggagtttccatttggttccagaatttgattgattaaagtagttgtaatttcatgggatagagaaaagggatgaggaggttttctatacatctccaaaatcatgaaccaccttcataacttatttctaaaatactgactccattcaggtctgcacgaatttctggactgaaaatttcacataaaaacttacaaaataaataataaaacactaattttgcttctaagaccatgttgggctttgccttctgtcagcatcactaatgagtagctaaaccatttagtgtctgtccggatgagtcctattaggaagctgagggttgagtggcttaagaccaattaacacacaagccagggaaaccaaattgaataattaagttcttagtgcatttcagaatctagaatctcatttaataggattgatttaagaacacattctaaccaatttttgtatgaatggatagtattctgaattaaatacttgcaactctctccttgtaaccatcaaaaagcctgctatacatacacctcatcatttatgatctaatttttagaatgatctaatttttagaatgaaaagtctgcaaaacataagaaaatattttaagagaaatgtgaatgaaaacagtaggcaagctctgaactagccattatgtgtttatcttactagctgcttcctcttatttcttacgtctttcagccctgaatgatgaatcaattatttgagtaatattttagttatttttcagtacaaaaaataaatctttcataggaaattggcatgcttatgaaggttcatttgtcccattagactgtaggtttttctgagaaagaactttgatgtttatctctcccatcttccttaaacaattcaaaccctttgaaaacaaggactgcaccttactgtttcttccaaacatctagcccaatgcctggcacagaacaataccaatatcatttgttaaataaataagcaaatacctagttgtggtagacagaataatggtcctctaaagatctgtaaatcctaatccccagaacctgtaaatatgttaggttacatgaaaaagagtaattaaggttacagcaaaaattaaggttgcagctggaattaaggttgctaataaacagaccttaaaataggaaaattattgtgttagtttgttctcgcattgatataaagaactacctgaggctgggtaatttataaaaaagagaagtttagttggctcctggttccacagggtgtataggaagtgtggctggagaagactcaggaaacttacatcagggcggaatgtaaaggggaagcaggcatgacctacatggctggtgcaggaggaagagagtgaaggaggaggtgctacacactttttgacaaccagatcttgtgagaactcattatcacgagaatagcagggaggaaatctgcccccatgatccagtcacctcccactaggcccctcctccaacactgaggattacaatttgacatgagatttgggtggagacacaaatccaatccattcccattaccatggtttatctgggtgggcccagtgtaattagaagcatcctcaaaagtggaggagaacggtagaagaggaggtcagagtgatgcagtgtgcaaagaattaacccaacattgccggccttgaagacaggaggcagcctttggaagctgaaaaaggcaaagacttggatttcccccctagagcctccagaaataaacttagccttgctgacaccttgattttagcccagtgagatctgtgttagacttctgacctatacaactgtgagataataagtttatgttgttttatgcctctaagtcttagatgattttttctagcaacaacggaaagctaatatactagtatagaacttgtattcaccgactatcatccagactattcctatattacattattaaatagtctctgaaaaactctcatagtttctcctgatttttaccttctttgtgagtttttattgaagaaaaatcatattcagtgatgcttgttaaagcacagtaagagtttttttcagcaccatcacaatagttacaggcaccactgcaatggagtctcttacagtggagatgagagattgggctcacctccgaatgcagcatagacaagtggaaatttacagccgaggagcagcataggaggtcggtggttggaaaattaccaagaggaagcatcaggggtaggattctttctgaagacaggccagggtaatcagacgtcacctagaagaaagttcagtaagctgactaaagtaaggccaaataaagaatcatctcagaatcattagagttgcttgtgtgttaaatagaaaaaaaaatcttgttagttattttaacttcacagtttctttataactgctcataagcacatattactatagaagactgttcagcatctgaaacaagaagctttgggaagtccttatatcttagagcacattgttttttattcaaagaaataaaatatgaacttaaactatctgacaccataagtatgccaggaaaataatcctaattgctaatctaaattcatgtaaatgtgtatctcttgggtctcaaccttaatacttgctttcaataattcctattcttgaaaagttattagggcctagaaaaacagaatggagctcctcgaggttataatcaactttaagttttagatgattatatctcaagcatagaccatgctcacacccctactcattgtcccatgaaacggggattgtcctaaagctctaaatgccctaaatctttcatctgaaagcttagttttgagacacacattaaaaatttagaggtggtgaatatgcatacttattatatatttagaaagatagataatgcttatgataaaataattttaaaaattaagtgcattttcaaaaatgtgtttcttagccaaagttattacacattccatattattcctatagcaagattgggaggctgtacatatgaaaacataaccattttctattgaactgagtgtgagacacattttggaccagaggtttatatcaaacagttgcactagttgacccgctgagatgccctaaagaaaaagaactcaagaatttaagttgatttccagctgtttgttattagagcaaatgttagtgctcccggagtgtttgcccgtggccatcaaccagcacctgcatctctttcattaggtagactgcccttaggctgcagcagcctgttttgcctgtgagcagtgagagtcagaagtacttgggaatttacatccccattcggggccatccataaacagtgattgacagctgttggagtatcaatatcccagttcttctgcttctgatgagaataccctgtgtatgatgtatactatctctatagctttcctgaaggattcaaacagttacagtttgtggggctgtctaacaccacatccttgcttgactccttcacttcctggtcccaattcccaagtcccttactggctttccctgaaaatacttcctaagaattcatgttcacaagcaaccttgtttcaaagtctgtttctggtgaacccaaactaaggtattatattcatacagacactaaatttgttattctatgatctattattttcattaatgttttgagttttacagtctcatctgtaaaatgtactcaagttaactgaatccctcaggatagattgagggaggtttcaaaagtgaatataaaattcctcaaattccctcacttcactggaaatagacatactagacactctaagtaaggcagcacttgtttataggtagctggcttctttataaaagggatacaccatttaaatgttgataaagtgtgtgtaacagcagataaaaccgtgatcaggtctcctgtgagtgagcaatcaccggccgattatcactgagctaatcacaatatgtcttaataaaggtccattcaaaagaatgaaaattgtatccatatataagacaaaggggttttaaaataaaaaaatcttagcaaagtgtacaaaagcactgaagaaaaatattgaaactaatatgtttttacacataatcattttaagatggtatagtgagcttgatacaaagggtgttacagagaccgctggaggttcctaagatcctttctggtggtctacaaggtcaaaaatatttttatcataatacgaattcattatttgcctttttcactctgattctctcatgaatgtaaagtggagttttccaggggctacatgatttgagatgtggcaaaagctggaatatggaagcaaatgttagaatccagctgtcttttattaagccagaaattacaaagccactcttctcttttttattctgtttttgaaaatagtgtttttaaataaaagtgtatgatttatgtcaatatgtaacaggactattattattttaaaataaataaacatctaaatttttttattttatgttttaatggtgtcaataaatataacgtgtctaaacaagttttgggggatcttcaataatttttcagagtgtaaagaggccctgagacaaaaacaaaaaacaaacatagaaaacagccgatatagagtcaaattcaagcccttcatcttagaaaagatgaagaaagataaccaagataaaggcgaagtttaaaatacgctctcactttttttggtcttattttgagaacctacgtatgttctaggaagctagttttaatggagcaattaaaaaataaatttcaattaaatgagttctaccagtttttttttatttttttattttttatttattttttttttttggtaaacaagcattcaggcgcctaatctatagtgagtgttttgttttatttttttaaatgcagaggcaatggttagtcttctgaacatttgcattctcattttcattagcaaatagcatattgtttgacagaatatgtgaatgttgtattaagacaatgtatttaagcagcgtgtgtggcatgctgcaattgtgggaatggaattatgtgaatttgtgagtagcatgcgaatgagtctgcccacaatttagggagagtttaagactaatatctaagagccagaaagctaaccacagatgccacatgggagctgtgttatcatcataagaactattctgtgttgcttcttttagtcgctgctaatttcagataatgttcatcttacatctggacttcaccagtgtgagtgctattcaccatgtgggacatatcttaagtacgtacgaccttccaggtttgctagttgtagtacatgataataataaaaatgataataatatatttaaacactagcatgcaactaattgaacactgtatattattagtgttcacataaaatcttaaaaaaatttcagaaatagtaaagtctcctattgtagagtcacataatcatgatttcattaagcttattgcatctttacctaatttgaatgatctctaaggaaagtaattctctagtcatcttttgtaactagttgtaattttatctgaatgaatccatgtaatagataaaataatttaagataaaattctcatataatttatttttaaaggacgcaactcaatatttgcttacatcatttaacagccccttcatttcttgcatcccaaagacaagcattttacatctttgctacacctatatgatgttaaagaaaagagcgccattcgtccagcttatgatatgctttctatgagatcctcacggccaggatcccctttgccctttatgaatttaatttctggaagaacatatgctacagagaataccacctttgcctttggaatcagatggactttggtttgacttatgctgctgtctcttttttacgttttaacttgaacaagttatttagcgtcttgccaggttcctcatagaacctaattgttccgcacccattaactcgtcatttaacattaggtatatctcctaatgctatccctccaacatggtacatgtatacatatgtaacaagcctgcatgttgtgtacatgtaccctaaaacttaaagtatagtaaaaaaaacctaattgtcccatttgatgttaacaatatctcctttacaagtgtttctagaattaactgagagattttctatagccccacaaagaattctggcaagaaatggtagatagtattagtagcattattagtggcatctgttagcctcatgagaattatttcatcaacatccaccttctaggctagaagtataatttaatagttgacgtctctgaatgacatcattgatgagcattatctggtacatggggtatataaggtacacatcctttgcaactaggtaaggactacccttccattttgagccttatgtacagctcattctagaatggtatccattaaattatacatgtccatgttagaggttgacagttttctgagataattggaaagagtatagcatcaaagaaatatttaccttgaatttgctctggtaattctcagattcataaacagtggtcccatttattatgggaccatggcagctgtgttaatgtagtcatacacaaatttgtatgatcccaaacttcttgtaaagttttcccagcatatcattgcacctctagttcccagggcctgcattcccctcattccactcttatttcccaaagaaattctgttcaactacaatacttttcatgcagattttcctgatttccaacttccctttccttaactctcactgtacggcattaaatgcttttctcctatactgggtgtctatttgtgacatgtagcctcatttaacaactgttgtatgcttatcttatcccactggatggcagaattatgcctttgttattcttttatctcctccaatacctaccatttgaacatacgatgtttgatatagacacactaaattgaatttaaaatagtcgagcatattattctagtgtgatttcctaatattgccttaattctctcttaatgcgttttattagtaaatgcttataaagtgaatgcagaaaccatcaactatgatgattccacatagaaatatatgacataatactttttttggtacattttaaaacacttaaacctcaaaaaccttctttcaaatggaagacaatgtttaaaagcacaagaacccttttcatttttataaagattaaattatctttccattctgcttcctgctttctattgctactttctccagattaatttttttaaagagtattgacctatggacattaaacacaaaaggaatataaaataaatgcgttggaataccaaacatcctgttggttgttacaattctacaacaacaattagatttttttttctaattaaaatcatttgaaatcacagtttttgtcttctcagaggtttctcttttcccaaagtttccttcaggtcctgtccttgtagtacattggggttgtagtggcctgtgccaccaggagaatggattcattaacctttacattgatttgaagtgtcgttcaaataaatacttatactctttttctctgatggcttagtgaagtcctttatcaatagcactgatatctccccttgacctttgcctcctgttcattcagaaaatttccatcaggctgttttatttacatttgcaatctcttgctacctcagttaagtttggcacagaaatgtattagtcctggatccaacagaattattttacactctatattcttttggcttctgcagagaagaaaatttctttctttgaatttcattttttaatttcagggtttaaacatttcctgctttctgcatatgtgtctttttgtattttgtctgcctgtttctcttgttctcttgtgactctctgtatatgattatttcaatttcacttcttcacaccaatatctactaaaagatatagttagagccaggaaatgtttctgatcccctgttcccaatcttatcaataaacttttttttttttttgtgcaaggggattggggaattactatgtgccaaatgttgtatttagtattttacagatttttaaatttatttctcaaacacccttagggaaaaagaaactgttccatcttgcagatgaggaggctgcattttatattatgtgtataaattgctttgatgcatacatactagtaatgacagtagtaaatgggctgattgaccccaggatttaattctgtcaccttattagatatgtgaccatgagcagttacttaacccctttgttcctcaatttcccctttggtaaaatgggaataactatagtctcttctgtactagtgttgcaagattggctatggattaaatacattaaactacatagagcaattggaatgtttctggtaaatactaagtgttacttaggtgttaacattgtactgctatgtcataggtcttttctttgatggagaggggatacactataggagaaaatatcagcaagaaattgagtgtcacttccctccattaccaaacttggaggaccaaccttcttccctacatgatacatagaatgaatattaatatcctgtattgggttaaatacatcatttctttagtctggtcaaagattcctccttgagattcagtttcatacttcaacactcattctaattttcagaatggaaatattgggccatccctttgacccaagccatgaacttggttttaacactgatttttaataagtggttcttttgttttaaaggaaaggtagcctatttatagaaactccctttagagaaacaatctttctttgaaaactaagctgtaaaatgatgttcttttgtatgtgtgtgtgtgtatatatatgtaaacatatatatatacatacatgtatgtatataaagcataagagctatgtctagaagaaaaggcacactattaaaaagctccaattagaggaatgtcagacccatattttctccatctgtatagtatcctttctttgaatgggccaaagaagccatggacactgagtgagatctgataatgctttttattccttgaatttctgagatgctgaagagaaagtgtcttgctatcagtattgtttctagggttgaaaagtacctcttaaaaaaacaattaccacaggtatttaattcaaaagacctgaacagagttccttctgtggttacaaggaagctgcaaattttgaagtcatataaaaaagtcacatctactgggataaaaataatctcagcaatcctagattaagatgaaatatatatatatatatataaacaaccccaaattttaataacatagtagaagatacaataggttactgatcgaaggcacaaaaagattgtatactttagaccctagcttttcttatgatactttgatgtcctttacacttgtagacatttgagtaagcttttttttttaattcaataaacaaatatctttgaataactggtagacatagaaatacattttcagtgtaagggttaagcacataacggaataattataataaaggaagtaataatgggggtaaaaaggagggattgataaaccctgcatggaggaaaggaatcaaggaatattctggagaagcatccatttttactgaaattcaaagataaagatgaaaggtatttccaagcagaaataggttgatgctttttgaaacatattgatatagttcaagtttaatcctatatgcttgactttaaattgatgagaactagtttttgctgaaaataaacaggatgagggaaccagatatgcccctgagcgctttgaattgattataactagatggagctggtttggtctagttaggtttgatttgaaactgcttgagttaagttttattcagtcagataacaaaaaaaaaaaaatttgagtgaatcttatggtttgactacatgctttctatattgagaatattaaacatttgtccattgcatttgtcattcatgctttcccttgattgctctttaacttttacttctatttcttaaaaataatagtttactttttatgtgaaataaacttctccaatgtgtcttttaaaaaaatcaccttaaatgtaagagatttcattaatattcatttctgtatcttttgctttttctctaaatttaactctttagtatatttggtatcaaataactatctaaattgaatattttcccaaaaaccagtatcctatctgcacttaaaaattaatctattcttttcacattctttgatatcaccttttcctataatacatgcttataccacttacttacctgtaatatgtgtgcttgctttgtgcaagaatttacaaatccttataatacatcttatctcacagaacaagtccctgctctaaatttttcttccagtttgattttttattgtttagctgttcttgctgttttcattatccagatctacttcaaaattattttgtcactttttttccaaaatataaagatatattcttaagatactatgttaaaatatagaacagttcttgttttattttattttattttattatactttaagttttagggtacatgtgcacaatgtgcaggtttgttacatatgtatacatgtgccatgttagtgtgctgcacccattaactcgtcatttagcattaggtatgtctcctaatgctatccctcccccctcccccgagaatagttcttaaaatctccccttttcttccccattgtgttcttataatctccctttcgcttccccattgtggtcaagccctccctcccacccttaatcattggaaaccatttctttgttttctatccttgtagttttctcttttccagaatgtttatgtaaatgaaatcaaacaatgtatagccttctaagtctgccttccttcacttagcataaggtatttacaattcacccacatggttatatgtatcattagtttgttccattttattgctcagcagtatttcattaaatggttttataccgcattttattctccagctgaatattttgattgctattagtttttggaaattgaatatgataaaatgcccacttttagtgctaaatcaatgttttataaaaattttggtattattaatcagggttagctcctgaatattatgaaatacctgagaaactcattgtctaatccttgattgcttgctaatgctacctcttatataactaaattttaaaagttgaaattggatcactgctgcaggctccctgagacaccaaaaaaccgtgagtctgcttgctttctcagtggggaggctagtggtctagggcaagttatcagccctggtcactggctgcctggaaatagactcagtgctgttgtgggggcacagtgggagtgagactggcctttagtaccgtgggctgtgtgggagagggttgaggcctgtgactaccggctttcccccacttccctggtgacctgtatggctcagcataggcagccacaatccccccgggaatataactccataagattgggagccatatcctcatcccccacagcagctgcagctagtctcacccaaggaaagactgaactcagacatgcttatccctgccccccacctggtggtctttctctacccaccctcggagtcgaagacaaaggtcataatctcttgggatctctatggccctgcacactgcctgagaagcctgaatacttaaccaggtgtccctagggcaagtttgtatccttataggaccatagctgacgcgctcttgaaagctccacctcctacctggaggccaaccaacacaaaaccagtgcactaaacaaaaacacaagcaaggaccctcacagagtccacttcactcccctgctacctccaccaaagcaggtgctggtatccagagctacaagacctgaagatggatcatatcacaagactctttgcagacactccccagtactagctcagagcctgggagctccgctgggtggctagatccaggagagcaataacaatcactacatttggctctcaggaagccccattcctaggggtaggaggagaacaccacatcaagggagcatcccgtgggacaaaagaatctgaacaacagccattgaatcccagatcttacctcttacatagtctacccaaatgagaagcaaccagaaaaacaattttggtaatatgacaaaacaagcttctttaacacccccaaaagatcatgtcagttcaccagcaatgaatccaaaacaagacaaaatctctgaattgccaaaaaaagaattcagaaggttgattattaagctaatcaaggaggcaccagagaaaggtgaagtccaacttaaagaaatcaaaaacacgttacaggatatgaaagaaaattcttcagtgacacagacagcataaataaaaaccaataacaaattctggaaatcaaggacacacttagagaaatgcaaaatgcactagaaagtctcagcaatagaatcaaccaagtagaagaaagaaattcagagcttgaagactgggctttcgaattaacccaatccatcaaagacaaagaaaaaagaatttaaaaaaaagaacaaagcctttcagaagtttgggactatgttaaatgagaatatgttaaatgtccaaacctaagaataattggcgttcctgaggaagaagagaaacctaaaagttttgaaaacacatttgagggaataatccaggaaaactttctggacttgctagagatctagaccccccaaatgcaagaaactcaaagaacacctggaaaattaatcacaaaaagatcatcacctaggcacattgtcatcgggttatctaaagtcaagacaaaggaaagaatcttaagagctgagaggcaaaaacatcaggtaacctataaaggaaaacctatcagattaacagcagatttctcagcagaaatcctacccgctagaagggattggggtcctatttttagcatccttaaacaaaacaattatcagccaagaattttgtatccagcaaaattaagctttgtaaatgaaagatacagtcttttccagacaaacaaatgctgagagaatttgctactaccaagccagcactacaataactgttaaagggagctctaaatcttgaaataaacccctcaaaaatacaccaaaatagaacctccataaagcataaacctcacaggacctatataacaataacacaattaaaaaaaagtatttagtcaacaaatagtaagatgaataggatagtacctcacatcccaatactaacattgaatgtaagtggcctaaatggtccacttaaaagatacagaatggcagaatggataaagattcaccagccaagtttctactgtcttcaggagactcatctaacatataaggcctcacataaacttaaggtaaagggatggaaaattatgttccatgcaaatggacaccaaaagtgagcaggagtagctatgcttacatcagatgaaacaaactttaaagcagcagcagttaaaaaagacaaagaaggacattatataatgacagaaggactagtccaacaggaaaatatcacaattttaaatgtatatgtacctaacactaaagctcccaaatttataaaacgattactactagatctaagacatgagatagaaggcaacacaataatagtggggactttaatactccactgacagcactagacaggtcatcaagacagaaagtcaacaaagaaacaatggacttaaactataccctacaacacatggatttaacagatattttcagaacattctaccgaacaactgcagaatatacattctattcatcagcacatggagcattctccaagatagaccacaaagcaagtctcaatacatttaagaaaattgaaattatatcaagtattctctcagaccacagtggaataaagttggaaatcaactacaaaaggaacgctcaaaaccatgcaattacatggatattaaatcacctgctcctgaatgatcacggggtcaacaatgaaatcaagaggaaaatttaaaaattctttgaactgaacaataatagtaacacaacctatcaaaacctctgggatacactaaaagtggtgctaagaggaaagttcatagcattaaatgcctacatcaaaaagtctgaaggagcacaaatagacaatctaaggtcacaccttacagaactggagaaacaataacgattcaaacccacgcccaacagaagaaaatacgtaacaaagatcagagcagaactaaatgaatttgaaacaaaaaatataaaaagataaataaaacaaaaagctcattttttgaaacgataaataaaattgatagaccgttagcaaaattaaccaagaaaagaagagagcaaatccaaataacctcattaagaaacaaaatgggagatattacaactgataccaaagaaatacaaaagattattcaaggctacaggaacacctttacatgcataaactggaaaacctagaggagatggatacatttctgaaaatatacaaccctcctagattaaaccaggaagatatagaatctctgaacaagcagtgagattgaaatggtaattttaaaattgccaccaaaaaaagaccaggaccacatggattcacagctgaattttatcagacattcaaggaagaattggtgccagtcctattgacactattccaaaagataaagaggggatcttccctaaatcaatctataaagccagtatcaccctaataccaaaaccagggaagaacatagcaaaaaaagaaaactacagaccagtattcttgatgaacataaatgcaaaaatcctcaacaaaatactagtgaactgaatccaacagcttatcaaaaagataatccaccattatcaagtgggtttcataccagggatgtaaggatggtttaacgtatgcaatctaaaaattcaatgcaattcttatcttaataccatattattctttacagaactagaaaaaacaatcctaaaattcatatggaacaaaacaagagcccactagccaaagcaagactaagcaaaaagaacaaatctggaggcatcacattacgtgacttcatactgtactataaacatagtataacataacatagtatcatataaacagaattaaaagcaaaaatcacatgatcatctcaatagatgcagaaaaagcatttgacaaaatccagcatttctttatgattaaaccctcagcaaaattgtcatagagggacataccttaacataataaaagccgtctatgacaaacccacagccaacattatactgaacagagaaaagttgaaaggattcccctgagaactggaacaagagaaggactcccagtttcaccacttctgttgaacatagtactggaagtcttagccagaacaatcaaacaagagaaagaaataaaggccatcaaaatagataaataggaagtcaaactgtcactgtttgctgaagatatgatcgtatacctagaaaaccctaaagactcacccaaagagctgctagaactgataaaataattcagcaaaatttcagcatacaaaattaatgtacacaaatctgtagctctggtatacatcaacagtgagaagctgaaaatcaaatgaagaactcaacccctttcacaatagctgcaaaaaaaaaaaaaaaacttagaaatgtacctaagaacatgaaacacttctacaaggaaagctacaaaacactgctgaaagaaatcatagacaacacaaacaaatggaaatacatcccatgctcgtggatgggtagaatcagtgttgtgaaaatgaccatactgccaaaggccatgtaaaaattcagtgcaattcccatcttaataccaccattattcttcacagaaccagaaaaaaaataaaaaaatcctaaaattcatatggaaccaaaacagagcccattagctaaagcaagactaaacaaaaagaacaaatctggaggcatcacattaggtgacttcaaactatactacaaggccatagtcacaaaaacagcatggtactgggataaaaataggcgcatagaccaatggaacagaatggagaacccagaaataagccaaatacttacaaccaactgatcttcaacaaagcaatgaaaacataaaatggggaaaggccaccctattcacaaatggtgctggcataattggcaagccacatgtagaagaatgaaactggatcctcatctcttccttaatcaaaaatcaactcgagatggatcaaagacttagatataagagctgaaaccataaagattctagaagataacatcagaaaaacctttctagacattggcttaggcaagtactttatgaccaagaacccaaaagcaaatgcaacaaaaataaaaataaatagatgggatttaattaaactaaaaagcttctgcacaggaaaagaaataatgagcagagttaacagacaacccacagagtgggagaaaatcttcatacatctgaaaaaggactaatatccagaatctaaaataattcaaatcagcaagaaagaaacaaacaaccccatcaaaaagtggcctaaggacatgaatagacaattctcaaaagaagatatacaaatggccaacaagcaaatggaaaaatgctcaacatcactaattatcagtgaaatgcaaactgaaaccacaacatgataccacctcactcctacaagaatggccataatcaaaaacataaaaaaaaaaatagatgttggtgtgggtttggtaaaaagggaacacttttacattgtaggtgggaatgtaaactagtgcaaccagtatggaaaaaagtgtggagattccttaaagaactaaaagtagatgtaccatttgatttagcaatccccctactacatatttacccagaggaaaagaagtcattacacaaaaaaaatacttgcacatgcctgtttatagcagcaaaattttcaattgcaaaaatatggaaccagcccaaatgcccaccaatcaatgagtagataaagaaaatgtggtatatatacgctgtggactacaactcagccataaaaaggaatgaaataatggcatttgcagcaatgccattgcaattgcaggatggaattggagactattattctaagtaactcaggaatggaaaaccaaacattgtatattctcatatgtgggagctaagctatgaggatgcaaaggcataagaattatacattggactttggggactcagggaaaaagggttggtggtggcaagaaataaaaggccacacactgagtacagcatatgctgctagggtcatgggtgcaccaaaatctcagaaatcatcattaaagaacttattcatgtaaccaaacaccatctgttaccccaaaacctactgaaattaaaaaaaattaaaaattaaagtaaaataaaatatttagccatttatttttcctgggaaattttaaacttcattatgatggattcttctaatgtacatttgatttattttatattttgagttggtaatatgtgcagttatttaaaaattcaagaacttcacagtgaaaaatactttctctttctttcctgtgacacagtcacccaagtttctccctagaaaagctattgtcaacattccctgtgtccagaggctgctcctgaatcccaaacgtatgtttatattttcactccaacagtggcaagtacccacccttctctaaatcttgtctttttttttcacttagcaatgtactttggagttcatttttttttttttttggaaaaaaatggtaattaaaaatttgtaattttaatggtaattaaaatcccaggctggagtgcagtggcgccagcttggctcactgcaacctccgcctccctggttcaagtgattctcctgccccaccctctcgagtagctggtaatacaggcatgtgccaccacgtccggctaactttttgtatttttagtagagacggggtttcattgtgttatccaggattgtctggatctcctgaccttgtgatctgcctgcctcagcctcccaaagtgcagggattacaggcatgagccactctgccaggcctggagttcattcttaagggtacaagaaaagctgtcacattacttttgatgaccatatagtattccattgaacatatgtacaatattttttatttaaatgttcaaacgtttccttacttacagagatctaggttgtttacaatctttatttattgtgaacaatataaaaatgaaaagtaaatgtctgtatcttttttctcattgatacaagcttatctacaagaaaatatataaactgtacttgctaggtaatatagtatatgcttatttaattttgataacttttgccaaattattttcctcataggttatcctaagtcacacccacactagccagtgtgaaaagtcctgtatcccaacaccttggccaatacaatggttatgaatctttttcctagctaatataataggtgaaaagtttaccacattgtagtcttaataataataagagaaatgtgagctaagattgaacatttttgatgtgcttagacctttaatacttcctgttcttgaactctcttgttcatattctttgcccattttttcaactgaattgggccttttaaaaattaattcccaagaactttatcacatgaaagttgatgtttgtaagttatttatcttgacttcattcatgatgtattttttttgccatttagattttttaaaataatgtcctttaaaaacttgaatggcaaaagagaaacataatgaatggtgatagacgtatttatcctttttaaaaatctgaatatctcatatatatataatgcccatactgagaatattaaaatgtaactgattttttctctagtaatttttattaaaaaatattaattttttgaagccatctagaatttattttagcattagttgtaagatggagaaaccaactttaatttaaatttttaaaatttcctgatggttaattagtcagttgttctactattgaataatacattctttgcatagaatccaaatgttacattttcttccattaaatcaccatgtatattttttattttcctgaaatttcaattgtcttaattgacttactagtcaaatcatgtgttattaatgtacatctttgataattagtattttacataatgtttgactatttgagggagtcattcccaccaccacccatcattcctcttcttttaaataatatttctggcttttttgcttatctattttacaataactttaaaatttatattttacctgccccctgcatatatgggcattttatgatttgtgcatccttaattcgaagtgagaggaacatatgattttctggaggaaactttcaactttgaatgcttgtgaccaaaggaaaactatgacatcatctggcagccatttcaaattatagccagatgttctaaaatggtttcttactaccccagaagtgtggctttaagtcacttccacttcacaggcattgctatcaattttctatctctcacaactcaaaatcttaaagacaaaaggtgttatatcatcttataactttctgaatttttacaggtgattttagctaagacaatccaaacatctggagatccctctccatttttctttgatgttaaacacatttttacagaagtaaatacagctctcttctgcactgacatagagaaaatactttttgctcaatatttcaaggacgactttaaaaatctattctaaaatataggtaaaaaagtagcatatgaaatttaaaacattatattaaaacaagatataattgcactataaaggttaaatctcatatttagcgctcacatgatatcactcaattttgtgaggcgtcttttgtaaagtatagtaggccattatgagtatttggttacataattcattttcacttaatgtagatagtattaatatattttgtgtggttcggttctatgaattttcaaagagcatgattcattcatgggtaatcagtaacccatagtccttgtatagtcattagaatatcctgtcttgatggttttctgtgaatatcaacgctctcagaagtatgccattgggactaagcctacatagatgtcagagattctctaaaatgacccagccaatactccctccacctttcatttctctggtattgtgacttactaagtgttttacaggaagaaattaaacattcaggaaagtgtgttaattttcaaaaagactccttttttgtgtctgccctcattttcttgctttttgagtcagttatcgggattttgaagtttaaaatgctgagatttttaaagtttcaatcgaaaagtattcatactttgacattgaataaaatttcccagttagcatgatctttaaaatacaaatttgatttacatttacatttcaaagcttttaattctttttggtgaatgtcccctgatactgcactctgcagacccattctatttgtttagctttggcttctcccctgccttgagtgttaaatttggtgggagatgggcaaggaaatcagagtgaaccctcacatctcagctctgatagaaggtgcacctattcctctataccagtatgtttaagaagtcttgtaacacatcttgcttttagaaatccatttatttttgtttttgtttttgttttttaaagaggttctcatacataagtggggtgaacaggtgaataacattgatttctttagaagacaggtattatgtaaatactgccttgtagaaatgcatttccatttcctgcattgatctcatcttaaagccttgcagtcaatcctattttttatgtgttgctgttttaatagaaattccatgttccacaatgaaagtaactgaccaaagatgttgaaatgatgtttaaaagcctcttatctatcatctttggaatttcaggatatcattaaaaaacaaaagcaacaaatgataaaaagaacaaacagtggtgtgctttagctgatattcattattcaaatagcttctcaatgtttttttcgtctatttttctttccttctagaaaattcctttttgaaagatggctttgaactcggaccagtctataaggaatagattttactgtttatcattaggaggagaggatttttttaccttacacatagtgtggttgaaccgatcattaagtgactaaaactctcctctatccctaaactttatcctattcaactaggaaaaccaagacaggacctcttcctcttgtagaacatcctgacagcgttcactaaaagctagtttgtgtatatctcagtagagatttccatcaacaaagcagtgacaatatctgccaaaggattttgcatttgtattgcaacttcatgagcataaaataaaaaaaacttgaattgccactatcatataatggttattcttatatgtaatcattattaccaacttatttatttttctaaaatcacattttattttttaatgaaatataatgaaaaatcttaatctccaaatttgttttttaaattatattgtagtttatcacatgtttttaagttaaccagaaacatctatgatcttgacctttaaatcatttattaaaataaaaacataggtgcctgggaccagaattcatttttataaaatcacaactgttcactatataacactatgatttctttttgtgtttctgatattttcctatctaaaagtgacatagggttaaaaaggagagaaagtggatgtagaacaatatccaaacattggttccctgcttcagtccataattgtcattcattttttattgcctcaattccagttatcaaaaggtaggtactaatccaaactgcatttcacctcctagcaaaggagttaaaatatgtcttattgttctccatgttctgtatgaagttcttactttgaaatgcagggcccttcattctttggcttaatcctctgaaactcactgaattttctagccttgtcatctaccaaaatgtgcacatattgttgtaccttgggctgtcttaaaaaaagacatcatgaactctggagccagactatctagatcagaatcccacctgtaccacttactagctgtatgacctggggcaagtgacttaacctctctttgactcagcattctcatctatataataagaacaattaaagtatctgacaggagaatcaaagcctggccaaatgaaacaggaaaagagggagcaaaaatgctgtttatttttctgcttaatcatttactccttcattaaataatcatttatacctcaacaacttccagttttaacaaaaatagatttgagtttacttaatcacagataaaataaaacatatggataaatggaaccaaagcaaagcaataaagaaaaatagtgagaaggaacattaaacttttggtagagcgtggacatgacatccaagttaagacctgaaatgaactataattgaaattccttgaaggaaaagctggccaggtgtggtggctctcacctttaatcccagcgctttgggaggccaagggggtggatcacttgaggtcaggagttcaagagcagtctggccaatgtggtgaaaccctgtctctactaaaaatacaaaaaattagctgggtgtgcacctataatcccagttacttgggaggctgaggcaggagaattgcttgaacccgggaggtggaggttgcagtgagcccagattgcaccactgcacttcagtctgggcaatggagtgagactccatctcaaaaaaaaaaagaaaaaggaaaagaaaaagaaaagcagaaagagaaacctagtaagttacataattcagcctaaaagttagaatgttagcttctggggaagttaagaccgtcataatttttttttccacttctgtatactaagaacctgaatgattcttagataacaatttggatttatttaatatttattaagtgaattatgaaatcagtgaataataaaaaagcatgtcacattttctattgctaaaaaagtaattttatataacatccatttctccaaataatatcctctctaatttaagatggataatgatgcctgatcttatttaagaaatgtattctattttgaagagcttaataaaaataattttgactcattataaacatggccaactccaactctcttttagccagttgtatctttaactaagctggtaatcagatgagaatcatgtgcacattgcattctatgaagcttagcttcactgatgtggcttacacgctgtttcagagatgtatggtcattctttggtcctttctagtgtatgtggaatcccgtttgatatagtttggatatttgtatcctccaaatctctagttgaaatgtaattcccattgctggaggtggagcttggtgggaggtgtttgggtcatggaagtggctctctcatgaatcgcttggtgctaccctaacaataataaatgagttctcactctaagttggcataaatctggttggttagaaggcatctgcctcctcactctcttgctcctattcttgccatgtgacgtgcctgcttccccttcgtcttctgccatgattgtaagtttcctgaggccctcaccagaagcagttgctagaactaggctggtgcagcctggaggaccttgagccaattaaacctcttttcttataaattgcccagcctcaggtatttctttacagtaatgcataaacaacctactacaccattggaccctgagattttgctgatggactgttcctactgaggcaattcctctcaattgttccttagctctctccccagggaagcatcttaaaaccacatgatggcggggcacggtggctcacgcctgtaatcccagcactttgggaggctgaggcaggtggatcatgaggtcaggagatcgagaccatcctggctaacatggtgaaaccccgtctctactaaaaatacaaaaaattagccaggcatggtggcgggcgcctgtagtcccagctactcgggaggctgaggcaggagaatggcgtgaacccgggaggctgagcttacagtgagctgagattgcgccactgcactccagcatgggcgacagagcaagactccatctcaaaaaataaacaaacaacaacaacaacaaaaacacatgatatgggccttgaatcatgaatgtaaatgggtgttcaggcacatgactttataacaatttgagactgtaagtgaatcatggacctatgaagcactactcgtctctgaagagatctttgactgccttgaatcctcaagtttaggagattcattttgtgaatgtacacatggtcatgtgcccggtacacagctatccacaggtgataaagagcaggacacagggcaaaacaatttgctaaagggttgggagaaataacctaataaattcaatttctttctcgcaggcctccctttaaaaagcatgtatcttatggtagcataactctatgcttcccattctcaactcatcagtactattttttgaagttgtaggttgttggttgacatgggcatttttaattttgttattaccagaccccatcagattccctaggcgtcatgtgtgttatcataggaaatacttctctacttgcctcttccattatgtcagctgttgtttgatggggattaggaaagggcacaagaaggaagctgaacaaaactgcacggctggtacctttctctgtcttttgtaagtgcttgttagcaatccaggatttcctgggaaaggacagaaatcacagatgtgtatatatgctctcacagaaagtggaagccagtaaccctgggaaattcgtgctcaactttggaagtgtatcagagatatactccacctctgaaaacctccaggctgagtatatatttaaaatgtatctttgcatttttcaggttaactacatacgtgactagcaagacaaaatacagcattattttcttttcatgatataactggataactaattgatttgtttactaattaatttccatttccccacaccagagcatcaactttatgaaatccagaatgcagttttgttcattgttatatctctagcctaaaactgtatatcacacataagctcaacaaatgtttgttgaattaattaattgataaatggtagtagaattagattctaatccataatacagaaatataaccttgagtagatttcttaaaatatcttagactcatctttctcctctgtaaactgggaggaaggagggaagagggacaacaagatgacttgtaaaaaggtccattccaattccagaattctatgcattgttagcaggaaggaatattaggctgacccatcaattcactgattaattgaaaaataggaattaatggaattttaccaaagggaattaaatggatttagtagctgcaatgtaccagcctattttgaataaaacacagttcctatgctggttgattccagaggggtaggaaatggatatgaacaaatcatataattctctatgatacaagaacaaaggatgaccagtgtataaggatacctcagaggtattgtgggttcagttccagactactgcaataaagcaaatatcacaagaaagtgaatctcaataatattttggtttcccagtgcatgtaaaagctatgtgtacaccatactgtagcgtattaagtgagcaatagcattgtgcctaaaaacatgtatattgggcttcaagtaatcctcctttctctgcctcccaaagtactgagattacaggcctgagccaccgtgcccacccccatgctccacttctaattctagttctcttgctatttttaccacatcttcagagacttccttcactgaagtcttgaaccctttaatgtcatccaggagtgtttaaacaccttcctccaaactcctgttaatatggacattttgatcttctctcataaatgacaaatgttattaatggcatctagaatgatgaattccttccagaagggtttaaatgtaattttccaagatctatcagaggaatcactatctatgacagctatagcattatgaaatatatttctaaaactataagacttgaaagtagaaattactcttgatccatgggctacagaatggatgttgtgttagcaggcctgaaaacaacattaatcttcttgtacatctccatcaatgctcttgggtgacccaggtgcataatcaatgagaagtaatattttgaaaggaatctttttttttttttttttggagatggagtcttgctctgtcacccaggctggagtgaaatggcatgatctcagctcactgcaacctccacctcctgggttcaagcgattctcctgcctcggcctccagagtagctgggactataggcacaccccaccacacctggctaattttttgtacttttaatagagatgaggtttcaccatgttgaccaggatggtctcgatctcctgacctcatgatctgcccgcctcagtcacccgaagtgctgggattacaggcgtgagccaccgagcccggccacaatggcttttacttagtcaccattccattagcccctaatgagacagtcagcctgtcctttgaagttttgaggccaggcattgtcttctcctctgtctgggaaagtcctagatggcatcttcttccaatataaggatacttcatctatattgaaaatctattgtttagtgtagccaccttcataaactatcttagctagatcttccagataacttgctgcagcttctgcatcagcacttgtttcttcactttgcagttttatgttatggaaacagcttctttccttaaacctcatgaaccagactctgctagcttccaactttttttctgcagctttctctcacctctcgtagccttcatagagttgaagagagttaagatcttgctctggactaagctttggcattaagaaatgtagctagtttgatcttctatccagaccactaaaactttctccagatcagcaataaggtggttttgctttcttatcattcatgtgttcactgcagttgcattttcaattttcatcaaggacttttcttttgcattcacagcttggctaactggtaaaaaggcctagctttcagactatcccgacttttgacatgccttccagactaagccgaattatttctggctaatatttgctagagggaagtgtatatttaaagctgtgagggtatttataatgaataatgataatattattccttctaggcataatagggatggtattaggtgtgatcgataggttaatactcccagaagtgatatagtaaatgctaatacaatgtttatgtaaatagagggcatttggtaggtatgggtatcataatctaatgagttgaaatcatttatttttgcttaaactacttaccaattcagctttcaggtttcaagtgaaagacacgcaattctttctttcacctgaacaacttagaggtcattgtagggttgttaattggcctaatttcaatattgttgtatctcaggaaatggtgaggcctgaggacaaagaaagagatggggaacatctggccaggaaaagagtcagaacatacgtttatcaattcagtttgctgtcttaaatgggtgctgttcatggtgccacaaaactattaacaatagtaacatcaaagaatatagatcatagattaccatcacagataaaataataataaagcttgaaatattgtgagaatgaccaaggtatgacacagaggaaggaaggaaggacagaagaaaagggaagggaagggaagggaagggaagggaagagaagggaagggaggggaagggaggggaagggaagggaggggaggggaggggaggggaggagaggggaggggagggaatggagaggaaggaggggaagaaaggaaagaaaaggagaaaaagagaaagggagaaagaaagagaaggagaaaggggtgacaaagtggcagggagaaaggaaggaaagaagaggcagaaggctgtgtcaaaattgtcctgaaatcagttttgtctcttcttttaatttattggcaaacaaaccaacacagcaactaactctatagcatatacagaatggaataggaggtgtttcctagaattggaaatgtgctaacactgttgttgttggcatgttatgcttttcaccaaagaatttagcaaaaattttaagaaggttaagttttatagaaccctcaccttagcctatttgaaactaagctgaccagatgacatagtgatgcaatttggtgtctatatccataataaccacatctgtcaaatgtgtattgtccgatattgttgcaacagtagaatttttgatgactctctggatttaattcatgcatcatttggatcttcgagatcattttatacacccaagttctttttgcaacatcaattgtaatgatttgtaccctctggtttttttttttttttttttgtaatcacaagggattgtacaatgtaatcttaatgttgaggatatgaagttattttttcttcaacctctttaaatattagcaactatttcacagatggtcttttcttaagcgatgtcattgatttaccagtgagagcagccaaatctcacttgggaaataatggtcaatgcctctcagtcatccataaatggagttgacctaatgctaaactaagctacaaggtaagagggccattgaagaaatttctaacacagatggtcaaatcaattcaaatattacacaatcctctatcttcctccaccaaatcatcaaagtttccaaactgtcaagcctttcacttttttctgagttgtctgagtgacaggatatgcttgagatttcccacatttcaaaacttgtctttaaatgcaatttcttcatgcatgatgaataatcaaatatttacacctaataaacattccctacaacttttttttagcacaacaaaatacactatggtaatactattctccttaatgccaatggcacaacaacaaaaacgaaatcctggaaggaaagacttttactccaagtcaatttaaaacttccttattcattttaaatatttcactgcattaatttttcaaagcaacaaaacaaatattcatcaagtgaaactaagcatgacccccctcagataggtacatctgttgctttcctgctgtatccctgaataattcattttaatacatttaaagtatacacttcattaaaacaagctacagtcatttacatataaaatgtacattgatgaaaacaaaaatgaaagctgttagaaagctgatcctaaaattttgttactccttgtgatttatatctagctgtctctgtctatttcctcctacaatgatggtataaaggcatctccacatcctctggcccattgggagctttagttatatcagcaaataggtgggaaaagttagctggtatattttgatactcttttcccacagcctttgttcatcatggacaacttcatcaagatttatcgtcactgtttgtccattttagctccctctgctcacatcacataatagatgtaccatgtatactgaatggcatttaggaatcaaagccaacacagagaatactaatcagttttaacttcttgaaaattaatcaatttgtgctggtctgatacagtgcagggaaaaatattcagttttattcactccctgcccttttgaactctgttaactgattatctaaatggttttcagaaaggccttaattttttttttttaccattatagcatttccccctcctccatttttatggttatgtcttaagtcaggaagggagaggagggaaggggtggagacaaagggagggatgagaggaaagagtttagcagttaaagacacattattaagtattccctttaaataaacttgctttctataaatatgttattggaaaaaagtattcatatgtcttacagataaagtttgaatgacatagaatcaaatataaaataatttatgagatattttctacgtaatactttatcaaaatatttgacaattgtcactattgctacttattagaaaaaaggctatacatcataaaatcatcaaatttcaaaggttatgtacaagaactatgctattacacatatttttatattaataactaatcatagcaatgcaattttaaaactctgtggtatttttctttctgaggatccagaacaatttctgtttattcaatagtgcactttttttggaaaagtaaagtgtaaaaacaaagcaaaacaaaaccttttcttttaatggtgactggctgacatcttactttatagaaactagtctctgagaacacacattttttttccatatcacagtattttgctcttttataggatttctcaaattttcccagttcatgtgacccttttgtcaggagaaaaattacctgaaactacatacctagtatctcactgcttgcttccccacctgttcccttccctcacaaggacatgagctcaagtgtgcatgcgtgcacacacgcatgcacacacacacacacacacacctgtaaacggaatgaataaagtgggtcataatagttgtactactgaaagtcagtgtaagttaatatgctactataggctagtatgaagaagttttacattatttatttaaagccatatcagaagccaaaactgtaatgtttcttatgttgacacagcaatgggggtcagttccaggttactaggagactccattgtggtttaactatgttactagtaccaaacttgaagaatcattgctttttttctttttttttttttgagacaaagtcttgctctgttgcccaggctggaatgcagtggtgtgatctctgctcactgcaacctctgcctcctgggctcaagcgattctcctgcctcagcctcctgagtagctagggttacaggcacccaccaccacacctaactaatttttgtatttttagtagagatggcatttcaccatattggccaggctggtctcgaactcctgccctcaaatgatctgcccgcctcggcctcccaaagtgctgggattacaggcatgagcacctgaccagaatcattcctcttaatcttagcttcctggcttgagaaggaaaatccaaatatttcatttattttttcttcctcatttatgagctaagtttttctctgccataaaaggaaaaacattctaaggcaaattccttctcactgtattttttttatgacacacagtaaaatatggtcgccttctagaaatttctgctctttttctcatgtcttacaaagcataagtgggaagattctaggccttaaagactggcctgggttcaaattataccacttctctttaccagctctttcatcttaatttcctcatccataaaatcaggccattcatacctatattttggggttgttgtgagaattacagcatatttgtatattcaataaatgggagctgctatcatatttattgacttttaggattaaattgtccacagcttccaacatctctttttcttcctttgaaactcccaaactatcatttgagagaccatatgtattttggatatttcacatcatgaatgtttagtcctggaaagtttgcttattttctctggtgtttttgtacctgtaacactcttgctctactgttaaaacctgacagcaagcctgagtataaaccaggagcccttaggaatatcagattaaggatcagcccaggaatctactttatgggctatttgctcacgtactgctatttatctatctgaccgggcagtgacaaagtcaataccaccaaccacagcctttcttctacagattcttagaaggctttctactgttctcgtattatatgaacagcaaagttgacctttagtccaagggtatggataaatatatctattgtgtgtataacataaccccagttctcacagcagaaagaaaaatatgcccgattatttgattgttttgatagtggtgttttaaaagttctagactagcacaatacttactgaaatataacccatgatcattttaacatgcatcgtccaaagaacattgtttgctcctgacaaatagcatgtgcccacgtgtcaatgaaataaagcaatagttattttagcttatatgcccactcaatttgtttatgccctatttataacatgctacttattttacttttagtctaaagccttgcatgtcaatatctagttagaagtaagtttggctgcgggtaaaattctgacagagaagagggacaggtgattggtggcctagtagagttagggcagtctgatataaatgaaaaaattaactagcatccggtgtagttgtaacatttataaaatgggagtgtgtatattcatacattttatccttattataagaccctttctgcccttaagatgcagcactctgaatggtgaatactaaaaacacagactcttgatcgaggtgagggagttggaagaggcaggacaagaaaggacgttgactttctgaaaatgggacgaacggctttatctgaaagccctagtactatagctctctgatgggatcctatttgatactcacagcccgttaaggcaaaagagtaatgtccttcttgggcaaatgaagaagctgaggctcagggagaataaatgacatagccaagatcttggcaaatccctttcccttttcactagttatatggaatcagaaaacttaagttttagttttattctgccactttcttagggacttcaaatcagtattttcacctgcataatgtatgataataacccgcggctatgcttatatttcctgggttattttttagattgaaattaagtggtgactctgaagatgcttcatgaaaatttcaaagtactgaataaatataaaacattatctaaatggcaaaatagaatacccagcttctgcccatccccatcacagcataatataaatagtttctattaagaggagatgtgtggacaaaggggtgttaaagacaaaagctaaaattcattggaatatctatcacctaccttaatatagtcacagtttgcaaactggttgtctttagtgtttaatagaatagagccaaaagatatattttatcaacacacattttatatatgtgtaatataacactatatattatatgtatactgttatatgtaatataacattagatatgtaaaatgtatgcatataatgtgtgatgaaatatatagacacacatacacacacacatttgaacactctcaagctacagaaaaattgaaagtgaagaataagaaacatatttttaaatcacctgagagcaagttactggtatggtatattctcaagaaactgcaattattgtaattattgtcaaatgagtaattataaagaatttaatcacatttaatttggcaatattttatgcatccagagtgcaaagtaggctatttcattcttctatctgtatttttttctaaactgcttctgatattttataaaaatcatacaaaatcattagagaacacctaatccaaatccagcatcacagataaggaaatttataccaagttaagtcattttccctggactaccaggtttcatgtaaatcactttatacaagcagatttgacaaaacttggtattttaactgctgctctcaaaaaaatgtaagactgaaattatttgtgttctttttcttcaaagtggtctaggcatattcatgtttgctataaaactaaaagaaaaaaatgctgacaaatgaaatatatacataaatgtcagtgtagaagccattggtttagaagatcatttttaattgattagggaaattaacagaggaaaacagaatcacaaaataggcccaaataatttataattagctctataatatatagacttatattctatttgctttaatgttttttgaatacatgccaagtaactcagaggtaccttgagcttggcaaatggcaaaaaagaaccctttatgtattttaagatggataacagaggctaaaaattatatacactatgtgccaatcattgagattcaactctacttttttaatactcttaagaaatgataaaatctgattttatgacacaaagcctatacttctaacactctgagctctgtatgtttttaaaaaatgctgccatatcttactatttatttctggaaaccagaaataggctagtcgttcttggaaatttcactctatttctaatttcttccttgtcaaaaagtcagtttgttcacattcagagcataaatgaaacctcaatttgcataatgccttaaataaatgtcaaaatgaatctgtgattttttctgatgtataaataaagatactagttgctttaaacggtttaatcaataacacagcttaccacagtttaccatgctttctgggcaaagaatctgcgtgtacgtgtgtgtgtgtgtgtgtgtgtgtgtgtgtgtgtgtggcaaaattctgttgaaattcccagtgatatgtactgaatgagtttaattccctattctgaaactactactactagtattttttaaattatctgttctgtgtttgaataaggttagatttctaagtttaatcatgcattgcataacaacctcttggttaatgatggactgtgtatatgatggcggtctcatcgtattataatggagctgaaacatttctattgtctactaacactgaagtcatcctaatgtcctagcacaatgctctgcttacatgttattggtgatgctgggtaaacaaatctactgcacttccagtcatataaaagtatagcaatacaattatgtacagtccataatacttgatcatgataataaatgactgcattaatggtttatatattttctatactatactttttatggttatttgagagtgtactctttgtacttatagaataaaaagtaattgtaaatagcctcaggcaagtctttcaggaagtatttcagaagaagtcattgttatcataggagatgacagctctgtgtatgttactggccctgaagatcttccagttggacaagacgtggagagcaaagacagtaatgttgatgatcctgaccctgtgtaggcctagggtaatatgcatatttgtgtcttagtttttaacagaaaagtttaaacagtataaatactaattttaaaaatagaaaaccacttatggaataaggatattaagaaaatttttttgtacagctgtacaatgtgtttgtgttttaagctaaatgtgattactaaagagtcaaaatttaaaaagattaagtttataaactaaaaaagttacagtgagctaagtttattgttaaagagagaaaaatatgttttataaattaaatgcagcctaagtatacagtagtatacagtaatgttctaagccttcacattcactcaccacgcactcactgactaacctggaacaactttcagttttgcaagctgcattcctggtaagtaccctatacaggggtgccatttttaatactttgtaacatatttttgctgtactgttttgtgttttccacactaatttttgttcaaaatatttgagaagaatgaaaagtagcttgttctttttcattccagagcataattgatttttaaaaacctatttgatgcatgaaccatatttcccttctcagagaactcgaaacctacaggtaaaacaagaacctcagaaaaagaacccagacaaaaagtaaaaatagtttaaaagaacagaaatcattttgaccactcatttatttattattgtttttatgtcactatgtcactgtgcaagtatttcaaatcagctaaatgacaaaatgcttcagctatgagctctccccttgattgtctaagccaatgaaaacacagacacaggtagcctgatctgataatctaaaagttaagcacaaaactgtttttgaaatgtaccatattttgtgcaatattgtgctgcaaatttaggattattttgcacttcctattgaccatatcaactgacagagttttgatggatagtgaagaaagccagcacaatttttaaatctgcttgggtaagcctcacactcaaagacgagcacagagtctacaagtaaaatgtaaattttatgtagcaaagaaaactaggaagataaaggttgctttagtctcttcactatgtctgttcatagaatccggcctattatatcatggctcatttataattattacaaggtgatggcaggtttctggactgtggtaaattctctctcactttattcaggtatgtcatgaattctatttcttacagcacctactgaatattattcgttgagtctggaatgttgatcaaggagctatgcttttaacgtctattacttttcaccaattaactatttgcagttgctttttcaaaaaggattgggattcttttgccatatagtggcaatggattttttccaatattataaacgtctgagtcctgaacatctgtatttactttcaaatgtcacaactcatctactttgactatatgcattattaatctgtaagatggttgcctgtgaaaatatatgcttcaatttacaaatagacaattaagcaggaaatcttttagaaatagagaaaaaacatgacggggctgtaacaggttcaaaggaaaaagaaaacaagtgcaaatacctgtaacaaaatagtaagaacataaaactgtcagtatcaagattgcttttcacattgcaacatgacaaaaatgtcactgtctcactaactaagcaactgtctttttcttctctgcataaatctagcctctaagctttcccaaatctttttcagaatgaagcagaaattctcatacattaataaacaaaataaaatcaaacattgtatatgattactgccaagacagaacatcttattggaagacgattttgcactgtgtattaaaatttaaaatatgcataacctattgacccaacaatcttatatgcagggttctgtcccacagaaataatagcatgcatacatacagatatttgtacaaagatattcactgcagtattgttagtaatataaaaaactggtattataactcaagtgtctttcaatgagcaaatgatttttaaaacttttcagtgtacaatgcagtactacacagacatttaaaaagaaatgagatggcaatatggtgacttggaaagatgttccacagcacattgttatgtaaaacaagcaagtgtagatcatgagatgaagctcaatctcattgtaaaaataaaataccaaaaaaataaaaaagtactatgtgaaggggtgtgtgtgtgtgtgtgtgcaatatctaactatatttgggcaatggaaaaatagtaatttcatcttctaaattctaattgttttcttcctcttttttcctccagcttaacctgaaatttcaattttttcccttcataagtgaaattgtctttgtatatgcaaaaccaagcacagttttctaatttaatgttaacaaaatttgagtcaaagctgtggtaacccacataccacattgattgggtggattacttctccaacaccaggtttactgtagtaatccatggtttatggcatttaactctcattaaagcacagttaacaggtacccattcagttatcaccatgcttcaggatcacacgctacttgggaccatttttgttgttcatttttttttgttagctatgtcagcagataatattcgtatttcaatacctctgtagctgagcatcaaagctgcataacttctacagcctttctccttcctgctatttgctcactgaccttttacaaatttaattatttatacccaatttggcttcttctctttttctttttgcctattaatgtatctaatgtagaattgatattgtgaaccacacaatggaatgtgctgtaggaaatctctcaccttctaaagccaagtgacaaatgaaaaggaaaatgccaaaggattttgcaatttgaaacagagtgctaaaataaggatgcattgctgaggttatggtgtaacacattcatttcctccctggcgggaagaattttacacaatacctggatcagatcttctgatcagatatttagtaaagcacccaagaatgctactgatttaatccaacatcactctaagaatgggctaaataatttaacgtctgggtaatttaacgcctggttaaactcttaaaacattactatatgcttcatcctgtcacctgcttgattatcacttatacttgttcaattgttttaagaattataaattataaagagacaaaagaataggaaaagccttagaaatgcgtaggatctgtccattggataccatggcttgaaaagaattataatgataatagcaatcctgatattttaataaagtttagacttactttaaaagatattgtaggaacttctactgcattatgttcaattaaggacattaaggaaaaacagtcagtgaggaaacattgatccaaaatgtaatttgtcacagtgatggaaaagacatctaaatgtatattctccttatttttccttaaatatgaaattatccaaatatctagttagtactgatttgcgtttatttcataacagtcaatggagaaaacaaaataaaacttaaatcacaaaagattgttgtgatctcagattttaagagtttaatgacatgttataagaaattaataatttatctaaaaatcctttttcgaaagttcattggagaatttcattcttgttattttgctgtccttattataataaggactacaactacatagaaatgatttgaagtgctagttatgttttcattgacagcactatgatcagtgggaaaaaaaaaaaaagatcctgttaaaatacctaagtcttacttttgtttctttaatcatgggcaccctttatgtgtgtgcatgttaaaccagattagcatttgcgcatgcacatgtatgtatatctttttattttaggtgagacaataaatcactgatatattagtaacggggccttcaactatgtcaatacttctgccaatgccaattttcattactaatattaaattttatcatatatttgattgataaatgtttgttttttgtttgccttaatagaaggcaaacagtttatttcagagcttacatcttttgctcttgcaaggctgtcactatcttctcacagatttttttttaggaattaggagaaagtacctgtttctgagcaatcctctcaaaagtctgatgactatgatgattaacagtacagactgatatttcctgtgaaggcagcagtttaggccgaaatgctttctaatgtatgaagaaaataactttcagtttaggaattttagaggaaggaaaaaaatcacttaagcagcatctgtttcaagtaaaaattctgttgctaccaccccaccatcatggtccttaaattttcttttcattgattagatgttttcaaattttgttttacttcattttactattatattgatccggtgttttaaggaatttgcttgcattcttatcaaggaagcatcgttttcaatttaaataggtcattatggttagaaatctaaagaaatagcatagttcattatagtatacgctttgttaatagaagtaattattttcatccttattataatttgacacaatgtttcctttaaaaaacagtgatcttagaaaatactttaggtggataagaacaagagacatgatgagtaatatctaattagaggtaggtgaccttttaagctctaacaacattctctacatctccagttataaatttttatttctaacttaagaaattaaactaattatgtattatggagggaatattagatccttatatgtcagtgcagcttatttctaattaatggatggttgaaatcttcaaactaccttggacctatttggcatttgaggaatctcctttcagatgacatttcaaatgcacatataaacacacgtacacatatgcatatgtgtgcatagaattgatattgtgaaccacacaatggaatgtgctgtaggaaatctctcaccttctaaagccaagtgacaaatgaaaaggaaaatgccaaaggattttgcaatttgaaacagagtgctaaaataaggatgcattgatgaggttatggtgtaacacattcatggtgtaacacatgtatacatatatgtgtatgtgtgtttccatacatttttattctaagacaaataccatagtaataattaaagtaattatatttctcttaacactcttgaaagcttttttccaagtaacaggttcatgatatactgagctattttttgttacattttgtttttacaacatactaatattgatttatttgttagacaccaatagaaaacgcaccaaagtaataacaaagtctctcctagtagagaagcctattacttacttttgatgtatgtatattttcccaaactcatttctttggtaatgaacattgtctccataaaattgcattatcgaatagtttgtggaggactactgttgtggcatctgatcccagcataattctttctctcttttaagtctaaatttaagtctaaatcctgtggtactggtgttggggtaaaaaagaaggaagaaaggaaaatattttcagtccctgggaacatgagggcatttttttctctctcaggtggtgtaatcttcaggtaatcgctgaagactggggctctccttggggctctctagtgtggtcttttggagctgctccacttcacagttccatgacctgcaagagtcatctccagatccacctgtactggctcagctaccatcctggggcacgcctggaagcccacacggcctctggcagctgtccagtaagcagccttcttaactgctgtacagcaggacagtctagactggctctcttctgtgatgctcactacatttattctacaaatattttgaacaccttctataagctgggttctattctaggttcttgagattcattagtgcaaagccacaaaaaacccttgctctcatggagtctacattctaaggtctcataggaaacacatgtaactttaccatgctgaagagaaggcatgaggctgcttcaaaacttgttccctctcccccattattccctccagtttttttctctcctgctaaattatacattgctcagataatcaaatgcccacactaagcagatgtccaactagtgattcagatctctgtgtctgcttctcaaaggtacccctaaatcttttgtccattaggataaagatgagtgacctcaaaaatgttctttttttctcacttccccagacttcctgcattgatttggagttaggttgaggagctaaccatggttgctggtgattgctgagggtatgctctgccgtttcttaggaagttgtggaagatattggtctttttgtgaatatgtatgacactattcatttcctccccagatttgggctctacatgtcaatccctgtggaattgaaaaagtcatgatactttgttgtaagtccatatattatgatagaaatagacataagatgttaaagtgggacttcttaaagtggggtttcaagttccactgagatattgacaggacagttaggatccaaagtgagtgtgagtcagatgtcctcccctccctaacatgtggaattacagtgaaaattgttccaagaatgtgataaaatttttggatacaagccccttagataaattaaaaatataagaataggtcatagagaaaagagaagggagggattggttaaaagatatcttgggagagagccattaccctgctacaaatcgttcccctcccaccacctcccctcctacctttgaggaaaggcttagtgggaaagttttaaagagaccgtcattgagtgctttgatatgtttgttctcctgttggaagattctaggtattggtacttgacttagattcaaaaaagctaaaagcaccggtgaactaagatctaacttgctctgcccagtttcccaaaatctagagggtcaggtaagagctgaccaactgttttggttgcaaaagcaggagattgctgctgtgttgggatccagtctgcccatctaaaacttggaatggaaggcatatttaaagctaggttagattcaaaggtttgactattacttggaatttgcatttgaagtattaagatggaaaatagttttattgccaaaagtgagaaagagtttttcttttttctgagagtaatcaggaaagtctagagcatgtatttgccgatgccttctgggtgatggaaagacgatgtctcctacttcatgaataaagttcaatgagatggtagaacatataaataaattgcattgtcattatactttgcttattgatttttcagcttactaatcatatgtgcatctgtgtatgcatatcacagatgtacaacgcacacacatatgcatatataaaatattatatattatatattgctgtagtacctgttattttcatccagtagtgtatcatgaacttctttacataaatatatgcattttaatgtttcatttgtcatgatatttaactaatacccttttattagacataaatgatgtttccggttttctatattaagaataaggctgtgagaaacatacctgtggctacaccttttcataggcccttaactaattgcttaggataaatttcttaaggccattctttttttcaatattttatgggtcatcatacatgcctaagtcataatgtggtaaatattttacaaccaatcctggaacattttattcatataaaaatagcatttccataagattcttggcaaaatagctccaaaaaggcatgagttaggatgttttactaagaaagtactgatgcctgataaaactatgatgtgctgtacagagcttcaaaattggtatctcttttggcttaggattgacttggcgatgcgggctcttttttggttccatatgaactttaaagtagttttttccaattctgtgaagaaagtcattggtagcttgatggggatggcattgcatctgtaaattaccttgggcagtatggccattttcacgatattgattcttcctacccatgagcatggaatgttcttccatttgtttctatcctcttttttttcgttgagccgtggtttgtagttctccttgaagaggtccttcacatcccttataagttggattcctaggtattttactctctttgaagcaattgtgaatgggagttcactcatgatttggctctctgtttgtctgttgttggtgtataagaatgcttgtgatttttgtacattgattttgtatcctgagactttgctgaatttgcttatccgcttaaggagattttgggctgagacaatggggttttctagatatacaatcatgtcgtctgcaaacagggacaatttgacttcctcttttcctaattgaataccctttatttccttctcctgcctaattgccctggccagaacttccaacattatgttgaataggagtggtgagagagggcatccctgtcttgtgccagttttcaaagggaatgcttccagtttttgtccattcagtatgataatggctgtgggtttgtcatagatagctcttattattttgagatacatcccatcaatacctaatttattgagagtttttagcatgaagggctgttgaattttgtcaaaggccttttctgcatctattgagataatcatgtggtttttgtctttggttctgtttatatgctggattacatttattgatttgcgtgtattgaaccagccttgcatcccagggatgaagcccactcgatcatggtggataagccttttgatgtgctgctggattcggtttcccagtattttattgaggatttttgcatcgatgttcatcaaggatattggtctaaaattctcttttttggttgtgtctctgccaggctttggtatcaggatgatgctggcctcataaaatgagttagggaggattccctctttttctattgattgaaatagtttcagaaggaatggtaccagttcctccttgtacctctggtagaattcggctgtgaatccatctggtcctggactctttttggttggtaagctactgattattgccacaatttcagctcctgttattggtctattcagagattcaacttcttcctggtttagtcttgggagagtgtatgtgttgaggaatttatccacgtgcacattgtgcacatgtaccctaaaacttaaagtataataataataaatttaaaaaaaattggtatctcattttccatcttttatggaccactttctagggaacagtaagagcctggaaaataactaatgctaatttaggaagacagatatttaacacatggccctctcatctgctcttccttgccatatataaagttacagaatgagtgtttccttgaaaaatctaagaggatgcatctcttggaggaactgatgtttggaaaaagacatcctgaggaggaggggaacaacaccactgtaatgacaaagaagtctatccaggcacaattgattgaacattagcttaccttcattttctttctccctaacacactctgaagggacctggtgtctcatcttcaactgcagcacaagataagagcacatttagttgccactttactttagatgcaggaaccagcattgaccctggtcatttaagatcattcctacatttctaggtttcttatctgcactcgagcttccatgcacacccaaaaccttagatatcacccatgtcaaataccctgcagcaattattatttatagtcacctcttttagaacttcgaagacttaaaaccatagttatatctcattttattttctcttagctttcacatttcaccctaggaaacaatatactataatgtttaagagtatgggctctggagtaacatctggttagaagttgaaggcaatccctctatacctcagtttgttcttttttataatagggttaaaattaaaattaggaacagggggttgtcaacaagtgggtaaagaaaatgtggtatatatacaccatggaataatactcagtcataaaaaggaatgaaataatgtcttttgcagcaactcgaatgcagctggaggcgattattctaagtgaagtaactcaggaatggaaaaccaaatatcctttgttctcacttataagtgggagctaagctatgaggatgcaaaggcataaaaatgatataatggacttcgaggactcaaggagggagaagggtgggagggggtaagggataaaagactacacattgggtatagtgtacactgcttgggtgatgggtgcaccaaaatctcagaaatcaccactgaagaacttatccatgtaaccgaaaagcacctgtactccaaaaactattgaaataaaaataaaaaggaaaaaaaaaagaagagagggttatgagtattgaattgagtagtatattagctgttactgtagcaattattggctacttgccatatctcagtaaacattaatttttagtaatttcatagtccagtttggtggatgtatagggagtatggattctaattcacacctacatgctgaaattcagacctttctgacatatggtttgacctctttaagggcctctcagtcttttactggaccctcttctttccagttaacagacaaaggaagagacaaaacacagaagactgcccgattagcaaagccaaaaagtcatgtgcatccccctgtgcgcgcacacacagacacacacagacacacacagacacacacacacacacacacacacacacacacacacacatttcactggacagacctccatcatatgacccactcccctacatgcaggtgagctgggaaatgtaatctggttgtatgcccaagagaaacacaacacagatgttggtgaacatttcagcaagcctctgctgttattatcatttggatataaaaccaactttttttttgttaattggcacaacctctaagcattcttcctttgattgttatttgctctgttgaagttcaatgcagccaagcccagaaatcaaaggttcttctggtgcttagaaaccctttaatataaatatattattatcgaggcttataatgtgaagttctttacatttttgcataaaaagtgacccatagaaaatagtcattttcaaacacagaaaacttttgtgagtcaaaacagttggcacagagtacttaagacatgcttgatcccaactggcacctaagtagataaaaacaaataggttgggtgtggtggctcacgactgtaattccagcactttgggagacccaggagggtggatcacgaggtcaggagttcgagaccagcctggccaacatggtgataccccgtctctactaaagatacaaaaaattagccgggcatggtggtgcacacccgtaatcccagctacatgggaggctgaggcaagagaatcgcttgaaccctggaggcagaggttgccgtgagccgagatcgaaccactgcactccagcctggatgacagaaggagactccgtctcaaaaaataaataaggaaaaaagtatatataaaatgcctctaattagttatctgttattctttctaaaaattaaaatgggttgcatttccaaattttcttttctttttttttttttgaggcaaagtctcactctgtcacccaggctggagtgcaatggcacaatcttggctcactgcaaactcctctcactgcaaccaccaccacctgggttcaagcgattctcctgtctcagtgtcccgagtaactgggattacaggcgtccaccaccacgcctggctaattttttgtatttttaatagagacaggtttttaccatgttggccaggctgatctcaaactcctgacctcaggtgatctgctcgcctcagcctcccaaagtgctgggatttcaggcatgagccactgcacacagccacatttccaaattttctaaaggcacattttgaaagacataaattgaatttagtaattgcatgttttcttaaaatttgattatttctgattgaatctgaaagtagaagtcaacatgcatttgggaaagaaaatatcagaaaaaggaaatgcttttgctcagcatgcttaatatagaaagtaggtttattaatacaatgtcaccttccattttggaagattatattactagtggaaactttgcctttgtgggctgatagggaaaaatgataaaccatttgaaataatttttgaaaagaaatagaatattataaaaaaaacaagcagaaggagccattgtagtttcaacagtctacttcagtagcccttctacagttaatctattattgaaccaccaaatataatcatgcattcattcatttgttccatcgtttattgaagattgattgccacctgctatatgctatactctatgttaggtcagatgtttttataacaaattgtccttaacactatgttcaatgtttcagcaatcttctaatttagatttacatatacaaagatatataaatgaatataggtataatgagaaagatatataattaaccagtgttacattcgacattgtgttgtctaaatgacacatgagaagcttatttaatattcaaattctatatttttcactgaaaatcttaacttcaatcaataactagtaaatgacctaagaagttgtgtaacttttctcttctactgacagtataccgcattgttttttctcctttcatttagttactattttaaaatttttcttctttaataagtaaaatacaattctattttttttcaaaactgtgagacgatgtttttttacattttttgtccatgtgtgtattttttctattagttctcaataatttatataatttttttagttgtcgtttgatattgcttgaccccactgagagaatttctcaataattcaggcttgatacattgttatgaacaatgtctttataaaatgttttattgttgattatgataatctttaaacacaaatgttgtgaaaagttttatatatttatgaatactataaaacttccaatgcgaccttgatttcctccacggagactgaattgggataagaaaaacacttatttgctatgcaccatttattagtcaaccaacataccataactattggttaatttcttcaagcatcccattttattagtaaaataataatcagtatgccttttatttacttcatgtccctgaaaatatataatgtgactccttatttggcctaatgttgaataagcataaattagttatgttgaactcagtaattcaatgaaagttattatctccatggtagctgcttttgcctttctcaaaagcatgaatgctaagttttactatgaaaacccacataactaaaatgcaaagaagtggactctaaaattgcatgaaatagttcttaaaaagtagttttctagacccaggaaattttagtaaaattaagaaaaacaatacattccattgccacccaacaagataaaaaagatgtcagggacttttattatgttctagactcatgatgttaagtgaaacatcaagtgttctattcttttcatccgtcaacagaggtagccaactactctcctgaagtagtgtgtatcctgcccttgcaggttgttatttcattccatatccatagccgtgtattacagaagtctgcaaacttttacttaaagggccaactagtaaatattttaggttttgtgggtcataacctctctatgacagctactcaactcttctctggtggcaataaaaagcagccataaacaaggtgtaaataaatagaggtggctgtattccaagaaaactttatttacataaacagataacagaccagatttggaccacaagccatagtttaccaattcttcatgtgttgtattagcaagggtatttttaaattttttaaatagcatcaaaatgtattttagcaaatttttaattgaatatcatggttttgagatttacagatggatctagcctcttcatttcacatgctatgtcaaatcatttatttatctaatcttttaattatgggcagttatttaatcccccattttttcacagttatcagcaatgcagcaatggttgttcttcaacttctctttctgtgtatatatgcaaaagattctctgtggtactgtattgactgacattcagggtacttatcagattttctatgtctaaattagcaggctcaaaagacattttctagtatatgaaaatcaaggatagctgagatcagctaacttttttggtgaatatagactgaattaaagtgtcgaagccactgtttttataatctactccttatataaaacattaagtgaggccaggtgcagtggcccatttctgtaaacccagcactttggaaggccagtgcaggtggatcacttgagtccaggagtttgaggcctgcctggccaacatggcgataccctgtctctactaaaaatacaaaaattagctgggtgtggtggtgcatgcctgtagtcccagctactcaggatgctgagacatcgcttgaacctgggaggtggagattgcaatgagctgagatcgagacactgcactgcagcctgggtaacagagtgagacttcttctcaaaaaaaaaaaaaaaaaaaaaaaaaaaaaaaaaaaaaaaaaaaaaaaaaaaaaattaggtggcagaaatggtaaatttaaatactatgatctatttatttaactgaaatgttgccaaaaaatagactttatttttgaaggtgacaattgaatcctttctgattgtaaaacacaggctttttctattagaggattgatagatttgatctattaattagatcaaatcctctattagaggattgaatctatttgatagattccatgttaatttttctggtacttcaatcaaatgccattttatatgctttaactttgtttttattttcctcttgcactcaaaccagctaattcaaaggatagtgttcattttattcaaacttagctatttataaactcagaatacaagtatccccttttgccctaagatattttctgtcactaattaggttttgctttgcaagattatatcattcaaagtccttttcctgttactcaggtaaactgtcattggatagacagttcaaagtgttactttgtaaactaattaatgcacgtggtgctacaaaattccaagaatacaagaaagtccacaataaaaagtaattctccctgggcatggtagcaggtgcctaaaacccagctactccagagaccagagactgaggtggtgggaggattgcttgagcccagaagattgcgaccaacctgggcaacaaagcaagatcccgtctcaataaacaaaccaaccttgctccagtttccctcctgggaagcaaccattgttatcagattcttcaaccctctactagagatactgattgcctagaatggtcctgttttatgactggaatacactggcttcctatagaagtgcaaatgtgaatccaagttcatatatccccttgctgtttttctgcccaaatggaattcattatccaaacagccaagtatacatatctgtcaatatgatacatttttagagtaagttttcatataagcatccagatacaatttgatttttcttttatttatctaaaattttgcttgggttatgaagtttcttgatttattttctacaactttccctactttccattgtcccagcattttgtatttagctctttaattcataatcatggactctatcttgagtaagctcctggacctcctgattattttagtcttatttcaggcttatttctacacctggaaatagtctacaatgctactggacaggaatcagggttttttacatgactcccaaaacaaagtgggacagtagtcacttaatactgagttatacaagcaaagctgacaagcataggcttataaagaaaccatataaaattaggcaccatttctgccttccactaactcatgtttttgcaatcacaaactaagcaaactacctgtgaggaactacaacactttttatattatgaagccagaatattggaatggtttcctatacaattattctctggaaagtacaacgaataattccaggagatctgaatcataggaactttttaatatttaagaagccgaaatgtaggctaacaaccaagtctcattctaggtttttgatatcagagtaccagaagaaaatatgttttcagaatatcattaagttcctgcctttgtttctttgtgcttgcttctagccacatcagattctgatggaaagtgtatccattttttctttctgtcattagaaaacagaaatctgaaaagaagtgaccaggaataaaatacatctggctcttcttctcaaaattcaactaagtcactaattcctagggagcattattttttcatcatatgttcattaattgggtcattacttcaaactcaaatatatgattttaatttttcaaactgcacaaggatggtaatcctaaaacactgagctaaagctttcttgtgtgcttttcatcacagtggcaggtgcttctctttttttcacatttgctccaacacacttcatccttcagaacactctgtgtcattcaccacttcctgagtctgagtgtgtgactgcaagtatttgagaactttatttctcacttccttcagaccagtgaatgcctaattttaaacagactatttctaccagtttcccagtttaatctctgttgccatgattaagtagtccaaaacattcttcaatgatgtctaaggctttggaatttaaaagtaaattgcttctgggaaaaacaaatcaaacttgcattgcagacctaaagaaagtgcattaaaacatattacactgcactttcttggtggaataaatggatagtcacagtaatgtttcttctagcaatgtcagatttggagacacttcgattattttggctttcgattgagtttctctccaacactccactctctatttgatgtgtctacatatttcaatgtatccaatgacaatttatgccataaattattggctatatagggccaaaaattcagagtagaaaggtaaagcaatatactagagagagtgcatggagatgatatggatttgatttgatttcccattactgatttgctgtgtgacattgggcaaccttagcaggccttcattaatatcgctgttcatgtctacctatgatggtgtcatggctgccatattacatttgaggtatcttttctggtggaaggtggtagggttagtggtaagaaatattctaaaatcctccagtgtttcataagcacattgcacattctattttaaaaagtttgaaaggaatgcttagtaaaatgtgatacttggaggatttcattgtaatttgttgcttagttcaggaaagtaaatacctcactttttctagcattgaggagataatgaatatttacatttttaaattcacatttaaaatttgtgttgcagcttaactttaaaaattacttttattaaagtttaacattgtgtatagagggaaaaatctgcatactataaatatacagtaagacacattttcacaagctgaacacagtcctataccccccacccaatgacctcttcattttcttccccagtcgttacccctccaactaccatggataaccactatcttgacttttaacaaaataaatgggttttatctctttggtactttatataatttggaaaattctgtactcttttatgcctaacttatttcactcagaaatatgtttgtgagattcacccatactaattctggtagatgtagattattcattctcatagctgtgtagtatcactttgagtgaatatatcacagtctgttgaaagacatttaggtcatttctaacattcgtccattactaacaatgctactataaaacattttaaaatagcatagtgcaatagaacttcctacaatgacagaaatattcttaatatgtaccaccaaatatggtggcttttagctgcatgtggcttttgacctctggaaatgtgtggctagtgtggctgaggaaataaacttttaatttcagctaatttttattaagtagtcatatatggttagtggctactatattagacagtacagttctagcacatgtctttaggtgaacacatgtgcttatttgagaatagttattttacatgtaggaatgaaatgaaactgttgggaattgttattttatacctaggaatgaaattgcttggtcataaggtatgcaaatatacctctaatagattttaccagaaagttttctaccagaggggtttagtcatgcttatctttattcccttcagcaacacatgagagttccagtttctccacattcttgataatacttgacattttctatttaaaaaggaaatttagccattaatggctttactttttaggtgcctccataatctccccacatccattcttggttacatttaaactagttgctatggtcttaatgtttatgtccccccacccccaccccaccccacgccaaattcatgtgttgaaatcctaacctccaaggtaatggtattaagatgcagtgcctttggaaggtgaattggacatgagggtggagcatgcatgaatgggattaatgtccttatgaaagagttctgagggagcttatttgcctttcccccatgtgatgaccctgtgagatggtgccatctgtgagaaagtgggcctcatcagacactgaatctgctactgcctccatcttggacttcctagcctcaataaccacaataaataaatttctgttgtttataagccacccagcttattgttatagcagccaaaatggactaagacaatagtcttcacaaaagagtcacatcttttaaaaaatacaaatcagatcacaactcctttgtgtaaatctgttctcaacttcccattgtttttcctataaaatccagatcctaatcaaggtgagttatgttcaccaattttttctttattataaccacttcacagcaattgcagcattagaaattttatctctgatggaagttaatatcaacacatctactgatggtgagggttatatgtgtacaaacttggaaattagtttccagttgtaaacctatataacaaattccaatgaaatctagctcagaaaccatacaagaaaaaagcacactaatttaaaaaaggtaatgctttatttgttttcataaatatagctactgattgctagtgaaccaagaaactaaaaatttacatcaaataatgtatgattatttttatacagagcatttttttatcatcacttgggtttttctgaaattcaattattaatcttttattcaattggaagatagtaaatgaggacattattcattgccccaaagtcttcaaactgttcttaaaattagggtaaactatatcatcattctttttttttttttttgacagtttcgctattgttgcccaggctggagtgcagtggtgtgatctcagctcactgtaacctctacctcgcagcttcaagcaattctcctgcctcagcctcccaagtagctgggattacatgcacccaccaccacacctggctaattttttgtatttttagtagagacagggtttcaccatgttggccagaccggtcttgaactcctgacctcaggttatccacctgcctcatcctcccaatgtgctgggattacaggtgtgagccactgtgcccagcagttattcattttttatgtgttgtacatgagagatactaactggttaatattgttcagctgtttccccacccaaatctcatcttgaattttagctcccctaatccccatgtgttgtgggagggacctggtgagaggtaattgaattatgggggtgggttttcccatgctattcttgtgatagtgaataagtctcactagatctgatggttttataatggggagttcccctgcacgggctctcttgcctgccgccatgtaagacatgactttgcttctcctttgccatctgccatgcttgtgagagacttccccagccatgtggaactgtgagtcaattaaacctctttcctttataaattacccagtcttgggtatgtctttattagcagtgtgagaacagactaatacactggttaagaaattgcttccccaaaattcaaatcccagctctgccactcatttgcaagacctaggtcatttacttagctattctaagattaggcactaatgttaactaattattaatgatattaataatcaaatctatttcaaggaattctgagaataaataagaaagtgtttagaaagcactacgtcttctacatgtagtaaacatccagtgtttctttttatgttattttgcattttcttattcttatacttgtcatgataataaatgattcctttgaaagcttttgaaagataaatgctctttttccattttggtatgagtcgatagggtcattaagtctccaagtggcttgtcagtgttatatactgatggcatgtatatcaatgattagatggctatgaaaatgaattttagttttagttattactatagatattttaatttgcattaataacattacttaaaatgctgcttgcaacttatgcctttataagctgtgagtctcctatagcaattgttcactataaaatctcatgcttcctcccatgcagactttacacactgtattttttatcagaaatatccttttttatgtatttctacaagatgaaattcagtatatccttcagtgccacattaattatgcctcttccatgaagacttctcttcttatcgccatctattaggatctctccctaatttaacgtataactcttgtgttatttttaccttttgactgtatattctggttagctactgtattagtcttctattggtgtaacaaactaccacaaactgggtggcttaaaacaacataatcttaatatctgacaattccttaggttaaaagcctgaaatggctctcacagggctgtcaccagggctgcattcttttctggatgctccaggagataatctaattacttaactttttcagtttcttgaaatcacctacatttcttagatcatagccctggatcaatatttctccttggatcacctccatgttgcccattttggtggcttacttatattttaatgcttatttgagtgtgcaatcctttcacttttctaaaatttatttttctctactatacaatagaaatagtcacaagaattagaagttagtggggaaaaattgtaaatgataaaatgatgacaagacacatttctagagtaccaagatgggtcacacacacacatctttaccaagttgtttggttgtacaagccttgaaagaggggcaaagggggaactgagtgatttaagaatcacagaatttggaattagaatagacctccagtatagctacctacattccagcaagttaactattgtgtttatttatgagaggttaagtgcctgatctgagatgatacctctgctatatggtcatgggggctagaacctagctatcctttttgaattgctaaagaaccctccatacagtaacagatttcagaagcccctgtacttcccctagaagacacttatggatgcattctaatttgagctgccatcagttaggtttagcagaaataattttcagcaaagacaacaaataggttaatgaaatttttgaatgcaatggttctttcagggccatatgaatgtgaggatggtgatccctgtgtcaatggtcaatcgctttcttgtgaaaattatcgccttgttttccctcatatctatattactttgaagaaatatcctggcattataaaagtttttgatctccaggattttttcattttatctaatctttctcctttgtttcacaaagaagattaaccagttattcatatctcctgactcgtttgttgctaactgaaccagggctgaaactctgaattctgacttacaatcagagactgtccctcaattccatgttgtgttacctctattagagtaacctgagtaagcttcttagaaccagaaacacaggtaatacattatttaaatatcacactgcctcttgcatgtagcaggaacaagtaagttacctaagaaaaacaatgaatgaatccaaacagcctattgacaaggtaatccatagaactgagagtcagcaagatggcaggctacataaaacagaccaaaaagatgatagaaatgaaataataagattgtgtctctgttaaatttgtggatcacagtaaatgcttcactaatggtaacctcatagcatccagacacagtgagtcatttctctggttcccccttgtttttacccttgatttctcaagagtagctcagttcatatatttttgcttcagtaagaccattgactttgtgtgtgtgtatatgtttgtgtgtgtgtatgtgtgtgtgtgtgagagagagagagagacagagagaatggaggaacagcatagcacagaactgttcagctaccaacctaaatctattagccgtgctgtcctggaaatcacttttcagccacacaaaatttcactggccctatatcccaaggagccctgagttgccactataccgtagactcctctctccgtctggtggctctttccttccccttttttagatatataccttcaacttgaacctttttgttagtattatattattctttattttgttttaacataaaggggccactggacaatatttgttcagatcacttatgtgtactgctcagttgatatgcacatttactcttctgaaactgtttagcattaagtaacttagaacataaaaaacaatgcaacaagcatattatcttctattttttcccaaatcctttgtgatgtaagaggacagaacacatatatacatatcttttctacaaatggattatcaacattgttctcaacattacctagttccttaaataagaaatatatattttaaaatttgtatggcattcaaagagttacaattatgaatttcacatttctctagatgggtattaaacaatctttggcagatcacagactaagaaaggtaacagatgttggattggaaactgtacagtctagagatggaaaattaatttgtaaaaaagtagtgatttttttttccactgtgtgtgttttaaatggccttagcaaagcagaatggaaatatttgcattcctggcaatcaatttgcatacttaagcatttgtttttgttcccattctaaagataactgtgtgttcagtaataacccatatagtagaaagaagggtgaagaaatgtgtgtctttggcatccagcctgctgttagcgagtgactttctttctttctttctttctttctttctttctttctttctttctttctttctttctttctttctttcttttgttttgttttttgagacagagtctcactctgtcacccaggctggagtataatggcacgatcttggctcactgcaacctctgcctcccaggttcaagcgattctcctgcctttgcctcccgagtagctgagactacaggggcatgccaccatgcccagctaatttttgtaattttagtagagacagggtttcgccatattggtcaggctggtcttgaactcatgacctcaggtaatccacccgccttggcctccccaagtgctgggattacaggcgtgagccaccgcacccagcaacaagtgagtttcttagtctacaatgttcacttggaatttctttactcatgtcttgatgtaaaactcgctgaacatactgctattataaaaatagatatattttccatctctctggtggcatttcttctcttcctctcacctaacttaaatcttctatttcgcttctccagagctcccaacacaacagtcttcttttatcttcaatacgtagtggaatattgtgaaatagctgaagcagaatgggggaggagacagtggggaattttttaaaaaactgttttacccaaccattgagcatatactttttaaaatatttatattctgcctagagttgatgctgatgaaaccttgagtctgacaaagattttataaaaattcctatcacattccctatttcaatgtcaggcaataagtcagaatgcaggtatgacaatgtttttcaatggtcttacagcagactagaaagcaccatcaagaggagaatgcctctgctaagaggaattatctatttacactgcattgcagtcccatttctcatgcatagatctgtagcatatttggctaaaacttgcagaattattatgtcgcttcctgtccctctatccctactcactactttgttcaagggaattaataaaaaaaaaaattgccttattttggagctgtttgcgaaagtcttgttatttcagttaaagagaacactattttgttagcaagccattctgtttctttgggctacatttctatatacttatcagctaattatatagtgcagatatttttagtgggaggtagtcttttttttttgtccacttgtgacttctgccttgagacatttttgataaaattgtgctggggtcaagttgaaaaggaatgttttcctacattaaaaattttaattttaaagcaatttgactaaacatatcggtgatcataaaaataaagtcaaggtttaattcaaaacagaacattttagtttgtgtatagaaaaactttattttggagcagatatcaaggagacaaccaacagaataccgtcttcaactcttcgtttgttcacaaataaactcaatagattaaaacttatggtagtgaagttgcagggcaggctgttaccagcacggtaaaacaaaagaaagaaatctcaaaatacgtgcccttttgattgtggttatgcataaagctttgacagagtaaaatacatagaatgggtgtgtatgtaatatagagatacaggcctggaaagctgcctagagactttccgttgatgataattttagtacttaactaaaaaccatggttttttgactctttcatttttatttctgtaaatttaacttctactcagacagtagaagttttattctcttttattttattctggtgaatgcatcaaatacaaaagcaagttgtttagctcacaaattgcaattcagatcctttgccccttgtgcattcatttccagtgatgtttttaacaccatttgatcttaaacacccaacagaaaatagaagcacagggtgctacactgttacctcaatgagtgtggacaagtaagaattaaagtgaccttagattccagatttctgtgtccttccttaaagaagggatatacagaggtgctaagttgatttatactaagttaaagccatttcagtaatgcaatgaccttgtaccaataaatgtttaagtatctagttcttcagggatctgagaaataaatatcatatttaaaataacagatcttctttgagaacttttgactgcctgaaactttactcagggtggattttaaacaactttcatatacataggaatgaaagtatggctactatatgctttttactttaactcttattacaggttgaatagtgccaaagatgaatgagtatatttgtttgctcataatatgccaatcgaattctccttttgaggactgagtagaagttaagagtgtgagttacagccctgcttttctttttaaagttaccttggtcattgtcccacatggtggggcccatttacctctcagtgttcttggctacaaaataaaaatgaaggaaaaaataatgtgtgaagcatttttgagctctaaaaattctgaatttatgtctcaaaaataatactaaatgacccataattcaagataaatgtacacagtaagaatttttaatataaggaaatgtaaaacccaagaaaaggagaataaaataattatatgaaaactcaaccatatagttactgtaattaattattataaatcactcgatacttgctgacatggaagttaaaacaaatatttcaaaattcatcaaatacttttaccaaagaaaagcagaaatgtttggcaaatctgttataggagttttcttcataattttatgtaaggacctggtttaccaaaagctgttagattgatttttcctcttgtttttctaagattttaagttctataggatttgttaatagtgttaacacattttttattcaccctcaatttctgagggtagacatttaccttaaataaaaaaaaataacatgggagaattgatataataagatacagtttttatataagataaaggttatctcaaatcagctttggtgtgtgatcatcataagcttagtagggcttaaatgacttgttccattgtagtactgtcctcttttcctttatttctctctacactattcctttgtgttttaaaaaattattgaacctgctgtaaaatagaaatagtaacaaaatatacatcacaagatgtttgtaaagatttaatgagataatgcacataatgtatttaatacttttactagacaaatgttcttaaaaatgcaatcagtacatttatactgaaagaaagacacatacaaagagagaggtggaaggagaaaggacttgtggtccctttttgtttgatggaaactctttctcttataccaaactgatgtctaggcaataaatctataaagcactaataattagagcaagatgctggaacagaaacatactaccataatatcccacaaaagcactgattttgataagtaccaatggatgagagtacctttgtgggagcctgggcatctagcagaaaagtcccagtacactgttggagcaaaaggtatccaaggatagacgtattgaagggaataagaacggtttcactttacccatgtcacccctttaccgggcatagctcagtgacaagagaggctccctcagcctgcaatttttcccatacgtaaaaacaagcaagtagttagtaagtgtccagttcccctagctgtatgggatgctgcccaagacatccacttctttctaaccccacccaggatactgaggtaattagcatgactgagtggttggaagaaactgggaacaggaaacggaggctatagaccctactaaccactctacagactccctgaggaagtccacccatgaactacttaggaggccttgcctgtggatcctcctcaactagctcatgggcaccacaagtgtgccatgcacctcaagccccctccaagccagctcccttaatataccactatggacagcaagagcaagtgtctcactcagacaccaagcatgactctgcaagattgagagaaggcatatgaacttgagcatttctgggcacggccacagagaacacaaatgggaggttctcagaacctgtcctggctttgtgggatcgagagacagcatacagtcttaagaattcctccctaagagggaacaagtggcatggagcagatgtatccatggaaaatgtctaagagtactagctgaatctaagagagctcagaatctctggctgggttgattggtgaaggattaaaactgaaggagataactgcttcttcaaatgagaatacagtaatgtaagacttcaaagaacattaaataatcaagaaatatgataccatcaaaggagtacaataatattccaataatgagcctatcaaaaaaattaagatctataaattgcctggcaaattgccttcaaaagaattgttttaagggaacaattcattaagtgaattgaatgtgctacaagaaaacacagaaaagcaactaaatgatatcagaaaaaaatacacgagcaaaataaaaagttcaataaagatttagaaattatgagcgaaaccaacagaaattctggagctgaagaatgcatgaataaaatgaaaattgcaatagagtgtcatcagctgccttcatcaaacagaaatgatctgtgaacttgaagatatatcatttgaaaatattccatcagagataaaaaagaaaaaaacagtgaaaacaaatgaacaaaacctacaacatttatggaacaatatcaagaaagcaaacggtcactgtatgggagctccagaagaagagacagaaaaggaacagaattcttatttaaagaaataatggctgaaatatttccaaatctggcgagagatgtgaacatccaggtatatgaagatcaaaagcctccaaacggacttccccaaagaagactcactacgacacattaaaatcaaattgtcaaaaatcaaagacaaagagaattttgaaagcgccaagaaaaaaaacatgcttatcacatataagagaacctgcattagactatcagacaagaaataggtttttgtcagcaaaaaccttgcaggccagcacagggtagaatgatgtagtcaaagtgctggaaaaaaattacaaaacaaaaatagattacctggcaaagctgtccttcagaaatcgagagataaagactttcccagacaagaataaataaataaataaaagttgaggaagttcaccaccattatacttgccttacaagaaatggtaaagggagttctgcaagctgaaagcatgttaattagtaacatgaaaacaaacaaaagtataaaactcaccagtaaaagtaaatatataagcaaattcataatactctaatattgtaatggtagtgtgttaattacttatgactctagtataaaggttaaagaacaaaagtatttaaaataactatagctataataacctgttaatagatgaacaatataaaatgatgtaagtcgtaacaataaaaacttaaaatggggtgggcagcagtgtaaaatttgtgtatgcaattgtaacaataaaaacttagaattgggtgggcagcagtgtaaaatttgtgtgtgcgattaaagtaatacacgtaaaatagattgttataactaaaggatgtactatgtaagcctaaaggtaatcatgaagcaaactcttatagtagatacacaaaaaataaagagaaataaatcaaagcgtaccactatagaaaagcatcagttcacaaaggaagatagcaagaaagaagaaagaatcaaaggatctacaaaacggacagaaaacaattgacaaaagggcaatagtaagtctttacctattcataatttgtttaaaggtaactgaattaaaatttccaatcaaaatatacacagagtggccaaatggattaaaacaagatgcaactaaatactactgtccaaaaactcacttcagctttaaggaaattcgtagactgaaagtacaggggtggaaaaagatagtccatgcaagctgaaaccaaaaagagcaggagtagttatatttctatcagacaaaatggacttttaagtaaaaactggaaaaaagaaacaataaaggtcactgtataatggtaaagtagtcaattcatcaagaggacataacaattgtaaatttatatgcacccactattaaagcacctaaatgtattaagcaaatattaacagagctaaatgcagaaatagagagcaatgcaataatagtagggaacttcaatacccaactctcaataacgaatagatcgtccagacggaaatcaataagaaaacattggactttaactacattttagaacaaatgaacctagcagacatacaaaagactccatccaaaagcaactgaatgcatattcttctcaagcatacacaaagcattctcctgaatagatcatatgttaatccacaaaacaattgttaagttttaaaagattgtaatcatattaagcatatttctgacccacagtagtataaaactagagatcaataacaggaagtatactggaaaatttacaaatatgtgaaaattaaacaacacatttctgaaaaaccaatgggtcaaaaaaattaaaagataattaaaaaaatattgagccaaaagaaaatggaaacacaacatacaaaaacacatgggatgcagcaaaatcatttctaagggaaaagtttagagtgataaattcctatgtgaaaaacaaagagacatctcaaataaacaacctaactttacatttcaatgaactagaaacataacaaactaagcccaaatttagcaaaaggaaggagataataaagatcaaggaagaaataaaatttgagaagaggaaaccaatagaaaagatccacaaaactaagaattacttttttttaaaaaaaggtaaacaaaattggcaaaccttcactacactaaggaaaaaaatacagatttaaataaatatgatcagaaataaaagaggagaaattagaacagacaccacaaaaataaaagtatcataagaggctaatataaacaattatatggcaacaaattagactgcctagaatagaaaaattcctagaaacaaacaacctacaaagtctgaatcatgatgaaacagaaaatctgaatagaccaataacaattacagagattcaatcattaatgtaaaatctctcataaaagaaaaacctatgacctaatggcttcactggtgaattatatcaaacatttcaagaataattaatagctattattttcaaactctttcaaaaaattaaagaggatgatgtatgtccaaactcattttactaggctggcattactctaataaagccagacaaggacaccatgagaacagaaaatttcaggtcaatatctctgataaacatagatgtaaaactcttcaacaaaatactagtgaaccaaatttaacagcacattaaatggatcatacactatgatcaagtggtatgtatcactggggtgcaagccaaacacagaagaacatataccgcagcacctcacttaaacatggaatctagaaaagttgaactcatagaaacagagcacagaaggatcgttaccaggggtatagaaatggggaaaatgggtagatgttgatcaaagggaacaaacttgttagtataagattaataagttctggagactttatgtacatacggtgactatagttgataataatatattggatacttgaaatttgctgagaatgtagatttttcatatccttacaacacacacaataaaatgtaactatgtgagagatatgcatgttaattagcttgactgtggtaaccatttcactatatatatatatatatatatctgaaaacatcacattgtacaccttaaatatatacaatttttacttgttaattatgcctcagtaaagctggggtggggagaaaacctctaatgtttaacttaagtacaggacaaaaaactagcctatacattttggtctggacaatttgcccatctttgtcctctcatgacctccagatggtgaccttactattcagtggatgcagaagcaagatagatgacctttcaagtttagtctttgccataatgcctaacccagtctaaatggtgctgcactcaaatgatagttttgataacagtgttacatggggtcaatcatcatttttgcaaacgacttgagtaattttttttcttgatacttaaatgatagttccaacacaggtgattctcctccaaaaccataatgagtatgagtctgttgaataaatgtatacctatactttagtgagcatagaataatatttttaaactctttatattgttgtttattactatttcttaaaaccttatacgtagtctagttttactgtggattattttccttgtgtcctgggattgatatttaatttctttgcttttcttcacactttagttataattgttatacatttagaacatttaatctggatttttgtaccattcagtaaaagtagtcaaacttcccaaactttagccctgttttctccttacccataagctaggaatcaatatcagaatcagagataaaagtttgtaccccctccccgtctgtattgagctgctcatgcatttaaataattccattaattaatggtaacagtaactttggacataaagatcaaattagcagatatatataatgaacatatatatataatgaacatatatatatatatatatatatatatatatatatatatatatatgcttattagcttaactgtgaaccctgatgaggaatgtggtatgatttgttgattttatgccttaatgatcatgtgttctggctgcctgagtcattttcttttaaatgatgtatttgtgcattccttcatacttccagagttcttctaagttataaacacagaaaaatgctacagagccctggtactgcattccacatgtttccttatgatgtgtgaaaggtgtcgaattgtcattttctaagcttatgttacagagtaggtttttggtagctgtaagtctaattattccttctgaatatttaaatactgaaataggccacttaaaaaaaaataagactggggaggtgtggtgggtcatgcctgtaatcccactactttgggaggccaaaatgggaggatcactgggaggactgttgaacctgagttcacaaccagcctgggcaacatagtgagacctcatctctacaaaaaaaaaaaaaaaaaaagccagctgtgatggtgtgcacctgaaatcccacctactgaggaggccagggtgggagaattacttgagcttgagaggtggaggctgcagtgagacatgagtgtgccattgtactctagcctgggtgatagagtgagaccctgtccaaaaataaataaaataaataaataaaaccaatactttctactacaaatatattcattattcattcataacgctttgattatgatgagaacacttgtcttaagtgacaatatgttcttcaatgttatgttaatttcggcccacctgaataggatatttcaaagaaaagtattaaaatggaaaatcttaagtctaattgataataataagaaacatattaccttgtgaacgtcccactttgtcacagtgttttgatttattttatgccataagaccatctgagacatttgtcgcacatttaacgctggagggttttaagtgatggatatttgctaagtctgatttagtcaattatttacttcaaactggcaatttattaatctttcttttatgcagcaataacatttatttactggaaaaactgaatgcaaatagtgtatgtgtccattagtatcaagtttatatttctattgtcaactggaatatttttgtttagtatgacaatctggaaaacaggttgataaattctgtgagattgggtcaccgttaggtagctctcacaatatagatatgatcaaagatgagtatttgaaattcactagtttatgttaatgaacattcttatagaggctgccagggggacagcttctattggaattaccttttgtgaatcctcctcattacggggtaagttcttactaaagtgaataattatctttcattccagaactacagtgtcaggcataatgagtggattgttaatacatttttcaaggtagcgccagtcttcatctgtagccattaatttggtgacagccaataattattttaactggcccctgatgctgaaatgcacagattgttttcttcctgtgtggtgcagggaacacttctaaatttctgagaggtttctgtcacttcccaaagaatttcctgacagcagtgacatttggtctaatcatttattccctcagtttcatgacttccctgcggtggctctcatagtcaggaaagcttctgttgttttggaaccacagctacaaacatctgctgccaatattttgcttaaagtgttgcaactttccttaaaaaaggagacccccttctttttatgcttttagttattttccttaaaataatgttaaactcttaagaagtttcatagaggtggacatctaaaattattaatgaggaagcttttaaagatagaactggaatttgattatcaatagtcctcaggaaaaaaagagaaaataataataaaataataattagaataatattgaaatgtttataaaatgttatctaaaaaataataaaaatgaactcatttttactttataaatgactcagttataataaaaactactcagaacaaacacaccaaaatgataatagtcattggtctcagcagtagagatacagatttcttctttgtgttctgtactttgcaaatattataaaatagttattacttagaaaaaattgtttgaaatgctaaaataatggacatctactaaacacgaaatacaaaaaaattgccaaaacataatatcttcaaagattttcaatatataatcttactataaaaattttatctataacatttataccagttacctatcactattgaatatactttgaagattatgcaggaatatttcttaattctctatagtttccatttgtctgagggttttttccttattcctatccttctccctttctctttctcctctatatctgcacttttaatatgaaactgtaaggaaaagaaaattagattggagatctctatggggcaacagcatatcggctgagttcagcatttcaaatttttgttctcaggtctcctttacactcttatgattatcaagaacaccaaaaactttttgtttatgttggttatacacatcaacatttgtcatattagaaatttaaaatgacaattaaaagttacattaaaaatgtacttaaaagacaataaaagcattgaaaatcaattaaaacaacattttattaaaaacaaccatattttctaaacaaatgaaagtatttgtgagaagggtgggcttattttacatttttgaagatttctttaatgtttgacataataaaacacggctaaattttcttaaatccttctgcatttcctatatcacatatcatgtagactctaaaagaacttcattctacctgttaagaatgaggatttttgaaagagtaaaagaagaccaataacatcttagtagttttatggaaaaattttgactttgtgaaccactcgaaatggtctcagagatacctgaaggtcctcagaccacactttgagaactgctggcatatgatagatatattttatttttgtacctagacagcattccattttaatgaatgtaccatatttatataaactgctctgcaaatgaatgaatatttgtattgctttcaggttttttttctattacaatgttgcaatgaatgtccctataaaatatatttgctcccatgcatggatttatgtatatgatggacacttaagagtgaagtccagggttaaaagttatgcatattttaaagtatgatgtattgacctcctaagaaaaagattctgtaaatgtttaatttcaccaaaacaatacaaactcttgtttcctagctcttcaaaatactaggaaagtataaatttatatgctctgccaaggtaaaagttagacagtgtcatgatattgttttatgattttcctctttactaatgagtttgatcatttttcattcatgtattgttcaattatatctctttcatcatttacctgtggttccagtttttttattatttttctcttgggttgtgtatttttatgtattgacctgttgacactctgtatattaaccaaattagccctcgatttgttgtgtgcctcacaaatttttttcttaatcagtacatttaatattttcagtagaccattctcaatataatgacttggaatgttagtaatgtacacatttcatagactatgcctcttttctacgttttttattatttcaggaatagtaaaattagaggaattgaataaacaaaactattttaaaacttgtcaattaagtttgttcagaatacgatttgtttcccagtattaactctggacatccagatatagacaggctataagcttctgattacatgaccagtgtagctagtttagattcaccttcacagagtatgtctaccatgtactgcaccttatttgatataatttaatagctcaataggtattagctgaatgaatgaataacaataattagtagtgacattaattaaacactccttttctccacctctgtttactggaaataatgcttttagatatagagatcttttgagactattctgtggtttcaaaaagctcatcaggaaatgatgttttctataattggagtaatctatcaaaatagatgaattctaaaattataataattcctgaaattgtcctgaggcaaaatttgttctactttcataagtgtttccattttcttgttaggaagaagagacacaatctgaaaaccaagtctaattttcccataggtgtaaaagagaagaccttagtaattacttgtctttttcatccagccacttagtgtcttttcttatttttgctaatgactgcaaaaaatgaagatctccacaaggagaaaatgttctccccttagaatggctgttcttagacttgagttacacttttaccatcatctaatttttgcaatattttacatctttgcccagtaaaatgaggttcctaagttaaaagatttttgagcatattattttgaagttgctgttttcagtgcaccattcacattattgtcattattaattgcattctgggaccaaatctattttgaaaaatgtttttcttgcatcttggataaactgaataagcaaagaaagctactcctgaaacttgtcattaaagttttctttagaatacaattcattcatcagtactaactgtgagcatccagatatagacaggacataaacatttgaatatgtggccatgtaactaatttgagctcacctttttagagtgtttctaccgcacacaagaccttatatgaaacgatttaatggctcaataaacgtttattgaatgaatgaataacagtaattactattattattatctacaacaatacttgcaagtcttctgtctttttgccttttctttcatttctttttccccagtgataggctagataattgcatcccagagatgtccatgtcgtaatctccagaacgtgtgaatatcttgccttacttaggaggtgtgattaagttaagaatctttagatgggaagattaccctgattctttcagatgaaccaagtgtaattgttaggatcgttataagagggaaacaagaagatcagagttagcagtagatgtgatgatgaaaagagagattatagtgatgtgaggaaggggctgcaagccaatgaatgtaacagcttctagaacctgaaaaggcaaggaagtatatgcttgcctaaagcctccagaaggaacagggccctactgatattttaatttcagaattctgacctccacaaaagtaagagaatagatttgtattgctttaagccactgagtttgtagaaatttgttacaacagccataggaaactaatatacttcttttactccaatttctttctgtattccatgccattagatattgcctccagaatcaagcatctatgatagtgcttagcacttaaattggatgatacatttaagttcaacccttgtgtcatagtggattggattttactctttataaaatgtatattgtgaacttctattaactcaaggtcttttctgtttttgtcacgagaacgtaaatacattcaaatgaaaatatgctgcatatttttagaagacaaattttccttgaacttgatccttatagaacttaactctgtttactggaaagtaatattagagtttaaaatctagagatagcggatcatatagataagcaatgcaggatttcagtgatttctatggtcaccagtacaggtgtgatcttaaaacatcgacactattgaactgaattcataggtatgtatttagcttgcatttgtttattccagtagccactgaggtgtatttctttgtttataatctataatcaaaatcctttgctatgacatacaaaaaatgtatcgagccacggacgttgaccagggttttcttccttcattagttgaaaatgaactgtatctgctattgtttatctggggaataaagagccaaatgttaaaagttgccttcagctaggagcagtgcctcacacctgtaatcccaacactttgggaggccaggaggggtagatagcttgagcccaggggaccagcctgggcaacatagcaaaaccccatctctactaaaaatacaaaaattagccaggcattgtgatatgcatctgtagtaccagctacccgggaggctgaggcacaagaatcacttgaaccgggaagcgggcagaggttgcagtgagccgagattgctccactgcactccagcctgggagacagaatgagactctttctcaaagaaaaaaaaaaaaaggttgctttcagttagtctgttcacagtataattttacatctgggggataagaaaaactgttgactgaaacattttctacattttttctttggttcatattaaaatatgtagttttacattatttgcttttggtagaagttctgtctctatcaagaagagtggaagagtgcaaatagatgtacaaattccttggttatataaatattattctaattgtaaaataactgaacatttttactgaggtgtgctgagaaagctctttgtttttttgttgtgttttgttttgttttgttttgtttgtgcctataatctgttcccatggggacctgcacaatccatgattctgataaaatgaagagcagtggagagttacaacttataaagcagttatgactaggctagtcaataaagtctcaaaatcagctattagagtacggtatttaaggtttgttagagaacacagagtatggaaacattgccattaactaatgtgtaatttggtcacatttcctgataagataataagactttttgctttcctctaatctaaactttctccaggaagttatgcaacataaagcactatgattaatattgccactgaataatgtaaatgtattttctcaaaagaaatgaatcccattaatgggactgaacacagtcttcagtggaaggttcagatttttgattcaaacaatccagcatttccatccatttactaattatatgatttgagtaagttatttcaaatcactaagacttatttatataatccatgaaatgcaagtaatactgtacctttactgaagaagttaaggaattaaatgaggtattgtatctgcattagtctaaataagatagatcatattgtggtaataagtaattcttcaaatcttagtggcttaacacttaaaaagtgtcattctttgttcatattagaaagttaagatgttgttggctctgctgcacagttattcagaatcttgtgaaaaggagaccacaccatctatagaaattgcagcctctgaggacatgatagcaggagatcagagatgaaaggagaacaccagccttcaaggcttagctcagaagtaacacttgtcacatttggtagtttataggccatggaggctcatgtttataaggaaagactgggaacatggatattggtaagcacagtccttcctacaacatctaaaatgcttagcaagatgcctggctcataaaatacctcagtaaatgttgtctttttcaccatcgctattattattttagagggagtgcaagttggtagttaagagtctgccactaactccatgactttaggcaaacttttaaaactttctgaatctccattgtaaaaataggtctcccctcataagactgttatagtgaccaaatgaaataaagtgctgccatttagtaagccctctaaaaatatggtagtttcattgctatcatgcatttatattcattttatctatcaattggttaaacccaattaaatgcctacatatgtgtgtttttattataacagtgttgagatttcctcatttttattaatatgtataaactaataaaacattgattttcctatttgtgacaaatatattacaattattaatcattcatttgataggtatttattaggtgtctactgttttctagaggtaacagataaacaatggacaaaatacatgaggttttgctctcataatatttgaattctggagcagtgaagagtaaatgaggcaaaaatcaacaacataaaaataaactgtaatttcaggttcgaataattcctatgaatttattttaaaaaggaggatttggttaagactgactggttaagacttacattttgatagtcagaaatgccttttctgaagaagcagtgtttcagctgagatatgaatgatgtaaagatatttgagaggaaagatttcctttctggcagagggaattccaagtgcaaaggttccaaagcaagaacactgtaactagttcaaatgtaattaaagcaaaagtgagcaacagtcaagagttgttagaaatgagactgtaaagataagtagtgacctttttgtctatgaaaaaaagtttgatttttttttttcgatatttgatgtggaactattcaaggttttcaaacaggaaagggatgtgatctgatttttgctttgaaagatcattctgactatgtatggaagaatgatctttataaagaatggttcctttataaaagggaccattgcagaattccaaaaagagatggtggtaattttgaatgaattatttggtggggggatatggatagaagtggaagatttgggatatattttgaaggtagagttaatatattttgaataaggtaggtaagagtttagagctgaaagaggactagatttagggcttcagccactgggtggatggtactgtgatgaaggctggggaaagaatgggctctttatgggatatcaagagacatactttgcatctgttatttccagatacctcttaaacatttaactgactgtcagtcacatgcaaatcttttggcctttcaaataatacaataattttagtttagattatgcctatttttgaatgactgcttgttatgaatgctattcagcgatgtgatgactcaatatattttcttttaggtgctctgctgcaagaaagtttaaagcatcttagtttagaagctcataaatactctctaaaaaaatgtgatagaatttacaaagataagcttataaatctaggaagatacattttacttcagagtcaaaaacaaaacaaaaaaatttcattgacaattcatccaacgcccaaatgaattgattagccaagaacaaagaggaatttttactaataataggtttgtatagcttccttgttttaaaaagaactatgttgtgggtttttttcttcccctaatgaaataaaatattagagtgaaatttttaattagttaagtagtttgttgcattctaccacatccatgaccatctgatatagtacccaggaagaagtcaaagatgcaaggcgccatatcgcatgatacacgataacaaggtaatgaagagtaaatacatttgtcatttcagggaagttatttacatgacacagccttgggaaagcctgcttgggagacataaatgaatgaagctttttagattgatgaattaagtgtgccttttttgttttcaataatgtccaataaaatagtttatattgagcaagaggtcttcttttctgatctaagacataatgttgtacaagaggtacattgtgtggatacttaatatgatgcacatttgtttacatataacttctgcaaggagatattaactcccaagttctggaatctttctttgtgcttactagttatgactttgtaacccagggtcagagttccaatttcagcacacaaagcccttgcctttggcagctaaaggcctgttattatgggcaaagattaaaattaccctaggccaagatctataattttctatattaagtcttgagtcagtgccacaatgcaagtaaagtgaagtatcaataactcatttaaaattatttttctcatgaagcaggcagactagtcattctgttaaatccagtaaagggcataagggataaatctgggccactccaattttgtgttttatttttttttttttattttttatttttttgagacggagtctccctctgtcgcccaggctggagtgcagtggcgcgatctcggctcactgcaggctccgccttccgggttcacgccattctcctgcctcagcctcccaagtagctgggactacaggcgctcgccgtcacgcccggctaattttcttgtgtttttagtagagacggggtgtcaccgtgttaaccaggatagtctccatctcctgacctcgtgatccgcccgcctcggccttccaaagtgctgggattacaggcgtcaattttgtgttttaaatgaaacactgtgaacctatacaaggggatgtggtctttcccctttgtattttgtgtagggctggaacactcattctcaatacaaaatagagccaactctttgttcaccttttttctaggtatccccctaagtctctgaatgaaggaattgattgttgtattgtttctcagtttctgttggacatttaaagagagagggtagcagtgctcacagaagttcttcccttcaaaggcagcctatgtgaggtttcacacagcagtcagccagcgcacctggacagtcaggcatagatgcatttacaggatctttctccaatctgccataagtcatttttcttcctatgcctgtgctgtatgaactatgccatttagcggccacgtgctcccttactcctttataattcacatttagcgtcaatccagaggtctctattttgtcttttctttcacttgaagcttatgtatatagttatgatatgctttacattttgtccagggataactatagtttctagggcaactataaaacttggggaatccaacaaaaaagtccagggggttaaacaataatctaagccttttatttgtaaatctttgcatatctgtgaattgctttaaaatgcttcagccaaaaagggcagggatgctgaatcagacaatatggacaaaccatgaatgcctatggaaactacatggtgagaatatggagattcattatactattccctctgcatctgtgtgtttgaaaatttccatatagagaaattatttttaaaaaataaatatgtgaaagcaaccatccagggatgattgagcaggttttttgtttgtttttaaacagacttgtaagaggttttttttgttgttattaataagttaggctcaaaaacatatggggacaaactaaaacctacataaagagaaaaagaaaacaatgctaccatttttggacattgctcaatttcacattgtgaatgctagaatttgctccttgaagtgcaattggaatcattttctagatcttttgtaaaatcacaaaggatatttttgtgtttattaatatctttgcagccccttagagaccttgacatttttttctttaatactactaaaataatatcagatatacactcaggtctattccatttttgaatattgtctttcacacatacttatgcacatacaaatacaccactcctccccctccaccaaaggaatgtgtgtgtgtgtgtgtgtgtgtgtgtgtgtgtgtgtgtatttcacatataaaagcaggccaatgttgagcgtagtggctcccacctgtaatcccaggactttaggaggcccaggcgggtggatcataaggtcaggagttcaagaccagcctggccaaaatggtgaaaccccatctctactaaaaatataaaaattaaccgggcacagtggcaggtgcctttaatcccagctgcttgagaggctaaggcaggagaattgcttgaacttgggaggcggaggttgcagtgagccgagatcacaccactgcactccagcctgggtgacagagtgagactctgtctcaacttaaaaaagaaaaaaaaaaaaaaagcaggccaactaaaggtttgtttttgtcaactgtagtatttgggttaatcaggtaatgctgcacattctctttcaaatttagatttttatatggtaacttgtttgatatagttatcaaacaaatggggaaggtccaataatgttaaaagaacaaaatcaacaaacatcagtgaagaacttgatttgcagaaatattttaacagcaagaagcattctacagttcatttccattttgatggccattttaataacaatgctgaatgagaatgcatctcacctatgtaacagaaaatttccttgattccatttcatttaaggttttaggagtatcagctcagacactggaggagtaatcaataaacatgccaattatgtcagagaaaaattatgaatgcctgaatatttgcagccttatttctttctttctttacaaagaatatgcctacctgccttttgcacttctggtaaagatacgaggtaggcagacgtgaagatttgcaaagaactgggacagactggcaaccttcccttttggaaggcttctagcaagagattagactggatcttagaggacaaagcatgggggtacaaagacaagtttctgtggagactgagaagtaatcctggggaggaggggatacgcagaaaaagtgaaaaacacagagagaaaagagcttattaatgggaacttcttgctgttctgttagtttctttaagctcctagggtagactgaataactttttaatgcttcttaattgtttctctttatacttgacttcttgatgagacaggaccatgaaggaggccatctttattgaggttacataaccttcaatatattcaatctacttcattaatattcactgaagttacaagaaagaatgcccacaaaagaatctctttattttcctactgtcatcccttcttccactgagactctgatattttttgaaattacatgtttttttagttttttgggctcctttgagtataattgaaggaaatttctatcctgttctccattttcgctaggaaattgggagctacatgtgtaaggataatgtttattgattcttagaatgaaggatcttagattatctctcctccaacatcctcttttaaatatgaaaacatgtagggatttgctatctttacaaacaaataaaacccagatctttaggtttggtaatggaagtacctctgtttgattaggaacagctagaccttgaattctgattctcatcccttgagttgcacctttctcctcaggcatcctgctagcctttagaggtcgctgtcactctagcaggaaagggatcgagaaaggatccctactagttcactggtctcctctcccatcaccctccccctttttcattcattgccatttttccaaagagctgagtacacactaacctcaagacattttgtacttctaaccttttgcctacaacacttttcttcctcatatttccaaagattgctccctcctttcttttagaacttcactgagatctttccagattactgcatctattacttcctcttctgtcagtctctgctccttacattaccttatctttttttagcacttcacaattgaagttttatttatatgtttacttgtcttttggctgtcccttttactaaagtataatttccatgacagcaacattccttagtctagttatatgggatttagaataatgcctggaacatagtaagtgctcaatagttgtgaatgaatgaatgttcttctgttactgttgagcacaggctgcaatcactgaagattctggtaaataaggaggtggggatcgtttgatccaggaaacagtatggaatgaactatggaatatcaagacccgggattatatactggttctgacacttattagctgggtatacttaatttacttaaactctctcatctttaggactttttccatctcaaaaggggtttcaactcaaaaacaggtagtttggtggaataaaagtgaacacattaaagcatctaccacaatatcaaacatgaaggaagcttcatttaaaaattgataactatgcaatttgccttttaaaagttaatctgcttcttagaatttataattcatatcagatcttaaattgcaatttactttctatttttatatataccaagcagggccacattctggtaaatctgttctaatattttgaaaaaggcaggggattctccctcctgaccacataaagccagtttccttagaattaaattttcctgtgaggaacagaactagaaaaaactattttaagatgcatgtgtaactaaaaaagaacacgaatagccaagacaatcctaagcaaaaagaacaaagtggaggaatcatactacctgacttcaaactatactacatagctacagtaaccaaaacagcatggtactggtacaaaaacagacacataggccaatgggacagaacagagtccagaaataaggccacacacttacaactatctaatcttcaacaaagctgacaaaaacaagcaatgggaaaaggactccctattcaataaatgatgttttgataactagcttagccgtatgcagaaaattgaaactgaaccccttccttacaccatatacaaaaattaactccagatggattaaagacttaaaggtacaacctcgaagacaacctaggaaatgccattgtggaaataggaatgggcaaagatttcatgatgaagatgctaaaagcaattgcaacaaaagcaaaagttgacaaatgggatctaatttaaaattaagagcttctgcccagcaaaagagacaatcaacagagtaaacagacaacctacagaataggagaaaatattataaactgtgcatctgacaaaggtctaatattgagcatctttaagaaacttaaacaaatttacaagactaaaacaaccccattaacaagtgggcaaaggacatgaatagatccttttcaaaagaagacatacatctagccaattcaaacatatgaaaaaaagctcatcatcactgatctttagagaaatgcaaattaaaaccacaatgagatattatctcacaccagtcagaatggccattactaaaaagtcaaaatacagcagatgctggcaaggtggcagagaaaagggaacacataaactgttggtaggagtgtaagttagttcaactattgtggaaaacagtgtggcaattcttcaaagacctacgaatagaaataccattcaacccagcaatcccattcctaggtatatacccaaaggagtataaattgttctattataaagaagcatgaatttgtatgttcattgcagcactattcaaaatagcaaagtcatggaatcaacctaaatgcccatcaatgacagattagataacaaaaatgtggtacagatacatcatggaatactatgcagccataaacaagaaaagatcatgtccttttcaggaacatggatggagctggaggttattatccttagaaaagtaatgcaggaacagaaaatcaaataccacatgttctcacttataagtgggggctaaatgataagaacacatggacacatagagaggaacaacacactgtggcctctcagagagtggagggtgggaggagggagaggattaggaaaaataactaatggctactaggcttaatacctggatgatgaaataatctgcacaaccaacccccatgacacaagtttacctatgtaacaaagctgcacatgtacccctgaccttaaaataaaaattaaatttaaaaaacttaaaattggtaactatgtaattttcctttaacaagttcatctgctttttagaaattaaaattcatattgtatcttaagctacaatttactttcttttttttttttttttttttttgcagttgcaagatttaatagagtgaaaacagagctcccatacaaagggagaggacccaaagtgggtagccgttgccagctggaatgactgggtttatatcctgatcattgtccctccccctgtgctctcaggcgacagatgattggctacttctttacttcctgtttttccctaattagcattttaatgagctctctttactacctgattggtcgggtgtaagctaagttacaagccccgtgtttagaggtggatgtggtcaccttcccagccaggcttagggattcttagtcagcctaggaaatccagctagtcctgtctctcatcacctgggagctttggctctttgggtggttctaaacagcatcaaggttgagaccaaggttatctttggggtctccaccccctgaaacctgcccctacttgctagttcctgccagggagacctgggtgatcagcttccctcaaagcccagggcagaagcattctggtagccccaggtgcctagagactggcagaagggagacacttatgagtcactcctccacttcttccagagaccatactgttttgtttgtttgtttgttttttgaaagtgtcaaaaagtcgtgagaacaaagcatcccctctgtgctgtgagtctgggaatctggaatagaaacagaagttctcatccccagggacacctttcctggcactgctccccagcctcctcccagctccaggctgagaagggcgtccctccccgcgtccctgcagcagccagcactgaggtcggcctccaccccagccacagtgtgctgccatgttgtgtttccgggcctgtccccgatgtcaaatcctagaggctaggcctcttacaatttactttctaactatttgtatatataacaagcaggggcaaatctggcacatctgttctcaaattttgaaaaaggaaaggggttcttcctcctgtccacataaagccagtttcttcagaatcaaattctcatgtgaggaaccaggtaattaattctagatttgagacaccttcaggagaccttctctctactccgctaaaggtctcaggatatgtccgttactaaattaggaacagttcaccaactctggttggagaattgtttcatttcatggtcgtagagaaaggaaggttgacttgattgttagctaactttcttcgagataatccaaaatggaaaaagtaaagaatggttttactttgccctttgtattacctggcaaatttgacagggtctctcatgggcattgtctacaagagtgaaacaaatgagagagctttatagtaatgtagcatatttaggtcctttcacaaagtcaacccttgttaaacagatcataattcatataaaaagaaagctctccttcttaccagtttaagttttatagtccaaaatagagcctttgaactctcttcaattctaaaatgcatcactgtgatgcctgcaattgactgtactatttctatgctggaaataaaatgagaggcatagctccaggaaaatggccctaaaaataataatttttgcatgtgcctcaataatgttaataatatctaacatttgttttgtgtctttccatggttcataaaagttattcccctgtttaccttacataatgctgcaagttactcccaatcttttattcattcaacagatatttactacatgctactctatgccagatttgggattgagtgttcagtgtaaggtcatataattctgttagttagggaaattttacattgctggtccgcttttacaatgagtaagtggtgaaactgagttgtgaaaattaagtctattatcagtaaaaagatcatatatatcaaatccttgactatccttaatttgtgaaaactacatcaaatatgactttttcctataaggaaagcttttacagattcctagatggttaaatttaattgcttctacatgttttatatctaatcattatatgccaaaaatacacattatgttcaatacaaaatatttacttctttgattatgattatttttaggtaaaaaaatgaatatgctgccaagctgcaattactatatttagaatatgtacaacttgtgactagccaaatttgcaatgatcttttagaaaataggggaaagatttccagtgcctattttaggtaagaaagccttcctgagagacttattaaatattaaatgctttattaagaaatttagagactctttatgcagatattttaaaagcctgacagatatatccaatgtcggactgaattaagttcaatcttggcttattcagctgagagggtgctttgctgttgtggagccataggacagttgtcagggtgccttccacgctggaaaatacataagcttgctaaaattgtgcaggtgcatgcatgtgtgcatgtatgtgtataatctactgcattctaggaactacattatacttgggggatacaaagataaataatgcagagaccctatactcgagagacatttaaattgttaaaaaaaggcatataaataaatgagtgagctgaggtgttccacagataccaaattagaagtgtatataatagactcacacaagaataaatgaaattgatttataatttaaaaaatatttaatgtctgctttgctatcagaaagaatattctttaagaactaggactttttctattttattcattacttagtctttcatgaatagcacaacacctgatatatagccccatgttcccaatgaattttgaatgaatttcaggcaagggtgaataaataagttgaatgaatgtattaaaaattaattaataataagttattttatgggaatttggtggggtgggaaaagcggtcaggaaatattttatgaaagtgattaagcaggaaaagagagaagccagttcagaaagaaggagcagcgtaagcagatctgggagattgtgaaaggtctcagccctttttgagaagtactgtatgtggaaagtgagatgcacacatttagatcatgacattggatggccttttgtgttaaggagtttggacgttatccgataggtgggcatgtgggtgattaaagtaaaatttacactttagaaaggtctattgacaatttgaatccatataagatacctttagtgctcactcccagtggaaaaattggtacctatctaagaaaaatatgaatttctggacagctattcaaccttctcctggggtagtctagcactaaactagtttatcactttgtttctatagcacagaagggtgggtattgtattttatagtcatttctatgcattgtttttacactaaacatcttcataggcgacgtcgttgccaagttatttatttatttttatgattgcttagattgatttatccatagatgtttacagcacaaatggtctttaacatctccttgaaaaactcagtttctaggacctggattaaatttatattgtattgattagtatgtgattcaacttacatgacagcactcttcaaattgtcacaatttcagtaccttgactcttgaattagaaaaaataccatctcaggtcattacacctgtaaatcttttacctactgaaagcaaggttttcattctagctgatgcctccagccttgttaactcatacctgcattgtaacatagagctttcactttgaaaccagaattgtatttatttctactaactgagttcactgcatcctgggaattctttcagcctctagcacaggaaatatatgcttaggaacagcatgaaggaaattgagatgtgttttcttgacctgagttggagttcagtctaagggtgcgtatgtatttgcttccttgttggagaatcctaagtgaatgctctactagaaaggatcctgatgttttacattaaaagattcctccctatctacccccacccccacccccacggggccccgatttgttttttcctagggtggttaacatgagtttcacttgaaatcagagttacacctgggattatgacttggaattctttcttgttattacttttttttctttttcaagtaggttggctaattatatttacttgtggaaatgtggggactctatgctttttttgttaaaaaaaaaaaaaaaaaggttgtgcccctgctctccaactacatttcattatagaagtaatattaagaagttattttgtctgtctacatttatttaataatttgatcacaggatattgacatgtgtattaccctcagccactctgcaggaccagtgaggtagacactaggcaatggtgaatagggcccagctcctgacctcaatcagacgagatcgggcgcgttcagggtggtatggctgtagacatcctgacctcaatcaaatcaaattctcatagtagtggagaggaacatgggaatgcattatggaaagttaatgacatttagctcatcccctattgatgaacatctataaattatgatacatcataattatgccacaatactaagcagcatttcatttatgtgtgctaatatggaaaattcttcatatataattaaggtaaacaaacaaaaccaacatactaagcaaaactaccatctttgaaattaagaaaaagaactaaataaacaaattggtagatgtatatagttatgcatttttgaaagaaatcataaaaagtggtggatttaaaagaggtatttttatttttaacctttctatagtttgaatttactaattttttacatgtcctttttccattttttaattcatttttaatatcaaaggggtatctgcactgtaagattatagtgatatttttcttccttgtacctctttctaataaaaaatttcatcttatatgtagtacatagtaatctataaatataaaatacagtatgcaaagagctgtctcagaggaaagtgcaatactctggagccaaggaggagggaggaatgaggcaggatcagaaacagttcatcctggtcaataaataagattcttctaatttcaaaggtgcttcatcttagtaactttttccttggtgctttgccttttagccacacaagtttcgctagtctgttgctacatcaaccaactgatatttcttggaagtgctggtactttccaatttcttggtgtcaaaacattgccttcattcagcaccaataatgttccagccttttccccaaaaagtgaactaaatttaactgtcagtgaaaactttatgtcccgtctacttgaaacattaactttttccacttgaaacaatagcgttacattattccccttatggggcatggttgttccttttagaaccatctttttatatagggaaggaattatcagagaattgttacaatttttttaaatgatggtgttttaatctttaaaacagagaggagatcttgagatcactatttaggccgtaatacaatttgtcaaaaggtgatttcctctatgttgtttctagtcaaatagctgttctctgcttttatcgtcactgtggggcattttctttcttgtaaggctatttcacatagcacagaattatatataaaaccaaatataagcagtaatccattactgagggataaaattaggcatgtgcatgaaaattacattttttcaacgtatgctattttttatttatttcctctttttagtgtatattccctcaccagtttttggcctaaaggataggcgtaaacatgagcctgacacttataaatataatccaggtgatttgtttattattttaaaacaagccattattagaggggcagcatacattcttttaggagaactaactggtttcctagctttcggttttaattctaacctggcccagagaaccactgtaattatatttttgtgagtactcaatctttttgccccattccaaaatgataaagtcagtcataagaactgctcaaacttcattccctattcctgctgatggtaaagagggtagaaagtaagcagttggagaaagcgttcacttagatatcaaaagaactgattgtaactttgccaccaactaccacaaattagcaagcaattcgttaaacttttatttttattttccttactgacaaaatcaagagtttgaattaagaaaattgtatagttatatggcagacaggatctatacgccattcagcatgggattttattacaactaagaattacatacctagctacgccttgcttgttattgtacacaaaacataattaaatactaaacaggatgctaagagtcaaaagaaaatgtaaccaaatagcttcctttgccatatgcaggttttctaactccaaaatataataattctgtgttgtaaccttcaagtaatttttgccatgtaaattgtggttgaaattgaaagcttgccagctctatatctagaaatacatacatacatacacacatatgcatgggggcacacacacacacacatacacacatacacactctggtaggcatcagaagtctatcatgcatagggcacatgtggaaaagaaagtggacgtttcctaacaaaaccttttgcaaacatttcagaggacttattctgcaagaccttcctggatatgacaaacaaaatagtgttttgggataagtgaaaatgattaaaggcatgggttccagcatacagttagcttcagacacttatttctagcatttttccataaatattttttgttccaaatcagtataaactacttctgtctgcatttggaaggactgtggagtgttggagcaagtacaaaagcagttctaagtttttgttgcaaggctaccagttctcaacatcaggtctagatggccccagacgttcttaaagcattttgactaaatcttagcattgcatccactttcctaatttatattttcatttaacaaacatttgattaaaacttgtttttatccagagtaagtgaccgttgacttgttttccatgtgctagttcataatttggcagttggcatggggtgggaggtggggcatatatgcaaaccattgttttaaaactctgtggaattggatgtgatttctaagctaaaggacattctatgactgtagtgctggaggttgacatccattccatgctctacgaatgcctatctatgtctctattatagcagccattgtaatcttgagttttccttttacttggctttctccccttctagactgtgaccactttgccaggagcaaagtttagagtagtgccagtattagttggtattgaatacatgtgggtcaaaaaataaataaaagatggactgtgttaaaatgctcctgagtttcattatcatccttctattagtatcatgttttcatccattagtatgaacagctttttaatgtacaagtcacccagaatatcacacgaatagtttaggaaggaggtttcatttgtttcttttcttttctttttttgaggcagagcctcgctctgttgcccaggctggaatgcagtgagctctcttgcagtgagctccgcctccccggttcacgccattctcctgcctcagcctcccgagtagctgcaactacaggcgcccgccaccacgcccggctaattttttgtatttttagtagagacggggtttcaccgtgttagccaggatgttctcgatcttctgacctcgtgatcatttgtttcattttttcaattgagaaataatttacaacctcaaaatttttctttaaaggtagctcctggatcaaaaatttataacattttaacttttagtttttgagattcttttttaaagtcctttattttgtctactcttatactaagattttataaactcaccttgaataaactgcttctgttgtcgttagcttttcttctccatccagctcctcccactcttattttttcctgaagatttggaacctatctgaaatgaggaatttttaaatttaagagttaaagtaccagaccagtaatgttatagcaataaagaaatatttaaaaccatcaccacagtccaatacaaacactagaataacttaaataaattgaatgttaaaattaaaagtggtcagcttctgtaaggaaagcaggaattctgctgtcgatatcttagatgtcaatatcttctcatcaatagcatattaaagaacattttagtgacttatcaaactgcacgtattttaaattgtaaacagaaaatcaaaatacattctcataccttaattttgataagcaaaatctttgtcattgttttgtttgcttgcttaaaacaccaaatcctataagccatctgatcattatatcagtttatgcattgtatgttgcatgtttaatacaaagtttggaagactagaaatactccactaagcaagcaaacagtaattactcctttataattactgtgcaactttattgccatgtgttgttataattatattttaaatactccccatttgcatcatagaccataatgtcttctagcacattaaagtctgtggcttataatggcatcccacttccacaaagacctcttcttcatttagtctctattttaactactgttaaaagagactacatgaaagtaattggcaccataatcctacagtaaggaaattgtaagcaatatactatttctgtgctactgaagtctctaattattcagagtatttcatgtttaacatttaatatgcattcctctttcagttatggagccagtcataaccaaaacagttcttctcaaatcttaacatacacagaaatcacctggggatctggttaaaatatagattttgatatagttggtctggaaacgggcccaagagtctacatttctaacaagctcccaggtgatgagtccagtgctgctgggttcattgaccttactgtgagtaacatcactttcatgtattatctataactaagtgcaaaatgctgttaagtgtgcacacacacatacacattgcacacatacatacacacggcaaacttcactccaacctctcctatgatcagtttctaccctcagacctagaaataaattaatcctgtcaaaggatttatttaacacaaagagaaacagcattcaacctgtgaaagctggccaaatacacactagataatatcactctgagctgggagtcaaagagggcttccttgtcatttgccagatggaggggtgtgtgtgtgcatgtgtggtgggggcagttcggaaaagaaattccaggcagggaggaactgcccttagaagtgacgagagtgaaattagctaagtgtggcggcgtgtgcctatagtcccagatactcaggaggatgaggcaggagaatcacttgaacccaggaggcgcaggctgaagtgagctgagatccaagatcaagccactgcactccagcctgggagacagagcaagtctctgtctcaaaaaagaaaaaagaaaaaaaaaaaaaaggaagtgacagagtgtaaactattcagggatggaaggatactaataaagatatgatgaaggggaaaaattcttattttctaatcaaagaatttggattttatcttaaaggtatttaggaattacctaagaacaagacgattatgtgaattttagttcacctattctactaatgttttctctgccactctcaatgaaatatttctctttaggaaattaatctgaatttgactcctgaaatttaaggataatatggaaatatattcattgtttttgaaatagcacatttgaaaatgtacttggacacaggaaggggaacatcaaacaccggagcctgttgtggggtggggggagagggggagggatagcattaggagatacacctaatgtaaatgacgagttaatgggtgcagcacaccaacatggcacatgtatacatatgtatacatatgtaacaaacctgcacattgtgcacatgtaccctagaacttaaagtataataataaaaagaaaatgtatttctggaatttttttaaatgtatctagtaaaacattgtggctgtatctgtcttccattataatcatcttaaaattaacagtatataatcatcttaaaattaatagaatcagatgttttaacttagcaatgtcagtaaatataaataggtcattatcaatattcatagcctaactgcttatacagatcccccaaatatcagggtggctaaatttttagacctttaaaaaaattgtaaaatttatgaagacagtgcacaaagagatcttagttgaaagctaagaaaatctcaccctatgacttttaaattttctcttagtgttaaaaacaactatttgaaagttctctttacaataagggaaaatgttaaggtaggcttaaaatccagaatctcatactctttatatatttgatccttggcaatctagaacattgttatttggtaatatttgtttaagggatacctctgctaaatgtttttatgccagtcggtagaagaaatattagtgtaaataactcatttagagaattttattttatttatttaatacaaatgtttaaataagggaattgggaaagacctgcctttttggaatgtaattatagatacgtaattgttttagggagaggtaacaaaaggtagagatggtctcttttaatgaggaaagattttctggaacttagctttagcaacagtaattatttaacattttaatatgggatctggaaaagggaaaccccagtgaaatctattactatgtagatggctcaatagtttttctagtagtaaaatacaaccctgatggatttaaactgccagcagaacttttgcaattgagtggcaaggtaatagtaatagtactaatgatcagaaacaacagcaaaggaacagagagcattcatcataggcaattggaggttaacgcagataataataacataacatgcatcatacctaggagataatgaaagccaaattctggcaatgactcaggaaagggacctagtgctgtagtggccagatgacccaatgacaagctatagcaaacaagaaccattttagaaacacagatcttttccatcaacacatctttttgttgttgttgttgttgaagatagttgcaagttctgtatgttgacgaagcctctatggagttaaaatggaacagaactgatgaaaataaagcttaaacgttccaaactctctgacactgacacatgaccgggtttcacagttgggaactgggaagtggctgacagagattctaatcagtaataatctttgcagcaaacagattcagtatttatttagatataatacattctttaaaaaaaactttcacaatagctctatgaagtatttaacattatttccccattttatacataagaaaaatgagtcacagaaatgtaaaagaaaggaaggaaggaagggaagggaagggaagggaagggaaagggaaggggaaggggaagagaaggagggagggaggaaggagggaaggaaggaggaagagagagagaggaaggaaggaagagagagagaggaaggagggaaggaaggaagaaaggaaggaagggagggagggaggaaggaaggaagggaagggaaaggaaggggaaggggaaggagaaggagggagggaggaaggagggaaggaaggaaggaagagagagacgaaggaaggaagaaaggaagggagggagggagggaggaaggaaggaaggaaggaaggaaggaaatttgcctagtattttgtagctagcaagtaagggagccagacttcaaacccaggaagctggcacccttaacaattaagtgcccccaaagtatgtgttaaagcctatggaaatatgagcctatagaaactacctaaagagaagtcatactctagactattagaaccagggactatcctataaaccttataagaaccattgttaggggaccataaacaaccctgcttcaaagagtagaaatatgtttcataaaagccattacccaaagacgtataaaaggtaaaacttaaataaaaatagattaccatttacaacttggaaaagaaacccagaattttctgtagccactggtcaatgtgttcttacagccgtaaggcagaataaaaatctggaaattatcagagaaggttttaagaacaaaataagcaagttggtctctttttaaatataaatctgacattaacagaagccttatgatattaagggaaaactggtatgggaactaaggaagggagtgaaaacatgctcctcacctatgaattagacatccaagaggacaatcaagttcgatctcatgccatattgggtcactgatggcccatcatgcatggactgtaggactcacaaataaatctggacacaaaagttcttatgtatgggccaattctgcttatatggacacagtgcaaacaggtacgacaagatattttcttcctcaaggatgatacctagcagataaagactgatttctaattcagtattgttacaactgcaggtgtgtgacccgtagcgagccactaaaccattctgaatctcacttccttcactggtaaaatagggaaaaatattagttgcctcatagagttgtagtaaagattaaatgaatgatctatgtaaaatggaagtgcttgataaactttagtctattattaacaccaaatactaaaaaaaaaaaaaaaaaaaaaattcctcttcttggataacattccttggttaaaaaaagactatatttgagtagaaagaagcttctgactgttaagggtgatggatatgttcattatcttgacaatggtgatggtcacataggcatatgcatatatcaacactgacaaattgtatattgggaatatgtacagtttattttatgtcagttgactcaataaagctgttaaaaacaaacaacaaaaacttacctgtgggtgtaatgtgtgtgtctgtgaatgtagttgctaggaaaatttcttacctaacagaggcacacaaagctgccatccctcctcacaagaaattggaaccagtttctttacagcaagaaatgtaaggtgcttctagatttaccttttgtgagaaatttgtaccactgacagtgatgaactcatatgtcagcatgaccatcccattttaatacctgtatgtacctgaatctttaaaatggcaagagagaaaatatagagcaggatgagtttacatgtgatataaatacatagttttggaatctcacaggaaattatgttactcagagaatattgggatgcaatgattgcatttagcatttaggtttttcatctggaatcagaatttacagtacttataacataaagaattaggaatcagaatttacagtacttctaacataaaggcagtgactatctacagatattccatgatgcagtctctcttgtgtgattttcctggcttcacccaagtcactgaagtcagaggctcatcagagcagtcagtgtgaaaaaccacttgtgttcagtgaggcaatgatatttattgaatgctctctctatacagaactgtgtgctctgtatagggcagaaatgacattttgtttcttatttctcttggtcaatggtgacccctgtctctttgagtcattccctccagtactgataaacagagttgctgctaatagtgagctaaaaggatttgacaaaatatgactcccccttagagccaaatgattttcaaatatttatttttaggtacctgtttgattgtactctttttccactgttgattttggaaacaattttgaaattctcattaattccttaaaaatgtttaactttacccagataagtaaatgcaaggaatctagctggggtgggaatgggggagaatgggtgttggggaagttgtcagttatctattaagacaataatgccacatatcaattgtaacatcttagtggcatgaaacaataaagatttctttagcttacacattggtgtggtgggctcagtttatatcacctaggcttatatatttttttctgttgtgaactgcaagttaactctgtaccactaccgatcttggatgtgcgggttcacatgtctgggtggtggctggcattggatgatctagtatggccttggctggaatgttagcatgttaaggatgacgtacctttattcgcatctcatcctccagcaggctaacctgggcatgttcacatatccatgcagaggagcaaaagaagcaactctcaatacttaaacccatttcaagctcctggtcatgtctcatttgctaacatcccattggccaaagcaatcacatggggtcagacctagagtcagaatgagagggctccacaatattatatagcaagaggcaaggacacaggaattggtcaagaattagggcctttagtatcattaatctttagtaaaacatacttttcctaatgagtaacagttgtgcagggtggtcattttggttttcagactgtaaactgacaaattaatatttggttaattcaagcagataaactaagaaattaaccttcccagccatattaatgtattaaaaaagtttgtcaggccactttggctttcattttattcattcatttaaaaatatatttattgtgataacaagcagcaattttccagtcaagcagggatgtgaaggagaacatcagttctcaaagaataattttgccctgttgggttttaaaagattgtcattttccaatgtaattgttggaagagaagttcagacatcagttttggtcactttctcttgggaaatacatttacctgagtcatgtaggaccacatcaagcaatctgggactcacaagttatagccatatcctttggctatatttttatcatgtgggttcacttaacattataataattgttctccctgggattctgactagattttactggaaaattggagtgaagagtgttgggtggagcatcagcttctagccatttagaaattacaggggactaattttttaaaagctaatttgattgcagttagcaaaatgtctctcttttgagaaagaagctcctaatcatctttccaaaattgaatccttcagtttctacagtgcaaacacggttgctttgaggaagaaatatttatccacatataaataccgattatgaacacgtttctgacattactggaagggtcggtgcttgcctctttacttctaaaacaaattcacattctgcttcaactgattattttttcaacaatatttgttatattcttttatgatctgccagtacttttttgaagcccagttagttagaacagcggccaacagagctgagactaaaagggggccaaatatctcttcagaagcaagatgttacttcaaaagatactcattacaaagcactactgtgactcacataatcacttagtttttaagggggagttgttaatgtagaattggtttcttatcttcccagcccccagtgagcctttgctgtgcaaattcgctgatggaggacaaaagaagcgacagaatcaaagcaaatatacccagaatgggaggccttggcccagggaaggagaggtgagtcctgactgataacatttgctctgaaatttggcagtagatatccctcagaaggtggcaaggcagacgtatggtgccatgatgaaattgggtcccatggaacacccaatgtcttcaaaggggcaaatgagcagacccatgttaatgtgttctagatgaaattattgaggagtagaggatttcaaatttaacctcagttctgcactacagcaagtcttctgtctttaaccaaactcaaacctgaaaggaactcactgaaatacttatctacaaagaattgatttctatttgtgtaatagctataaaatgagggtataattacttaacaaaatattttcagtgaaatcaatagggaaagttgaatgtttgtgttttgaaacaggcagacaaaatttggctgtttttcattctgttattgagatgatttacttgcacatgtatgtatatttatgcatattcccatatgttcataaatgttttgatatctgtttatatatgtatatacacacacacacacacatatataaaataagatattgtcttggtcaaaaaagagggagaaaagttgatacatacagcattttgcttttcacaaggagaaggaaaagcactgaacagctcactatccatttaccctcaatacaaactggtaaaaaagccagtttatggatccagtgccacttaggaatgggttctttttgttacttttttgtaagaagacaaggaaaaggtgactgagcttccatgaggtcttttcattatttgtgaaatggaatagagttgtttgaatgacttgaaaaaatgctattttgtaccaaggccatactttcaagagaagagctttatttagtatttcattcaaagcacctacttcatccatttatcatttaagaagcattgtacttgatgtagcattttacactttcaatactgacagaacagtggtaaagaagaaaggaagctggaatttttctcagcaaatcctttagccttttttcagtttctgtttctaagaccattgtttgctttgagtgtttccatgcaggtctcaaaacccctcttaaaggttatagttatgttcaagtactatataaactgtaactcattacattaagacatgaaaaacagaatcatcactgagcatcaaaagctaataaaaaagataaagagttttaatattctcaactttagaaaggcagtgggtattacgttctaaaaaggaggtggagggggtgatccatgtgtttttagcatggagtccagtgcatcagcagataaccctattggcctcagaagacaactgatgcctgatagcactcattatcacatgtcccctaccaaacacccattatctaaaaagactcatttgacattttaaaatttggttggataaaatgcctgctgattagagatatctttgggtcacagactatcatcacaaagccccaagactcaattagcaacttggcattaatgacagaagattcagtttctgtctccttaaggaactataatattaccttcatacaatagatggcaattgcagcaagacacttcctctcactgtacatttcttgaaaatggaatcaataaagacaaaatgtagagagttacagctgccacctggctactgtatatagaatctaagactttgcttcaaagcatgaaaaatgctatatgtactatgatgtggaagcactgtggagttgagtttaggacccagagcaccttataatttaaacgtaggttttaaaggtatattcctaatctttgttttcaaaagttgatttttaagagctataaattttcctgttgatctatgaaaatcaagggaccatgataaaatttatctgtgaccaataaaatatatttcaaatatatatacacattgagagaagatagattaggcagagagatagcatgccctagaaatatgcttatcaaattttttggtttggggatgcacatattaatttgtacactttgattgtggtcttagaagtaaatacccaaagaatgttggataactgtgtgcccatcactttatattttttgcttccatttcccccttgcattttacttgctaaagtatattagcaagttgataaagttgtcatgatacacattaatcctatataagcaatatttaattaattttatatgccaggaaattctggttactgtatttgattctaagacacatgtttttgttgttgctgttttccacactttaaagcttctgaaattggttctcttagactaagtggtattttacaagataatatgcattttctcctgttaatcacttgagggcactacctacattgtcgggttaaggtctttgaccacactggtttcataaataaaagcactaaccaaagccaggatctgggtcagattcttaagggagggttttttgtttgtttgtttgtttgtttgaccccttccttcattcagtgtcatgactgagacaagtaactttctttggtgtctgtttttaatgtgtagttttgtttttcatttaccattatactaaggttggcaaaccaactttataaagagatcatttggggtgtttgtttttgcttgtttgtttgttttgatatatgaaacaatggtacacctttgaatccttttcttagataaaatgaaagatggtagtttagattatgctgctgtggaattgaagataatagcacagactgaggctaatgtttacttttcctctctcctaaaagatgagtaaaaatggtcatgtgaaagggatttctgacgaaattcttaggatacaaaaccaatagattacaagtattttagaagtaccatgcgcatgccaattgatagactaattaaaattttaatttactgtttaaagctgttttttcctcatggcattttgataaaaattttattagcaaagtttggctaaatgcacttctttatgaaaaaatctaatacagaaaacttcatacacagaaattagtataaattagcaagattttgaaatataaatatatgctagtggccatgttctacataagtgaaaaatgcaggaatattttaaaattattaactaatctttcaagagacaattggaactctgaataaaatgatcgagggatgggggctattaggctcttcttccttggtgttctacagttcttattgttttatttccttaagtagctgttctcaaactcttggtctctggatccctttatactcttaaaaattattacttacaacaaaataaataataacagaaattaactcatcatgtgctaataaaaacagtatattttattaaaatatattttttaaaacaaaggcaattttttgagaaaagtggtggacttttctatttttacaaatcgctttaatgtctggctcagtaaaaaatggccagatttgtgcatgtacttcagcattctctctttttctatactctgtcttgctttaaacatgtagagaaaaatctaccttcatctagataagtcatttaaaaagggagaaccctatagatcttctaatacgatcttaggaattcttggtcttcaggccacactttgagaaccactgtcctaaagaagctgaagccaagggcaaggctgatgttcacttccatatactagaaggaccatgcaacttgttggtatattaaaatatatcttatcatttggtaaatagacactgcccctaggccatcagtgcaactccacttccccttcctccccggtgcctcctccaggagcatcatgatccagcaagaatggggtactggctggcacagcaggatttttatacatgatgtaagggaggggtccagcttcaattttctgcatatggtgagccagttatcccaacaccatttattgaatagggggtcttttccccattgcttttgtcagttttgttgaagatcaaatagtcataggtatgcaaccttgtttctgggctctctattctgttccgttggtctatgtgcctatgtgtttttgtagcagcaccatgctcttttggttactatagccccgtggtatagtttgaagtcaggtaacatgatgcctccaactttgttctttctgcttaggattgccttggctattcaggctctttttttgttccatatgaattttaaaatagtttttttctagttctgtgaataatgtcattagtagtttgataggaatagcattgaaattgctttgggcagtatgaccattttaatgatattgagtcttcctatccatgaatatgggatatttttctatctgtttgtgtcttctgtgatttctttgcatagtgttttgtaattctcatcatagagacctttcacctccctagttagctgtatttctaggtattttattctttttgtggcaatcgtgaatgggattgccttcctgatttggctctcgacttggctgcagttggtctataggaatgctagtgatttttgtacgttgattttgtatcctgaaactctgctgaggttgtttatcagctgaaggagcttttgggctgagactatgggatttttttagatgtagaatcatgttgtctgcaaacagggatagtttgacttatcttcctatttggatgccctttatttctttctcttgcctgattgctctggctaggacttccaatactgtgttgaatagaagtgttgagagagggcatccttgtctggtactggtttttgagacgaatgcttctggcttttgcccattcagtatgatgttgactatgggtttttcataaatggctcttattattttgagctatgttccttcaaaaccttgtttattgagagtttttaagatgaagcaatgttgaaatttattgaaattcttttctgtatcatttgagataatcaagtgttttttgtctttagttctgtttatgtgattaattgcatttattaattgtcatgtgttgaaccaaccctgcatgccagtgatgaagcctacttgatcatggccttttttacagcatttggctgtcactagctgttattaatgctaatgtaaagtatgtgcttttgggcattcttagaagtgagggacagaagacacactccgtaaaatagcccccttgtctttagttgaatctgctcttaatggtgcatccagctcattaaacatttgaccagtcaccagtcagcatacttataaatatgaaaacttgacaatgcagtctgggaacacaacatttctattagctttgaaggcatatggggtgcaattgaattttataatactgaagagtggaaacttgacatttcagagacatagaattaaaccactggagataaaaataaggagaaactgaagcacaattcctagaaaatagtatatctaaagaattatttggaaaacctggtaataccgtctaggcttagaatatcttagatcattttccaaggtaagggcatcatctacatagtttatcactattttctttgtttataccacagtgcttggcaattcgttgtccaaatttttatgtttaagatgaccttgaaaaaaattaagatatgtctaccaacactgccaggttctgcaaatagtctttttaaccttaaactgaaggagattatttacatatgtgatcttgaaaagagtttttggccattatgatgcatgttagcacttgcaagttggttttcgtaattagcacaccagatatggttgtatttattttatgtgctttatctgcaatttagagagcaagctcaaggttaatggaacttctagtcttaaaataaaccttttttttggcacaagaatttgaattctcaataattcagcatgaaaactttcttatttagttaagtgttctattttaaaggtactaagcccaatatttactaacctatgatcactaaggataaaaggtaagtcatgtaaatccctgtactagtgtaagtttggattaatgtaattggtgatgagcttcagtcctctgcctagcctatgttctcaaggaatagggcagtataacatacttaggttcttagggcggggttggcagtgggaaatttaggaagggcttaaggctgggaagattacagcaagtaattacaagtggaaaagttggcaggaaatatccatgtaccatgattgggtctcctgacccattctccatggatcaagacaactatatgtggcacctaccaactgggagatttctggagttgttggtagtgtcctggccatcccagcctgccacaagattcagaattacccccactaatgtttaagcaacagtttacaacctccaggtaacatcaaactataactggaacctgaaagaatatgggtcaattagccaaattcctggaactctcctctatctagctgcccaggctcatcttagtagcaatctcaaagttgtatatttttcatcctacttaaccatgttatggtggggtttaacagtataggtactacatcattgactataagacaccattgattaaagatgaaatattactttaaacaccactaataaaagaaaaggaacttgacatactataaaatgctatcaattatcatttaaatcccaatttcacagatattaaaatgtgaaaaaaaaaacctgcatcttggaatctatgaaattcagccatttaaattgagataaaaacagatgaacctacataaaatatggtaacactgttttgtcttttttatggtatcaattaaggattaatttaactttggttttaatgacaaactcagattaaaacttttttttccaagattttgagatctttagatagctatattatattatacttttcttctgcttctcgtttagcctagcattttctgtgccatagtctttctcaggcttccagtcttagttctgatggcatctttctatcttgtccttctttattgccatatagggaaaaattctgcctgatagcactacgttagcaaaagccaaaaagaagaaagactgtgacgatatagtgcatgtaaataacaatattaagacccctttgatgttcttttctcaaacataaagaagttaattttctctgttctctgaccatttagctacatttaaaggataaatcccctgcatgttattggcttgatttttgaaaaacttcttgaagctgtcaaaaggacttttaatagtttttctcttatcctgattctaggccagtaatttcatgaagaagggcctccaggttttcagcttattctaattcctcctaggttcctgcctgtaatttggtttgagcccacatcatcaggaaggtctcttagcaatctcagtaataagcttgcttccctctatctctttgaccaatcaaaggctaaaaaaaattatctttagaagttcagctaagtcaagctgcagcttttccaaagtaaattttactaacaaaataggaaaaaaaaagcttcaaaatattttcaaataaaaattaaaagttcaaattcaaacatttctttaggtgaattattcatgtattaattcatttagctaacatttatagagcctctgcaatgtcccaaacactgggctagaaagaggcgatatcaagatgagcatgactagctgggagacacacatggcaaagcatggtcatattagcttccaccatgggtcatgggaggaggacaaaggcaatagttaatgccttcagtggcacctggagaaagagctggctttaagaggctatgacatcttatctgaggctgaaagaatagaatagaaatattcccacagaaagtaatggagaatttccagccaaaaaccacccctgcgaaggcccaggggtaatgctccagggcaaggcgagtgtatgtctgagtttggtaaagggtgaagtctagaggtgaaaaaaaaaagatgtggagaccaacaggtacaaaggcacttgatcatgagatttctatgggccagattttatcttaaggtaacaggatgctgctgaaaggaggaccataatgtggtcagatttgcctctcacaagagcaatcctcataacacaatggtgtgactgatggattggaaagaggttttgagcaaatataggagaagatattataccaacatatactcataaacaccgaaacaagagatgataacttgtaagaaggcagtaatcatgcattgaacttactagttaaacttgatgatatgtgtctggaattcaggatacaaacttgactttgagacaaacatttgggaatcaccaggaaataaataatagttgggataagaaagtgaatgtcaccactgtattgcagtaaaggagagagataaaaccctggccccctgagcactctggcatctcataggcagttgggtcaagtaacactaaagaagaaattgctttctgagaggtcagaacaaaaataaggggagaggatcacagaaaccaaagaagaaaaatacactggtcaaatgatgcaaatgaatgtaattattatttggaatcaaagtattccttggattcagaaattatgaaaatttaaagagtatagtgaggaccatttcacaggttgcttgcagccttttgtagaaccattagcccagattttactgtcttatctcagactgcatagaccttgggaatttccctatttatgatcttatttgtagttcatcttctcttcaagagagcaaataactgcacagtagcctaaggagcatccctttagcaggtgagagcagataactactgtacagggttgactgcctctcctggtagaaacaaaccattcagtagtctcctgactgtgccggagttgttccccggtaaaattctaccacttgactcttatgaaggtcagaaggtgatctgctcatatcccctttcagcaagtgaactaataaattgccctcagttttgctctaggcatattttttccgagaatagtttctcccttgacaggaagaaggttaaaaactctttctctggccaaaatattggcttaatgttggccatctagtaccgtggtcctcatcattcttggcattaggaactggttttgtagaagataagttttccgttgacaggggtgttggggagggggttggtttcagggtgaagctcttccacctcagatcgtcaggcattagttagattctcaaaaggagtgtgcaacctagatccctgtaatgtgcagttcacaatagggttcccaatccaatgagaatcgaatgcccctctgaaatgacaggaagcggatctcaggcggtagtgctcgcttgcctgctgctcacctcctgctgtgcagcccggttcctaacaggccatggatggctactggtttgcggccccagggttggagacccctgatctagtaggtttctgatcattgatgatttttattggtttctctgaatatcttagttatatacacttttagtatcacataggagaccctcaatttctcagccagggtgtagccatttgaatttctgaattcttagtggtttccactactagaaacactatatcatttcccctgaattttctttctttattactgacctcctgcccattctcaccttgacccttctggttgtagcaatcccattctgtcctacttttgtattctactgacccagcaaagctaaatgcaccctgacattttcaagcttacttctgaatcaggcctctgacctacattactttcataaatgatatgcccttttttccctcttaaaaattttaagacaagtcatagaagacataatatgctttataaattaaaggatcccctcaccccacattatggaaatagtattacaaagaacttttaaaactcaaaagtcatgcctgtaattccagtgctttgggaggcaaaagcaggaggatcacttgaggccaggagtttgaaaacaacttgggtaacacagtgagaccccatctctacaaaaaaaaatttaaataaaattagctgggcttaatggtgcacaccagtagtcccagctactgaggaggctgaggcaggaggattgctagagcccaggagtttgaagttacagtgagctatactgtactccaacctgggcaacagagtgagaacctgtgtctaaaatatttaaagtaaaaataaaaataagtcaaaacaatgcatgaaaggcaaaaaaaaaagttattgttatactacgccagtattttaacattttgttgaaattcatttttagttttatttccagtcagagatatttaaaatatttgctttcaacacatattgtacacataattttgtatcgtgacttgttcactaaaggtttctaagtagaaatactagcaaataaatatgagcaaagttaagtgaaattttacttcagtagcagtacctagatgtttatgtcatcataattttaagcccctttttatacataatttttaattaacttattttttattgaatttttaatcttaacaagtgaacagttgtaaatattgttaaaattggctgcaagaaataaacactttaaatataacatccagaaaacaatattatatttgtgtgtattagcttcttggactcaacttgtgctaattcagtatacaatatttaataaaatattcaacattttctatacatttattaaagtgttgttttaattatgattgtagaagactataaatctttataattatttgtttgtaatttacccaattatgtatcaggccagacctcaagaaaaggagaaatattaggctaaaatatcaatgttttatttgtccaggaacttcagtctgtatcagtttgtataaattttgctgcccccaattttttgatccccatttatcttgcagtctaaaaatactttcaacaatggttaaaaaaaaaaaataattcaggccatcatcattttggctttgttacagtcaatgattctctgctcctcaactaagaccaagcattgcagtctaggtaatctttctgaagtagcaatgcctggttcctaatgtgtactctttaagcagtatttccacaattattacctcttgatataatgtaatcatttacagttaagaatatcaaataactatctcctaagtcaactgatttgtctcaatgaatttattaaaaataaagatgcatttgttaataataaaaatcccctaattattccaatataccattgaaaatcttttcttctaaaatatttagctcctatagtaaaaatcctgtctggaagatctaaagtgtcctattttggctgaaatactaaattaaaacttaactgttgttgaaaaatgacaaaaataccccactttattttaaataaactatgaatgtctctattacacaaacaatggaaacctgaaaaatggaaaatatttctgaatctaataactcctttttgaaaataagtgacaattaaacatcacttttctacatacatggtgtgacattttcattttgttccaaggtattttactttttgtgtgattcttgagtttgtaaacatgccataatatttagtgattgtataatgatgatttcatggtcctagcttagtataaaggtagctcaacagagcagcaaaatcaatttccttttttcctttgtggaaagagacaaaaggaaattgaatgcaaagtttgcattaagaccatattagaattatgactcaacaatctattacacatgaagtggaaaccaggtgtatccaagtgttagttattgtgctattatattcagccaatgggttaagttcaaacaaccctttgcttaacccatgccatgttgttacccacaatgttccaaatgcatatgacctgacactatctcttgttgtctcctcttgccaaaggtactcagaggcaggactgtccctaggcaaaatcgtgaagtaggtgaatcttgtattcattcccgacccttttgcaatgaaaatctcaccttagattctctccacctccctctcccaaggtacctactctagttactcattcctctggatttaccctctgttttccagggagctcatgctaactcctgttccccaatcactctttaagtatataatgtccccgctctgaaatactcagtagctcccccaagaggagctgggcaatcaagatcctccatccttaccttttgagtcttatttcccactctcccctttacatgttctactgaaaacagctcactcacctttccatttttatttacacacctttttccatagtactcctttttgcctgagctggccttgacctctcatctccatctgtggaaattctcctcatctttcagggctctgctcagctgtacttccctacatgccttatctgatcacccccagcctctctcatctgcaccccatccataccactcatatggcacttaacacatattgctttgtattataatatttatgtatgtgtcttgtctccaggcactgtgctgggcgctttacaaacgtaatctcttttaaatttcacaacaatctgatgaggtaggtattattaaaccatttaaaaattgaggaaactcaggctcaaataggttaaataatttgcccaaagtcacactgctacaaagtaacagagctagaacttgaactcaggtctgtcttatttcaaaacatgatttccactgtaccctactgatgtcaattcctttccatcttctgaaagataggatgggggtttaagatgaagaaggaggtcaacatagattttttccttaacaaatgtgtgttgaagaaagacagtttattgataattactgtattcctagctagaattgattggttagctagaatctatgaggaattcaagtaaaatgcaagaaaaaattcttaagtggccagaacaaacaagcatggcataaaaagaatgttcaagacagtttgtaattcaggaggggctagatagcattggtctctttgagcaccgtaggaaaataagtacaaggaaaaagaaataaatgtgcagttgactagggaaggcttcctataagtccccaggacttaaacaatttgagataattagtagactgaatatatgactatcatcctaaatctctcatgcactaataatatctcgattgaatgtaaagcccacctgttttattctgcctgcagtgccgcatcttggataaattaggggagagaagcttagtgttcctaagagggaaatctaattccaaatggacagcttttacgactgccctttcctgtgcctgagaccagagagtttcagctaagtcctagacagctccattctgtgttcagcctaaggccaacctccagccagtcatgtggcagagccttcatcctgggaagaatttaaacttagaatctttgttcatcttgacaccactatcttcttgcctctcccatggcaaaaaaacaaaaaccttttttcttttctgctgtcgtattctattctcatttctcagtcccccagcttgtcatattatcagttgcatatttctttaacatgaatgagattcataaatttaaagaggtcatgcagttatcattaaacatgtgttctcagtgcacctctgttaacttctgacagtcatttcaattctgtttgcaaactccgtttcaatttatgtatgctccctttataccaattccattcacatgtgactctacacttttgttcctcataccaatcttcataataatttaaaatttagtatttatggaaatactgcatgcaatctaagcttgaaagcagcaggctatactgtacatcaggccctctgttagaagattgagaattttcatgtcaattataagctaaatttgaggatttcaatgagcccaacaagaaaaccatcctcaaccacaatggaaaaataaaaaaactcaaacaggcaaggtattttgttttctttaaaatgtctatggtttcttatcctttacaaaactcttcatagctcatccactttttttctaactttttattttgaagaatttatagactcacaggaagttacaaaataaatgtacagtgatgtcctgtttaccttttactaagtttctcccaattgttatattttaagtaattatagtacactatcaaagccaggacattgatgttgatctaattcagttttaaattcgaaaaaagaaaaaaaaatctaccctaaagataacttacttgaacagttttaaattccattcaacattgtaagcattgtaagtattaaccatgctgacagtcctggtaaacaaaggatggtatgcccatatggccacagagaaactttccccatattgttggatattgatactcaggtctaatttaattcttgggccaatgtcatagctgaggaatggaaaggagcccatatcagaagacttgggttgaaatctggttctgcctccaaatgtgtgaccttgagcaagtcacttgacctttccaagcttcagtgtcttcatctataaaatggagaaaatactcctcctgcctacttcataggattgttgtgaggatcaaatgtgatgatgtacatgaaggaacaaggtagactgtgaatcagcactcatgaagtttatattcttttcagaaactatatccagttatagagaagtgtactttttcagaggtggtcttattcctaaaaacaaaacataactacctccttattagccatgtgttctagaattttcttcatatgtaaatgacctcccctttctatcactcttgttaagataagaaatagcaatatatcaaacaagcactctggactcattacctacaaaccccttaggcatatggtctatttttaaataaatacttttttaaacattttcttctttaagattgaatgcatttttagtagcttttatttttatcctaactgcaggattcgttcttacttttttatcatgccatgagatgtacaataggtgttcttgacaatagtgtgaaattataacaatgtgaggttagacagtggatgttttaagaagtaaaaatggaaatcatccaagctgcattgtttcttggtatgtctgaatatataatataaactcccaactcactggtatattctggtttgtggatagtaaaaatgctagtcttggcagtaagcatagagatatacataggagaaaataaacttagatcatggaaagtaatgataagagtctttgtgtgtactaaatgttttgggcaccacaataaaaacgttaagatttgttttcttccctcttcatcctatatacaggctggcatggctttgacctatgaccccacagctgccatacagaatgggtaagtagatcacattttctctattttaattgtgaatagatctttgagctctgaatcaacatcaaagaaaaatgttaaaatttgttttgcttttgttttacatccttaaacacaaagtttaaaccaagcatttttcatcattatagtttttttcatcctataaattattctgacctcccattctcacaatgcctctgcccacattaaaccctgttctctctctctctctctctctctctctctctctctctctctctctctccccccccgctccctccctccctccctctttctctgtctttggagaacaggtaaagctaggctgagagaataataactctagagttagctttcaaacactttttggtgtgtgcccaagtcaatttattctttctttctggtgatcaggggaatggtaatggaggaaagtcaagttggtaactcaggtgattgcatcttcattttcataagcatctggaaatttgtatccacctacttagaacaagtcatatagcttaaacttcctcctctgaaaaacaagtgtgaaactacatggtgtggcaactctaaaattctgtgacttctaaatatctttcattgaaactttcttcttacttcctaatgtctttgcttaggctgtcttgtaattgacaataattattctttggttggttgcttatttcctgtcactgtcttttattttggaattctccaaggctttcagttgtctgtctttcagtctcattataaaagcctcattgaagatcaacatagagggtagaatgaattaaacttcattttctattttgtcagttgcctctaaagaaaatctgtgggatattgaaagtatttaaataattacctcttattcttatattattcattcaggcagtcatatagtcagtcattcaacaaacatccagtaagtatcccaggcacaatgctatgttctatagatttaaaaaaacaatgtatgatatgagaccctttccttcaagaggctcacaatctactcgtccatgaaaaagtaaacattaatggtagactagggtaggagtatagtcctttgtccttgggttgattaaaatttccctctagaagtgaaaattaaggatatcttttcatatatccaataggcatttacttatttccaacaaaattctataaactgggtgtgtagaaagaagtaaagatatggagaagaaagtcctctagaattatattacgtagttggagataaataattaactcacaaaggaaaaaataaggcattatatattaagtgatagtgactgaaaatagatgttataatggaaaggaatgacatttattgaacacatattttgtgcaaagtactttgtaatttagtggcacatggtttcaaatgaatacatgtgattacaattataaatttatattggaaatttatacaaaggaaaatagaaacaatagttcaaaaaatacctgtatgtccagtaattggattcaataaatattcatattttataatattttacatgcatgcatatgtatgcacatgtgtgtaatatatacatatgtatctacctatctagagtatgtattatgtatgtatatacatatctacctgtctatagtatttatctatgtatctacttgtgaaaagtaccttgttgcccaaggctctatgccaaggattggggatgcagcagtgacccagacataacttgtttttgcatttatgaaacttacattgttaaggatagaaataaaataaaaattagcttttatatataattatgtagtcaattattaaaattgtgtttagcatttttaattaaaaagatagtttttgctggaccatatcaaagtaaaatttaaacatcataatatttctaacttcttacatcttcgaaaataaagacattagtcacatgataaaaatgtcatcacaaaaaataaaatcagtagtaatttcaaaatatcatctactatccagattatttttcaactttgctcagttgccccaaaatgtattttacagctggatgattccgaagcaaaatcaaaaagtcatatcaaaatagcttatatggattatttcatttatttattatattcttttgggtgagtgttaatatcccatttacagataagaaaatgaggccatgtagtccgaggtagagctgggaatcgaatgccagtctgtaacactaaatagagcctgctgtctttgtccagctaggacaaagggaaggctatatggaagcaatgagatttggcatagattatccaggatgacttagtttatcaaggatagacatagggaaagatgcttatggagaaagtggactgctatgaatggaagtggaatttgtagagattaacaagccaacaagttttactggggtgaaagtttcttgtgaaggaattttataagtttaaaaagtttttttgttgtcagatttggaagttcaagtatttggtttttacttcataagcctggggagtaattattatttttttttttagcaacagagtggtgtaatataaataatgaagactatattggagcaggaaaatcctcttagtaggaagcatcattaagaggatattaaaatagtacagttatagaagtgtgagagtttgttctggagtggccaatgtatgaatggaagaaagaaaccaaaaggagagacaacctgaagaaacttttcaatcatgcattaagcaagtggccatcaaagaatcctacattcagggttctccatcaagggctggggacatactggtgaataagacacacccagtctttactcatctacatagtagcaaaggaaatcaacattaaaagtattttattacttatataccataagcacccattggtgaactgcagggtgttatgaattgtctagtcttgcttgagtggttaaaacttctctaaacaagcgattccttgagctgagctctgacaacatgtaatgaccgaccgaaactggatgttatatttgatggcaaaagagagaaacaaaagtgaccctgtaccatcagcagaaagacaaggaaataaagtgaagaaagatgatgatatggttaggctttgtgtccccacccaaatctcatctctaattgtcatcctcataatccccatgtgtcaagagagaaaccaggtggaggtaatagaatcatgagggtggtttcccccatgctattctcatgatagtgagttctcacaagatctgatggttttataagaggctcatccccctttgcttggcactgattccttcctgctgccttgtggagaaggtatcttgcttccccttcaccttctgccatgactgtacatttcctgaggcctccccaaccgtgctgaactgtgagtcaattaaacctctattcctttataaattacccagtttcaggcagttctttatagtggtatgaaaacagactaatgtagatgatatgctcaatttcaaacatgcctgattaatgtctcactaagactcactaagtctcactaaaacaaactaagactcattaagacaaaaaaagatcaagagtcagtggtaaatgtggaactgaagttagggaatgataacttgttatgcatgattttaatcagtcattctctaatgcgcaatttaaaattctacaaagacataatttcccaaatactcacccttaattgttacaaatcgacatagaaaataaatcgaggtttcaactgctaatctgagaaatcaaaggtgaactttgggcagtgcaattttcaaggcagtgaggacagcctagaacacagtgagcatttctctttttttctcaaaatctccacctcatatttcaggttaccactcctggaccctattggagttgctgcaggtacatccgttaaccttaaatcacctgaaatatgaaatgtctttatttataccttatattaacaatataacattgtatcctttaaactatttgaacagttgcaaaaatggttcaccctctgccactacccacttagacatttacaacaatgaatattttcctcaagaaacacattttagttaagaagctaaagatatccaaatcaagagattttatatactattatattatctcatattatattatctaatctcatatctctaatatcatgtaataaataattttagtccattgaaattgggcatattatctttcctcactttattttcttgtcttgctgctaatggtagcaccagtccctctcttcagtacttcctgtgcaccaaataatcctacccacttttactaatcttactctggtcttttctcactttctttcttctctctagttgctctcgtctacctctcttgctttctggaaagtaagactcccaagtctatacttcaagtgtgtaactagcttcagagatcaatgacctgtggttctagcttactaggtactgctactatgtcattgtcccaaactgaggtcattatcctcatcaatattttgtaatacaaactacacaaattcaaacaaaacgcacatatcaaattttgttttcctctgttttaaattctctaaatccatttaggttatgatctccactcctcaggactctttcttatcctacattcttcacaataaaactagtcattaagatgtgcaatctgtatccgatgtatatcttcaacctagcccttcctccgtgccactggttgaatttattcattaccatttcctacctacactaagctttttactccctttaatatacctccccccacgaacaattttcacattaatttttgaataatttttaagcaaatgtaactacagaaatcacctacctacctggtttaaagtattacgtggcctttactaactacagaacaacactcaaacttccccagatagtacgaacagaacttcataatttggttactgcaactgaactggaccgtctgtgattcttggaacatcccatgctactttgtacttctgtgtcttgttgaacgtggaattctgtctgcctgagttcccatatggtaaaactcactccccatggccccaccaccacacacatacacatgcacacacaccatatagatatgggtatcagtaactacgtaataatatactttttaaaaatattgttttcatttcaagaacatcattaaatcataccaggcagagctagttatgctattagtcataagaaaaacagtttaagcaatggttaagagtgaaaacttcagaatcatcctgcccagggatgcatccaaactctgtcatttaccagatgtgcaattatggacccattgtccatactttagtttcttcctctgtgaaataaagataataatatcagtacctttcataagactttgtaaagattaaaggaacctggtgtggtacaagataatcatcagtgtaaatgttgacattattgttgccctatgtttggcctttccatgataagtttgacaattagtcttttttattgtgtacttcttgatacccatatctataatagttccctgctagaatataactcaatgaagacaggcaccatatcttattcattttcatagactgtttaacccagtattgtgaatgctaaatcaggactaggaaatgtgacagatgacatctgcttggctccagcaagttgacatcagggaaaccatcctcctccccagccatcaagtcagtctgtccccatgtaacatcttaacctaattctcctaaaatattacctctagtttcacccaaagcagccaaactacccatgagtttctctgtcctgagtgaaagatggaattttggaaggcttggactatgcattgtgttgttggcaacaaggagatagaaattttacattcagaaattaaagaaataggaggattatagctaattgatcttatttatttgatacttctttatagaaattatgtttaaactgttttgcttatctttggtttcattacctttatatggtaacattcccagtagtaggacaccagtagaacaaccatttctatgcatgtgagatgtcacacaaatatatactgtttcttgagttaacattgggacatgccttttagaggtgtggaagctgatttaaacaacttactcaacataccaaggagcctaacataagtgtccataataaagtatattattcctcattcgcattgctctatgcaatttagccgtcaaatataactcagagataagtaacctaacagaaagataaatattactgtagagaagagcctggtcccattttacatagaacacagggtatccaaagatgtagttgcagcttactccaatccagttattattgttcaacgttgcttaatgctgattcacttgaggtcaataagcttaacaatttttttcaactttctatctatagtacagtctaaaattagaaaaaagaaaatgctcacgtcatattaggaacaatggacatatatacaattgtaataggagatagaatacaaaactattgcgattaaaccacaaagtactataagatatatgtatatattaacttttatatgtataaaatgtttctgaaggagtacacaagaaagcatgatggtgattctctgggaagggccaacacagtagtgggaaatagggtgagacggaaacttatctttcaccgtttacgtttttatttatttttttttcaaaaagaaaaataaagcaaattatttccataggaccgtggaggagaggcagttgtgttctgatgaggaattgggaaggcttcttgctagtgcagtgacatgagcttttcctcttggagaggtgccacatcctagctaaatgacatattttgtgatcctatggaatcctgtaacagtaaactaagccatagggcttttttagtatcttaagcaagtatgtgtctgagttgtagctagtaggttaaattgtgtaaagagttaaacggtctgtatctcataaccttcacattaatacagaaacatgacactgaaataaaggcccccgaagttagcttgattgttagctaaggaagaacaaacagttcataactacaccatggtgaatctgtgctgtttgcatttaggcagtagaaaatgtcagttctgtcatctgcctgaatctatccaagttatcacttaaaaattagatcaatatcacttttctctaggactctgaagggtagagagaagaagcatctgtgtcacaacagaaaagtaaaaatcgtagtactttttactgtaggctaacttacaagaataaaaatgtccattctcttagagctatgtggtaaaactctaatttgtttttactattgccctattgctcttttagcaatccaatatgaaattccatccctttgaaagatgagcaggggaggtgggaaatattccctcccatattcaaaatctcatctttcctgtgcccttttcattgggagttgctgtataaaagcctcttggattgtttttatttgaataaaatatattcttgggggagacgtgaaaaagaatgttttctatagcattggtttgctggctgctttatgtgggcatttggtattaagcaatatggaaaccttatcttattacactaggaaaggaatctaatgtgaaggatacgttggtattacaataaaaatgaccaataccttattaatcttgtactattgttttaccctgaggatagtatttatggttccagccctaacaatattgcctgtggacatgaaacacaagccagtgctgtttatttcaatatgtaaataggatttgctttttgtacagtaaaaaaaattaaaccctggggttattgatatattaatgttatttttattgtcagtgaaataagattttaccatattactactgaccgccaaatcccctgaagatgacttttctgcaggcaaaataatgtcctattagtgacctagatttgcattttctggatttctggaggacggttgcctttaatgccaaagaaccaagtgattctttgcatttcttgaaaatactaagtgtttcaaaggctagcttagacttccgtggatcacacttagttaacgtctcttagccactttgcatttaatattttgttcatgtgaaagaaaccccagaagtaactagctcatgtgcttcagcaaggtgtctcaatcttcatgctactaccgttcaggactcgataatgtttgtataggagctgttctatgcattgtagcatgtttagcagcatcccaggcctttatccactagatgccggtagctcccccctctcctccagttgcgataacaaaaaatgtctccagacattgccaaatgtctgctggagagcaaaatcacctgtggcttagaaccactgggttcagtgtaaaagaggcacttggtatatacataatgctgtgaatcttggtgaagaagtaaacttttttaacaggaaaataacttgttaagcaactcattcccattttctgtaacaacatttgcaaggcataatgcataatgcatatattaccaaatacaaaaaacataaattcatatgtttagaattaccttattttgttattctgcctagaaagttccccagtagcatgacatctctgcttgaagtatgtatgtatgtatgtatgtatgtatgtatgtatgtatgtatttatttatttatttatttatttttaatgtgatgcctgtgtgaaaatgttttcaaaccctgaccatggcagggactgaaaaaaagctaagagatttggaaacacattctgcagttccctccttggagtctggccttgtgtattttctttagataggtacctctaagcctcagatgcaacagtagcctctcctgtcatggtttaagcaggggtttcctgtaaattcatctggtgtatgtttggacttgagaagagcttatttcagaataccagaattaggagatcaagacggtatgccgattctgttcttcccagaacattttcagttctaaatgactctctgacttgagtggcagtattggaatttgctgggaagtatgaaatgtaattcttgtttgatggataggattagagcagataggacaaaaatgcattaaattttcccccaagggttccttttgctagtatccgtttacttggctgctttctttatgtttctgttctctgttttccccatagaatttcctgtaaactttgcctgtcaatccaatctttattgctttcatttttaatactccaattggcgcattttacaaagtcgaccagccacgctaaaatgtaatgtgtggtttgctttgtctgtataagaggctgaacctggatttctaccagaagttaaaccactgcatggcatatgaggaagactgtttattgagtggccttgggtgcctcacgtgtcattatgagccccaaatactgttcactgccttacaaataagatctgtcaaatataagacctagaaggaattttcaaatgcaaaccttgatttttcatagaaaaggactgtcttttttctagtttctaatgcccctgcatgcttagaaatttggtatattatttaagcttccacttagcatttaatatgtgatattggaccatcttctctgggctctcattcctcagcttcctacctctttcagggacccttctcctatggtcctgccaccctggtattgatcttcctgtatggtaatcactactgaattccataagctgctctgcatttattcattcattcattcaacatagagttatcaagtatctactatctcccaggctctgttctaggcaacaatactgatatacactcaacccccttggagctgacattctagaatgagaaatgtcaataaatacattgtattcgtcagttcaggctgccataacaaagtggcttgattgatttggtggcttaaacacaaaaatttatctttcctcagttctgaatggtagaaattcaagatcaatgtagccgattctggtaaaggctctcttcccctgattgtagatggctgccatctttttcatttgtttgtttgtttgtttgttttttgagaaaaggtctcactcttgcccaggctggagtgcagtagcacattcatggctcactgtagcctcaatctcctggacttaaatgatcttcccacttcacctcccaagtagaagggaatacagacatgcaccaccatgcccagctaatttttgtatttttgtagagatggggtctcaccatgttgttcagactggtctcaaactcctggggctaccatcttgttatgtccttatatggcctttcctcagtgtgtgcgtgtgagagagcctgagtgagctgtctgaagtatcttcttaaaagaacactaatcctatttcattaaggccccacgcttatgtcctcatttaaccccaattacttccttagacaccccatctccaaagacaaccacagtaggggttagagcttcagcaggtaaatttagggggtcacaaacattcagtccataacatataaaaataattttttaaattaccacttcagatagtgataagagaactatacaaatatatcaagagaaaaggatagaaaacaattgggacagacatggcagttgctaatttagctacaatcctctctgaaaaagggacagttgagtgagaccagaaatgaagaagagacagccttattaaactttggagaagtgagcattttaggtagagagaatttcaagttcagtgtagagatgagagtgagaatgatgagatcaggacagaagaaagtcagtttggttcaatcctagtcagctatggagaaagggttaagaaaacagtatcacagaagtaggcaatagcctgattgtgctagccagtgcaaagagtgaacatttgttcacattgcaatggaaagcctatggagagctttaggctgattaatacacaaatacagtacaatttaagtgactaaatagagaaactcaaaggggtattttagagtgttattcgtctttgttagacaaagtaaatgttcaataattttttaaaatggaaagatgaatgttttcttacatagtaattatcttttttaaaaaaatcagatttattagatgtaatttacatacagtatattcactctctttagtgtacagttctatgattctgacaaacacatacaatcatgtaaccaccaccacaatcaagatgtagaacaggtatctcccctcctcaaattccctcgtgctcatttggaatcaaccccttcctccaccccgctatagttttgccttttccctagtgtgatataaatgaaattatatagtacatacccttttgagtctgacgtcttccatttagcaaaatttacttgagattcatcatgttgaatgtttcagtagttattttctttttattgctaagttgtgttccattgtattgatgtgccacagtttattaattcagaggaaggacatttgggttgtttccagtttggggcaagcatgaataaagtctgtataaacatttggattaaagtttttccataaacaaaagtttttatttaattttggttagtatggagcattgctgggccatagggaaagtgtatgtttaactttaaaagaaactgcaaagctgttttccaaaatgggtgtaatgttttgctttcccactaacattgaatgagaattccactttctctgcatccttgtcagctgttagtattgtctttaaaaaaaaaaacaactttgtattttctctttttgtcattatatcaggtgtatagtcagtggcttcttttaaacgtcacaactataaatttaagggtctggtgagtatggatagtaagaatgtaatgtatgatgggataatttttttcatccacactatttttttttacccaaaagagtatgatcttatcaaatcattgttaagagttaaagtacatttaagactataatttaagtacatttaagactatatttttgcttgaagacttttacagaaaataagcttaaagaatttattccttgaatcctgacaaccttgaattctagtcctcccatatttaatgggagtctcatgggatgctttcttagaaagacaactcatgaaaatctctatttaaaatatcactgacccctgaggttggatgaagtctttgtcccataaattccaagctcagtcatactattaaaaaaaaaacaaaacatagtaattgagttttgctaaaaatccaataaagcaaaagaattataccattatttctcacatgcatttttccaacctatcctcacatcgctgacatactccatctcaggcaacctggttttgtctgttctgtggctcgccactctaaccttttgcttaccagtaagacataggggaaacacaatttaaattctgctgaaggatttgagcattcagtaactcatcgactctacagtatagtctgagcagaaatggacatttcactgattttcacatccagaagctaccctttaatagatctccaggagaatcatccctcctctgatttgtgaattcctgatcttgtagcattctacagttgttcaatgagaggctctggaggactagaaaattcagtgctttttacagagtctataggagcctatcacataggttcagtgtctctgccagtgccttgacttaatccagaaaacattcccattccaacctcgatacaaattgtcctgttgcttctcttttcatggagaaagtattttctgcatgagggcatggacctatgcctaacacaaaatatccataactttctaggaactggtctttatttcctgacagaagacatagatgcaattcctgtatttgtaacatcagtcacttttgtaaagcttggtgctttcattttgtctttctttcaaagccttttaaacaacactcatggcttttctcctcctgctagtgggaggcagtattaaacttatctggcataagaaagattttgtgcagctaattttatcagatgactccaagtcatttcattcggagctacttatttctcttagtggaatcaaataatgtaaatctcctagacgttcttgttaatggttggtggaaaaacgtgcgggtggaaatatgtctttcccataggtacttgatagcatttgattagaggccaggcatgtagcagcttcgtgaatcttcctttttgttttctgtttgcagattttattcttcaccgtacagtattgcaaccaaccgcatgattccacagacatctatcacgccattcattgctgcttcccctgtctccacataccaggtatgtccaatttacctgcaccttaggagatatctttcttgcagtaatacagtatttagaggcaaaaaggacacagtagaatgaaaagaaaaaaattctcatacactttaatcacatcttaatgtaataatactcaagttatgagttagcctatactttcaagagcctgtttgcatcaattcactggataataaaatccactatgcttttcattcttcctgctgagttttcatgattatgctactgtccaaccaaccttaatacagctctctcaccactgggaaattattttgtttgttgtctgttactttgtttgttcatgttccctattgtgtcttttctaaaagcacatttctagcaattccttcactcactccaggatattttatcactgtcatctcattttgtcatggttgtcctggtaaagctacacagatagatgttaaatcatacttcccaagaaacagaagaaattatcaaagtggtaaaaagttgttcgtattccctgctcttatttcattctcagttccagagagaccaaaagagacctcaggggttccgcatgttggaatgctggaaagtctgagactcaatgtgtgtcctcaactagatattatagccagttaattccaagtacataggtcgattaaaatagtcacacttctccctcaaacaatactccttgttttattcctctgagttattacgtatgtgatattaatctcctctctacctaatattgttcttcaaacagttcttccaattctaattagaaaacgcctatatatatgctgcacgtagaaagtgtctagtgtcatttcttaaaagtttggagggagaaagagaaagagagaatgcaagcgtgtgtatgcatgtgcttcttgaattttgcagctggtgggggtggatgttatataatgagtaaaactgtaatgatactgatactattaattcagtgaagttttgccttgttcagtcactatatacttcatttcaggatatcccagctgtcagagaatcaaacttaagactatgtgcacttttccttaactgattccccccaaagcagatcattttctttctttttctgcactcagattcttgaaacatatccgtgggcaaatggaatagattttcatttgaattacattagagggtctctgaatggctgatttcttaattgcctttccttggcatgaggctatgtgcaggttctgttcagtttttgttcttcctgcaggcctgcctggttgtaatgtgcgtgtgtgtgtgtgtgtgtgtgtgtgtgtgtgtttcctttttttttctaatcttggcctctgttccagccaagaccacccattaagccacagtgtagagcactttggtgacatgaataaaatattcactgaagagtgattttacttgggagggctcataagtggaatttaactctagctcccttttctcaaaagaagagattacagcaatgatcgatgttgttgattctcacctttcaccaggttttttcaatccaaagtgttttggcaattctgtgtgtgtgagtatataaaaaaaatcttctgagttctccacgtgacattcagcttatacaggctgactttttcatttgtctgacacatggtacatttaagaatagttggctggctgacatactcatttttatgtgttataccaattaccatgagcgaaaataattacaaacttgcttaacttgggttaaacctaaataactgccccaaatttttggtttatctctttagctcttaccacaacttttaccacttggacatatttctaaaatgggatcacttgagcatttgaagttacaactgatgacagaaaaagagaaagtcttagcagtcaactcttgcttccttcattacttgccaggacatccctgaaagctgatcttcaaatggtctctgaggcctcctaaaactttagcgttcaacatcaacctcaaaatatgctccaagacccagcctgggccatgtgggcactgaagtcagctccactgataggggaagttgctttaccttttaccttgtttcagggaccaatttaatcaagtccaagaattccctttttacccttggttttgagcacgaattaactgtaaagtcaggtggactccactttcttatgacctagtgtgactccactgaacacaagaaccaagttctctctatgattgctttgtgctaataaatgctgtttgatgcataggtccagagtacttcatggatgcctcatccgccatacgttatgcaaccaacagtaagtgttctcagtcacctgaggctaatatttctattatccaagtacaagcttttggaatgcatagaagctttggggtaaagcttttgttataatatgtaactcgttcaggcagccatattctccagataaaaagctgttcctgaaattctacaaaagcatgtacaatagatagctagagatcaacatagacatagaatcagataaagagagagggtgaaaaagcaagagagtgagagagagagagagagtgcctggaaactttattagaagaaatagcaatcaaccattcaagctgagtctaccatttcttatgcatgaggaatttctgctttatgcaggaactcagaactccggacaattaaatttattctacaaggaaactctttgtttcccttctctttctgatatgcttttctttctttggccacagtctgatatgccttagggacaatttggagtatcatagacaagttttgacttgaagcaatatatttcaaatatgaaggtagttgtctgctaatagatgaatttatatagatagatggcaaggtgtgtaaatattttcatgttaattaactatagcagttttctttttctatagtggaaattttctctctgcaaaatattcaaattctcttttttacttgctagatttcccattttatggcacaatattacatcaattccaagtgaaaagtatgacgtattacattagaatctagactgaaggctaatgattgcatttatctttgcctaagtcttccagggtttctagctctatagaagtgcgagatagagatttcaatagcaacacactcatgagggtgtgaggcaggggaaagagccctagactggaagttgtgtgacaaggtctctggtgactcttctgggtatgctctctgtgcatttgtttccttttctgacactatatacttaatagtgcttttgtgaggatcaaatgagagatcacatgtaaaagacaatgtaaaaaagtatacatgctatgcattattattatcattgtcctcattattattgaatgtgttcattatacaaggaagaagcagtgctaaattttaacccctttagaagataaatgtaagtaagttagtatacattaaacaccagggagctaaatacgcagacatccatttcctgaactcagaaaattagagaatctggctttcatatctgagcagggtccattttatttttttaaataaggaacttttcatgttgctccaaacattttgatagttttttatttaaagaataaaatatatgtagtttaccacagcagaactttgtaccatattttgcaaatccctttatttactattatttacacaccttgagggctttctgagttcatctagtctatgttctataaatcataccactatgcaacaaatccaggctacacttttctgtccaagtcataaggtaaaattcagtttgtgctgccaaagcaatacatagcatagcaaagactgagccaacggaggaaaaggaaagaagtcctgccaagttctcaaaaggagactttctggaaggaaacaaccaccttctaaaaaatgtgttcatccgtaaagcactaatactaacttagtcctcatactgagttttaacaccatctctttgtggccaaaaggagtgcacatctggcaaaatctgaatattttaccagatgtcaaactatgtaagattcttcagtacttccagatctattaggggcagggaagatggttgtatgggactttatttcagctgtcactcaggacttttacaaagcttttcacacacctccttttccaccccagtacagcttcagcctcgtgttcgcatgtattatttctgtgtgtgtattattagtgtgtgtgtacatgtgtgtgtgtactttaatttgtccttttagattttccttgctgtggctactactcagagctgatatcgtatcacctcccatgactaaattatgcatcgtgcttgagcttaggccactaggtttaaatgtaatgtttatggctggggtggattcctggaaaaatagaagtggctgggccacacaccactttgctatcttttagatggagaaaagggcaaaacagtatcatggaaacacagagtttgtaccatcaatcatttccctgtaataatcttgttggctgtccatattacataagtaactttacccaactggctttaattttatcatcaaagtgaggttaagtcaccctatgatactaaaatataaaaatattcaagccatcttagacaacaaatcaaaaaacctgaatctgagaagaattaatgaggaacttgatgattaacaacatggattcttggttgagctcattaggacaggaaacccattttagcaagggggtattgagctatttacataaactttctgagccacagtttctcatctgtaacatggacataataatacccaaataattatgttttgttcattaaatgaaataaggcattaaagctcttaaaataatttctggaaaagagcactcaataaattattattatttaattatattagtagacttctcattatgctttaaattatcccagttttatcaaatgagtgttgttataagcagaaagttgaaagtaagcaactttgttgagaatcatctatttctaccacattcatagtgctaattaccttactttgctaatgagtttggtggagaaactctgtggctataaacaagacaaattgcttacattggtacttatttcacttactttctaaacattcaacacctaaaacttaaaaaaaaatgcccattgagaatctccttttttcagtaactggagactaccttacaaataaattcaaggtgtcaaaatctatgtctcaaatatattgcccataattccaatttgcttgcaacttttcttctctgtcacattttctctttcctcactttatgataatttcatgcatgaggtttcattgtacaggaatatacctcccctatcaccaagcgtgtacactgattcctgagttggagccagatgtattgcctaggctagaagcccttcgggttctctctcaggcttgacttaaagggctctaatgtctcaatctggtttgtatctgaaaacagtgcttccgtaaagttctaaagtagagcgcaatgaccttgatctctttgctaaggaggatgaatgggtaaactggaggggcaacaactggtaagagagaaatgaaatggcacagagaactaaagggaacagtaaaggcatgaaagaagaatagaaaacataagcatataatttctaaagtttgccatttaagtttgtttctttgtacatttaattttctaagtaatgtgcttgtagatttagaaaaaaaatactctgggaagaaaggatagatgtctctttgcatggattataattctgatgttttggaaagaaaagagatttctgttactggaccctgggaacttattggatctcctggaaagctgtcaaaccccacgtagagaatcaagagcatttctgtttgccttttgttattgttcacctgaatagactctgagaagacagcactgttagactaaattaggaattcccttttttctgagaagtaaaaatgctgactttgtcaatgtagttggttatttgcttctgcttctcagcacagacgtctatactgcatgctgaaatctcaccattgcactaacagaattttaatagttgatggattgcaccaaatacctactctacagagcagtatgttacattgcaatgtcatatgaatacacagttgaaattgctgtgttccaatacattggatattttgttacatctgttattactgacaaggagaaaagatgataattttcaagaggaagcagagttccactttcttaaactttatttaagctcatttgaagcataaatcttctgttcttgatatgggtagtgttatatcatctcaaggagaaaggtcagctttcattttgacttaattacaaattggttatctaattacagtattctaagaaatgcaagatgcccttattgaatcaatacatgatttgttgccatggcaacaaatggcaaaaaagttgcaagcaaataaaaaattataatcgttatgattaatgaaccctgagttttcagctaaagagaaaatataaacttcttctttacaaccaggctgtttaagaagccccagaatacttaatttggtcattctttgcccttaaacatgtaaggcctaaggcctagttttagagttgtgtccttcaattttgtaggtgtgtgttttgagaaggcattatcaccaaatttgccctaattactgtagaaaatagtcctggctttgctaccgttaaatataacttcaaaattttacggtaatttttcaaatataatctcagcaactttagtaaaataactttaaacaatgaaatgcaaggcttataattcaaaagaagtgtatagagtataaaagattttccacctaggatcccttcattcatcatttctattctccggaaatacacattgtaaacaaaatcagatatttctatccagtcaattttatatgcatatgaaattatatatttgcatgtgtgtaaatgtgtatttttaatatagaaacaatattactctacaaatgttgtattatgatttgctttatttttcctcaataataaaatgttctggatgtcaataaatatgagccatatatagatctatatcaattttgctaacagctccattgtcactactgtataaatgcaccaaaaggtgtactttcttgaaaactcaagacagtaatattacaccctagtgagaaaacgtctgtcagataagttgctgacacaaaagatatttacattttaaaatttgatatacattattttcaaattgccttttagatagcagtttttctttctccataacctcaattaaaagcaggtaatctcaagttttaaatattttgttaatgtggtaaatgtctcactcatattttattttcatttctgaatcctatgagttgagttgattttcacgtgtttattgactaattttgttttctttatctctgaacttcaagttggtttgctttgcttagttttcttttgaggtactgatcttttcttatttataaaagatcttattacagttagtaagtttatagtgtcatagataatttaaatattatctcagttgactttaaattttaattgtatatttgtcatgcagatttttggtatttatgtattcaaatgtatcagtctttcttttagaacaagggtcagcaaactttttccgtaaaaagccaaacagtaaatattttctgttttgtgagctatatggtctgtgtcacacctactcaattctatggtttattgtgaaagcatccatagacaatacataatgaatgggtgtgccttgagttccaataaaactatatttacagaaataggtatggccacatttgactcacagcctatattttgacaaccccagctttagagcatctgtattccatgcaaaataccttaatcactatagatttaaaatgccatatgttttcttactatgcttatagtaaattttgtttaaaaatgttgttacctttgaagtttattttatagcatgagatgagattaagattcaaaatttcatttttttgattttttttcccccaaacatggaaccaattgccataacaaattttaccaaagaaaccctctatatttcgtcctctggcataaattttatgccaatatttatcacataataaaatctttttatctttgtatctgttttccaaatgctcttctgtcctgcttctctatttcctttgagcattgctctattttgactactataactgacaataccttaatcagaggtgtccaatattttggcttccctgggccacattggaagaaaaattgtcttaggccacacataacatacactaaaactaatgatagctgatgagctaaaataaataaataagtcttataatattttaagaaagatcgtgaatttgtgtggggtcacattcaaagccgttgtgggctgcatgcagccagtgggccacatgttggggaaacttgccttataaactgataggaaatgtccacaatatttttttcattgtttctcaaaaatttttctagctattttacattttcagatgaactttaatgcattttatgaagttaaaaatgtactaaaatttcaaattatatattgacttatgggaaatttaagaatatgacatatttacaacattgaatttttctatacaagaaaaagaacttttcgtctacccaagaattcttttatgtattttggatcacttaatagagtatcaggtttccgccatatgtattctatacattgcttaatgttttcctggcatcttagtatttttgttattatatgttttagttttttgctgtggctataacaaagtagcacagactgtgtaatttataaagaaaataagtctatatagctcacaattctggaggatggaaagtccaagagcttgatacaggcagctggtgagggccatcttgttatgtcataacatggcagaagacatcacctggcaagaaggcaaaaacaagagagccagagagagcttccttttctaacaaagctattcccacaaatctaattccatggcaacattaatccattcatgaggacacagctgacattaatccattcatgaggacacaacacttatttctaatgtgtaagttttgtaacacatgaaataaatattcttcggcattgcaattataaaaattttattatattttctcattgatcactttggtgtataaaaatgtatatactaattttattcatttaattttaaaaatctattaattgttcaaaagtattgctgaaatttagaatatatacataagttaaaatatgcatataaaatacccatttcctcttacccaaagattagtacagttaatatctaatgttacatgtttccagatgtttttctgtatttatatcaatatctaccaacttatctacatctacaaacatgcatgcatacaatatacccattatatatatcatatgtatgtgtatataccatttaccaaaatgatatcagtcaaatgacatcacacaatatgtgctattttcagtgaatattttccatttttcccagttgagaaattttttatcatctctcatcaaattttcccaattgagcaaaaatgttatttacactggtttacccaatccaggaagcaatcagtgaccacatattatatttggttattgggtcatttaaggctcttttaatctggcagtcttttttcccttcctgttcatggttagctgtcctgccatgtatcccactcttgcaaaatgtttggttgattcttcatgatgctgtttagccttttcttctatctcatatatgaaacaatttttgtaaccagctatctttctgaattccctcattgttttcaatcgaatatttaattcattctcagcttttccaggtcatcaaaaataatataattttccacctgattttaaatctttatatttcataattcattttctggccaaatggctttggaatgtatcctttgacttatttcttatcataatggatatgccactatgaattattttttaatttaggtgtagatgttgaacttaatcaaagtttttttgaaactattgatattattttccttttgccaattttattgtattaatatatttgtaattaattgtatcataatttttaatattttcctaaggtagaatcattctgccatcaactccatttggttatgatatatccctgttaaaaatatacttccggattatacttgtgaatagtttattatcttggcatcagtttttattaataaaattagtaagctatttttgtcaggtttgaatattcaattaacaaaggctttataaagttaatttggaataattcctttttctctaattgcagaaacaattttaaatagcattaaaaaaatctctttttggagattataaaatcttcatacccaagactatcttagttttggggaagagatgcatttattttaccaaatccagtttaaaaaataatctattactccagtcagacatgttctcaggaggctaaaactttataatctatttaagaatttgttaaggttggcccggtgtggtgactcaagcctgtaaccccagcacttggagaggccaaggcaggcagattgcttgaactcgggagtttgagaccagcctggggcaacatggcaaaaccttgtccctacaaaaaatacaaaaaaattagccaggcatggtggtgcatgcctatagtcccagctacttgggaagctgaggtgggaggattgtttgaggatagaagctcaaggctacagtaagccaagatcacaccactgtactccagcctgagcaacaaaacaagaccttgtctcaaaaaaaaaaacaaacaaacagaatttgttaataccatgtatgatcatgatcatgaagaactctgactgttgcatagttgatagtcatgttgctgaatgatcaaatcaattggattgtgaaatgccacggtcttaacaaaattagcattatcttttgctccatgactagttgttgataattagatcataggccatatagttcttaagttaaatgtagtacaaagtaaaaataatcagttgccaactgcctaataaggaatttttaggtatgagcaagttgtaaatcaataatttgtaatttttaagaatgtatagagtttttaatgcccttgattgtcataaaacttgaggaatattttcctcacatgctcgcttgattcagtctttctttcccttagcccttagctataccaatcattgactcctcgtcttataacattgagaaacttgggttcaatgaaaaaaatcaacaaataataaaaacaaatattcttgagcatcaaatatgtgcatgatatttttctagatattattggaaatggaggagagaaaataagaaataatttgtcctcaagacttgaaatataattgtagaaaaacattatatgctcaggataatttaattgaaaaggtacagttgaaaatttgtcaaaattttagtaattatataacctaaaaaataaagaagcctctgtgaacagttaaggacagagaagaacaatgacataaagatgaccttaaaggatgggtgatgtttgtggggctaaaatgaaaaaagagaacattttaagtgaaaataatacacaaaaagtatgggaggagagtctcaagttatttcaaaggggactacggggggagcaaatagcctgccttaagtgaaatgtttatattagagaacgagggaaatatttggttggaaagttaaattgctacgtattgaagtacaactttcacgcagtcaaatctggcagactttcctacacattttttattagcttgacaatcccagtactattgttcagaatttaagtttactttgaaaaatgtaaaacagaaagagtaagttatgtcactgatgtgtgcgtaaaagtaataatatgcagtggagtaatgtatgaatcaattataaatagaaaaaaataaattctgctacattatgaaatgccattgtgcaaagtctttgtatataaagtcattttatattcctaaataattttggaggtaatgtttatcttccaagtagagttcctgaaggcttcctgctgtctgagatccctgcctcctaagcacaggagtgtctaggggcagtggtgagtctagaatcttttgaaatacaaaaaatatgctttaatacattttttaaattctcagataatggtggttggaagctgccaagtgctaggcaccaacacatctccagagtacatagggatgcatctattaatagatggccactgtttctatacccagtaacgtaaaaattgtcccaactgaagtattctagctctgttactgtgggagtatgcggggcatgtgtgtggtatgtgtgcatgtggcctacctttctgcatgtggttttctgttattttactaacaacctttaaaatgaaagactagctcaagacataatgtatcactttttagaacagcaggcacagcattctggacatgacacaattgacagctgctaagaagaaaaatttcaatcatacatgatctccagtgtgtccttggatagtatttagaatttcttcattacttcatcattagtaaagcagagtatcacagctttgccagttccttcataaagatgtagatgatgttacttccttaatagctatttaacatattaaatataattcaaatagaaataatgttaaatatccaatctattaaattcttatttcctaaagaaagaaaatatgcagctaaaataaagtccttgtcagactttctagaaaacagcaagttaccagggcgacaatcatatagaggtagggtagatcatttactttataaatgttaccagggtaacagaaactactcgtggaaatcactgaaggatttaggatgagagtacagatagaccatggaactatttgttctttcatagcacattggaacaaaatgtccaaacatatttaaaacttttaacacttatgtgaagtatttgggtattcattaaatagatgatcagaaacgggttcacatattgagagtattctcaaatgtgaagagtacatctcaaatgtaaatcaaaagatattatttttgatttcttactgctcagtatgtcattgggatactttattttactctgaattttgactttgctagattagttctagagaacctagttatttctacctaggtgctatgtctgcaatttaggatcatggttaatggtgttgattagcatgaggcttgagttttataggtcaaccaattagggtgtaggagggagggaagtggttaatggagagaaagggaaaaactatacatatacatatatatgtatacgtatatgtatataattttcatgtgtgtgtttgtgtatggcgtgtacggattaatcaggtttgcttaaagaattatggagtttagagttagatttttcaaaatgataacacaaatacaagtaaaatgcctttaaacttttctactgcctaagaagaagcttaccaaagataggaattaaacgtacatttttctccctgttttagaacaattggtttccctcccaataagactctgtcagaaaacaaataattctaatatgttcatctatggttaacagttaaggtatgtgcaaagtctataagcagtaaagaggaggaagttactcactgtggagggagtagaggaataagaacaaggcttcacagaggaggtaactcctgaacttggttttgaaaactaaaaggagttttttagaccaacaagtgttgggtgtcaggcaggaagggtgctctgagcaaagtgatcagtagattgtaggcagggttttggtcctattcaccatgtgctgcagctggtgaacatctaagagaaagcaaggtatttttacaggctaccaggtgcctctaacactggggcatatgcatgacatttgtgtgcccttcaacagttctgccacagaaggtatcacttaatcatgattagggctgttgtcctatattccattaaacatggcatcttctcctagagttccgtttgcatttctaggcaaagcctcctcaccaatatccgatgtgccctttcacaagttctccactcagagttgagtgtaatatgcagagaatgttattgatattacttgggtatcataaagtaatcattatagcctctgcacaaggctaattagtcctaattatctgaataccccaggtgaaagtgagatttctactcccctcagaaccccaagaatgcgtagtgtctcatcatttgactgtcaacaaatgcttcgttgctaagttattcaaacaataaagtaagatgatagagattctaagaaaaaataccagaacttatatgtctacatgagtttcttttttctatgtgatgaaattactttgggaggccttttccattgatgccatcttagactaggacattttaaaaatttattctttgggaataattttcagagataatttattaatcatacaagtaaaacaagttcatcaggttatattcacatgatagaaaaatggagaaacacatacataatagctagatagatagatagatagataaatagatgatagaatgggtggatagatgatgaatgaatggatggagggaaggatggatgcagggatgcggatggatgaatggatggatgggtggtcagacagacagaatataggtaatagatatcctgggacatgacactagttcttctttcccaactacagtataattttattatttgagagtttattccatatagttcgcaatatttctcccgttctattttgttctaaataaatatttgataataagttacactttatagactatttctgcattggcaaatattaagacacaagcttccaggtgccgttagacaaggatactgacaaaggtttctgagaaaattaaagacgtgcatcttctctgaaatcaaacccaacttattagggaaaatgatgctaatattaaatttgtctttgtaagtttgatcattaaatattgtcattgtcagtaaggaggtgtgttaaaaacaatttaggaaaatttctcttatgttcataatgtagtattctaattccttttcagttgcagatttgtttatatcagctgaaacaactgtgttattcagcgtagtgtcttaattggcagttacatctgtagagagaaacattttcttgtggacatttcttttattaactctcaataaaagccaagcacatgttaactttcaattttctgaagaaatgtatagggcaactacattaatattcttcaggtatgtaagtttcttataacctatcttgatataagaatgactcagtaaatccaattggctgacatgtggcttatttggtgtttatttagtctgagccaggatgttattaaatttataccatctgatttatagtttcacctaggtacaggctattttacctctcatggaaaagatggcaagattgttcagtttgtgccagaattttccttaataaatgtcttcaaagctctcacaggagcccaagcatgtacacagttgggatctagtagttctgtgctgttgagtgcttgagaggcaaatttcatctaaaatattgagggcaggcataagacctcttggctatcatcactaggtggctcataaagtactcatgattttaacagtactagactctgatgcacttgccaagatgaatcaggtgtaaaatgtactccgtggcagcaaacggaactgatagaatagaactatttgatgtggaccatgagaatttaaaagtatctgcataaattgatgatttggcatcagataaagctgatatcaaaccattctatcttacaataattactcaatatgttcagcagactctgaaatctgcacttgagaaatgacagaaaaactatatcatcagcagagaaaacatcttcttgctgacctaggaaggcatacaaatagttcagttggcgtcacactgtttatgcataatattttacaaattagggtggtacttgttcccttttatatcacttaacataagtataatttcattgcacataactgaggagaaatagtagaaacaagctgagaaaactgaaagcaaattccaagaaagaggattagtcctcatctatgttaaaaagaacattgtgctcttggctttattttcttatttagcatagagaaaatcaagctaattatcaacttgggttctgaataataaccttaaaacttctattgagaagagaaaccttttatcaaagagttattcttaaacggttcttaatcaatacacattagaaccatttctgcataacaatgttgtatattaaaaatcaattcttactttccgataaaggcttttatcttgtcttgtatctctaagtattttcaatcaatactgaaaaaatcattatgcttccaagtttgtgttacatgatacatgtctaaatactcagattctgatatcacactccaaaataatctaactttctgagatgcatatatgaaatttatttcaaggaagtgtttatattatacatggcatgaactgatgaatgattgatggatactacatacacattactgtccatatatgctgaaagctgacctccattatagatattatttaaccaaaagactgacatatacatataatacaaatgtgtgtttatatgaggttattcagagttacatttaaagactgaacactgttgagatttgtggtattaattagtaaggaagagaatatggtggatgcatgggtcaaaactgactcaggaaatttcagcctaggtggctaggtagaaagtggggtccttaaactgaattaggatgtgtaagagaaggcataagttgaggatcagggatatatagttccttttgggcatgttgacttttcaaggccagataaagattttcaatatgtacctccaaatacaggtttgccacccaagaagggtagtaataaacttatgagtcatttattcctgctggagagaatagatgagatttctagcaattcgctcacttttcatagtaattaccatgcttgatctatgcaatagctagtgttgtgcatacgctgaggttaccttaaatttactagtcttatatgtactaaattaaatgcttgcatatgccccttacaagcaagattgtttagcaacccaattatgctttttcttatacctatactgttatggctaattatgtattgtattacatatgtctttttgaattaatcaaatgtatatgcacttgatgtttcctcttagggaactgaccacagtgataagttaggaaaatagagatacttcaaattagaagaaatcttaggagcccccaatgaagtctagcagttgatgtaaaggtttcagaaattgtcctgtgtatccatgaaaagctgtttcatttccattttgcaaacatttcaggaaacttttttttattaaattgtatttcttccatagccactagcccagctagtggaagaacaacaaaattggaaaagcacagcaacaagcctctgcctagtaaaaaccaagaaagcaataaacctttgccaagcctataagaaaaatttaaaagtccaccgtttatttatcttgttgtttagatatatctgtctcattgttaagtcattgtgaatgcagggatttataaaccctacactattatcactggagggttcccactgcttttagaatagagtgttcctaaaaaaaaaaaaatccatttcttttactttattgacaagaatagattatttcaggctttgctggataatcccatctttggcctttggggctttaaaccgtgtttttctctaacgttctggttgatgctggtaatgagaaccagttttactgatcatagaagtatgagctcagagtgactcactaattccaatgtgtttccaatggccaacttgaaaaagctacatagggggatgtgagagctaaattactgaagaccatcatgttttcctgtggggtttttccatgccctgaatatgttatacatgctttttgttggtgttttcttctctgttctatttgacattttaaagagcagaagtttaaagtaagtttcttaagaatccgtaacagtatgcccgtatctccagacaaatgtttacaaattggattgtggctcaaagatttaactttccttcatgtctttttctaaatacaaagttcaaaccgaaattgtcaagagtgaggattcattgacagacaatcagcaggaggtccttttagtggaatattacctgtgatacaaaaggattaaacatttcaaatataaacctttaatctgtgctatctaattactgacatctgaaccagtatcaaggaatttgtcactttttcacttttgtaattctaacaaagaaaagaagcaagaaacgtaattctgcatctggaaaaaacttctaatgcaaaagcatgtagctttagtcttttctcttgagatggactaggatatgttccctgtatttctgatttgtaaagattcagcaaggcagctctgttactgcaatcacccttgcttatgaagttatgtagacagtcccatgtaaatcagaatggtccaaccatttgatcctgtccatttctattacacatggtcaggcatatgatgagaaatgttctggctaacacaatttcatcttataactgtcctagaaaatgaaataaattgttacagcattggtttcctagcagagccaaaattatgcaaggaggaaagcccttctacttttcctcatatccctgtactctctctgataaatctttctctctttccccctctccatttacttttggtgctatacagattcaatttattagacaattactaaattacctcatattattgcttaaagtgtatcttctcttctttaatttgttaagtttaataatctccagtgaatatccattaaagagcatatgctttttcccccattttgaattgttaaaagtcattagaactaggattttgagccaatctgaaatcagctagatattccttgtattgctttttttagaaaacttacttattgactgttcaggggaaggacatatttgtcctaaagcaggctgttaattatcatgaaaacttacctattggctgttcaggggaagcacatatttgtcctaaagcaggctcttaattatcacatcagtctagccaatattgtgatggaatactgaaagtaaaggagaaccaaaaatatgtgggttgtatttccagaaaaatatatgttataagagaatacgaaacatgtggattgtatttccagaaaaaaatgtatgtgtatttgaaaattaaagattccttaggggaagaaaaacttgttttaaattttattaatctcaaggtatttaaaaatcctctgaaagaattttaaaggctgcaaattataattatcatgtaattaattaattcctgaaatgtttttagcagaatcaagaacatttctgttgcctggaccttggaagaatgacagcaatgaaaaagttcatattatttgccagtgtttttcccttaacactgaaaatgttaaattgctctatagttagtgacttattggaaaaacgaaaccagagtcattcattcctctattcattcaacatacattttttgggtgtctgctatgtgccaggcactgccattctatattcagttagaatacaaaaccaaaccaaaaaaagatcctctcttcatggaatgtatcttccagcaggggaaaaataatttaaaaactaaaaatgctatggcaaatgatgttaaatatttggagccagattttggtaaaaatagcaagcaggtgtaatttgtcttttagaaccccagccattattttcaacatcttttcttcccacttggcgatgtccttccttcaagacgcttagatgttccaaaaggtcattctttctctcttttgctttttcatttaaacaacatttaaagagaacccactatgtaccagatatgtgctgcaccatattcagagatttaatgcagtataaattatgtatagtccctgtctttatgaaacttccagtgtattggggaagagagaaatcaaatcagtattttaaggaataagaaattaaactggccatacattctattaaagaaagattcatgggactctaatctcatgcatgtgtgtgtgtgtgcatgcatttggtgggattctcttagagagggtcatgggaggcagaaaacaaccgtcaactcccactaaactaatagtggatgcttctcccaaaacctctcctgaaaaatttgatctggttattagcatcttggggtaaatgaagttatcagtagacttaagtgtgtgcaatatttttcctattactttgtaacaaaacgtttgtgaaccttctagaaaattccaggcatcagcaagaagttcattggtcttttaggtttggagtcttctatgctttggaataatgtcctccttattcagattacagagaagtccttcactctgcattttcatgaggcaattatataatattgtatatactatcacaaaagattaacctgaatataacaggataatgtatttatggatgaaggaagtgaagctcagagaggttaattgtcatcactaatatcacacaagttggtggcagagctgggacaggtatgtttcaattcagttaacaccaactctatttcattatatctggcttgatttttttcattaaattttgatatgtcaggttatataatttaacctagagtaaatcaagttggcagattaataaaaaattattattggattcttctgtatatgaaagacaaaatattagtatgttatctatgtcctttaatgccaatcacattagcatatgaagtaagatattttttaatattttagcaatcctatcattatatcttaagtggaaaggagttttatgatttagctaaaagctttgattttgacagacttgttcatccaaatactatcataatttaattctttgtgtcctaaggttagttaaaacctttgatctgacaggcacatgcatccaaatgtaccgtaatttaattctttttgtctcaaagttatgttatgttgggtgatatgtctgaggtaaatatgccttatttttaatgttcataatcactgaataagacccaccttaatgttataaatattgtagcgctatttcaggttatcagattaatgatactgtttgcactttataaaaagtagattagataactatgagaaaattctatgtaagtatctaaaactatatgctaacattcttttcaatttctacacgtaagatagtttattgttgcagcatataattaattttgagcattatacaacatttttatttaattttttaagatgagactttttttcaaaaccctacatattaagtctaaaagatcaaagaactctgaatcaaacccaaattgaatagtttcttctaaagtaataatattttgtcattttccttatattagatattatctacttgtaaaactaaaaagttataaaaacaagcaaaaagctttatcttttttctttttatatatgcttgaattatttttaaaatgagaaaacaatttttaataaaggtggaacatttcctactcttttaaagagtttttcctgattaaattttaaaactacttaggaaattttgcttataatcctgcatttatgtaatggcattgagaataatttgccaaacacagaccttataatactacagaaacaaatccagagagctttactgaccagctactgactcactaaatgaaagaaaaagaccattcccattgaaaaataatatcaatattgaattatccatccatggcatgggggaatacagcatctcttccaggaagtcagagatggacaggtaaaatgaagagccagaaaaagaatttctcataaaagaaagtagagaaattaagctttcctggaggagaaatgcagctgttcgagctgtggaatttcaatgcatgcagacctcacatctatctcatatataggtgtgtatacactcgcttcatgtgaactttgtgaagtcaatcattgctccatttgctaatcccagtttcaatttttgtcagctgtccctctatattttcagtgtaaatccctgtctctttgtaattataaccaaaacatacatgtgtttaatcacctctctatcttggacaatttttgttttaatacttgggatgccttcatggtgtaggcctagggaatcctgccttgaactacattcaaggggcaggaattctagctgcggattccatttccctgtaaaattatgcagccctggctgcataatgctgtcactgcctgaagcagctgctcctgctgctttcagcattgtacattgtcaacttttctgtcacttcattcacaaactttgctcccacattgttcacataatcatctctttgcttcttcctacacccagattttaaggaaaataattatgaaataatttggtagatataatatgattttagagtagtaactccagaactctttagaaaagccagttgttcccttattgatctctctactttttttttaacgtacttaggaaaaaattgtcgcatgactatttaccgcaggtctgactcaagggaaaggtcatgcatggcagtaataagaagcaagatcctcacagacatgctgaaaattagccacatggggttataatcaaaccagatcaagaaaggtgactgagaccaaataaaatgaaatgtgaattgtcattcacttttgctggtaagttttgaaatttgaaattgaccagcaaatttcctactcctcttgtgtctataaactgaaaaactgggaagttcatttattctttgactactagtaattttgtagtatgagtaaattggaaagtatgattactgttcttcacaatgtaaaggtttaaaagaatgccaaactaagcactgcattttattgttgttttccaaagccacaggtaaataaaaagttttctgtttttctgaaatttttgcatactactactttcatccaaaaaacaatgtcctaaatagatgatttaaccatgtgagttcacactatagctgtgtcactaggatggggtgaaatcatcatttcatatttggatatatccttggaatataattttttttaactttgacaactaatttcctgattcgttaaagtccctaatgaatatacataaaatagttaacttaaatacctcagataggcaggtcatggtggctgatgcctgtaatcccagcactttggaaggtggaggcaggcagatctcgaggtcaggagatcgagaccatcctggctaacatggcgaaaccccgtctctactaaaaatacaaaaaattagccaggtgtggtggcacgtggtctcaaaaaaaaaaaaaaaaaaacctcagatatgattataaaccagtgaagctttaatatttttaattaagtttgaattgtgtacatttgggggtgccgtgtaaaaaatacattttaaaaggaaggtcttataccgaggccattggatattaatatttgttgggtctagcctatgaagaaatcatggaattataatttgactttttgttttggtttgctgttgttgttttgagatggagtttcactcttgttgctcaggctggagtgcagtggcgtgatctcagctcactgtaacctctccctcccaggttcaagtgattctcctgcctcagcctcccaagtagctgggattacaggcgcccgccaccacgcctggctaattttttgtttttttaatagagacagggtttctccatgttgaccaggctggtcaggaactcctgacctcaagtgatctgcctgcctcagcctcccaaactgctgggattacagacatcgagccgcagcacctggtttagttttttttaaccctttataaaatacccactatagtcagaatagccactcagaatatgtgggttagctgaatttgctatcccattgccatacaaattctaaaagctatcaactgacagactgtttggcaggggggtgggggggctgggggtgcagcaaaaatagtcaggaggaatgacacaataaaatattaccaatcaattaaccagtgagttgacaactggccttgatcagagctaaggagaaagagggctctccctataatgagctgtgattaacaacaggaattaccgaaatgtaattatagccaactcttcagagatgagccatccatgccttgagacttcagggtctcagtaaagatagaggtatttttgttcttgattactaagataacaattgagccatgtttttagatgcaatccggtgtgtctacaagccttcatcatattttagagttatttccttcctacagtatgtttttcagcttgatactcagtgatctcaggcttattcctggggacccagagcctcctgctgaagcaaaacatccaggcttgctcaacatagacagtcccttaacttacagtgggagatgcaagtcttgtggctcaactgtgactctaggagttgagtggtagtagcatcacccagtgaaaatttcagactaaaaaaaagacagaaaatgacatggcatctccaataatgtttacttttgtggaaaattgtaatctccttgattactttatattgcatttgtgaaacttactctattatagcttgttaaagttatttaactgtaatttatctctcagttatttcacagcaagatataacagaggccgggcacggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccgggaagcggagctttcagtgagccgagattgcgccactgcagtccgcagtccggcctgggcgacagagcgagactccgtctcaaaaaaaaaaaaaaaaaaaaagaaaaaagatagaaactcagcattcgtgaatggatgaattaatgaatattctttattctaaacactgtacagtaccaaaatatcttttaaaaagttatgaaggctctaacattgcagacggtttggcatatatactataatttgagtaccccctcagtatttcaagttgacacaattcttactactaaaagtattgctttatcaatttcaagccagctaagatagacttctttaaaaacagatcaatttttgtttctaaaaatatatcctaatatcagggtattattctaccacagagaattcacattgattgtctatccatttaaaacaatatagttatagtcttttcacagtatttcaaagacttggataagctggcggtgtaaacatttcctcgtgggaactttataaaatgaaaagaaaataaatgattgatgcatactcaaactaattgaagtggtactgagtcaaccagatgttttcacctgaatcatgcccacagatgctattgcttcattatcccttaatctagggattacctccattggctaactcgatgacctgtgagggtttcaaataagattgcctctcccttgtaacatacatcataaagagagcttgtttagaggcagcctacctccgccctgaacatgttttcaaggaagtgatcagggctgtttgtttttcttgctgttggatgtggtcttcagtgaagtcacaggaatggaatgagagtggccacagttgacaatggagctatttccacagctggctgcaaagagtgggcagtccatcacagataaactagcacatggggatagatgatataaaacatctgtcacaatagggataagcaaaaacaacgtgcctttgaagattgtgttttaatgatgaggtggggggttctgtctctataataggaatgaaagatgtgttgttggtgggcagatggcttcaggcttgctcttgcatgaaataaagcaaaagtatgtgttaaaaatctctgacagttgtcaagtcacctgattttgctgaccgttcatttccttgcctatcccatgtgtaatctatgagaaaagaaagggagtgctaggaaaaaataatggcagaaaaaaaaaactggttctgaataattttcttttggataactttaatacatcagtataattttaactggaggctgagaggtcagaaaacgtgtttttgcaataagtttctttaatatatttgcatccccatgtttttttttatagaagttttgtaaggtaatataaaaatgctatgtcaccaaggccacataatgataaatatttcaaatgtgaataccaattagtagacataaagtcctatttgttcctgttaaaggagcagtgaggaaaaataaagacatcttaataaactatttttgatgtaattataatagtttggtttcccaccccatctgcctttgaaaataaattaaaaacaataaaattcacatacagttttatttcatatagttgctatagaaaaagaaatctttgcaacagacaaactgattgcaaataaatgccgaatattcttgcacaatacaattctatatataccctgttacatgaccaaagggtaccactgtcactgctgtcccccaaaccattccactctgctctggtaaggaaatggttgccattgctgcacactgaaattttgctacttttgccacaaccccaccggaaaaatggatgtcacattccttgctcatttattattttaatctgtctttcaactctaattcccttgcaggtgcttttgattagcagaagtcacaaatctatatctagcagcaaaagggtgtaggaaatgtttttagaagggttttcttttcttttttcttttttcttttttttcaattctacattgaagaggtaggattcacactgggggaaactaatgacatctgaagagagtattaaaaaataaatttctacatccatgaatggcagaggtacaccacaagaagcaactggactggtcaaaataagagatcttaaagaaagagcagtgccaggcatggtggctcacgcctgtaatcccagcactttgggaggccagggggcggatcacctgaggtcgggagttcaagaccatcctgatcaacatggaaaaactccgtctctactaaaaatgcaaaattagccaggtgtggtggtgcatgcctataatcccagctactcaagaggctgaggcaggagaatcgcttgaacctgggaggcggagattgcagtgagccaagatcacatcattgcattccagcctgggcaacaagagcgaaactccatctcaggaaaaaaagaaaaaaaaaaaaagagagagagagagaacagatttaaaggaatttgtgatgttctgacaagacttgactcctgactgagttttatggctgatgagggagaaggaaacgatcaagatgacttaggagtttctttgttattctgagaatcgagcagagaagaaagaatactctgagaatgaaagaggaagacagcattcagagcgggacatagtagttttgaggtacatgggattcggtcagtagttggaaatttggatcatgaattcagaagaaacaccaaggcaagaaagacttttttaaaactttaatttttaaactaattatagcacttttgattaatcaagtcttaacaagcgggaatattttggaattttacttctaacaccttatttttatggtatgtatattgagctaaccaaaatatttcgctgctgtctcttactattctatgcggcatataccatctcttctaatgcttggctgtcatagctatttctaactcactggttaagcagatgacgttatttggaaagaatggaggtttcagtgtgaaggttgccatgaaaatatgtcataggaaaagaaagggaatttttttgttaaaggagattttatgggtaaaggcagaaatcgtatggagatgattgaggaactatactaaatatcagtggctgtcatttataacaaggagttatattaatattactaatattattccaagctatctggctctcaagcaagaacaaacaaaggacttaacaaaatgattgagagtcaaaccaagaatctttttagaagcaatgtaatagaaaattcactcagagccctggcagaccaaatgcagagctaagctttccaaagtttatcgtgaatataactcacctggggcaggctctaatttagtggggctggggttcacctgagattctgtactaagctccctgatgatagtatccagtcccaggccatacgttaagaaacaaggtagtagagtttaagaacattctattaaactaaaaaaaatgttaaaattaatcatatagtattactgcttaggagaaatggcaataaaatctaagcggaataaaacatgtaactaagtttcttgcacaaatcctgaaacaaataggacactgaaggataacaagataaagctgtcttttatctcatctggacagttttaaatatattaattgaaatcttgaaggcctcagaatgtaacttgtttggatgctaatatataagttttaaccttagaatatgtctgttacaccaggacatattttatctcagcattagaccacagaacatgtcatcaatagggtatatactgagtttgaagcatgttagcaataataatactaatagaaagtgtgctttaaaaggagtaaattagttctttaatagggtcgtgacttcacacctgtatccttagatctagttaagtttccagccctaaccaggcaaattcctaaaaatatcttaaaggagaaaaatattctctgagggaccacaaaataaagtgctttttgcagcaaattgcaggacaaggaatagctactttcttagtaatagccaaaaattgaggtgccttgtgacatatttaggcaacttgcactataaacaatggccataagtaagataacaggcagctatttctcttgatcgcccctgtggtttgagcaatgattttccaggcccatttgccaataggatcttacaagaccttgaaaaggatttgcaagcaggtctttcagtctatttgtcagtaaggagaagtttttaatgagaagttttatgacagctcacagtcctgagtcctagttaaacccagataaacattttaccagacaaaagatgaggtccataaatattcagacgtcttctgggaaccctgtttgccttatcatttggaagaaggctggcctgagtactgcatccgatgtgtgcttgaaacttctgtaagttgaaaatgtgtttggaggtatacaaagtgattgctgtacaaatgaataaagcatttcttatcacatgacaaggtttgacaagaatctcaggcagatatatggctactaaaacagttcatggcatagcaaagtcctaatttaaaaaaccttaacctacatttgtggcagtacacattggctgtaatatgtacagaacatcttgcagcatttaactgagcataaataattcttccatagaatggaaatcatgtcgtgaactccaatgttaaacttccttgggtggggtgtggctctcagaagccctgggattttcatactaaataatgagaaggtcaagctggcagtggtcagactgagatactgtcaaagaaaagcagaggaagtgtatgaatggatcttttacgtccatctttttggccagagaatgcttctggtatttccattgaatcttcttgtccagtttgagcaaggagctgctgttattgtttcacataccattaaagtcatcagagacctgctggtgagcaagtgccattcactcactcagtccattagcaccactaactaagcatctgttttatgacagacactgtgctgggctcagaaccattaaaaaagaaatatataaggtattgctaatgataccagtgaacttaggattcagggaagaaataaagtttgatcatgatcaaagtgtgtgcaaaatgttatgggagaagagaggagcaagtgaccggtagcctgggtcagtcataggagttattccccagaatttagtatttgataagaattttagaagacacatataaactgctgtagaagcctagcgttgcaggccaagacagcaagggtaagaggtaagacggacaagagaatgatgaggaatacagtgtggtggaaagagaggcttcatgtgcatgggctggggatcaggctagaaaggtaaattgaaagctgtgtgatcctcgtagattatgtgtgctatgctaacaaggccatcccagacctacctgtagaagcctctttttgacagagataatgctgaaacagagtagaaagcacatgctcttgggcagccctacaactcattcactctaactggtttctgaataagacaagcaggaatagaaaaatgtcttgtcctgtcactgaactgtcctatctactcttacactcctccaacacatttaatgtagaatagccattgacttaacagtaccagtgtcttaaaaaggacatttccactatgaaaaactaacgcagctctaggttgcactttgggaaaggaggtcatttaacactgtttcccttataaccccacttagaacaaaaaataaggagaaactggtctgctcctcttcaaattttatatatatatatatatatatatatatatatacacacacacacacacacacacacatatatatgtatatatgcatacatatacatattgtttttaaggtagaaaaaattaggaactaatctcaatatttcaaatataattttttattatgaaatatatttggtgggtagagatcaatggttttctttctaaaaaaagtatagaaggagctgaaatatatttgattaatcaattcatttttaagtgtcatagctttatagtcttttgtctttgattttttttgtcttgtgctgtttttgattcctttaaataaattttggagtgtgcaatacatctgtataggaaagctatataccatgggggccctgcaaagcaaagactaaggactatggttatgccactaattttttcacacaaatagtctcattttttcacattatctacaccacaacacatgtatttttatgtaaactacagcagtttacatgtgtcctctaaaattcttatcaaataccacattctggggaataactcctatgaatgaaccagactactggtcacttgctcctctcttctcccataacatatttgaaccaggctactggtcacttgctcctctcttctctcataacatatttgaaccaggctactggtcacttgctcctctcttctcccataacatatttgtgagtggtagacacccccagctgaaagctactcattagttatgcgattggaatcagaagctgatgaacacaagttcaccctttgtcattgaagctctaaggtccttctgaagtggcctgggatctttctctaaacaattaatatttccattgactcagcagttatgatctccttaagtagaaaaataagaggaaaaaatatagtaacccatctgtgtaagaaatttataatcttaagatcaattctgtaatcaagtgtacaagtttaatgacaaaataattaagtgtcctattgcatattcagtcaacaaaatccctttgaccgtagagtcctcaaaatctcaaattttcaactctccctcaataatgcaatatatttaaaagccactttgctctattaggattctaaagaagctactgaaaacaccaaaagctactgataaacttgtttctgtagttttaggcacaaacgtctaaaggattaaaataaagcattattgagaatcctaattatctatgtacctgctttggtaagaaatacttcaatatgacatatttactttatattctcattcaaaatgacactattatattaataggtacttaaccaataattgaaaccattattcacagttgaataggcgtagtacataattaggattcttttaaagggatttccatggctaaaactaatttggctttagtgtctattaatattataactttaaaaaaaaatacttccagttactagttactgaatcaaaaatcaacttgaaattaaaagtgtgattaagagtacaaggaaaaaaatgctatgtttataattaatagatattctgttattgggaaatctatgtacatgtacatatctcttctacctttatcatatagcagtggaaaatgtcttacttctaaacattatacccctagcccatagctatatatctccatatagtagtccaaatatcatgccaattagtctaatcctgtccaagcataggaaagagaaacccagctctagtttgccccatttccaaaataaatagcaaaataagttagcactcaaaaataatgataaagccattggaagtcatgtaatagtcctgttttctttcattgcacaattatggaatttgggaaattggtgtatattataaccataatcttgccatagatctaaaatgtgctattagttgtcgggaacagactgtagatgaatactttgtgtcacttttctttctttcttttttttttttttttttttgagatggagtctcgctctgtctcccaggctggagtgcagtggcatgatcttggctcactgcaagctccgcctcccgggttcacgccattctcctgcctcagcctccgaagtagctgggactacaggcgcctaccaccacgcctggctaattttttctattttttagtagagacggggtttcaccgtgttagccaggatggtctcgatctcctgacctcgtgatccgcccgcctcggcctcccaaagtgctgggattacaggcgtgagccactgcgcccggcctactttgtgtcatttttctagttactgcctttcaaattcttcctcactttgtataaatggagcttatggatatatgtatatatggaccagggtttctgaaccctagcactaatcctgggtttgctggataattatttgtcgtggggaactgttctctgtgttgcaggatgtatagcaacatcaataaccactaccccctaggtgctaatagcacacctcggcagttatgataaccaaaaatgttaccagacattgcaaaatcactcctggttgagaacaaatgaaatatgtacatatacaaatactttttattctaatatatatatatatatttatatgtctcatatagcattagtcaaacttttttcatcaagcaaatcttggatttcatctttaaggggatggtggttgaagatgtcattaatgcgcatgtgtgagttgaactatggttttaaaactgaactgccccttgggagaacaagttttctcaagaattttgtaatgatccattttaacgagcaatctcaaaataacatttctaactaactactttttgattagaagttttattctttcatcattctttcggtgaactcttataaagcatatattatatacctcacactataaacagcactatagacactagacagtggtgaacaaaacaacataatttcaaccctttcagaataaacaatcaaaatgagaaatattagtaaatatttacagtttgtcattgaactgaaaaatgagtggtactgatatataaaattaatttacaaaaactgttttgagtacttactgcatgcaattcctatttatagagattacaaaagttgtataaacataatgtcttccctcttgaaagatgtaacgtggaaagaaacaagtagacaataataaaggggaaggaggtattaagtgctaaagtgaagttctaggggcagtgtggcttctggcttaccatgtaattcatcatttcccatacctccagcatttgtcaaatccttccaaaatgcttacaaagttaaaggctaccacctttgccacatcttttgaatttcaaacataattttttaaagttggactgcactactacgttggttggaaatttatcaaggtagataaggattaatgattgtttctaagaattagagacatttcttactccttttgtttcttctccccacaaaagcctttcttaaaccctgaaccctcatcaaaacaaaacaaaacaaaacaaaacagttgacatcaacaaatgaaagaaattagacatccctacatatactacaagacaaggaatgttgcatgctaatactgcagaacactgcatttggacagctattcctcaagctaccttcatgccatttatattatgagatctctgttgctattaggtatttgttctaggaatattaaaaactggcaaaaatcagacatgaataaaagaataatgaaatagtgacttaaaaccacctttttaaaattcatatatagttttgtgtgaataactataggcaatcgtataatacaaatcacagacattttgacttgaggcatttagataagacagcagaaaaaaagggatgctgtttttttaattttcacttatccaaataattttatttttgtttttccatttctatgagttcaaatgcaaggctactaagattccaaatatgaaggattcccaatgtgttataatagaagccaaactgatcaaattgaagcatgtcaggtcatcacacttattcagtgattatatggtgtgattattcagataatatttctaggtcagcccatcaaaaatgcaggcttagcccctttgaatgtttttaacaagatataatgtgattatcacataaaagaccatggcctgtaaaaagactggattcaaacaaataaatgagaaacagcgtacataaaataaagccacttgtttgcctgtaagaactgtaacactggctttatacgatagcagtttttagacagagcatacttcttaaactttagagtatatcagaatcacctggagagcttgttaaaatacagatttcaaggcctaatcccagagagtctaatttttgtctactgctgctactgatccacaaaccatagttggggtggcactgacctagaatactatcacaggaatattaatgcagctagttcttcttattgtggttcatcttctgggattaatataggtgctaaaacagctatgtgtgctctagatggtagagaagccacacatgcttttccctgatttgccaatggttttgtatttcagttgggaaattaaaatattgaactttcaaagacttcaaatttctttcaaacattggcagaaggttaacaacacagatgcttttctggccttaggtcagatatatttacgccacacatgatgatctttggaaactttacccaaattactgttgaaaattgtttatttcagaactagggcaaccagatccaccctttgtctcttgagtgggagcagctttgttttgcaaaggcagtggctaaaaaggaccagacctttccatcagctgtttggtcattgtattttttagtggaattatagcattgtacaatatttttctttgcagcccaaacattgagcaaagccagacatccagagatgctaaaatgaaaaatctgtttcttcttgctttgccacttgccaggtgaactctgtcagacaccacatcctatacatctcaagtaaacaaaattatgcttaatgtgttggcaacatctgtcacaaacactcttcagcctatggcttaaatatattaagttggagtggatttgacagtgtatttaataagtcaaagttacggttgtggatactggctttgccatgctaaccataaggcttttcttttcttcttttgtatttatttatttatgtcatatacaatacaaaagagattctgtagttttaaataagcaaagtggctggcaaactccccctttgctgtaggtaaccaacactaaacctctctaagttgtctgtcccagacaaagtatcattaagaaaattcatttctcccaggagttcctattagttacttccagtttactccctgactgtacatttcttccattcccttaagattaaaaaatttgtattcttaataatttgtaggattgttttcactgaatgtttttattgaatgcaaacaagactctagattcttacatatccttccccaagaatccttattttattttttatttatgtgcaataactgatctgcttagaaagaactgttcatttatgtgcagtaactggtctccttacattattttccactctgtgcctagtgttgctatttacaattccaattaatgataaatcccttcttacttttccctttgattgtcaggtttctggtttatacacagaagcaacactcactctatgacatctgtaatcaaatgagtccccaaatactgctttcaatgaaaagattctgaaagagaccagacaattcttccaaaattaattccaagtgcaggcattcgatccttctcatcatgcatgaattttgattgttctgtcacatgctcacctacctcatctgcatattgcctttaaaaaaaacacacccctggggaatgagacaacctccagggtattgagaagaaagtatccttaccaaacgcagtttggtttttatctctgatttacatgaatgatcctttttgtggctagagcaagctgtttagaattgaggggtttctgggattgtgacagtttagctgcatgttggaatgtctaagggcaaatattctaaaaagataacctgtcttgagttcaagaagagaatcgaagtcttgcagctgctaagcattagaatgttgtcaaagtaccactttttggttgaaaaaaaaaaatgcttcaggacttccatcttaactctgaggttattctataatttatccctaggtgatttaagaagaacccttgttcttcttaaagtgtttacttctggtctggcacaacaaatacctgaaatgaaggccagtaagtattttttaaaaaaggaaaacaataaagatggttttgttaaaaagattcaggcagcagaaagaaaagtgatgtgtctctgaattataattaagtaaaagcttatcttatgtttctcatttaagaggcatcctgatgaatgacaatgcacagaagcatcgagaaattcaaacaacacaaatgcacaattgtgtatatttacaagctacagacctttaaaataacagacatgttttctgattgattcctactgaaaagcctaaatgtctttgtgaacaaagctggccctgtatatcaagcatttccaaatatttggctcaatttctattatctctgaaaattaatggggaggagcccacagagaaggcagagtgatagcctgatctttttcacagatatagtcaggaagttgaatttcgataataccaggaagaattgcttagtttgagcaaaagcattttaggaaacgcgcagtgggtaattagtttgggtgccgagatctggccatctacatgcatctgtccagtgagaaaaataatgtttagggaaataatttattcagatacataatcatttgatcataactgagtatttaaatgggttgttataaaatatgtttctacttttatcacaatctttaaataaacattgaaattatatactctcaaagattccatccaattcaagctttttaagtttgttttttaaaaatatttttccttctccaagttaattactgcaaggaaagtagcagggtagagaaagagaaatggaaggataaaatgacttagctccattcttcactcaccatatgacactttgcatatggatggaagttttttaaaatgtctgtaatttcttttatccccaacaatgataataaatcaaaagacatattctagacatccacttttcttaacatctgatttaaaagttgacacttttatttttaaaaaaaaattgtggatggacataaaaatttgaccagctctaacagagtttggtattctgtcttgtgtctaaaatatagatagatagaaaacaggtcaaaaggttaggaggaaaacaaatgggaaatagtaatttcgatttttagattatcaatgatagattttaatatgtccttcaaagagatccagttcagaaacccatgtgggccagcattatccctcttagtggtagattgtattggggtgactaagaattatgtatgtattaataagtaatagataaatgacataaaccaagtcttatcaaataacaagaaaattagagaatttccactaatgttcatatgtttcagtcagagaagtttatatttagaacagtgggcaagaggatatagatgattttcaatacattctacctcaaaaaatgaaaatgtaagtgacatattttagacacatcacaggtaaattacctcagaagaaaggaagatgttaatgccatctattcagacaagcacaaaatgacatgaatggacataaaaattatatacagttgaatttagcctttttagtaaaaaagtaaaaacatttgatgttcacacatttacaatttacagtgtttatttgtaagaagtctccttccttgtaggatatattttcaaatggacattgtatatgcttgtagggtgctgtgattacaccaaccatggaccatcccatgtcaatgcagccagccaacatgatgggcccactgacacagcagatgaatcacctttcgttgggcacaacaggaacggtgagttgaagagattgttttgtttccttgaacttttttgatcagatgtgatattctccatttttactggcattatcagtgaaactgtgtctgtaccatattcgttgactaacacatctttcaggtttcagtatgaataagctgcattctgcatgtatgttcagttccagggcacatgtactcacagtggcaaggctaaagttctattgtgtcattcagttacttcttgttttttatggtacaatgtaccagatgtaatgtctgtttttggaaaggtgtcctttttgtatgcacctgcaaatctagaccctttgacttaatatactcaatcctggttttctcttcccagctgcttaccagctcagctactatattattagcaggttatacacaactgaggggccagatctatgactgatactattaaatcaataaagagtaattgaggtataatcgagttcttttaatccttctttctgatatgttgatatggatgatgttgaaaagaaggaagggaacctaatgtgcttgattttttcttataggttgtgatatttttgactagtcatctttctcctcagagaacaaaagtgtgctgaaaaatgcctattgcagcctggattttgtatcaatgaggcattttaaatcataagaaaaactttgtttgatttttttaaaagataattccccaaatgttcaaggaggcaaaagcctaatacaatctagaatactgaaacttcattagttgccattacagagaacaatgaaaccatgaaacctaaccactcatgtgacaccttcagtaacagttttattttcgtaaatgttagtgcagataatcttgtcatttaacaaaacatagaaataaaaatatgttttcttttgactgaggcagcttaaatattgaagaaagagcactggactaggagtcagaaatcctagatataaaacttgcgtaagccctgtagtttctgtcaatttttgggaaaataatatctctagtctgaattttttctctatctagttgaagtattaaacttgatcatatatgggtccctttgaatattcaattctgtatttttaagcctatatgtcttacagttaccacctctgtgattcttcaattatgctgactcattctccaaatatctatgtacaatatgcacactagttgtgtatcaggaattttaccctatagcaatggcttgcttgccaaataaatcttgttgactcatgggcttttaagaatataagaagttactggcatgtccactgagaactcactaatctgtcctaaataggaagaaagtcaatataatttaatggaaagagccacattctttcaataaagaaattttagttttagtaacataaacaaagtgcctatcactaagatctcagttgcagaacctgtaaaaagcagtcgatggtaacttacctgtctgaatgcttgggctggatcaaatgatctcttaggtttctcacctacacttttagaaatcgtgtctaagatatatttaactatatgctgtggtacagctaattttcatcatggagatagagcttgaagacaatattttattgcttttatcaaagaattatttgtaattattttgtgcgttactaataagcaggtcctaggaatagtatcagaaggcctgcagtttcttatttttattaatatattgtagatttccctccatatcagccttcgtgtccttcagtgatcataaattctgaataagtgatgtaatgtaattttaccgtattgaataacaatctggaatctgattaaagagacaattataatgcaaaacatagaaactctttaaaatttttactcatttggttcaaaagtaaagccaactgacttgctaaaatttaagtttgcaaactagtagaaatataagagctagttaactaagcatatgactgaatcctttagggaattaaaaaaataagctaaaagacacagaacagactcagaattaaaatagttattgattcaataacatatattatgattttgtatttgagcattccaacaagaacacatttgtaagggaccatgacttttaggcagctggtgatagccaaatgattcagtaataatatataacattctctttcttagagagtaaaagttttaagcatatgatttattattaataccaaatttccactagcttttttcttttcaccctttacatttgttctaaataatgcttagatacattataagatttgcattacctgatgttatggaaaagtgtaaaatttagtaaggtttagaagaggtagagagaaaacagaattactttgttgattcgtttaacaaaatataattaagtgtggttggtgtccagaatattgttatattgttttcttagactgtcactctaattcttcgatatgccttcatagattcattttatctgaattttgattggcatttggagtgactattatccagttgaggttgattttggaaaatcagatttttctaccttattgcatctttccaacattttcattgatggggaaggaatcctggcatcatggaaagatcagttggctttgtttttaaacttgagttcaaaacctgactttgttcccttattagctctgcatgtttaggcaggttacttaacctctcagaactttctcattttacaaagtgggaaaaataatgcttacatcccagagatgttgtgagtgttaatgaaatgacaatatgcagcatatcttatacagtgtgatacccagtatgtgcttctcaaatgagctgctcatacccttcacctccagtggcttctaactggtgggagtctagtttaggtagccagaagtgatgtaacacacagtaaaatccatggtataaatcacttacctgcactatttcacttgatataaataatttctttaacgtctccatttctttggctgctaacattctcttttaaggtagcaaattcaaaagcctgtagagtccagccaagtcatattaatgaatgaagtggatcaagttcaaacaaaaacccttggaaatatataatcaatttttaaatatttgcctatatcataaacatactcatactatataaacatatatgacattggagattatattttagagaagatgtattttccatgcaataataatactatctctgcctgagttttgggcaaatagaagtgagaggtggtgcctttggcagcctgaaatatggatgccttgtctgaagaggacagccactattccattggtagtacagctgttgtgatggctattgccacatggacatacagacccagggtggtctcactttccaacttttaaagataagctgaattcttgaattttgatttgaaatttctccatatttaaatattgggtccagtttgtcccaagaactcccagtttgtgactcctgcccaaggtttttctggttctcctcagacctctctggccattccttcttctcttcctgcacagattggtaagccagagcttcatttttaacatacttatgccacatgattttcgtaagcaatctcattcagtctcatggttttaaaccctggcttccacgttgactcctaaatctcagtccccaatactaacctcatctaataatttcagactcatttatccaactacttgctacatatctccatggaaatctccctcagacatctcaaagtcaccatgacccaaactaatctcatgagctttccagaactttcttctaactgaaacctgttcctcttgtgtgtttctgctccctgtttccctgcaagctaatgacatgaccattttccctgtagtcaaaccatacatctaagacccaatcaagaccctttccttctccctcaccaccatacacaattacttttcaagtcccactgattttctctcatagacattggtcaaatacattctttcttctacatttctggagtctctgccctgggactcatttgataaactgtaatagtttcctaaccgttcttcctgctttcaatttcaatttgctccaatccattctctaccctgttgtcacaggtagtcaatctaaaactatctgacgtctctctcctaactgaaacatttcagaggatttcagacatctgagcccacagaaattctgcaaaacaaggtgtgaacagtgacaagtcaagattaagattaagataggattctaaactctagaaacagatgggttccaagggcagagcagagagctatccagtgaataatctagagtaggaagtgatcagggctgacggaagttgtagctatattggaatttgccatttttagaagggggatcttgaacactggcttagtcccactcttccttttaaagtccctggctaaaggaattgtattgggccaaaacctctttttccttttcatgaaagaagatatattcatctcccatgacctcaaattttgaaatgaatgccatgtagtttaattaacctttctctacaatttgccacctcaaatgtttattgttcaattctctattttaagctagacagaatctgcaggcctcaaaaaaaaaaaaagtgcatcttatgcaagcagtgtaactgttttatttcaggggtctgctgaccctgaaggattttcctagcttttctacttttgtttatttttttgtcacagcattcccttgatggaaccaaagccccattatccataacttcttatcactttattgtaagctttagcagaaaccactggagattttactgtgttatgagaacctccaagttgcatgacaatcttgttttacaagtttcttatctccttttcatttgttcagttgctggtcaccagtggcttacaatgtcaccagaatctgttggaagaaataaaaagtttttgttctgcaggttttgtatctgcagtttggtttgtgttctccaagccactgatgatttgtgatatcatcgatttccacagtgtaaccatagtcactcacaaaaataaccttgtaattgtactccatttgtccccacagttctctagcatttttcagtcacaccactccttcactgctctgaaattttgatagtatcaggtgaaaatcctcaattattcagtttgtttagacattgttcttttttctgttattaggtatgaatataaatattaagacagagttttaaaaagctaacaggatgttaaatggactctgattcaggaagcagtatcataaatggtaatgggtacatctaaaatagttttttaggaaaaaatattaattaaaacactcaaatacaaaacagaaaatatatctaaaaaggtaatagtttaaaaaaattggtttagtcttactttaaaatgaaagacctttgaagggagtcttataaacaataaatgagctggcattaagtgtaagtctagtagtacgagtgtgtatttgtaaatattacacttttgttgtttaaaaaaatgaattctgaattcaaataaattaccgacatagtaaaaaagcctcaatagataaaatgccaaagaacatgaacagatagttgataaaagagtaaatagaatgccaaggaacatgtacaaaaattgtaatgaaagaaacagaaacagtaattaaatatacatgtacatatatcccatcaaataaagctatcaaaatgcagtacaaattgctaatgaaggtgtaggaaaataagcattctctagcactgattgcttgatgataggaatctaaatttgtataagtaccagttggatagcaaggtagtcagtcgagatacttcaaaacatttatactgactgaccaagaagttatagttttgagaagctggtctatggaaatattctaaaataacagaaaaataattatacctcaaaaatatttgacacggtgttctttataatgtctaacaaagaagaataattaaatatgccataatccatccataaaccagaatgtaatgcagcatgaaatcgtaagagaaataattgggaaaaagtttatttataatgtcaaatttgaaaaaatggaagtaaggcaggctgtagtggttcatgcctgttatcacagcactttgggaagctgaggcaggaggattgcttgaggtcaggagttggagaccagcctagataacataacaagaccccatcacaataaaaaaaattgaaaattagctaggcattacattattgtgtgccctgtagtccaactactgaggaggcagaagcaggaagatcaactaagcccaggagtttgaggttacagtgagctatgattgtgccactgcacttcagcctgaatgatggagtgaaaccctgtcgaaagagaaagagagagaaagagaaagaaaaaaggaaggaaagatgtaaatttgcatgtgtggagttcagtatcaactctaaagaagtattataaggctaaagagaaatataaaacaagtgtggctatttccaggtgatgggattaggagtaatgtctattttaatcattatgcttttctacattatccagctattcagcaataaacattattggcttttattatttattttaaaatgtcataagtatattcttggaaaatgtctagtagcatggtccaataattaacttttttttttttttttggtttggagtggaaatgtgtgattgcaatttttcaaaaggtactaggagttactactattatttaaaaaattggaaaaacttttaaaatgattctaattattctagatttggggattataatcaactcagtagttcaggtatctgttgcaagaaacaaaataactcatgtgtctggtttatttgcatttgaatcttttgatcatgtttgcttttgttgctcaaagtgccttgcaatgttcaagttctaatctgtcttctcacatgccatttactcaggagagagtgattaaaattgaccttttgtggcaaggagatgaaagtgagaaatacgtgatagtccaaaagttgtcacatgggtggaaaaagaaaatttgggatttttgcttttaataaaggtcatataaatggaataagagtcacacaagaggacctatttaaccatgtgttggcagttgatttgaatctaaacaatatcaagtttcttttagagtttacccctccaaggggagtggggacaaaattagaattttccatttttagaaggggaccctaggcctatgccatattccaatctcctttttaagatccctggctaaagaaattgcagtgagccaaaagctcttttttcatctttaaaaaatcagatatattttgtgccatgtaacccctaattttgaaatgattgccatgtagtttaattaagctttatctagaatttgacaccttcaatgctaggagacttgggataaagataaccgtcacgttcaatagattctgttctgtgtatctctgctcccacagttacaacacataaagctttttggccttgaggtgaaagcaccttccgctctgcctcactgacaaccactgggatcagagctagagctgagtaataaataatgaaattttgccttcaaaatgtgttagcctccatagaatatgagaatgtacaaattttttatttttctcttttaaattttagttctttcttttgttctccaggactttgtttcgtatcatgctctgggccccctctaaatgggctgccttgtagaactcttttgtcagccagagagggcaaaaattttatattgattccctaagggaggtaccaaacaggctgtggaagatgacagtgtttcaggaaaaactgtactgtcccagcaagtctaatgggacctaataacatgtacagtattgtggtaatagggaccatggtatcaaatgcaaatgaggaatcctaatgcctttactgctctaaggcagggtgggtcaggcaaccatatgacacacagcggactcttccacgtgttagggctgattctattttattttcttttgtacttcattgcattctttctcatgctcttttcattcaaagattcaatcccaagacaggattatgatactccaccagctgttgtgtcaggtaggaaaattctaattcttttaagactggattggaggggagagatggaggttgcctggttttttcccaaactctttaaagcagtgattctcaacagaggtgggtgcaggaaatttgaattccagtttgcaagggggcatgtgtagttcagaaacataaacttaatattataattcagttatatatctggaaaataaatgtgttgcattttaaatagaaagtaaaaactcaaaaccattttatctgtcaaggatacacagaagatagagtctgtgttctgtgtatcagtgattctcagtgttagacacagtcatcaaattcctgaaaagtgggaaaataattttatgtatagcaaaagacggcacagattaataaaaaatagtttgagaagcactgctttagagaccagaattcttctaaattggaaaatcatcccatttgcttgctcagcaccctgcatagggtctgacacatagtaggtactcaatataattgtttgttgaatgaatctaaacttcaaatttgttcccaaaacgattcttttggatattgaaagaaaagctgccattattctatttatacaaaaaagtggcagaggttgatttgaaaatatgttagtgtcttgagggttttaactagcaatatttcagttgtttcataaaatttagtagtgcagtttgtaataggatatgtctatgtaaagaggtggatttttattttgaactgcacagatcttcttgtgctttcattttgattttgaattttgatttattgcaaagagaaaaatgggcacaattttttatttcagttaattttttaattaaataaaatactggcaatctgaagaggaggaattctttgattctttgacatgtcagacagcaaggtcataaaatacaaagagaaacatgcattagaaagacagaagaagaaacaaaggtcagaaatagactcaaagaccccatggagcagttgaatctgtcaacctgctggtggttttcaagcaggggaaatcttgcttttggccacccgtttgcttgacccagcatctgaagggtaattcttttttaatttcttatagccttgtttagttatgttcctggctgaatactcatctttaaagttcaattaataatgtcccattgaggaagaatacgttagcatttggccgcgaagtcatttcggtcctctttaaggtctctacaataaattgccactactgaaaatatcacttagtttttcccaaagtgtatttcctgtcatatcttaacatgccaatttcatttaggatttagggcccctgggaagagactatatttcatacatggtacttttgtttaacaagatacatctactcttggtaatttaccaatattcataaaaataaaagacacaaactagaacttaccttcaactgggtttcctgattttactttcaagaacataatgaagaaagcaagcaaatcattaaaagtacttatcagatatcagtcataggtcaggctctacgtaagtcaattgaggcagaagatctggctgacaatctaggctcaggagttctcacctgattgcatacacagggccactgaaagttctagagcagataaattacttgataaaagcaatgctttaagaaactgaatctgaaagttttgtgtggtcttgagcaagaagacataaaaatcacatggaacagttaaaaagattagatatgacatattgtatttataataaaaagtagtcctaggttcccagcagtggagtatgaaggaagggacccaatatagagttaatatgaaaaataacattttgggagatttcacagttattttccccttgtaagatttaattggtagtttgacataagtttcacagacttctttggtctacgtctaaatagaaatagacttgcctttccaaaatgcttgttaattggctggtaggacaacttcaatgacttttgagaaattgaatctgcttttctcaatccttggccacatcaggaaagtgaaacaggcaatagcattgtaatatctccttcccaaatcttccaatatgtcaatattggacaaaacaaataactctttgccagtgtagaatccaactaaattgttttaattgattgtagtcgagatatctgcttgacaatttacagatacataacttaatttcattcaatcaatatttcaacatttattgaacaacttctgagtggtagacactacacaaaagtactggggatacaaagatgagcagaaaatagacccctgattaaaatattatggtataatattagaccattataacattaatagcaacatttatttgtgttgtcgtgatgtgaaatgcataaagtatagagaatcaagaatctagaaagaatatttgaaatcctcaggaagacaaatactgtttggttttctgtgtaatattaagtgacatcatcttctgagagtgagtgagagaaggcacatagtaaggatttaagaagaacagagatttggaaaactatggcatgagaaggcctatgaacaatccatagaattttgaggggtagtagtgggggttcatttgaagctatggactatgtatttgtgtgattaatctgtgagaatgtttgattttctgcggtcatgattagtagccaagaaggcagacaggcaaattaatgcagggttaatatttactaggtgaagtgaggaaaaggatagtgtgcaattatgatattggcaagaaagtagttgagtggcaaactgtgggtttaaggaagaataaagaaggaagaaaaaagaaggcagtggtggatgagagatagaaaacaaaatatacagattagcagtttcaatgagatgtactaactacaatgtattttactaactacaatgtagttagcaaaatacttggatttaagattttggataatgaactatttcttggcaaagtttgaatcatgggagcaggtggccacagtggacttgaggtgaaagtgacagaagttaagggagttcattaatgtgaacataaaaagtgactaatgaagtgggggtatcttgcatattttagttttgttttcttcgttctttgccattaataaattatacatggctcaagaatattttacttaggaagagtctgagttacatatttaagcttcaacaatgaatatgtcttaaaaataataataatctgggaagaaagagttaaagcagaaatggtgatgttcaaaagaaagaaggaagcttgggaaacaaaagcatctctgatttatttccctggagtcacctcttgttgcctacatctctgctaggccttacctagctcatttcaaggagggaagacagaaggctgaaactgccctctacattttcacaccaaagcaggaatctattctccttttagtatttcttttccataacaactataactcctttaaaaatcctcctctcttaagcaaatgttaatgaaaaaatatgtaaaggcatagtaaaatgccattttctatacatggttgggttttatgaaacacctatgaaaaccgaagataatttgtagtcaaatttttatttcagttgttttgagcttaatttccttgaatgacatcagcatgaaatcaagcagaagactactatcactagagaactaaagtagaatcaaaatctgtcctctttttctaaaaagctttgagttcagaatttgaacctaggtttgaaaaaaatttttttttaaaaaagaaaagaaaaacggggcctgaaaaatacactgaaaagaacctgtagaacttgtggagcatattttcattctttgctctaaccttttatgcaccagctgaaacaggctgaaataataagtgttatcagtacaacttcatgatgagatttcacagaaaaagtttgcataaatcacaatatactggtccaataagaaatttttaaatgtctgatttctaaccatggagttgtgctctacgaataaagttcttcattggagtacatgatgcaattaagacaaaattcactgttataaacagcatgcactttctcacattgtttttgtttcagcaatctaagtttgcattggaaagcctcattaatttggaatttgtgatgtccaagcaaagatttaattgaagcctatttcttatgctgcatcttaggtgagaattgctgtgtgaaactatcctctatcatccagaggagggaaaggcagagtattttagctgcttcaaagaacaaggagaacaagaccatctttcaagctctaagcaacatttgttttcatagataccatgagctaattacaaataatttccatcttttaattaaaaattaagttcattagtacctccaattagcaacaattagccattaaattgtttttattgtaaaagacctgacacattgttatgtgttcccacaagccacacgtgaaaatcagtttcattttttggctcaaataccgtgcatttatgttgactacaaaactatctttctttacatgagttaattgattttttctttgtaataagttcttagagactttgctttacttattcttcatttattcaactaatatttacagagtacctacagtgctacaaaaaactaagggtaggtccatttcttgcccccaaagaacaaagattctaacagagtaaaaggttataaagaaatgtcatgtaacatagtatatgacagacatcacaggagtggtctgcagagcaggactctgtacatgatatgtgcgcaagtatttgacaaaaataggcatgtgaatgctgagttattgtgttcctgctggtgcatttattttgttcgctaaattataaaaattgaatcattaagaattttcctatgggaccataattgttatttatgtattaaaataggcaactagattggactagtatataaatatcactgttatttagcccaggttgttttttggtttttgttttgttttgttttcagaggatgggataggtgggtgtaaaattctatgcctcatcttctaatccagcaagcatttcctgtaaagttccagatagtaaatattttaggctttgcaagccatacagtctgtgtcataactattcaactctgccactgtagcatgaaagcagacacaagccacgtgcaaataagtgagcatggctatatttcattaaagctttatatgcaaaaataggcagcaagcagaatttggtctgtgtgctatagtttgcctacccctgctctctctaatcaatttatttttataggtattccaaactaaatactgtcactgatattctttataatacatctgaagtgaccttcccttaaaattcgcatttttgagcttttttatttcataaaagacagaaatatcagaaaatctgagatggtagacattgagatggaggttgagaaaaacatgtattagtgttttagtgtgtacagaataattgattataatagtgatatattaaaaccctttaagaatatttttattttttatatatttttttaatattttcattatatattggtcttttaggacttatagcagcaacaggggatcatcaaaaccaggaaaatcaaacatatattctgtttattatcctcttggcagcctttagaatcctatacttttagaaatttagagaaaagatgagaaatatatcatcccaaaagatttgtagtaaaatatatttgacatctttgtcacaccacctgcagcggtttctgttactgttgtgattgttgattagtgtccactgatattactcttgacctgccagtattttagctattctatttccccctgggtaactgcttccctgagtactgtgtgctgctttgccatccgattataagggaaagctttcctggtcttgtctaaaagccgaacactacacagggtaagcctgggatggctggagatatgactaccctctgtggcaaggacagagaaaaacgacgcttagtgatgcagcacacacatcaaatcaaaaggcagcctctcaaaatgctttctgcagtagaatttttcagtgagtggcagcaactgacttaaagcatcccgcagcagcagcacacagcatcacttagtgcctcagtcatctacaaaagggcagagcctacataatacgcagcagagcactttcaagacaacaatggactttaaagtaagctaattgcgtgtgcaggaatcagcacatctggtactgaaatcacttggttccgtttttaaatcaacagcacaaagtgggcacttgaggcgcctgtcagagaatatagtcaggaattgactatgtatgattcagcccttgccagaggcatgcgagagacatctgattctggagagatactgcctaataaacatgttaacagttctctagaccctatgttaaattagttaatcagaatgcaaaatgcccgaaccataaaattggacatccctattgaaatgttttctctcagttaaaattttaacattttaacctcttctttgagaagcaatatattacacgaacatttaaacaatgttaccagccttttgagatgccacagcaaaccaaattgtctgttattttacccaatgtcttttatataaagaagcaaatgattaatagatccttgagttcagtgtctcagcaagtatctctctccagatgaatgaatatacttatttttaactaacaatgtaaaatacccagcttaatctattttcccttagccttggttatcaggatagttggaattagatggagtacattgcaaatgttcctggtagcatgttctctctattgctcttaactgtttgttgatttgctggtatttttaattgtgcttcttaatgcagtgcttaattttgtaaatcttccacaaattcaacttggaagtacaaagcttctaattcctttattaaaaaataaatgaagaaatactattgggctaatgggaagtttgtgtgctaaacatcttaggagaaggacaaaatgaaagacgattttgattgtgtgttgatcttatctaaaaatttaccaccagacactgtttgttttcattctcacacatgcagttttaaacaggaaaaagtatggtagaaaaaatcaaaatgatttttagaattcacaggatgtatgtgatttctgagtcatattatttaataattatttaacaattagagttacttaaattttctgaagcttagcttttctctccttaagagtagagagtatataatctattcattaccctttatatatacacaacaataaaaggattaattgaaaggatatgtccaaagtacctagtaagggcgtgactcatgatcgatattaaataattgaagcttcctttctgcttcctttctttggattcaggaaagtgtgttaggactttttgaagtatcattaatcttatatttgctatgttagattaacttatccaaagaaaggagtctttttaaatagtttccaaactcaatatctaaaaataaaagaaatagtaagagagttaattatattatctttcttattggccaaactattatgatattactaggtgaattaatataaatataaatatttaataacatgaaaaagaatgttcataatgcacagtgaaaagatgacaaaagtgaacaatcattatgattttgaggcctaaaacatacacatgaaaaaatctagaaaagaatgcataaaattattatcatatgtgttttcaatttctatttctaaacttcttgaaatgttgctttgctacacttataacttattaaaactttaataacagtctttgaaatggcaacagttttaaggagacatttatgtaccagaaaaacatgactgtgtgaaaatgaaaataaagatgatgataatgagtgtggtgattatatgcatgatagcagtagcaggggtaacctctaacattttccccacctctactcatcacatctcaacgttatggcatttagagcaagattaaaagagacattatatctctatatagaattggcagaatttttgagtgattctataacctaaattcattaaattttatgtaaatccattttccacctaccagaagatcaatatttccataaccaatagttaatgccacttttcgtattgaaatcacatttcaaatgatatattatgtttcttgcatgcagcagttggaacaacctaaaatcttcccagtttatattatgtgagacatcaaggctcttgtggtttacagaactgatatgacatatttgaaaggggacggtatataatacacttttaattacatattatgtctaacttctgcaacttagactactactatatacacattttttttacttttctgcttaaaatgaaatctgctgttgatttgtttccctgagctgtaattacaaaatacttatacttacccaatcaagctgatataacttctaagtgcttttgccacccaagatattgtttattcttccttcctttctaccactaagttttatttattttgatcatgtggaatatatcagtatattattttttatcagggaactttatgtgcctgctctgagtctagcagtttgcccaagagactcagatacgggaatgcacaggactccagatccaggaaatatgaattttattcataattgagcagttacattagcaaataaaatatgaagatttggtaaaaattattgagattcttgagatacttgttctggagggttgaagcctactagccaaagaaaaccaaggatcaactatagtcaaacatagttaagttcattagcttgctgaaacaagggaaaatatataccagttgaactgtggagcatctcagaaaaggaagtctggaagggcttattacagaattagagcttgtgcaatatgactttgggaagggtgtgaagaagtgaccatttattccacattgagtgatacctggaaatgaggggcaattgaatgattgtgtgtcttaagtgttatttagtagttgggaagaagaaagaagggctcgagctgtcattggcaaagatgcagccgtcattaatgttagacagaaaaaggagatgtttgattgtttaggtttgcagaatgtacctgtctctcttttgtccaccacagtccttgagtggccttgtctgaaaattgttgataatcttcgaaaattgtttagttgggaatgctatgaccttgcaaatagcttccagctaattaaaggttatttgaaagatttccataaattctttccttatctcaagggcaattataatattgcctaacaaaaatatagcagaatattaaatgtccttggtgaaatataaatgcaaacatgagagagggtaaatagtgttttattcatcacatagtatgtattcatcacatacatactatgttctaggcactgttcttagtgctctacgtgaattgatttgtaacatttgattgtcacaatcattccgcagggagtttctttgtcctctgcaaattcgttctttataagctcagctggacccacactcatatttatgctccttcagctgttttaacctttttcacctttttaagttccaaacacgagtcttcccatttatgctaaaaaatgactctttctttatgagaagatcagtaccacattttatccgatcttcaaatgtttgtttcttcatttttcccttcttcctatcttcctcttttgtcaagccatagtcctctttttgtcaatgttaacccctccttgtatgttcttgatttcatctgcctcaatttgtttttatggtcttatagcattgattgccctctatcccagatgcaccttattcaatatatatttattcaatgatgatttttcctatgcttaatgaaatgtgtagatccttcttgcctcaagattctcatggtgctggtcttatgacaccttgcttttcttcatttttttctcagtggcatcatgtgcttcctcacttttaactgttatatagatgacctccaaatctatattgctaaatcctatcatctattttgcttttcatgccaaagtttccaactacttcctagatatcccctatccactcttacctggcccatttatagttcaaacttcttgttcacaatttcaaatgtctcataatcttgcttctcaatccagtttcttctgcagacttccctagggttcaagcaaacctctataagcattctttatctaagccaagatgttttaagtgtagctacaagtttaagattgttagagtctttgacagtagcttagagtatagctcttctctttggggtgagaaccatatgatttaatattatactaagcttagagtaggacaggaaatcttttaccaattggtgagttatttttctttcagccaatggtgcttaaaacctcagaggtgttttggtgcactctatgccacatgcaatcttcctttttcatgtagatcctatttctacaatgtattttgaatctgctatacccattccattctattacccaggtccaggctgggttcttattacattctagttttattatttgagtgttgttttggtgtcaacacctagcacttctctttcctattcatccttcacacacattcttgaataaattttgagattaacatttaaaaaattttatcttcaagaatatgttaatagaacaattaggagttaccttagtagataattatccctaccatctgatcactgccagaaagtaggatacagatcagatttctgaatctaaagtcatcttttctaacagcagccctctaactcataaccagtatataccagaaatgttacactacttaaagctgtagttagcttatggagattgttctacaaggaggcaggtataacaactatgtcataccacagaaccacagtatggtgatagctgctcactggcctctgcttgagaggagacctaaaatttctctgacagaaatattgcccttcctgcagctaacatcgaagtgaaggggtatgtgtcttgaaaggagtcagcgggttctcattcttcttcgcttcttccatttgagtctatcatccaatgccgatttcagctgatagtttaaacatatggtcctgtgtgtaaccagcagcaaagaaagctacattccaagtactttttaagaaacataacaatttcaaagtcactgccactcatacctttcagaaccttgactaagagaaatgatatttttggagaaatatttggatcttatgcagtatatccattttccttggatattctaagttagatccttggattaagctaaaaaaaagctgttttacctggatgactgcattccactggacccgtgaaacagctcttcatgaagtatgccttggcacagtaccatttgtttatgtgtgaaggacactataataaatagaccttggaaacttgctttgctatattaaggctgttgttcattagaccacacagtgtctgctcctttcagactcacaggagaaacatctgtcttccttccatattgggaatcattcttcaatgcacctagcttattttcttacctaatggacacagtgacttgtataaatcattgctaactaactctggtaacattttaatagcatttatttaattagcctgtttgctcacttcatcttactctctttcccttcacctgatttttctcacttatttgacactgcaatattttatacaaccttgaaagctgccttaaatagttttgggaagcaaggtggactataattaaataaattctggaaatggaaatgactagtgtattatttttatctgtcaagagccacaactcaaatactacaagaattgagaagaacttatcaaccttgtgttcaaggcctgccacagtataatcttcaagctactttcccaactagttttctttctgtctgcttcacgactcttctttcactagtcacagttctttgtaagatgtgtttaatggtgagtgcttgctttctttgctcatgctcactttccacctggaatttcttccctgccacacctgccatctctgtggatcaaatcttgtgagtttttctgattttcacactttattttgaaaactctcaaagttttctgttaccacctgatgaattccaccttctatgagatatttgcacattcctcgctatcttctctccaacctacctttagattataagttcctggaggtttggagatcaagggctctgccattccttttatcccttgtggtattaaagctcaaatttttgatctaaataagtctttaagtaagaactctccctcaattatatacttcaatgttggcttttactcttaataaatgtggagagaaaaagtgggggaggtaatactaggctagtcagatgcctgaattttctctcacagttctaaaatttaaaagtatctcttccagaaagttactctaggtaactgccatcctttggcaggactagcacaatatccatctaactggtcggactgattcaagccttctttccattcaattcattttctctacagccccagagccacgtttctgaaacaaacaggacatgtttgaaatccttttgcagctttcaggacataatcctcagtccttagcctgtgcaacaaggcccttcatgatcctgatgcctcctttttcacattcatctgttactacttctgttctcccgccataatgaactgctttcagtttctgggatgggccaagcctgcagggtctttgcataagtgggagtagataaacatgagcaaatcctcatctagaatgtgtttcctttactcttcaacctgctaatgctggcttgtttcacagcaattgtctcaaatgttttcttcttcttggaaggttgccttatccttttgtcttgtcttagagttttctctccccttaggtgtctgggaatacctttattgtaacatttagcacactgaatcaccatttccagtttaattatcatttctcccctctagagtaaaggctataaactcttagagcagagactattcatatttaccttatttctccataatccagcaacatctggcccatggtaggtgtttattaaatattcattgattgaataaatgatacctatatgtaaaaatgctgattcgttagacacacattctacataatcctaactttctcctcaaaagattaaaatagcaagaggaaaacagactcagaattcccaagaagtctggaaatgtgaatgaacaactaagtgcagagagctttctgaaggggataggaaagactcatgacaagaaaatggagttgggaggatgtcaaaggatttggagacagtagaataattggaaaatgatgcttatatgaaataatttaagatattggtggaaatgtacaatgtgtctattagaaatatgaatgcccttcagcaatgttgcttatctgaaaggtttcattttcttattttccctagatagccatcatattcatttatcttactaacatcctcataattgattccccagtgtcaccttgtaaaagtacttttatactcttttcatcgccaagatacctcacacgtacaccattgcaaacatacactggtcccaatgacatcgcatctttgctttatttttatttttttaaatagattcttcaatagcctatgttatgccttttacagattctctggacacacatcaggtgcctcaccatcattgttaatggcaatcagagcaagtaatgtcttttagttctttttcattaatgaaatggaatagcaccatattcagtctgttagtgatacactattacatcgagagcttactgaagaaatgcagccagcctgtgtacatagggctggttttccttagatgtgattttcagccatgaacaaacaaggcaccctttcatctagcagaaaagtttgctgtcttcccctctttctttctcatttgttttgtcctatttttttcctgacagtctgcaagaaatataatgttttctaaatgacattgaaaattcttgcagattaggtattcaaagggataaaatatcaattaatcttttgaaagcctttcttttttgttgttcctgtctttggatttcagtttcttgaattccttactctcaaagaaatgtttttcctcttgatttttctcattataaaactggatataaatgtaaagtaagcagtcattctaggtattttttaaattcctttagcattcatgcagaaaaaaaaactctgctgttattttaatccctttaggaaagtatgtttgattgatgccctcgaacttggctagttgaggcaaaatctgagagtttttttttaatcctctaaactcaattgaattatattgccttagcttatactttataaggtgcccgttagctttaaaactcacactaccggcatttgtgcttgtcaaccaagccatttagactttaagttcatttgaagaattaaattaatgtgatgctaaagcgtctatttgtgtataggtcccagttcctaaaataacttttcttagcagtctcaccaagagtgaaatgctgttagtgggctaaaggaaagtatatcaacttcacaggccttattctagaatcagtaatttgtgtgttaaaaaatgagtattaaagtaggcagtacagctgatgcattcttgttaaataaagcatgaaagttcagcttttgtgttcatttctgcagtgagttccctttactacccctttttcaccatagttcattcctgaatggccagacataatgagaagatacaagaattcgactgctcaatagaagtacctcatcccatcttaatgctgagcaggcagcatatggtgaaagaatgaatacaagttttgaacaagatgagcatttaaatcccagctcttgcatggactgtatgtatgggttctctgaagctgtcttaccatctgtaaagaagataatgacaatactcacagagatatactatgagagttagatgagatattggcatagtcataatagatactcaatctttcccacatcacaggattccaagcttttgacttagcatgttcaattttttaaagcaatagttctcaaactgtgatcccagtctagcagcacagcatctcctgagagcttgttagacatacagattctcaggccttgacccagatctactgaacccaaaagggttgggcagggggtgagggtggaggtggaaccatcttatttttaaaaagcctccaggtgactctggtgcatgattctgatggtgagtttgagaaccacttaagccaatcagcaaatcacaaacattggctgtgtgtgaatggggaaaggataaaatgattaaaacagtgggaggtatataagttcattttcatgatgctgcgaagaattactcaagactgagtaatgtgtaaaggaaagaggtttaattgacttacagttctgcagggctcgggaggcctcaggaaacttacaatcgtggtggaaggggaagcaaacacatccttattcacatggcagcagcaaggagaagtgccaagcaaagtgggaaaagccccttataaaaccatcagatctcctgagaactcactatcacaagaacagcatagaggaactgccccatgattcaattgtctcccaccagatccttcctgcaacatgggattatgggaactacaattcaagatgagatttgggtggggacatacccaaaccatattatttcaccccggcccctcccaaatctcatgtccttacctttcaaaacacaatcatgcctttccaacagtcctccaaagtcttagctcattccagcgttaacccaaaagtccaaatccaaagtctcatcagagacaagggaaattccttccacctatgagcctgtaaaatcaaaggcaagttagttacttcctagatacaatgtgagtacaggaattggataaatatacttattccaaatgggagaaattagccaaaccaaagggactacagaccccatgaaagttcaaaatccagtggggcagtcaaatctcaaagctccaaaatgatctcctttgactccatgtctcacatccagggatgtggtacaagaggtgggctcccatggccttgggcagctttgcccctgtggctttgcagggaacagctcccctcccaattgctttcacaggctggaattgagtgcctgtggcttttccaggtacacagtgcaagctgttggtggatctaccattctgggatctggaagacagtgtccctcttttcacagctccagtaggcagtgccccaggggggactctgtgtgggaactcgcaccccacatttcccttccacactgccctagcagaagttctccatgagagttctctgtccctgcagcaaacttctgcttggacatccagatttttccatacatcctctgaaatctaggcagagattctcaaacctcaattcttgacttgtgtgcacctgcaggctcaacaccacgtggaagctgccaaggcttggggcttgcactctctgaagccatagcccaagccgtaccttggcccctttctagccatggctggagcagctaacacagaagtcactaagtcctaggctgcacacagtgaagggaccctgggcctggttcaggagactatttttcctccttagcctctggtcctgtgatgagaggggctgctatgtagacctctgacatgccctggagacatttttcccattgtcttggtgattaacagttggctcctcattacttatgcaattttctgcagccagcttgaatttctccctgaaaatgggtttttctttcctatagcattgtcaagatgcaaattttccaaacttttatgctgtgtcacctcttgaatattttgtggcctagaaatttcttccaccagataccgtaaatcatctctcttaagttcaaagttccacagatctctagggcgggggcaaaatgcctccagtctctttgctaaagcatggcaagagtcacctttgttctagttcccaagaaatttcttatctccgtctgagaccacctcagcctggacttcattgtccatatcactatcagcattttggtaaaaaccatccaacaagtctctaggaagtttcaaagtttcccacatcttcctgtcttcttctgaaccctccaaactgttccaacctctacgtgttacccagttccagagttgcttccacattttcaggtatctttacagcagcaccccactacacagtaccaatttactatactagtctgttctcatgctgctatgaagaacttcatgagactgggtaatttataaaggaaaaaggtttaattcactcacagttctgcaggactggggaggcctcgggaaacttacaacaatcatggtggaaggtgaaggaaatatatccttcttcacatggtggaaggaagaagtgccaagcaaagaaggaaataaccccttataaaaccattagatctcatgagaactcactcactatcctgagaacagcatggaggtagctgcccccatgattcaattacttcccaccaggtccttcccacaacatgtgaggattatgggaactacaattcaagatgagatttgggtggggacacagcaaaatctaatcaggagggagttaaactgacagtagacattttagtcttgtgtagaatgttaatttttctttatcagtcaaactccttccttccagaattatacatatatatgtataatatatattaatatatataatatatatattatatatttttatatatattttgtatgtataatatattatatatgtgtatatataatatattattatatattgtatatataataagatatatatacatatctttcttttatgatttccttccttttgcatgactttttttgaagactgacataatttcacttaggttggaaatgagtgtattggtccccttggagaaaaataaataaatccctatttgagtttatccagtacaataaaaactatcaggataaaatgatataagtaggaagtcctagaaaaaatgaaatccaatgatcagtaccttcgcatagtatgtgtatccgctatggaatagttggttataacttttagaattctagaggtctaaaaccagcatgatagctcattcctcatctcttggtctgaagaggagggaggcacaattgtttataaacataacggcactgaggtggggtgtatgggtatgaaatcctagtgtttctacatggttactttatataggttttactgagttaaagctctgtttttaatatgggtcaagactcatatatatatatatataataccataccaacaagccctgcatccctagcatgatcctttgaacctctagtaattagggcagtaactaaattggccctttttattttccactggtgtcaataccagctaagaggattacatcttgcttggatattaagactcttttcataactgaaagcatctaatcctgattattcactgtttgtatttataaaatatataaaactagaaataaatctctcaactgaggcccaaatgtcacagtcaaattaaccttccttgactactgattcactttgactcacagctaatgaggacagctccttttttttttcttctatttttctctcagtgcctgtagaataaatcctacatagaactggaaatagattttattgtgcatatatttacttatctcctgtgcccttcacattgcttccagttctgtatcccctgtgcccttcacaattgcttccagttactttggagatttttttttttttctgttttactttcctgttcagaatgcaagataaaatcccatggaaaaatgatcaaaatgcaaagtactcaacacaaaattataacttaaatttgatttatcttttggtcatatagatttccttagggaacatatttaaacatcatttcccaaacattccctagagtaagagatctgaaattttgtagcctagtaaaatcaccatgtgagcattaaatgcccgaatgcccaggttacagtccaggccaattaaatcagcatatccgtgggtggatccaagcatcagtagtttattaaatcttcccaggtgattacaatgtaaagccaagtttgaaagtttgaaaggatcctaaaggattcctctcagtcttatgagatattagtgttgtacttaaacaaaaaacgtataagatttaccacctttgggaaatgtagcagactgtttttgtcttcttacaaacacttaagagaatcacaatgaacattttcacattggctaagctcggtgtctcatgcctgtaatcccagcactgtgggaggccaaggcaggtggatcacttgaagtcaggagtttgagaccagcctgggtaacatggtgaacccccatctccactaaaaatacaaaaattaattgggtgtggtggcgcgtgcttataatcccagctacttggaggctgaggtgggagaatcatctgaaccctggaggcagatgttgcagtgagccaagatcccaccaccgtactccaggctaggtgacagaaccaggctgccccctccaaaaaaaaaaaaaaaaagtgtattaaaggctgagtacataaaggaagaaaatggatgtaaagaatgaaggaggacaagagaaaaagtaactcacacctccaagaaaaactgaaaacctatttagcttggcttatttcatcatatttcaaatttgtttgctcagatttcattgtatgtagaacacctgtaaaaattttattggaacacatcttccatagaatataattcagaaaatatggattaaaaggaatccaccacgaagtgtgtttctgaaatgcttattaaaaacccagttatatcagatcttcctatactttgttgtcatttttgatatttaaaatagtgtgtgaagtataacataagacttcagaaattatgtgaagtatctaatagaaatagggtatttggatcacaagcaccatgtgaaatttagttttaaaaagtcagtctccaaaaattaacagaagaattaaatgaatggtatgtagaggactccaacgtttattaacactggaaagggaaatccaatcaggtaagaaagtagagtggtatgatagcagaaatacagtgccaggatacattagatctagtggcatgtgcaggataagcttaaacaaactggttagtctgggactatccaatatcccatttctattatactcattcaccattttatattctcttctcccgggcttttctaaaaactttctttttctgaactttatacctctggaggctatctaatcagttgttgtctacagtttcttctttccttcatgaaaactaactggtaacctttcctcgggagtctcccaactccttcttgggggccaattgtatggtaaaatactaatttctgaatgcattaacatttctttttaattttcttaattttattttatttttccataagttattggagtacaggtggtatttggttacatgagtaagttctttagtggtgatttgtgaaattttggtgcacccatcaccctagcagtatacactgcaccatatttgtagtcttttattcctcactcccctcccactcttccccctttgtccccaaagtcaattatatcattcttatgcctttttgtcctcatagcttagctcccacacatcagtgagaacataacatgtttgattttccattcctgagtacctcacttagaataatagtctccaatctcatccaggtcactgcaaatgctgttaattcattcatttttatggttgagtagtattctatcatatatacataccacagtttttttatccgctttgttgattgatgggcatttgggttggttccatgattttgcagttgtgaattgtgctgctataaacaagcatatgcaagtatattttttgaataataataattatttttttcctctgggtagataaccagtagtgggattgctggatcaaatggtagttctacttttagttcttcaaggaatatccacactgttttccatagcagctttactagtttacattcccaccagcagtttagaagtgttccctgattactgcacccataccaacagctactggttttttttattttttgattatggccattcttgcaagagtaaggtggtatcgcattgtggttttgatttgcatttccctgatcattagtgattttgagcattttttcacatgtttgttggccatttgtatatcttcttttgagaattgtctattcacgtccttggcccactttttgatgggattgtttggttttttcttactgatttgtctgagttaactgtagattctggatatcggtcctttgtcagatgtatagattgtgaagattttctcccgttctgtgggttttctgtttactctgctgactgttcctttttctgtacaaaagcatcttagtttaattaagcccaaaaaactttatctttgtttttattgcatttgcttttgggttgttggtcatgaaatccttgcctaagccaatgtctcgaagggtttttccaatattcttccagaatttttataatttcaggtcttaggtttaagtgcttaatgcatcttgagttgatttttgtataaggtgagagatgaggatccagtttcattctcctacatgtggctaccaattatcccagcaccatttgttgaaaagggtgtcctttttccacttttatgtttttgtttgctttgtcaaagatcagttggctgtaagtatttgggtttattttttgagttctctattctgttccattggtctatgtgcctatttttatatcagtaccatgctgttttgatgactacggccttatagtttaaaatcaggtggtgcgatacctccagatttgttatttttgctttggctatatgggctctttcttggttccatatgaattttagaattgttttttctaactctgtgaaaatgatggtggtattctgatggggattttgtggaatttgaatactgcttttggcagtatggtcattttcacaatattgattctacccatccatgagcatgggatgtgtttccatttgtgtcgtctatgattactttcagaaatattttgtagttttgcttgtagaggtctttcaactcctttgttaggtatattcctaagtattttttttcagctaggggttgagttctcgatttgattctccacttggtcactgttggtgtatagaagagctactgatttttgtacattaaccttgtatccagaaactgctgaattctttgatcagttctaggagttttctggaggagtccttagggttttcaaggtaaataatcatattctcagcaaacggacagtttgacttcttctttactgatttggatgccctttatttatttctcttgtctgattgctctggctaggacttccagtactatgttaaagaggagtggtgacagtgggcatccttgtcttgttccagttctcagagggaatgctttcagcttttccccattcagtgttatgttggctctgggtttgtcatatatggcttttattacattaaggtatgtcccttgtatgccaattttgctgagggttttaatcataaagggatgctggattttgtcaaatgctttttctgcatctattcagatgaccacgatttttgtttttagttctgtttatgtggtgtatcacacttattgacttgtgtatgttaaaccatccctgcatctctggtaggaaacccacttgatcatggtggattatcttctcattttgttgttggatttggttagctattattttgctaaggattttagcatctatgttcatcaaggatatcagtctgtagttgtctttttggcttgtgtcctttcctggttttggtattagcgggtgatgctgtcttcatggaatgaattagggaggttccttctttctctatcttgtggaatagtgtcaaaaggattggtaccaattcttctttgaatgtctagtagaaatcttctatgaatccgtctggtcctggatttgtttttgtttttatttttgtttttgagacagtctctggcctcactgcaacctctgcctcccgagttcaagtgcttctcctgcctcagcctcctgagtagcttggaatacaggtgtgtgtcaccatgtccggctaattttttgtatttttagtagagacgggatttcaccatgttagccaggatggtcttgatctcctgacctcgtgatttgcctgcctcagcctcccaaagtgctgggattacaggcgtgagccactgtgcccggcctggactttttgttgttgttggtaattttttaattactgtttcaatcttgctgcttgttatcggtctgttcagggcatctaattcttcctgatttaagctaggagggttgtatttttccagaaatttatccgtcttttctaggttttctagtttatgtgtgtaaatgtgttcacagtagccttgaattatcttttgtatttcagtggtgtcagttgtaatactgtttcatttcttagtgaggttatttggattttctctcttcttttcttggttaatcttactaatgtcctgttaattttatttatcttttcaaagaaccagatttttgtttcatttatcttgtgtatttttgtgttttgttttaatttcatttagttctgctctgatcttggttattttctttcttctgctaggtttgggtttagtttgttcttgtttctctagttctgtaaagtgtgaccatagaatgtcagtttgtgctatttcagactctttgatgtaggcatttagggcttgatctttcctcttagcaccaccttagctgtatcccagaggttttgatatcccagagggcaggactcactcccacggctgcccacccggcctgcccccgtaacagtctgtttccaggtggagggcgagacaggcttgaaaacttgcccgaggctttctgcctcccagctgcaaaggaaaagggctttagatcttcccctgcctgtgaagtccgctagccagattcatgccctcccctgagttctggccgggggtttctctccccattcaaattgttacaaatttcagatagagaattccttctcccagtggagttttagctcctgcccctctggccaccctcctgctggatccctgtggtgccaggcaggaatgggctgcttgaggacccggtgagctcccagggcctttctgctgcttcctctatccctgtatttcactcagctcggctctcttaacttgactcagctccaggtaaagtcggaaacttctcccacaaacagaccttcagcttctccagtgggggtgtgtgctcaggagaggagggtgtcccgttcccacttcctcagttggggcactcacagtatttagggtgcttcctgggtcctgcaggagcagtccgcttccttcagagggtctgtggatcctctcaggattgctggtttgttcttgcagtcgatctagagctaaaattcacagtgcaagcctccgcatgctgctctgtccggagctgcaatctagttctgccttccgtccaccatgatacctgaatgcgttaacatttgaccctagtgatggaatttcacacgctgtgatggatatttaattgtaagacagacgcagagtgatggtggtcattctccatatagctgtcctaagagatctcaaaaacttctgcttaattagagtctcttaatcatgaaaagttttgagttatcatagacagtggtgaaaataattaaagtaattaggcaaattggatttggataaacattttaaatggatagtcaaatatcaatgttggagaaggttctattggcaactgagtctgattgacaggaaaaaggaagattaaatgcctaatagacaaggctctaagattatccctggtctgataacgattttggataattctaccagagttgacaatgttgtgtatttctttttaactgatttcgtctcttgcttaatttacccttctaaattcatatgatctccccaaccacaaagaacagttaaacacccagcacaaaatggtttaattttaaaagaaattgattgattcatgtatataaaaagccaatagcaagagctgcctcaaatgatatcactacatgtttttttctttatattcatttgcatttgtcttcacattccatattctcacatctgacaaatctatgtcctctctatcatggtaacagagtcgctgacccataagcttacactacaccatgctagggaagagaataggtcatttccaggtgtctctgtatggaaaagagaatgttttcctttccagtagcttaagtaaacatcaagtttcattggctctgttagggctattttcatttatttctgaacaaatgatcaggatacactaactgtagagccaatcacattgtaactacatggtagtgaaatgggggtcataggattttcaaaagaaatgtggattatcatcaagaataggaaatgaatgctgagttgtaagaaaaaaatgcaaatagaagttcacccttgtcatcattcttcatatccttctgtctatagtgtacaacttttgattgatttttacttttgaccttaagtcattgatccctcttttaaaaatctgtcttgttttataaatatccttgagacaagacttaagagtatttttaggaaattcaaacctacatatttttattttctataagtgtgtatgaaattcattaaagaggatgttcgtttatatccaccactttaaaacttacagcagtttaaatataattggttttcagtaaaaattgtatataatgtaggaaacatgacttcattgggcaaaactctagaaaaatatgtagttaacatttttgggaaaaactgtccgtagtagcctgtgagttagtgaaggagtgtccccaggccctaaacagaaactaatgttttctaggatatagcattcaaggaccaagaaactaggtgagaccagatcaagaaaattaggagataaaaatgaagagtaatatgatatctgtattgctttttctttttgtttgattttggctgccttcttctttgctaccacccaataatgagcacttctggtttgcttatctatttatttcattagttttattttttttcgaagctaattcttacacgcctctcttaatgttcagaccctttatatcttattttttccagtgaatgggagatattaagatttgtccttttgagttgattatatccaatttattttctttgtttgagaatgtaactgagatatcactgggtctctcaatattttgaaaccagatgattgtctaaaatcctcaatcccataccctttagaagtccaaagctttatgcaacatgtatttgagttttcaagggcattaataatcacttttatttgctctctttattctaggttgattttgatgtaaaatttaatcttttttcaattttctcataaaaatcccactcagagtcacattaatgaagatttgggatgtgttcaggaatcgaaacatattgttcgttccaataacttcaacttgaatataaagctacatctctgtggtttaaatgccttttaatagcttcaccaaagtggaatttcaggcccataccactcatgggctcctctctcctccgtcttcccgccagcttcttcaggttttctctcttcccatctttcttagaaacacaagatgctcccattccccgctttataactgcctcctctcttggactcacttctccagctcctccagtgtcttctctcttcccatctttcttagaaagacaagattatcccattccccgctttataactgcctcctctcttggactcacttgtccaccctggcccactactcatctcttctcacctcctcaaaactacattatttcattaccaatgatttcagccttggcctcacttcagaatgccttttaacagagtactccacagccccatgttgtcaagagcttcctatgatggaagatcttacttatacatttggtatcctgcttctttttgtcctaatacacttgtttgtttgtttgtttgtttttcattttaagttgtttcataagtggctccagtttcttctcaaatatgttaggtataggggaatttttttactggttcagaattccttttctcttaattttaatatttttcctttaattctcacccttaattattcaatttaaaaaaagaagcctgcttttttaacggactttattctcctttaattttttatgttctccttgaaaaccttaagctttttacccagagtgcttaattattcattcactcactcattcattcattcactcaacaaatatatattaactaccaaccataacgaattaggcatggtctttctagtttacctggtttgactgctaagagctttagcagaggtacagagaaaaagctgttagatgtcataagaggtagttaccatttcccaatgggggactgaagcaaggcaacatacaggaatttagcatttggactcagattgagagacaggttttggatttgtgttgtaggtggattaaaaaaaaagtttgaacacagtggaaacaaaaaaggccagaaggaggaggttagcaagaaaatgctcttaactgtgagcaagtggattttggaatagccaaacataattgagatgatgtaggtcacaatgattttaagaattgaatgggagtggaataaaatttaccccacaattacatactttgcttcttcattgcttgacggttatcatcaaactaactattcttcaattcctttggcaaggagtggaatctggactctggcaccagagggtcgatttccttccagttctcctttctattttttttttgcttttgtttctttactttgaactcctcacagtcttggaaaaaagagggcttgcagagactttttcattttgtttttatattgcccaaattgtactcacatggatagagtagtaccatttaattgtttccctctaaatatgcacagttcccagaggtattttaatcagatagctttatgccctgttgtttgcagtttccaactttttgttttctattactttctgtttatttagaatgttgctgcctcttcttttcttctctccattttctccctgtcttcatttgctcaccacccatcttggatcaacctctaatatgaatattcaaaatagttgagtaagtcaagttctgtctctgaaaatctcttgactaaaaaaacagattaaaaaataatatcactgacccttttagaggctgagctctgtttcagaaaacattaaggaatgccttcaacattttctcttgtttagttgcatcatttacttgagtccactgggatgattggcattcacgatgtgtgggctggagaccatcaaaaggaaatgttttgtgtggaaatggaatttactctgtgtgtggcagtttgaataagttccctttctctttggctaaagcatctttaccaagcccaatctaatgcattagtcacagaacttaaatagaaaacaacaaagcttccaggcacattgaggatttcttcgttcctttgtctttttgatgaagtccctcagttctttcatttccaaaataaagaagcaagcctagtcgacagacaaaattaaatgaacctaaagaggctaaggacattagttgtttatgtgttcatattagtttctggaagaactaactagataatagatcagtcaggccagttaaactaatttcttgattatttcaaatttaaagactgataataaatgttggtttgaccttaacagactctcttatttaaggaggtcaccactttacaggcacttttaaattctttattatttacaaaccagactaatatggcaaaaagaaaacagaatgttaaggaacactgaagagggtatgagcagacaagaaattcaaatgtgaaatagaaacactaagaagaaagtagtaacaatacgaaagatccaatttgcaggaatttgattatctacttggttcctgggtactatggtgaatgtaatattggcaatgataaataatacctaaaattaaatagctttatatatgtaagattaacaaggagaaatgagttctccaggatacccaatgtattagtaactcaaccagttttttctgggttttatcatgtcctattacccagtctatgctttattgccatagtatatggcttctcaacataatacttggcatataatagggatttaaacgtttctgactgaatgttcctagtaagtgaattaggtgtgtgtatcctttattggaatttaacaaaacaacactttggcctctcaatttcctgagctcctcacttctggtgacctttctctattctatcctagaatttatctttagcaattactgtgctcactctaaatctcaattttaagcactcagtttcacacatatcacattctgatgaccacctccttctttccacacacttctttcatgaccctatggcaacagttctttgacactgctaagcctgcttttctgtttattgttgccccctctttcagtacttttccctcttcattttctcacatccatctctaacttagattccatagtaaaagatagtaatcactgtctttcctgtgcttcacctaccctggctaactcttcttccatcatcttcttccagtaaaacttggatctcacttgtattccattctcagactgctccattcttttgaacagctggatatggctagagtaaaatgccactatgttgacggtctttaccttgattttgtaaccataagacttaaatgttacctcaacacttcctagaaatcttattacataaccctggtccattcactctcctgctcttcaagacaaccattttataccttctttctcactgccaagcccaccacctttcattttcacctcacatcttgcttcatatatagaaatgatgaaaagagaacgttggtaccttacaaatctcccaatcttttcacatctgaatctattaattgtatccttttgaatgaataaattgcccctgttcttatctaaagtcattattttttgttttctgtcagttttttaaaagctcttttattgaagtataacacatgtacagaaaaaatacacaattcacaaatttacagctcaataaattttacaaagtgtaaacattcatggatccatcatccacatcaacatataaaagggtcttatcacagaaacctcccttatattcctgccccttttataatccccacaaaagtataaaaaaatcctaatttccattgccataaatttgtcttatttttaagctttaagaaaaatggaataatacagtgtaaaaccttttatgtctgccttctttaattcaacattgtatctgtgagacccatccatatttatagagcactttgtttctcattgttttatattttatatataaaatacgtttatatattttatatataaaatacgtttatatatttatatttttatatataaaatacgtttctatatttatatattttatatataaaatacgtttctatatttatatattttatatataaaatacgtttctatatttatatattttatatataaaatacgtttctatatttatatattttatatataaaatacgtttctatatttattttatatataaaatacgtttctatatttatatattttatatataaaatatgtttctatatatattttatatataaaatacatttctatatttatatattttatatataaaatacgtttatatatttatatattttatatatgctttatattttatatactttactgtagatgaaatttaggtgacttccagcttagaatcattataaataattttactttaaatatgttatacttatcttttggtgtatatttgtaagaatttctgttgatacatacataggagtgtgattgcttggtcatgagttctgcaaatgttctgcttaattgacaatgccaaacaattttacaatttaaactcccactagcagtatataggagttcctattgtccacatccttaccaacacttggtattgtgagcctttttcatttttgccagtctggttggagtagggtgttatatcataatatttttaacttgcatttttctaatgaccagtgagtgagatcaatcatgttttaatatgcatattatcgtttacatcaactatatatataaatttttcattgtcttgttttttaataaaatttttagagatcattgaatattcacatgcagttctaagaaatcatatagtgagatcccttgtagtctctctattctgttccattagtctatttttctattcttgcaatatgacactaagcacactatcttaattactgtgacttttcagtaactattgatatctagtagtatacatgcttcaactttgattttttgcctgcagaaatttcttccacattctaagtcctttgtatttccatataaattttagaatgggcttgtttatttctactaagaaatctgcttgaatttcaatggggattgcaatttgtaaggaaaatttacactttaagaggactgagtcttctaattgaggaatgtggcatatctctgaatatatttaggtcttatttaatttctttcatcaagattttctaatttgtaatatagaagttttcattgccttctctcatatttctagttattttggtttttgatgatatatatatatgtagtatttaattttcattttaattttctcttgttgacttatagagatacaattttgtatgccactagcaaatgaccctcactcccgaatacaataattctctgtatttcttttttaatagtttaatgcacagttatctgtgggttatgtttagtgatattctgggagactgaatggaataatatacctgtcaagcccactaactggccttcttccttctttaagtactttcactcccagtagaagtatatcctgctctgtattcacctcctggatgatcatttcatcatttataactgtctactttgttatttctatattagtaccttaagcaaatagcctcctttatatactaaaactaatataaagcattatgaatgcatacactgttactagtctggatagagatctagttcattatccattatacattccactgacagaagtagaaagaatataggaagaactgaacagtaggggtccaggtaggagtccatcctttccatgccctagtagggacactcgacgctcaaggaaaatatctcaagatctcctcctctctgtgcatggtctctcatcccttgagtgacatgatgacatataaaacattcttagaatttcacttgaggcagatattactaattaattaatcaaagcaagcatgtgaaatggtatcaatttgccaaaccaggttcagacattgtgcctcaattcagaaataatagaattatgcaaatctaaaaatgtgaccctcaaaagtgtggaatacctctgcttgaggtaataccgctcctctccttcagctactcactcaactctgacaaatcgtaactcagtttactccctatatccccaagctttctttgttaaaagaaattttgaactacttgcttttgaaagtaactcacatggcatgctcttagcatcatctagcacaagctttgttttcttctgttcaacttcctttcagaggtgcatttttacaacttccctctattgttctcattgactttccgggtttgatgcgacctgaaaaactctcctttctgaaattcgttaaccagcttcatcagttttatagcaaggactggaagcaccaatttaaaatttaaatggtacaatgataacttcaaattagtttgatcaattattttaggaaattccaaaaactgaaatttcaaatattgaaatgcaggaacttccttgcccctccctggctctataaataattaaaataaaaagtttcctcacaggaaatatataaaatatgtttgttttgttttgctttagtggaggaaaagagtgtaaatctagaactaataatttggggttttctttgtttgtttccacagaaataatcaatgattccacactaatagaaaccatttgtcccaactgaaataggcaaaaacacggttctgttccaattttacaatttttttttgtttcttcacacaacaccgtggtgatgcagtgtctagactttttggaacaaggcatggagtctggaatttattctgtgggtttgaaaatggttattcagtgctcctacacattcacatgtgaaaatctaatgatttcataataggtaaaaaccatcaagctgtttaccaaatacatatatattcattaatgctataagttcaagctgctacttatagcattggtgaatatacaaggaaatattgtatggattaatatatgtcatctcattgtgccgtggtccccattaacccctatatctgaaatatgcaaaataaaaaacttgtgttcatgaaataattattgcagatattttctagcttttgtgaggctctagtaaaaaaaaaaaagcttaagaatatacatctattcttgtggtttcaataagtaatctgtgagaatttatcaagttaaaagggcagaattgatatcacaggtcgttctcttagtcctctgccatttattagctggataaaatgaaagcagtctctgaggcacccagatttaaccagtgtttgtgcaggctgtattattaagtctgactgtagttcatctgtgctctgaagaaaatcaaactatgtgcttgcagagaaagttcagagttatttgtcaccaattacctaaagctgggagttgagcttacacatagctatggccaattcctgtaaatacttgttcctaatttcacaagactgtcacttcctgaggatttaccttagaaagtgtatgtctaccacagaagaactgtaatacaaaaatgtttacccagagataatagtcttaagggacataaaactccatagcattgattagtttaaaataacctgttcttaattttcaaacaagtatttcaagttctgttaggttttctgtgacaaaaaaaaagcaagcagaaagattttttttcattaaaagatacacacacatacaacacattgaactgagctaatctcaattatactattaaatctctactggttattttaagaaaagaaacataaaagtaagttaccaagtatttaaggtagctcgcctggaagaaaattaggttgtctgaatataaagtgaaggttaaaaaaaatggaaaaaacaaaaaaaaactaaaattatcaatcaatggcatgtttctatatttcttacttaaattattaaaggccattaaaacaagttaatacctatattacataaaaatgatcagaaggaagatcttaagaccttatttacttcaaaaataatgaagtagactgaaaagtgtgctgaatactaggtcagaagaactgggggctgggcgtgggggctcacacctgtaatctcagcattttgggaggcagaggccagaggatacttgaggccagaagttcaagaccagtctgggcaagaccctgtctctacaaaaataaaagtaaaaaagcatatctaggcatggtggtgcatgcatgtagtcccagctacttgggagggtgaggcgggaggatcacttgagcccaggagtttgaggttacagtgagctatgattgtaccactgtactccagcctgggccacatgagcaagactgcctctaaaacaaaaagaaacgagaaggaaagaaacaacaacaacaacaacaacaacaatgacaaaactggagtttatcctcgttatataagaacctatatttctccatctgtaaaataggtaaagcattttgcttgactcagtgttgctctgaagagaagttgattgtgaattgcatgacaggcagttcagttttggtcatgttgacaactttattgaatgtcatgaaagaagtaaagatactctgattcagttttactaaaacaaaatgcagatggagttttaaataagtgtcatttgaagaagtttagctaagattcacctaaaatgctactttattattaagttctgggatacatgtgcaggtttgttacataggtatacacgtgccatggtggtttgctgcatccatcaacccgtcatctacattaggtatttctcctaatgctatcccttccctagccccccaccacctgacaggctgcagtgtgtgatgttcccctccctgggctcatgtgttctcattgttcaactcccacttatgagtgagaatatgcagtgtttggttttctgttcctgtgttagtttgctgagaatgatggtttccagctttatccatgtccctgcaaaggacatgaactcattctttttatggctgcatagtattccatggtgtatatgtgccacattttctttatccagtctatcattgaagggcgtttgggttggttccaagtctttgctattgtgaacagtgctgcaataaacatatgtgtgcatgtgtctttacagtagaaagatttataatcctttaggtatatacccagtaatgggattgctgggtcaaattgtatttctggttctagatccctgaggaattgccacactgtcttccgcaatggtagaactaatttacacttccatcaacagtgtaaagtgttcctatttctccacatcctctctagcatctgttgtttcatgagttgttaatgatccccagtctaactggtgtgagatggtatgtcactgtggttttgatttgcatttctctaatgatcagtgatgatgagcttttttttcatatgtttgttggccacacaaatgtcttcttttgagaagtgtctgttcatatccttcacccactttttgataaggttgtctttctcttgtaaatgtgtgtaagttacttgtagattctggatattagccctttgtcagatggatagactgcaaaaatttgctcgcattctgtaggtcgcgtgttcactctgatgatagtttcttttgctgtgcagaaactctttagtttaattagattccatttgtcaattttggcttttgttgccattgcttttggtgttttagtcttgaagtctttgcctatgcctatgtcctggatgatactgcctaggttttcttctaaggtttttaaggttttatgtcttacatttaagtctttaatccatcttgagttaatttttgtataaggtgtaaggagggggtccagtttcagttttctgcctatggctagccagttttcctaacaccacttattaaatagggaatcctttccccattgcttgtttttgtcaggtttgtcgaagatagatggttgtagatgtatggcatatttctgaggcctctgttcttttcccttggtctatgtatctgttttggtaccagtactgtgctgttttggttactgtagccttatagtatagtttgaagtcaggtattgtgatgcctccagctttgttctttttgcttaggattgtcttggctatgcaggctctttttttgttctatatgaaatttaaagtagttttttctaattctgtgaagaaagtcagtggtagcttaatgggaatagcattgaatctataaattactttgggcaatatggctattttcatgatattgattcttcctatccatgagcatggaatgtttttttccatttgtttttgtcctctcttatttccttgagcagtggttcatagttctccttgaaatgatccttcacatcccttgtcagttgtattcctaggtattttattctctttgtagcaattgtgaataggagttcactcatgatttggctctctgtctattattggtgtatagaaatgcttgtgattttttcacattgattttgtatcctgagactgtgctgaagttgctcaacagcttaaggagattttgggctgagacggtggggttttctaaatatacaatcatgtcatctgcaaacagagacaattggacttcctctcttcctatttgaatgccatttatttctttctcttgcctgattgacctggccagaacttccaatactatgttgaataggagtggtgagagagggcatccttgtcttgtgcttgttttcaaagggagtgcttccagcttttgcccattcagtatgacattgagtgtaggtttgtcataaatagctcttattattttgatacgttccatcaatatctagtttattgagggtttttagcatgaagggctattgaattttgttgaaggccttttctgcatctatcgagataatcatgtggtttttgtcattggtcctgtttatgtgatggactacatttattgatttctatatgttgaagcagccttgcatcccagggatgtagctgatttgatcataatgataagctttttgatgtgctgctggattcagtttgccagtattttattgaggatttttgcattgatgttcatcagggatattggcctgaaattttctttgtgtgtgtctctgccaggttttggtatcggggtgatgccggcctcataaaatgagttagggaggattccctctttttctattgtttggaatagtttcagaaggaatggtaccagctcctctttgtacctctggtagaattcggccatgaatccatctgctcctgggctttttttgttggtaggctatcaattactgcctcagtttcagaacttgttattggtctattcagggattcgacttcttcctggtttagtcttgggagggtgtatgtgtccagtagtttatccatttcttctagattttctagtttatttgcatagaggtgtttatagtattatctgattgtagtttgtgtttctgtgagatcagtggtgatatcccctttattattttttatggtgtctatatgattcttctctgttttcttattagtctggctaatagtctattttgttaatcttttcaaaaaaccagctcctggattcattgattttttgaagggtttttaatgtctctatctccttcagttctgctctcatcttatttatttcttgtcttctgctagctttttaatttgtttgctcttgcttctctagttctttcaattgtgacgttagggtgtcgattttagatctttcctgctttctccagtgggcatttagtgctatcaatttccctctaaacactgctttagctgtgtcccagagattctggtacgttgtgtctgttctcattggttcaaagaagttacttatttctgccttcatttcattatttacccagtagtcattcaggagaaggttgttcattttccacgtagttgtgcagttttgagtgagtttcttcatcctgagttctaatttgattgcactgtggtctgagagactgtttgttttgatttccattcttttgcatttgctgaggagtgttccaattatgtggtcaattttagagtaagtgagatgtggtgctgagaagaatgtatattctgttgatttggtgtggagagttctgtagatgtctattaggtctacttggtccagagctgagttcaagtcctgaatatccttgttaattttctgtctcattgatctgtctaatattgacagtggagtattaaagtgtcccgctattatggtgtgggagtctaagtctctttgtaggtctctaagaacttgctttagtaatctgggtgctcatgtattgggtgcatatatatttaggataattagctcttcttgttgtattgatccctttaccactatgtaatgcccttctttgtctttttttatctttgttgttttaaagtctgttttatcagagactaggattgcaacccccgcccccttttttttttttgctttctatttgcttggtaaacattcctccattcctttattttgagcctatgtgtgtctttgcatgtgagatgggtctcctgaatacagcacaccaatgggtcttactctttatccaatttgccagtctgtgtcttttaattggggcatttagctcatttacatttaaggttaatatggttatgtgtgaatttgatcctgtcattatgatgctagctggttattttgcccattagttgatgcagttttttcatagtgtccatggtctttacaatttgatatatttttgcagtggctggtgccagtttttcctttccatatttagtatttccttcaggagctcttgtaaggcaggctcggtggtgatgaaatctctcagcatttgcttgtctgtaaaggattttatttctcctttgcttatgaagcttagtttggctggatatgaaattctgggtagaaaattcttttaagaacgttgaatatttgccaccattctcttctggcttgtagggtttcttcagagagatccactgttagtctgatgggcttccctttgtggataacatgacctttctttctggctgcccttaacattttttctttcatttcaaccttggtgaatctgatgaatatgtgtcttggggttgctcttcttgaggagtatattgtggtgttctctgtatttcctgaatttgaatgttggcctgtcttgctaggttggggaagttctcctggataatatcctgaagagcgttttccaacttggttccattctccctgtcactttccagtacaccagtcaaacgtaggtttggtcttttcacatactcccatatttcttggaggctttgttcattctttttcattcttttttctctaatcttgtcttcatgctttatttcattaagttgatcttcaatctctcatatcctttcttccacttgatcaatttggctaatgatacttgtctatgcttcatgaagttctcatgctgtgtttttcagctccatcaggtcatatatgttcttttttaaacgggttattctagtcagcaattcctctagccttttttcaagtttcttagcttcctttcattgggttagaacatgctcctttagctcagaggagtttgctattactcaccttctgaagcccacttctgtcaattcatcaaactcattctctgtccagttttgttctctcactggcgagaagttgtgatcctttcaaggagaagaggcattctggtttttggaattttcagcctttttgcactggttttttctcatcttcatggatttatctacctttagtctttgatgctggtgaccttcagatgggttttttgtatggatgtcctttttgttgatgttgacgctattcctttctgttagttttccttctaacagtcaagcccctctgctgcaggtctgctggagtttgctggaggtccactccagaccctctttgcctgggtatgaccagcagaggctgcagaacagcaaatattgctgcctgttccttcctctggaagcttcgtcccagaggggcacccaccagatgcctgtatgaggtgtctgccagtcaggaggcatgagggtcaggggcccacttgaggaggcagtctgtcagggacccacttgagggacccacttgaggaggcaaagctcaagcgctgtgctggaagatctgctgctctcttcagagccagcaggcaggaacatttgtctgctgaagctgcgcccacagccactcatacccacaggtgctctgtcccagggagatgggtgttttatctacaacccctaactggggctgctgcctttctttcagagatgccctgcccagagatgaggaatctagaaaggcagtctgactatagtggctttgccacccagtttgaacatctcagcagctttgtttacactgtgaggggaaaacagcctgctcaagcctcagtaagggcagacacccctccccacaccaagcgccagcatcccaagtggacttcagactgctgtgctggcagcaagaatttcatgccagtggatcttagcttgctgggctccgtagaggtggcaccctggcttcagccccttttccaagggagtgaatggtttgtctcactggcattccaggtgccactggggtatgaaaaaaaaaagctgcatctagcagcccaaatagctgcccggttttgtgcttgaaacccagggccctagtggtgtaggcacccaagagaatctcctgttttgccagttgtgaagactgtgagaaaaggcatagtatctgggccagaatgcatgttccttaccgcacagtccctcacggcttcccttggctaggagagggagttatccaaccccttgtgcttcccaggtgaggcgataccctacgctgcttcggctcaccctccttgggctgcacccactatctaaccaatcccaatgagatgagccaggtacctcagttggaaatgcagaagtcacccgccttctgcattgatcttgctgggagatgcagaccagagctgttcctattcatccgtcttgccaactacccccaatgcttattaaccatactacctaggaactccagtttggcaaggaaagtctaaataatggaatagatactcatgtgaactagtgaacattgctgtatatggccacaagtcatgtttctaatgacctctaattcacagaatttcttcttagagatgtagagagtggagtggggatggaccagagtagtattctacagagggtgccagtgacatcctcttatgcaaaggatacacatactaacttactgggcaagttgcaaagtttagaattactaactttagaataggaaatactcaaataggtaaggatttgtccttttactagtatatagtaaaccttggaaacccatgaccaaagggcagaacatgagccacaaatctatcaattctgaacttaattaaattcatggttgataaaaatatattctcacttgctataaatctgctagatttttgagattcaattaaagaaacattttccagaatatatttcttagagtagtagttttaagcaaaactaattaatgataccaaaatcaaaacaaaagttttagaaatactagtttatcacctttaataggcttcttctgtaaaacacgatttctcagtttaatcatatgtcaatatcaagaagaggatatatcaggcagcattgctgaaatacattggaacacagaaagctttactctcagtatagctagtgttccaaggaatatattgtaaaaagggctaaattaaaggatatttagaacctatatagcagaggcaaattacctatctgaaatgtccagggaactgttatctacaacatactctatagagtaatcttgttgaaaaggcagatgctggctgggcacagtagctcacacctgtaatcctagcactctgggaggctgaggcaggtggatcacttgaggccaagagttcaggaccagcttggccaatatggcaaaaccctgtctctactaaaaatacaaaaattaaccaggtgtggtggcacacacctgtactctcagctactggggaagctgaggcatgagaatcgcttgaaccctggaggcagagcttgcagtgagccaagatcacgcccctgcactccattctgggcaacagaatgaaacccagtttgaaaagaggaggaaaacaacaacaacaaagaaaaagaaaagatggactagtgttcagatgctttccttgattcagaatcagcatgcctcttaaatactgaatatactaagatacacaaaacagtaatttagctttttcatattgatacatgaacttagtatttgatctcagcaaatttagtaaaataatcaggagcttttgatttgccacaaaaaatcattcctctaaactttatgaattgagaaaacttgtctttatttgatgattccagttttgatgttttgtgttattggtgaagttcagaaactcagaaacatagttgattccatagaaaattcaattcttgaagagtagaactttgaaggtgcaggatgaatatgtgtgttatgaatatgggtcatactttatgcttatgtaactgaacatgtagttttactggggctccctttcttcattgcaaaaatacaacttatcctcaatacataatttattgactactacaacttagcaaaaaatgatttggcttcattattcatcccgataagaaaaatctggtgaattaaaggtattggaaaggaaattttaacactgatatgagaatgaaatgggagaagggaacaatagagacttcaatattatctgtaatactccatttttttatatttaaaaaagtgatgcaaaaatgaaaaaatgacatttgccaataatgccaatgtatcacataactattacattactttgctgcttttttaaattcaaaaaataaatattactaaccatttatatgatcattcattcaacaagtacttgttgagagcctactatgtgataggtgctagcaataaaagagagtaaaaaagagacatcatccccaactctcctggagtttgtgtttagatgtgaaatgtgaaatgtttgagatcttatttagaatagaatgtgtaaaaggacaaagtgaggaaatgggggtgaattaactcatattgataattaagaggtagggctactgtgggtacttaatcagcaagcaaaggcctttcaatacagagaggagctgccttatttttagtgaaaattgagctgggaaaaaatacacactggctatgggccccatagctaaagcagtctcctgtggtatttaataattttctcactggttgcagctcaaagttcacatgcatttttctttgattctctctagtatatgactgctgctgctcctatgcaagggacctacattcctcagtacacgcctgtgcctccgacagctgtttctattgaagtaagtctacccctgtctaataaagaggttagaagaaataaatctcagtcacatatactgtagtcccccataaccataggaatcctcacttgcaatttttgtgctactctaaaatatgacattgtaaattcagtgtatgaaagtataaacatttacttgaatgtggctgtgttttgctttgcacatgaaatgagctcatctgctatggaggcacgacgggagtctctttcatatttagagaaaattccagaggccaaatcacaactccatcaaattttaatcacaaatacttcttataaaaggaaaaaagtttgcaactatgtgaatgaactaattctctaatgccttgttcctcaaagagtggttcctagaccagcatcattggtatcccttgagagcttgttagaaatgcagacttgctgggcatgatggcatgcacctgtaatccttgctacttgagatgctgagacaggaggatctcttgagaccagaagttcgagaccagcctgggtcaaacagtcaaacagtgagaccctgtcagaaggaagatcagaaggaagaaaaggaaaaaaaaagaaatgtagacttttaggtactatccagacctactgcatctgaatttgcattttaagatgatcactcagtgatccaaatgcacattaaaatttgagagacactggactaatgcactggttctcaaattttctgcacatttgaattattttgagagctttaaaaatattgattcctgagtcctatccccagagattatgatttatttgtctggagtatagactgaacatcatatttttaaaagatcttagatgattctaatacgtaccaaagactagaaaccattgctctaggccatgaacctgcacaggtttacagcttcttacagacaagaaagaagttgtacaactcttattgctgtagatatcatgaatgatgatgtcagcttgtccttaatggaagctttgctgctttcattctctctttccattgggataaatctatgccctctacacatcattttactggacagggccataaactacatagaaatggagagggcatagagctatgcagatggtggtaaaacacttaggtacctatattcttctttctggttctagccattactgttttattgcccttctttcccctctcctgatgcacaggtgcattatggtcaccgtgcattccttctcagcagctgggaatcccctgcagctgatgtctttgctactccatttgttggcaagcaactactgtgttggtaccactccacataaaaattcaccaagactcccaatctctgagattgagggaaacctttacggactaaattggatcttctaaaatgtttcctggttttggtgtgtgacaaatgtttgttcataccaaggtttaggaaatccagatgtttaacagggcactgatggaaatcaaggagttccaatgtttaaatctttcatgtgttctagacctataggtctcaaagaatgtgtcatcttaaacagttttaattgtcttttcagaattgcaagaatatatgattaaatttcatgttctttggtatatttagctttcaaaaagcacctatgcgataagaaaattaaaaatctggacattctaggcagtttaagtgtaaacttctgccacatattttcatttctctgtgtacaccaaagacaaatacttatctacaaaatttgaccattttgatgattattatgagacatttgacagcgtggcttattggaaacagtctaattatatttagggattaaaagaaatatttcattgataaaaatataaatatactctgatatattgccttgaaccagtgattataaggaaaagcattaattcattctctatgtgaaaacactcattgaacatttatcaatatctataaaggtgggaggtttcaaaaaataaataataccaaatagtaaattaggaaagaaaagattgaatagagagacttttcaaattctaaagaagaaatttagggaatttcagcgacagaattaaccaagaacttctgaaatttgacatcactgcaggtatccaggactacaaataaaaccaggaaaatttatcaggataggtgctcttcttaggcctactaacaaccaaataaaatcacctatgcctctctggattccaaaaatatattcctgattgtgaccaattccggaaatccactcttgccagcatctgtgagaaacaaaaaaaaaaaaaaaaaaaaaaatagggtgaaggaaaagcaaaccaaaattaaggacaagttttgttgttgttttcttaaaacttcttgatgactttcagttcatataccagaaaacaaaacaaatcaaatcaaattactggagagaaaaatctacttaatagcatcctttaaaagatttccaaactttgatgtatatttttattaaggtcactttccattgttatcccaaatggtatagacatgatacagtgaaatatgccaggaaaatgtttggacatacaagtttgtataggaatcctgaatgaggataaattggcatttattgtggataaatgtgcaaacctggtttaaaagttccaagtataggcaaaattattttctgaccacttaactactccaacaacttctaatggcaaggcttcttggtgtcacattaggatgaattacttagcccttatctaaatgtgctctctgggtttcctctgagtacttattgtgacttcatgtagctgagggtatctctacttaagccaaatagaagaggggtacttacagcctatctagagagggcccttcactgaagcaagtaaggcttttatgttcttatttgcctccttagggtgttgttgctgatacctctccccagacagtggcaccttcatcccaggacaccagtggtcagcagcaacagatagcagtggacacatccaacgaacatgcacctgcatattcttaccaacagtctaagtaagtctgggctgtgctaagctcttttcctcaagatcagccatcttgacatcactctctcatgttgtatgtgttagcttttgctgaaatataaaccatcccaaactta

SEQ ID NO: 1205 - DNA, 710007 bp, Homo sapiens; identical to SEQ ID NO: 1204

SEQ ID NO: 1206 - DNA, 69586 bp, Homo sapiens
ggaaagactatgttttaggtgacccgtgtggcctttttgttgaggcctttaggatacaaggcccccacctaaagacgcgaccctcccgtaggaggggggcagggcccgggggcgggagcacagcggggccccagcctcaggcggcgcgtcactgagcacaaaggagacaacagcgaggcggcagcgggcgctgatcttcgctcgccagccactcgcaattgcggttacagacctgcagctccccctcccccagccggcccgcccgcctttctgtctcctctctccctccgtactggacggccccggtccatttccgggctccggatatttggtatcgattggggccggggacgcggagcaggtggccgcggcggggcagctgggccgccagcttggtgcctcggggaccgtctcccgctgctttggtcaccagcccctgcccgcccgacccgctccgttctccggcctgcgagccctgccggccggactttgcgccgcgtccggcgctgctgctgcgctcggggccccgctcggcgccggcggtgaccgggaagcccgcgttaaaggggcaaccgggaccctggcccggtatggctgaagtcagcatcgaccagtccaagctgcctggagtcaaggaaggtaagggccccggagggagagcgcgcgggaccctcccctctcccagcccgaggttctctcaggtcaggggcgttgccatttcggctcccgcggccctcgcccggtgcccgccctgcgttggccttgcccggacgtgaaaggaattgaattcaggttctagtgtgggacgttgggcaagtctccgacgttccaagcccgttttttctcaagggggtggttggggggggggggggctagcagcagccccagcaagtaggtggctgtgcccgtgttctcgtgcatcgcaaagcctcagtggacgctgagagccgggtgaatctgacttactccgcttctaaaaaatcgaggcccagcctggctggcttgaaggctgggaagtggagaggggttgacattcagttccgtgtggagcctttgttttgaaacatgactctttccctccttctctccctacttttcctaggccggcgtctggctggctgactttcccaccttcctcaaggtttaaaagtttagtcttggctgtgttctgcgcgggcgggaagccactataagcattttcttacaaacaaaacacacacacacacacacacacacacacacacaatagtgagcgaggggaacaggggactgatggccttgtcattgctttttgtaccaatgtccaggaaagtagagattagtactgacctggctttagctgacagcaagtagccttttgacttcccttctcttgtttttccactagctgcctcaggacctagcttttttttgctgagatcttaggtgctggatcgccttatgccttgagttatctttgtttattctttggtcctaggaagcatagacgttccagagtgctgacgcagacccctaagttccaagggctttgcaaaatcggcttctgttgtgaatgtcatttgtatcgattgaatactgtagcctgaggcgtcttggagatgtggaattgaaaatagtttttgctttcttggaaccgcttgttttattgccaacttaatttgactccgttggtcttgtgtgtgctcaggccagcccaaaaatctcaggaaaatgagggactgcttgattgctttctcagagtttcaagcactaggagactagtgactagtggtcactgattttatgtagaatttctgatgggcctagttctgtcttactgttccggaagggtgttaaagcttaggcgtgagattttagcgttaatacttttctacctttccgtccctggtatggctttgatgaagacttagggctttcacctgtagaaaacagttttcactctgctgtcaagactaaggaggctgagcgataggaaaggcggatccatacttttgagagttcttatcttagagattgtctggttatcctttacttttggatatgagggttttttgtgtgggtatgtgttgggtttgtctctagagaaagagtgatccttgtgcagtgtgtagtgcatggtgagtagaatgagaattggagttcaaacaaaacctggtatgtatagtattaatcatatggtgctatgattttatccaatcccctattcatgtgagtgaaaaaacataaaactcttcatatacatttatattacccttaggtcttctgatttcgtaccaagacatgaatgatgtattctaacatattatttctcaaggagttccacaaacaccttccatataaaaatgcaagatttttccatttccacactctagagtctaatacatttaaattagctttcattttgcgtaatacggtgtttggcaatctcttttatgtaatctggtaaattggtaagaaaattcagtgtggctctttcattaagttacaattaaatattaattttgaaggtggtcaggaatcgatgagatcactgtctttgtaaacatctgacttttctagttccaagatcatcaaaggaagtgatgtattatactaggaatgtcctactaatggtggtgaagtttttgatctgagaagtattcaagtctaataaagtgtatccttccctaatataactcttaattatggcccagttactccctaacagtgtctttatcctaattaaagagaatgaagcttgtgcccctgatagggtaaaacatgtgcaaacattgagactgtggtaatattgaaactccaacttcatttgagaagggttagtagtagtaattagtttaatattctgatgcagatttttgaaccccattcaaaaaaatccctgtatctgtctcctctactttttaatttaaacttttgatagatatatatgcagttacaatttatattcaatttggtatcatggggtagattccaatagagattaagaagaatagtgcagtgagtgtgtgcccgtttccattgctgtttaggaggggatggggcaccctgtgaccttttgtcgtgaacatttcaatagaggtcgtgggtagcagctgacattagggtaaggggatatttaaaaatcttctttcctaggttgaaatctaatgcttgcttacttagtttttaaggaagtcaaaaatattcatcatttggacagaccttttgaaaaaacacacacacatacacctatggtagtatttataccttggtaaatctcttaaactgggagacaaagggaaatgattgagttcatatgtaggtgaaaagaatcaagtcaactaagtgtcaacacatcattttttctggttaaaagtgtgtttggaacatctgtatactttttgtaatggaaaacgctgttgccaatattcaggaataatactctatttcttctgaaacatttgaggttctagatttgaaataatttccagccattttaaacttcagtaggtctataactgaaatgcaaaatgcaatttgcgaatgttagggaaaggaacaggcatgtttcaacaatattctgaaagtttcttggagttcagagctggaaacatatttttgtaaaaaacttttaatcagttgacaaacttacatttttcagggggtcagttttagcttcttcattgaatttttcttttctgaaccagcaatcaagactccctacttccttttgctctccaagttcctgtatcggtaaatgaattgtccacttgctgtaattttgccatttagccctctctaaccaagatgttgatcgaggcctttctagacattttggcgtttcatcaacttctttgcaatttcttaagcattagagctttaccacttttagccatgcagtgcatgctttcaacctctcctattttctccaagtgttaatctttatttttctttccttacagcagttctctcaatctcatttttatgttcaattcttacattctttaggtggaaagttccactgtctcaaagttggtgaattctgtgtgtgttggtgtgcatgtgtgtgcttaacatctgaaatcagtttacctaggagtgacttacttcttgaagtacaggtagctagctattctgggagcaaatcctttttctttagtgaaagatacaatttaatacatttttagaaatgtctgtaaaaggaaacatacctagaaagcactgatttattttaggttcagggcactccagtggcataatgtgttaaattaagttaatggcgtacatccagaccttcaagggggaaagatataaaattatgtctggtaccatcagtgaacccagtagtctaagaaatttagagcttatcacatgcacactaggcatctaaacagatggcagtgtccatgagatgtacatatatctggctacacggcaaacccactttccctgtttttcaaaattccataacagtttttgttttggttgttggtttttaatgagaccctggctggatctcttggagctaggaggtttatgtcttagttatcttgctgtaccctcatttggatgaatgtcttttatgtaatcagcaactattcagtaaatatttgcatgtgtgaataaatgaatgagtgaatgaatgaatacattattattctctgttggtttaggaatcttgtctctggcataattattttgtattctttttcagagtataagcttttaaaaggcagagataataccttttaaactgtgtgtatcacttatttataccagcattaaatttataaaaacttcgaatttttttctaattttttataggtatgtcttgtaaatagaattcattcaacatagatatgtattacatagaaaaattaaagaaagtaatttgttgctttcttttctgactttggagataatcattaagaatagaattttagtaaaattttctaaatgctattttgtgtttttgatttttacttgagtaataataggtttaattttttgttctaagtacaaagcaatatcactcaatttgggagcaggaaggaatcttagataatttgcatatctgctgtgtgccacatgttgtgttgagggtatttccacaataaaaaaaaattttccatggtacatgaacatgatctttgctgtggtatagaatgcatggagttgttgaaagaactgtctgaattcatatgtgcaccaaaaatggctttcacaaaagggaagaaaatagtatattgccatatgtagacttgcattacttttttgaatgaagaagggaattttcaaatggatgtaactgttaatttgtaaaatatatattttttaaacaggtacttaacggacgactcacacgtgggaaaccatagttaattggtactttaaaaagagatttcagagtagaaagcactaaaaaccactgttctaggccaacttccttattttccagatgaaaatcccagggtcagggagggcaagtgagttgtattaaaccactgaggctaagtagctaggaattggcacattggggcctagaattagaaaagtttagaactgtgagtagttgcttacacagcttattcttccctccatttctttttacctaccttctcttttccttttcctccttccctctcttccccttctttcttttaaattgttctgtagatgcgaaagattcatttctgatgtgtttcatttatgtgatatgccatatgtttaagacagtagaatgaaaataataaggctttttctgaggatagttattttaaggataatgtatcatatggatgctgagttaacatacaattttttacaacttttagttttgattcagcaaatgaattactgagtgaactgtaggaagtcacactcttgcctcactgttttttctacctgaaaagtcttgcaaaaatgcatgtcttctctggtatattcattctaaagaggctaatatttaaaggtagaaactctaaaattaaacgtattggagaaataaagtcataggccatggtctttcctcagcccttgttagggacttaacagtttttgttgagataaataaatttttcctcagtgacaaaaaacatgtgagtttcattcataaagaaaacagttatggagaccactaaacttaagtaaatgctgcttgaaatcccagttctccaaggtacagaagcatatttagaagtgaattgctttgatccatagaggagaaaacaaacattcaaacaactatatttgctgtttcagaggtagccactggaagtgccattggattaatgtttttaactggtgactcgtttaaaggtgtcctgtgcttcaaaaatgtaaaattagaataacctagatcttagataagacctacaaaggataattagtttttatatttagaaggactttggggattacttggatgtttgaatctagaatgttccaggtgtttgaatttaaaaaccagcgcaagagttctcagatattgcttttaaaaggactgttaagcagaaaacaatcattatttccttctgtcatcatttcgttaaaaaagcatacacacatacattaagtgtgtgtgcataggatagtttttagcctacattgagaaaaaggaaaaaaaacaaagcagtaaagactttctaataaaccagaaccagtgtattaccggtcttgtttatttatcagtggttctttcctttttctttgtcgttttagtcaagttcagcgaataatttacatacaataaaaattccttcctttttagtgtgtagttctgagttttgacaaatgtgtagtcttggaaccaccacaacaatcaagatacagaacagttcctaacccccaaacttctcaacccccgtttcatgcccccaccagccactgatttgttttctgcccttgtagttttgccttgtcaaaaatcttatataaataagatcatatagtaagtagttttttgagtctcctcaaacatactgtttatccattcactaattgaagaacatatgagttttcagttttggtgggtgacagtaaagtcactctaaacatttgtgtacaagtgttttttttttttttaatgtatgtgtgtgtatttgaacataagtttttgtttccctcgaatggactttctgggttatacggtgagtgcatgttaaaattgtcaaactgtttttcaaaatggctgtaccattttgtattcccaccagcaatgtatgtgagctccagttgttctgcatccttgctggcatttgatattttcaggacccatttactttttttaattttaaccatttgagcaagtgtgtcatgatatcttattgtggatttaatttgtatttccctaatgactcatgatgttgtgccttttttcttgtgctgatttgctattcttatattgtttgttgaagtgtttgctttaaattttagctcattttaaaatcgactattttcttattattgaatttgggagttctttacatattctggatacagttcttactagatacacagtttgcccatgtccatgcttttaaaaaccttagttcaatatcagaatgatatggggatccaaacaccttcctagccctacttgatattagctaaatctcttagagatggtttcaggaatctgtagtttttatatacagactatgtactcagacttatgcaattacatttggaaaattacagaatgagtatactgtggccaccccaatacaaggatcttctcctaatttcttaagtttttgcagtgacagctcatttatctgataaagaatgagcagtaatcctctctagtaattcaaatttgttgcagggacctgcaaactactgccacttgttttgtatagcaaggtagctcaggatggcttttacagtgtttaatgattcaaaaaaaataatgttttgtgatgtgaaaattgtatgaaattcaaatttcagtgtctgtaagtaaagttttattggaacatagccatacttattcatttacatattgtctttgtctgcttacatactgtagaggcagagatgagtagttgtagcagagaccacgtgattggcaaagcttaaattttttgcgacctgatactagacagaaaaaaaaaaaagatttgttttggagccattttcaatgaaacttttaaaaaactttgttatttaaccttttttggacagttcagttatcggtataaacactgtttttcataactttgctttaatataatgatgcccttgggaattattgttgattgaactcttatgacagcctatttaatttttgaagtgactttaaaaagtacagagttaaatcatttttctttctctctctcttttttttttaagacggtgtctagctctgacgcccaggctcgagcgattctcctgcctcagcctcccgagtagctgggattacagttgcccgccactatgcccagctaatttttgtatttttagtagagacagggtttcactgtgttggcccggctggtctcaaactcctgacctcgtgatccgcccatctcggcctcccaaagtgctgggattacaagcattagccactgcacccagcctctttttttaagaagaaaaaaaaattacactccggtaaatttctggggactttcaaaatcaaatgtaggtagaaatcttatgtaaagtaagagtatgccgtatgccagctctgagtaagggtctgtggggctttcagaagttcatgagtatccaacagatttaaccaccttaaaatgtttccttacgttttttttttagcttatattattggtcctgtttaaaacttattacagatatttgtgtgaatgaagtatcatttcatctttttagaaacttgtatcagaggtacctaggctaatttatcaccaaatttttcatcttgcctgatgagcatttccagtcctgatacagctcctcagtgaccaaataccaggggagtctcccctggacttttttggcttttgtttttccaatgagtcataaaggcttagtcattttccattaactttaggagttttaactgcatatagtaaaactatgaatgacttataaggatatctttccctcttcaccgcttccccatcagcaacaaattctgttttgtttattgactatggaggagtccatgattgactttaagtattatattcactaatttttgagtagcatcttcccaccaaatactttgaaaatattaggtttttcttttatattatgaaggtctgtgtaaatatcgaatacaagagttgacaaatactgtgaaagactctttttgtctagatgggagtcctgacgtagaagaaagagaaagataggggctcacttaatggtccacgttcttcccatctgtacatctggagtttgccttaatatctgggccggtagctcttttggaaagggctattcactctcaatgtctgcatttatagatcactttctggcttttcctagaaaatattttcaattctgtcagtgattgctggattctaagttaacatgtttgcttctgttgttttcccagcattctctggtcagacttcattatttcaaattggtctttggtggatccacaaatcattccttctttttatagtttccccattgaagctccatagagctaatctttgaaagatcattttacttttactttttgttgtatgagttgttccagctctcaaatttctataagaagttgattggtgttgtgattgacaacacctgaagtcagagtggtctcctttggaggcaacagtcttacttgtttaaggattaattttaattatataagatgctggtaatttttgtacacgttccagtaaagtgatatggtcattttgttgctgttactagagtattcagttagtttcttagatagtattgggttccatcagaatttttatgtgtgctattttctcttttaaatttatttttagataaaggggggaaggctcttacacagtttaaacaagtcaaacatagcatgtatttttaaaattcttgatataaggggagacagttgtgaagaatctgaaagttttgggttggaaacaatgaatatacagattgcaaacttgtcatggtttatattgaaaagaggagagagcatgagcaaaagaatgagctgaagcctttttgctttggggatgatatgttcaatttgtacttattttagaatggtctctttcaggttcatatggtgtattagaagttaacactggttaaaaatatgcagtgctacgaaaaacaaatgtatccttcaagggagttatgatataaaattttctaaaccatctaaataattttgactctatataaaaaaagtgaggcaagtgattcctttatagcagaaaaggatttggacagaatcttgtcttcctgttcctagatacaggctgcccctgattttctttcatttcctctgcagagggtattacatgataaccaagcaaactgtaggttgtactgaagccaatttcagtagcaatcatagagaaatctagggcatttagaacgcgttgcagatgaacataaaaaatttggtgatcttcaagaagctttctgaatatggaaagtgttgactttcccaggctgtactctgatcatctggccccaggaaaaccttttagtaaatgttacagtccacatttgtattcactggacagttagtgactgataacatggtctccatttactctgatactgaagactctgtgagaactattagttgaaacaggaaaagctcacctttttaaaaggcaccaggttgaacaaaaggttaaaatgtacttgtggtgaaagatactatacagttggatataagcagattgttgttatcttggatgctagaaatagtgaaatcagcagcagcaatgaagaaagcaatatttggtgtaggtgaaagttagcatggcaattaccctagatgaataggcttcagttattacatttttacatgatgtataatacttgtatccaaaagacaaatgtctatcacttacactaaatcaactacatttcattctaccttatttttaagttggatagattcttaagaggtaatttaatctgtctcctcacaggtcaggacatgaggctctgatttggaaggtgacttgtcaaagttcattcacttgacaagctgctgacagagccaagactaaaattctgacaggtatctgtaattaagagggctctttatactataatttgcttgcgccttatatactatcataaagtccttatatttctgtaaattgggcaagtaaatctatatttattacatttcagatgctaaagtgtcatggagatttagcagaaagcttttactacagcaactcaaaatacagaattaggaaactacatttagttttagctatgccaaaaagttttaatctgcatgttaatatgttggttagattttggctggctacacttctactcaacagttttccttcatacccttcttgatggtgataatttgatgattcttctgtctcagtaaactataattacataatcttcacatagaattctactttactttctaatcttggacattcagctgaaaaagtttggagtggcggagcttattaaacattttagacattctgatttccccttaactcaggcctacaatgtgtataggaaacatattctccctcaggcggacatatgaggttagaaagagctttagacgtgcagtaaactattgattatattgttattccttgccaggaaacattgcttcagattctatttctttttcttctagagacagggtttcactctgttgtccaggctggcgtgcagtggtgcagtcatagctcactgtggcctcaagctcctgggctcaagtgatccttctgcctcagcctcctgagtagctaggactacaggcccagctaattaatttttttttttttggtagagtgagggtctcactatattgcccaggctgatcttgaactcctggcctcaagtgatcctcccagcttagcctgcactgggatcatttctgcagattcctaagagcaagtactcactgtaaattgcagcacagattctgtactagacaagtgactagatctatgttaatcagtgacttagtgggacctcactagaagcaatacctaatagaaaataactaattataagaatttattaactttaatgaggccaataataggctctatttattgagctgctgcttagtgagtagcagatgctttctttcgcccttcacataccttatctaatttagtcctcacaacatttatccttattttacagatgaggaacctgaggttcaaagaaattaagtacttgcccaaggtcttttagcctggaagtaagcaatatttgagtcctgatctgtactcaagatactcacaaatacttcttaaacacttaaaaaaattcaaaacagatccaggttgttgctctgtatactctgtttatttgtatgttattgaagtcttagcatcctcctcactggagtctctcagtgtgactggcagcttaagttttggcttttctcttctcagagtgctagctgttttcagcctttgttgggaatagagaactatcaagagttcacatgtaactgaagtaccaataaggtgaatataaatttctttctgaaaaaaaaattaccccactcttgtgaaactgcatggagagccaaagggttgacagaatcacttcttaaaatctatgtgtaactccctgttacttgtgtgggaattttctggacgtactttgaaacactggctggcttcctcaagtctgctgtgcggtcaccttattctgtatagattgtttctaggggaagaaatattatttttatgtaagcttacttttattaaaattaggcagatatagctcctgatcttctgtggaagtatcctcctaggttgtataaaactgatttgattctaggaatgtacccatgatctcaaggtatcttttagacaaacacatttttagtcagtgaacatgaccagttactgagcctgtggtggcctaacagtggaattgcagaaatttcaagatttacacatttgttttctgttcctaacttttgatttccgtaatccaagatttccagaaatgtgtgtagagttctgacaaatagttatcagaatggaattgccagtattgcagtttgctttgtgagagcaagattttaagagattattttaccatgcctgtttatcccatgactctatctaaagtaaagttgttggggaattttgaatattgctctcaatcgtttaaagttgaaatgaatttactactcctaataggaaggaaagtgctagctaaagtatctagttgcaaaagagaatttgaaaatggaaatatctgactcaaaggataaatagaacttgcagtagctggtgcttaaggaagctcttttgtcatatgaagccaataaactaaaatggtttttcttcccctggtgtaaacttgtacttaagctgggctggaagtgatctttgggttttaatgggcatggctgggtttatcctacagaggtttaaggagatgggtggcttttctttctaggctaaggcaaacagagtactggctgccaaaccatttgagggcttgtgtaagtgccaggaaaagtgccattcaagtagtgaaacaacagaaggttggagtttctttagggatacatggaataaaaataaaatgaattcttactatctggatatgctttgtgaaaaattgttttgaaaaaattgtctactactgcttatataatggtatttaccctgttgaggatgccttatgactatcagtggcctgtttttttcgtagaatgtctgactacctccatgagaataattgataagtacctttaaaatatcctgcagtgctcaagtacagttgacccttgaacagtgtgggtttgaactgtgtgggtccatttatacacggattttttttcaatcaagtgtagatcagaaataacagtgcttggcgggatgcaaggcctgtgtatactgagggacttttcatatacctgagttccgcagggccaactgcaagaagtgagtatgcacctattttggtatctgtgggggtgctggaaccagtccccctcacgtatacccagggatgactgtacttatgatggctattatttctctcatattacaggggcgtaaacataagtgatgttagtttgtttaagattatttagttggtgagtgatggagctagggttggaatcaaagtaagagttctcttggttacaccatgctgcttccttgtgcaataaatattcactgaatatctcaaagagccagtgttctgtgcagtgtactgcagaagttactgtgtaagagtttaatctttctctaagtataattttaagttatctctttatgtttaattacgaaattttataaacccatttaaaaagtaaactgaacaatttaaaaacagcagaagtgcttcctttttactcatctttatgattttaagagtaattagttgctaagttcatatattcctgaattgttctaaagtaaagcaaccatgtaaaatgcagttgttttttaaagaaggtacaggagacaagaaatctaggagaatgtttcttcagttgtgactcatttaactttcagggccagttgaaattcataaatgttcacatttgttaatcagaatccagggtacttcagtaagtgcttggtaaagtattagagatttggtgggtttattcagtaccagttgtatttcaagaattgaactcctctaactatgttgaatacctggttcactttactttctaatcagaaatttgttcactttgtgtctgtgactatatctgcacagtggttgctagataaatgtaggataactcttaacctttcaccctacagaggttagcaaaactatcacattaggcctgaggaagaagcagcataggagaaatgtaaatatgcgagcactttgaagataaatcagtggctgacacaagaccagtaatatactcaagacccttggatgtctgaaatggcaaagcgaattatgcagtgtgcttgcaagcacacatgcttgtgcatgcatgcacatgcagaaggttaaaatggttttaaatgctatgaggtctctaattcaggttcactgagtggtccagttgtctaaattagttctgtcataccgtcacgttgtgattatcgtctagagcagtcctatctaatagaacaactgtgatgatgcaaacgttctgtattctgtactgtccagaatagtagccaccagccccatatggctatttagcactaggaatatgattagtgaaactgaggagatctgaatttttaaaattaaatttatattatatgtaacagttacatatgattggcggctaccatatatagtgtgaaacaattatttgtgacactaaaggatagaacgatgttggatcgatagaacatattgattttggttcagcttaaggatgtcatttccttttgtttgtttgtttgtttgttttggagacggagtctcgctctgtcacgcaggctggattgcagtagcacaatctcagctcactgcaacctctgcctcctgggttcaggcgattctcctgcctcagcctcctgagtagctgggactacaggcacataccaccacacctggctaattttttgtatttttgtggagacgagatttcactctgttgcccaggctggtctcgaactcgggagctcaggcattctgcccacctcggcatcccaaagtgctgggattacaggcgtgagccaccatgcccagccaggatgccaattctaatatatgtcccattgagcgttagactgtgaggaatgcacatcctcaaatcctcacatcctcaaatgcacatccacatcttcaaaacataaagttttgaagagaaccttagtgacttcttgatgggaatagaaagacagagcccaggaatcaatttgatgggcactcagaataaatgatgtcctgattgagctcattttgaggttatgggatgtttcttgagaagaaaggaagcttaacttgagtgctttctgttaatacctgcatcagcatcttctaagaatagacaaggtctaagtcttaacttttcttgggtagcttctgttttgttactcccagcaaaaaaaggttttggattcaaagcaccaatccatacagttgttggctttaacacaggaagcttatgaggttgtccatgtttgcgggcattttaaaaatcatttatggtagctgagtcagataaaccttatatggaaagttttatctgtgttcgacagtttaaccaatataagtaaagactgctctgtttctaccttgctaccttttccctgctttttcactcttcctctcactccagatcatttgtgctgtcagatggaaattctgactcagccattttctctttcccaataagttacccactttactctgtggtcgctgataatgatgtagatggtctatgatattaaagtagtacttctgatgtgaggacttatatcatctcagcattttcaaaacccgcttgcctgcaatctggtgtatctgcggttagccataacatatctacttgccaaacaagtggtttaggttaccggggttttcatttaactttgaatttaggggattagaaaaaaaaataactcaggaacatactttgataaattacgtgagaatgaaatgttgggattcaatcagttttacttttcagaatgattcttcgcagtgtgtttgttgaagtgtgcatgtgttgttggcacacatttaaaacttatgcttattacccttgtaaaactgttgatgatgctattatataatatagtgctccctattttaagttgccacgtgataactgaatttacttgtacagttgatactaataaaacatttctttgcagtaaagagctggtataatttctccattctgataatgaaaactgaacaacttttcatatttctcttcttacattggtgttcaggaagattgtcgacaaatttgggaccatatgtgggctttacttttgttaattttcaaaggagcattataaaataaatcaataaaattgctactacaactgattttcttccttgtaaatatttcttgcttcactgtttagatgcttatattagaataaaaacatgtatctctctttattatgaaatattttgaaaaggattatcagattcgccttcatggaagatgaattggaaaatatagaagtgtttaaaacggaagataagctacattgtaatctcatagtatgttgttaatgttagaattttgatgtttattctttctggtaccttctaaatttaaatagaaaagtcaagtatttcaaatatagtcagggtatcctatagggaggcataagatcagccctagactctgcctgtaacatggagagtacgtttgggacttaacctgtgcattaacccgtatgatatgctacatggatgattatccatagggtgtataaaaataacagacctcagaatgtcagttgtttctacaaaacacctacatacactctggagaatgtgagtgctttgaggctggaactaggaccagtggataatcactataggttggcagattttgtccttttgaagacagttttacctctggttattggaaaaatgggctgtgttttaaaataaagggagtttccggtggctgaaacatttaaaaggagtccagatgattgcttggacaagataaggctgaatttgacaacgattaaaaccctttttgatagtgtatctataattttaataaagtgatagatcagcatctttttatgaacagtgactgaaatttagaagtatttgaggaaactaggaagcccagtctgccatttaggaccattattattggaaataggattacagattcttgatactcttgacagtttggtgctctaaccaataaggtgactttagcaggtcagatatttgtaagaagtttgcagaggatcctgagttatgctattctggtgtttgtaaaactttttgtgaaaaaggcagctttctatctgtgatgtttattgcaggataattaacccggaaaatgtctttctgttactagaatttctgaaggtttttctcctttcttcttattttttggatatcaaccttgagttgtgtttttccattcaccttatacttaatttattaacattttgtaattcttgggatgatttggcagtttgcaactacaggggagttctaaggatgtggggcagttttctcaaaccagtaattctggagactagctccagattgtgcaaattcctgctagcacctcagcacatactgctttatctgctttaaatgccacataaatcctaagcaccccgttgcattgtttagctgaacaaatacatccgtatgtatacacacatttttcttgattctgagctctaatcttaacagtgccactcatttaactatgcgatcttgggcatattattacaaatctcagccatcatttctttgtaagttgagtgatctgtttaattgtggcccaaagaaaccaagaattgaccacctgcctgtatatatcacttttctaggtattctaggatcctattaggcaacatatcctttcattataataaagctgaaattccaggtgaaggaatttactgttgtttgaggtagtattgatagacatgtagctccatagccttgtttcagataagctggaggatgtggatgaatgaatatgctggatggatgtgggtggaaaaattcaacatttcgtgttatgtcctgtgcactagtcgtcattgttctcaggatccatctttttcacaagcatttatttgaaagtcactatcctgggcactgggataaatgttggagataaaatgatccataatatttttcttgcctttcaggatctagaatatatgctggggaaacatgagtaaaaatttttaatgatataattagtgctacagttctatcctgtaaactacgtgctatgaaagcactgaaagaaaatgatagatgagtctgctgtatgtttgtgagtcagctacataggtgacatttgaatgggggtcttgtaggttgattgtgaattttctagatggtagaggggtggttgggtgctttgggcagatggaacacagagattcccccaccatcatctgtgtaataatggtgactaagcttctttcccatttgcaagcctctcccattctctgtgtttcattctcacaacaaccaagcaaccaaaaacagagaccaaaaccaataaccataagaatctctaaacagatgaaatattggtaaatattgcttggttccttagtcatctgtataaggtgtagagtgaaaatgtttgtctttcacaaagaaattgcaaaaattctgtgtcgactttgtggacagtctagtagtgggattattatactaaggataataactacaagacagtgcatctgatttaattgtattatggatctctgtttagaaggatcatctatctcccagacaggtggaatatcatggcatattggaaagaacagggaatttggagacttaattagaaaagtagccctgccattgattgctttgactagtaacaaaataaatgaagatggaacacctatgtagattatttgcttagcttcagccaaaattagatgccactaccctcccactgtcatactgtgtttagattttgttaatttcaatggcatgaaaattttagaacactaaaaaatggagaaggatcaaaagtttgtgttaccctttgttctgtagtaaatgaattgctcacgtattacttaagtgttcttttgttttcagccttgagcctgaaagtgagaaattttagctatcagtgatcagcaactcagaactaagtttgcttttatggggctcataattggggtatttgagtgagcataagagcgtgtctgctgtctatagccaagcatctctaagctccctacttgccctgctgatgggggtggaggagggggttggttttgctaatgatattggcggtagtgatattgatgtcattttgttgatctctatataaagattgctggggttgagaatgtagaggatttttcattaggataagatctattcagtttctctgaatcccatttctcttttactgtggtaattttattagaacttttaataaagagaagaaactctaacagattagggagacatttcttttgtagggtagcgtaaaagttttacaaaatacgtttattatttcaaagtgtcattaatatatcttagacacatgagtctaaaattgaacaatatcttctcttcccaaatggagggaaacttgtggatgttgaaaagagggttagagagatgagggcaagtggtaggtcccaaagagagatttcccttagaatttttcactgtagtcactacctagggtttcctgtaggtcacttaggaaacactgtgaaagaatcggaaggatggggtggtgggaagagggtgagagatgagaaggtacttaatgaagtacagtgtacattattcaggtggtgattacggtaaaagcccagacttcactactagacagtatatccatataactaagctgcacttgaaacccttaaatttatacaattaagaaactttttattcctgttttttcaggtgtaaatataggccgactgtgattgctagaagtctattcttgggagacagtgaggcaaagtaaactaggtctcatttttatttgcattttgggggacatggaaaccactttctgaatacatgtaccatctttactaaaaattacttttatccttgattttaaagaacttaatgcccatttatcttattttaactagtatttaataataccccccccctccctttttttttcctgatactctaagcagaaatatctggggcaagaagaggtggatttgatttccagttcatttgttttatttgttgggtagtcttattcaagccgttttatttctcttgagccttagtttcctcataagtaaaatggggatgttgataaagcctttatcctcagatggttaggaggaataaatgtgaaagtgcattgtaatttatgaagtgctgtataaatttcagttgtggctgtctgttattaccaaactttcacaagacaaaatgtatctcttgaatatctttcttgttcatagtagatgttttcatgtatacagaacaaaggaaagcaagcataatccctgctttcaaagcagagtatatagtccctctgctactcatagcatttacataaaaagaataattcacaaaattctaccattctataaaagggaaaacagacacaggtgaaagaaatagcctctagttaatgtggtattaatccaggcatttttatgtggatggaagcttttaaagatgaatcatggcaattgtaatttccgaaagtcttaggatgtaggtaaaagaacaacggaaaggaaatggcttttttttcacttcctttttagtttatgtagaattagttgggaaagcactgggaatgtgcacattatttggataatgtgtgaaaggaacgtgtagccgttcatggaatcagaaaattctggctttggttgaaatggggtgatagataggtactcattctgcatacttgactgaggtgaaagaaggagttcttgatagcaggagtgctgttcactgtttagatttggttaatcttgtgcagagcttttaaacttttgagcagagttagtttagcaaaatgtcccccactaagtttttttctcaccggcattgccagtataaatacaagttaagttcctgattcttggccaaaatttgagactgtgttcctttagtggaagagtaaacaaaattcctgctgccctttaggggtatgtgtgtatgtgggggatgtggcaggggttgggagggggcacttctctttgtccctgagaaaaagataaggggattctaaagactcttaccccatcacttgtaaatctgaatcacctctttgaaacagtctttaaaaagaatattttgtttctgagtgagaaggagagaaacttgctgtaaatgagctttttaaaataacaatctgaaatacgttttatgaaaaatgctcagagtttacttatttctttgttggtgaaagctgaggagatcttaatctagtactgttaatgactaagaaaagaattttttaaaggctgttttaggcctccaaatttgatgtcatttgggctggaattttaagagacattcaaatcaatgttgatcagtttccttttaaagtgttgaattattaaaatatacaaattttgtctctatttttctactgattgccaaggggagggcagacaagggtgttacctgtagaaggagaacaagtagttctgcttcaaagttcatagaatgctcctacagttattggtagggaattggggagtgggctgtgtctggagctggaggggtaaagttggcaagtagatgtacctgaaaaaaggtgtgtgaggagaaacaataaggcgaaaacaaaaatgagagacttcggaagcaaatgcaagaagagaaaaaatataagagatagagtttggttggcgtgaggtggagtggggtggtaaatcaccagattttctttggtacatttcaggtaagttgtataccaggaagcctatgtaaaaaaagaaccaattccttatgagggtgcacagggtctttcctatcccatctcttgctgtaattctctttggggcttctgtgctccggacacacacaactccaggatggcctgtgggttttcatctttttgtctttttccataattgacccctttgccaagaatgtttaccgcttctgtgcataggaattttaacttaccttgagatacatttcgtgttaattactttaaggtttcttgatacacggtttcttgatacattctgtttaaatcacccccacttcttacatccacccccagttcataacaagcataactgttccagtgtttatgacttcaaagaattttctttagtacaactaattgtctttagtacagtgtttattaacttacattatacctgttttcctctctgatatttcatctcagtgatggcttggagatgactcattcatcctgaaatagagttcaacacatgtttattgagtaaatggtgttgattaggtgcatactatgccattcatgtatttagggggagatcaacaactcaatgaaaatcattctttaaggaaatggatggggggtatatatatgtatgtatttatgtatgtcagccagtcctcctttccatttctaagacctgcttggcctattgtaaattaattcactgtatatacaggcatccctcattttattgcactttgctttactgcgctttggacaaactatgtgttttacaaattgaaggtgtgtagcaagcatttcttagtaataatgtgtttttaaatttagatatgtacataacctgtttagactgaattccatcgtacatttaatagactatcaatagactatattaatagactatagtgtaaacataacttttatatgtactaggaaaccaaaaaatcgtgtgattcattttattgcaatatttgctttattgcagtggtctggaaccaaacctgcagtatctccaagatatgcctatatttagattaacatattgaaactcctttaatgagaatggggatagggttctagttttatgtagtttgtttattactaaatttgtttaaatgatgtttgacatattagtgtgttatgctgtcataatagcagagtttaattctgtttatgacattattttcttcctttctcctactcttgtttgactttatgatccagctttatttttttttttttaacttctttcaattaacgagcacacattgtgtggaaggtgcagaaagtacacccacaaagtccctgctatgaagagcttgcagctggatagggaagcagctgtgtgctcgaatttcagagcaaagtgcatttctttctgttaatgctcttctaagcaatgaggcagagttgtacggcttttaatgttcaaaagagacttagccaccatccctaacactgggaaaatgtctgggcagaggggagagcctacgggaccattgagatctggtgggaacaaagaatagttgtgtaattgactatggtgggaagctcattttaatagcagactgggactagtagaagatgttgatagagttggcttacggcaagaaggtcagcctgagttctgaatgagtgaaggtgaacatgggaggcaaaaagtttgagaaatgggagggtgaaaggtggttcaccttaaatgtgcccacagagaaaggtgggaagatgagtgtatgccgtttatcctcagtaggctgtttatgctgtttacatcgaaggcagaggaggttagaaaaggagaaaagttctcttcatgctctgagcgtggcctggctgtgaaatagtttcagtaattctcaatctggttactgatttacaaagttgactgaatatgtgattgttttccaggttgtgctagaatactgatggagggaatacagaggcaaatcttgaaaaaaattagagtgggttcagaagaaattatatattgggcaagtaatatttcagtataaatgagattatatgtttggaaactcctagtaacctccgaagggcaaagtcagtgtatttgacaatacaactctctgtgtgtatgtgttcatgtacttcctcataatcattgaaaatcttccagatccccttctagctcaggccctcctcatatcttttgggtactagttcagcttctgcagattcagggacaaattgcaataatagaatatacttcagtcttgctgttgagatagtaagaaatcattatgaggagtcatcaaggtaatcagcaattcggaaatttctcacacctgttataatgtgtcaaaccatatcttcatgttcatggtttagcaatatgtgctgttgacaacatgaaataagtgaatttaattatagaacttaaaatgtaatatgtaagacatttaaaaagcacaggaaatagaaaaacccatgaacctaccacccacatcaaatgttaatattttgccttattgtgtatcttttctctttttgcttttgaagcagaatggctcatgcagctaaggcactcatgcccctcttcgtctctctggagagagaactactgtttggagttaagtttgtgtcagtgccatattattaaaaaaattttttttaaccataggtatatctatctacaaactatattttaatgtttaatgttctgctgactgaagttaagaaatatttttaaaattattgtagttcttcacatgattctccacatggaaaaatgtaataatttcataatttttaattttagttagcatggtattagaaacatagaaaacatatttttggcgtaacgttctgacctaataacataaattgaagtggcttttaagctttttgtaatctatagaatgatgtgtgttttacattttgacctagtacctatcatctctgtatgtatatatttctgtgatgtttatatataatacgggaaaagtttccccaaactagtttcctgtactgtgtgtgatttatactagtcccttcgtatttgtggggtggggtgtagaggtggttccaagacctcacatggatactaaaaatctatggatacttcagcccctaatataaaatggggtagtatttgcatataattcatacatattctactgtatacttcacattgtctgtagattacttatactacctaataccgttcatttaggaaacaatgataagaaaaaatgtctgtatgtattcagtacagccacatttttttttcctgaatattttttatttgtggttgatttaatccatgaatccaaaactcagggctatgagagccaactgtcctctgttattctctagactattgacttttaaaatgcctttctcaggcttagtaaattgattttttgacctaataatagattgccacccataatttgaaaatcattaagagtaatcttaaatttgatctaatcataattaatctaaaattaagactgacttttaatatataagcacaagcttttccagtataataaaggtgttttaaatgataggtcaatacattaaaataacattctttacacaagatttgattatatttattttagctaattcattaatttttgtaaattaagtccgtgtatgtcttacccatttaaaaattagatattaattaattgaagtgttttagagaatatgcgatggttaatgtagaatattttctttctgtctattcttaccatgatttacctggagggaaggagggccatcattgtgtcagggaaggggaaggagctcttgagctcttgctggcttagatgttgacccccaagccctgtcaccagtgaactctgtacagccttagaaaaccccttcttccttctggctttcagtttcctcacttattaaatgagggtgttatctagctcatcttgaaactacttttattctgtgaaacataaggtaactaggacctgggcttcaagatattagaatcggttgagaatatgaaaagctgatgaaaaagaacagggctttctgttcgaattactggttttgctgttatgtttgagcgaggattaagcaggttgtatccagttgaatatagttcttgggcaagaattattcctccattataaaaccatttcaaaataatcttgacctccccaagatctccctccctttttgtggcattatccctcagtcgtgaaggacacaactaatgttgagtgtatatgtgaacatacataagtgcaaagaacggcaaaggaacgtttttcattctgtttcagttaagtgtcctcataggcaaatccaaagcttcggaaagaaatctatcacttttcctaagccctggggaatgtttcatgagtcctactcaattgcagtaatctgaggctttggggaatttcctttttttaacatgaattacatgcttggaatagagtgagaacatatcacctaaactacacgtccttaaaacagcactttacatgatgaatccttcatgttttgtctgtttgtatgtttacgaagcaggagtttaaattgcagcttggggtaaacatggataccattgtttaccccaaaccatttcttcaagaccatttcttcccattttgcttctgagaagacaggtcaggaaatgcccttgcctggctcttcaggtggaggcagagttggggcagattcctggtttccttcagggttcccattttcttttggtttgtagattattttggggcagcccaaggtttagagggacctagagacctagttctaactcatgtccctggggattgacccactgaagaatgtttaagaaattaagaatttttaaagtagagctctgcccctacctgagggactagtgaaaatatattttttcttgaaagacgccagggtagacataaattgctgggagaggatcgtctgaaccacagggaagcatagattagatttcttttaacacctctaattatgcagtaactcagttctctctcagtagcaatatgcaaagcatgactgatacgtctgttatttcagcagcacttaaccctccatttatagaagtggattggaatttctagacctctggaatctgattctgtaaatgttctcacctcaggccaggggccaaggctaaccagtattttgtgacaccctgtgcttggcactaagcaggcactatagatttttgtgactaaagactgcatacttaactagtcactattttatgcattgagaattataaagtgtgtcattctgaaatattagaattgattttttttaaagtaaaaaaaaaaaatcctttcctttgtatgttaaagtattactaatgagccttcctgtctgtttttcctccatctactctagtatgccgagattttgctgtcctggaggaccacaccctggctcacagcctgcaggaacaagagagtgagtaatacctctcatttatgctccttcagttttctttttttagtggtagcttgaggctggtttcttagggcttaggtggggagagagcacagtcacttggcttcaccatccatacatcctgaaggatttctttaggcaaatgatgcctgggtgatcagtgaagtttcgggcatgttaagtaagataggctgccaggaattagtagactgctgcgtctgtaggaggaaaaagagaggtttgaacctttttcctagcctcttgttgtaggagggacacaatggttgtagatttatctggggtgcgtagaaggaatctattcttgctcctaggatagggacttgaacagttttcccaggcaactgtggtataaatgagatcacattgtgaatttttctgaatctttttttccatgtggtgatgaaaagtaaatctaagctatgcatgttatattaaagtacatacttgtgaatatatgatttgtgaattcacatatcaatataaaattgacattttgaaaaatgcggttaataaatagagtgacaacatgtagtagtagaaagagcattggccctggctttagaatatttgtgtagatgtcctggcactgccactttgttgccgtgtgaccaaaggcaaattatttaatctttttgatcctctttttacttaatggaaaagtggggataataattccttgctctttattatatattgttgttgagacaataaaatgaagtgatggatgcaaagctgttgttatggtaaagctcttaagattattatggcatttattactaacaaaccaagacattattcattcctgtcctcaatctttttgttccagttgagcatcatttggcatcgaacgttcagcggaaccgtttggtccagcatgatctccaggtggctaagcagctccaagaggaagatctgaaagcgcaggcccagctccagaagcgctacaaagacctgtgaggatttgggaggtgggaggggtgatgcaagactggttttctctgtggagctagcaaccagggcaggggagaaggagactacttctgttcctctgattccttctactgttagattacaaatcttaccctggatgtctaacagtttttttgatttgaaaatgttttgtttttgttggagcacttgaccaggtttaaggacatgttgatgatggtgtgaattttaacattttttagctgttatgaccttgggccagttagtcaacttctctgaatttattttccttacccataacatgcggataataatctctgtcccctctgcctcatagtttctttgggggatccagtgaaatagtggacatcaaataactttatgggttgtattggttcctttactatgttctagctgtgtttgccgctcttactttccttgcttttcagtacatagcagaatgttctgaaaagctctgaagtgtagactcagtttttttcataacttcagtgtctgacaaaagttctctctagtagcctcctttaacacacagataaacggaaatgattatttctcaggtttcttttggcacagtgacttttattctgtttcagtgttataaagctcccaggatacatttcttctttgagagtggctcttacatcctaaatctttaatgtgggtagatttaaccacagatactgtgttgaggaggaaggggtaaaggaaaaatggaaggaaccccttaatttacttcagtgtcatattcaggtaaaaaggaaagccagtcatttttgctaacttataggaagggtttgtctttctgtttattatttgtagagaggactttattaatcattttgttaagcttcccttattttgtaaataaacacttttattgattcatgctaaatctggcaccatgaaaggagaccagagatatgaataagacagctgttgcctttaagggcctcaggaaaacaccttgagcattgtgtatctagagatacgtgcatgagtcacagagaattgaaatgtaaatttcaggcctatttagagagaagagactgggaaaagcttcacaagacgatgtgtttaatctgaaacttgaaggttaattagaagtttatagtgatggggaaaaccattctagccagaaggagcagcatgcataagggcaggaggtaagaggacttggaatcaatctcacgttagctgcaagaagttcagtgttgctggagtggagagtgtatttacaggcagaagtaggaagtgaggccaggaaagtagtcaaaagctggatcaaaagggtcacgataagttatgttaaagatttcaggttttgtagattttaaattataaggaatggagaacctttgaagtagtttcagattttcattttgggatctattctgtagactaggtgggtaaaggcttggagtgggcaagatttgaaggcagctgttgagcaatggtcaaattaagagatggtgaggcttgaatgaggacagtggtgacagagaggaaggagatgatgaggcctaaattgaaggtcatggtaatggagatgtaaagaggaggagagatatttgagatgttatgaggctcagtgtcacaggttaaggtgagaaccaaagctagaatgttctagagttctaaattcattgccctttacattattcacaattctctgttagaaaggccagttctgaggttgatgcagatgtttaaaatcctgaattaggttaataacagtataatgagctttttcagaaattatcaagacaaaccactcaaatataaatcaggagtagagagtgatattttataggtcctaaaggagagaagaaccgggtattatatttctgcctgagacttcaaggttttgaaattgttcctggatgaaataagtaagctagaagggaagtctttcagttcactccctggcaattttaatagctgtacatcttgggaaggatgaaatgctgcagttttcattgaactggaaccttttattcagtctggatacccgggctgccgtaagtcaggattaccgcttgtttactactgctttctcagtttcgctttcccaggagtctgtataattagctgactgaaccagagatggtacttcttggaaatatggtttgaaatcattaaactcagatgaagcttcacttatttattttctgtaccaggagatacatcttctgtgtcacttgtgacctttaacacttcatttgggtttgccttctctacggtgcttctactttcttcccacttattatcacatccaatgtagttattagtcaattaattctatacagattttacattaatttgggaggttcaggtagaggcttgaatgaagacagaggcttttgaaaactaagtccgtgattttgtgtatgattcttaattattacaatgagtgaaggaaaagaagaaatataaatagcaattggtctgagtagatttttgtttattttcatttctttggtttgaatagataagaatactatgatattagacctgtaatgtgaagttactaagtgtacacttttttatagcttataacatggcatgacagagaatgatttgtggttattagtggtagaggcaggaccgtcaaacaggccccagtggggtgaagtgataggtggtatagaagaggtgtggagttttccattgttgggtgtgatgatcagattccagttctaccacatattttcgttgtgatcttgagaaaatgatgcaacttccctggaccttagttttctcatctgtaaatgtgaccgtgtcagcctctttgcatctttatcttgaagataaagtgagaaaaataatgtacttctcatatagtgagtattcaataaattgtatttattacttttaggaaatacattattttttattttccttattcatgttttcacctttgctttttagtgaacaacaagactgtgaaattgctcaggaaattcaggagaagctggctattgaggcagagagacgacgcattcaggagaagaaggatgaggtataacttagttactgcccctctccctcatggagaaaggggtgctcagctttagagcaaaaactttctgtaggtcacgggctcaatgaagggtttctgaatgggaagcagaatgcctcttatttgggctgcattttcctctgtggaccatgatttatagcctcttgattatgtaaatggtaaaagtcttgagagataatggataatttcacatatgatgtgagttagtttcctatgactgccgttacaaattactctgcaaacttggcttaacagaaatttattgtcttagagttctggaggctagaagtctaaaatctgaagtgttggcagggtcacgctacctcttgggaaggatccttccttgcctcttcctagctcctgactcctggcaatctttggcattccttggcttgtatctgcatcacttcagtctctgcctccattgtcacatggctttattctctgtctgtatctttgtgtcttcttgtcttcctgcaaggacatcagtcattgaattgaggactcaccctaatccagtatgacctcagcttaactaattacatctgcaaagactgtttccaaataaggtcacattttgaggtttggatagaaatgaatttagagagggcacactattcagcttactacaaggtgtctgtccctgggttgttcttgcagcattagagagagcagacttttgagtggggcctgcacaggagccagggagtagtccttgggagaggccaggagcaggcattgctctcgttctttctctttttcttaaaggtttccctttcctctgatctgttggttaaaaaaaactaatcagtttgattctgtatatatttttaagtcatagtgtttttaaggctgaaaatgactaaaattactaatagtgtttggtttgtgagaagacttgaatttaccatcagctattatttccttttgtgttattattttcagccctttttttaaattattttttgacagtgttttgctccatcacccagggtggagtgcagtggtgtgatcttactgcaatctccgcctcccaggcttaagtgatcctctctgcctcttgagtagctgggactacaggcacacgcgcccacacttggctaatatttaaacatttttttttttgtagagacgaggtctcactatgttgcccaggctggtttcaaactcctgtgctcaagctgtcttcctgcctcagcctcccaaagcactggaattactggcatgagcccctgtgcccagcttagtttcagcacttcttatgaacaatttatttcattttacatcatttctatgctaccctgctttcacacctgttatgctgtacttggtcactgtcttgatttataatagagaagcaaatgatttattatttttaatagttggataacaatatggtttgttaagcacccagaaacactttcgagggttataagcatggtgttaattacataaactgaaactacactgggcaaactggcacttatgatcatcatgttaaatagatatgatcagggtcatcagtaaacagcctacatacactgctactcctactgagccactcttgttcctgtaagacttctgttcaatgccagatgaatgtgaaacacctggtatgagagtattgagttgtttcttcaagaaacaaatcatgatcatgtgataatcagagctgcaagtaaaaattagggattatttttgatacttcctgtaatacacaggaggcgctttcttagtatttaatgtgttgcctctttatagtgaagactttgctttggggatgacactgggaactaaaagaagtgattatattttgtagacaggaaagcttctatttaaaaaataccagagtagtgaagttggcttcttataaatgctactgctgtcctgtggggttttttttttttctccgtttagagaaaaacaggatagaaagagaaaataaaacactttattttaattatgtagaatctaaatagtaatcatagtaagtaatctcatggtaatactatataaaattagcagtttagtgattaactccatttttcggatgtagaaattaagtattaaagaagtaagtgactgattccaagttataaaatgctagagaaatgtctgtacaattcaggtctcctgactgcttctgacttagacatactgtggtatacatgaaacatgtggactttggagttacactcacctgggtttgaattttagctcattaactatttagcttggtgattttcagcaccgcccttaaccacgcagaacctcaggttccgaaatgggttgagtcatagtagttgtgcataccctaaagggctgttgtgaggtaaatgagatcaggtacttggggcacctggtacatgttaaatttataattgccctttccttgatttctgttatagagagatatgtgctgcctagggcaaaattaaacaggcttaagtgtgtttcagtatggtgtgatttgagaggtcctcaagcgtttacacacgtgtcattacaggtctcccactagcttgccctcagtagagtggaaaagttaaatgagaaatccagttgtataggtgtgttgaccagacaagcctatataaacttcattcagactttttgacttttcaactcatgcctcagatgagaagatggctactgtgccaaggtagaaaaatgtgactctcagctgtctagtatgttgtcaatattaaatgaagaaaatttgcgtgagtaaagtttgtcattgagggatatatgaaaatgcttatttattttagtctgttggtaacagggtgcctgaaagggagaggaaactaatactgagacagtagtgctaactcttccggccaatttttgaaaaagaattgcttgtgactaatgaactctcttagttcttattttttttttttttagacagagtcttgctctgtctccaggctggagtatagtggcgcaatcttcgctcactgcaaccactgcctcctgggttcaagcgattcccctgcctcagcctcctgagtagctgggactacgggcgcctggcaccacgtccggctcattttttgtatttcagtagagacagggtttcgtcatgttggctaggatggtattgatctcctgaccttgtgatccgcccacctcagcctcccaaagtgctgagattataggtacgagccaccgcgcccggcctcctttttttttttttccccttccctctcaatgctcttctgcttccctgtagagtctacttggttaataaggacttagcagcagcagggctgtggaaaatctctctctgggtttccacccaaatctctttaagagatttttggggtcaattttcctggttagttaccaccccataaaataccagatatagagactgagaacccttttctcttggaacagagatttttttttttttaattttttctgaacaacattgtgtgtcagatgtggtggagttatacaaccttgcgtgtataaattagcagttctagctttgtcatggtataattttattatgtttgttaacaaagcacagatgtaaggaaagtagcatttccatgcaggacacagatgtggaaaagttgaaaaaaaaatttttttttcggtctttctagctttgagaactcctcaccttccctcccttcattcctcttcttcactttcttgctctctcactctgtcttgctcttctgtctctgtttatttttaactcttttacatagtttctcgaatatggtagttctccctaggctccctgttggaaggagcttgtagactttgggtatactggactctgtgaattagtggttaataaaaatgggttaaggttaatcagttaatttaacttagttattcttaactaaaactctaaaagtgtgtgtgtacttatgtgcatgactagatgtgtgtgtgtgtttaaacctaggtttaaaatatatgtgaatgtgcaactattttaaggaaaaacttttttttttccttaaataaatattagcatggccaaacatgtcatgaaaagtttgtggcactagtttaacaatttgaagccctttatagtataaactgctcagggataaacctagtaaccaattcacattgaaaaaatgaatctagtatgagccatggtacttacacatagcactctttaaaaagattagaatttcatgttctaaaagaatatttacacattctttggtaatatttagaggctagatcaaacagtaataccatttagctattaaaaattttcctgtgttttaagtattataaatatgactagaaagggagatgggaggcttcttgttgaagtcttcctctcttcttacactattatactgatgtttttacatccatagaattggtattttcctgttttatcaaacaaaccttttggatttatacctgccttgacatccctgccgagttagatgttaatatgttaattgctagttaatagagaagtttagcagttaaatggaacgatttttttctctgacagtcatttgacagtcacattttaaaatcaccttttgattgtttttaaactccagatttcctctttttgaaactcattgccattggaggatagaggtgaaacgctgagaagtaactctctatcccttatacatttatatgatataaccctccatcccttatatatttaaatgatataaatcatatacagattgagcatccaaaaatccaaattccaaaatgttccaatgagcattttctttgagcatcatgtctatgcttcagaaagtttcagattttggaggatttcagatttcggatttttggattgggatgctcaacctgtaaatgacagaaataccctaaggaagccaacaccatgtttcagttacttgtcatctacttgggaaagatgtgtggggatcctctgggtgccactgcaccttgtttatattaatgcttctcatagagccatgttttcatttcttacattatgctaattgttttactaaaagcaagataagaacgttaatgatatttatcaatcccctactgctcatagcactattctttaaagctaaagaatttgacacagggcacacgtctggcccactgaagggaatcactaaatctatgttttcattaaaattacctttctctagtatactagagatccttaactgtttccttccttatggttatggtttcaaattttccagagttgggtgagcttggataacagaagggaaaggtgagatacaatggtaaactcccatttcaattaatgtatttactaggaagtcttctgtggaacaggtttgtttttacatattagcccagaagtctatctcattaattaaaatgtaattaaaaatgactttaaaagagcttaagagttcatttagatttgttttcccaagttatgtagaacattaattacctgagtttttttaaaatgtgaacagaagcttctgtcataaatttggaaaattataggttactggaagataacaggttttttttttcttttaaagttttaaaatgtgctaatatgcatcttaaagagttatatatgctgcatgctttctattgaaaggtgtgttttttttggataaagttttgaggccagtgttctcaggaagaggcttgggaagtgctgttctagacttatcattaacaggaaggaagctgaggaccaaggagattgtttatatcaaaggtgactaagctggttagctacatccaagtactgtgactgataattgccatcgtcagcttgtttcagggggatttactttacactgaaattatctgacaaaactcattgcatagtaatgttggaaagctgggaggagaacggacttgtgctaaacctcagctataatatagtggcagttttccattgaatttttgtcctttctttcctcaagcctagtagaccttttctttcaaaaaagagctgagagcttagaagagcaaaaaggtttgggtgctaaggtgcatgacatgttatgattattattatttttttacttgattaaaagcactttctttgactagctaatgcattacaaagaagggctgtaattcttttttctctcctggttctttacactgagagagtggcgtattactatgcttccattaggactaaattcagtagcaagagggcagttataagcaattctatgaataggactctgaatttttaagactttgatggaaaaactatcccctaaatctcaatgttaaaatgaatctctcttttctccaaatgttaaaatgaatctcttttctccgaatgttaaaatgaatctcttttctcctacagttcaagttagacacggttttaagagacactgggaaagaaatagtcactactaataccaattttggggagaacttcaattctttatctgtacaatggaaagtctgaactaatcaatcttaaagccaaatgtctttgactacttaatttatcattttaataaagccgtgtctaccaggtctgtggagcatagtttataatttcttctggaagttggacctgataattttcctttatattttttcctcagttatagcaggggaaatatttgtttactgtaaagcaaaccacgtaggaaaatatagttttgggtgcttagtaaacatacagttcaaggaaatgtttacgtttctttctacttctgtagtaaacattatagaaatttggaaaattcttctgtaacaaataatagttttttggagaataggctatctgtcccgttcctctcttcctgattgatagattactttgtaagatattaaagctaaagaatctggcacagggattggcacctggtagacacatttgttgaaatgatacattaaggagtcaaagacatttggctttttttttaagattgaatagttcaaactttctattgtacagataaagaattgaagttccccccaaatttatatcagtagtgactatttctctcccaatgtctctttaaaccatgtctgacttgaactggaaaagagattaattttaactttcagatttaggagatagtttttccatcaaagtcttagaaactcagagttctattcatgaaaagtatacttatgttaagtaggattatgatatcttttacctctccctctgagttgcatcattttgtgagtgctcacttaagtgtctgaaactattgcatggacatttacatagattacttatcaaaaaaatacgtatatatgtgtcagttaaaagtgtattaatggtgtattttaagtttgtatttggcataaagtcagatttgtaaggctatttggatgaatagtaaaaaacagctgaggatatggataaatattgctaatttacctagaatgagcatccagcttgtttctgcatagatgtgaaaaaaattaattcacttaaattttcttttgaaatttatattgccatctgagggtattcttcattcgcacctattcataaaatttgaagaatagtaattctttaaatttataacattaacatttaatatttcttgtattccttatgaacgataaatataaagaagtaagtacctcaaattaccaatgattgttattaccatttgtaccagtgagtattattcccatatttgtatgagcctttaagaatctgatgatagctattgacttctctccttaaaagtgtgcatgaacatataagtttacaggctattttatggggctttcatagaagtaatcttcagattcagaacattgtcactctgcagctcaaaacctttagtaatcctccatccccttattttaacagactccagacttcttaagattgtctaaaaggagttcctgtgatccagccttagactgtttttctagcctcagctttttctacaacattccgtatctcatgttctaatttaaccttagataggtgctcattaaaatgttcataactctgctgatgttttctttttcaactttgcctgtcggaattcagttctttgttcaaagcctaacacaacgcaaaatcttgtactaattcctttaagcaaaaatagtattccctcttttgtactcccgtggaaatttttttgaggcatttacaatttaattttattgtagttacttttttttttgaaaagtttctatgaaacttttgtgttcataaagggatgataatcttttaggaaacattacggaatgttattcatcattctgtccctcacagtgcctctcacttaatgactgctaaaaatttgcctggggatgaacaggtgggagacagaaggaagattgttttctcttttttggttaagacagtggtattctaatgcaaagctaaatcaaaatctccataagaattcttttcaaaagtttttaaattataaagttttgtagattactacatcctgcccaatctagatttattgaatcatcagtttggaaagagggcccacaaatacatatttttaaaattctgttgtgtaacctgctttaggaagtactgagttttgaatgtcttccatgttgtggtggatttaaatctcaattaaaaaagcctgtctcacttatctagatcatgtgctactcctgttaagcagtcatctggcatttgaagacatgaaattaatgccagaaagtctagagagccatggacagagcacatacaaacttggcagtggaatgtcaagccccaccatatggagtttgtttgttctttggtaatgtgtatttccattctcctcttgtctttgcaggacatagctcgccttttgcaagaaaaggagttacaggaagagaaaaagagaaagaaacactttccagagttccctgcaacccgtgcttatgcagatagttactattatgaagatggaggtaacaattcctgcatcatgatctattctatccttagactcaaccataaaacactcctttaattttgttcataaagtgaccttagggacctgggactgtttctcttatccccaggcactgggtacatttagatgtgtggcaggattctatttgaatctaataaattcatgttttgttttgttttgtttttattatactttaagttttagggtacatgtgcacaacgtgcaggtttgttacatatagatacatgtgccatgttggtgtgctgcacccattaactcgtcatttaacattaggtatatcgcctaatgctatccctcccccctccccccaccccacaacaggccccggtgtgtgatgtttgccttcctgtatacatgtgttctcattgttcaattcccacctgtgagtgagaacatgcggtggttttttttgtttgtttttttgtttttttttttgttttttttgagatggagtcttgctctgtcacccaggctggagtgcaatggtgctatctgggctcactgcagcctccctctccaaggctcaagcagttgtcctccctcagcctcccaagtagttagaaatacaggcatgtgccaccacgcctgtctaatttttgtatttttagtagaggcgaggtttcaccatgttggccaggctggtcttgaactcctgacctcaagtaatccgcccacatcagcctcccaaagtgctgggattacagatgtgagccaccgcgcccggccttatctgttctttagttggacaaccagagccactttcatgatggctaaaatttgaatatgattttatgagaattggcatgcattctttttaaactttagcgacttggaatgctttattataatctaagcacataaatggggtgtggaaaatggtcgatgagtctctggacttaacctttctcaagaagtctggaaagtactgtttgaagcaggaaagtggtatgaagaaagaaggtataccatgcatcagttactgggtaacaaagctttgttctgtgctttcttgccttttaaacctaggccgatggtttagcctgctgatgacaaacaatattaaattttaagatttccatgttcatttttttcttttgatcctttctttgctatttgattaccatatagtatgatttctgaggggatgattccctcagtttcgcttctctggtgcctgctttgcagggtggtgatggtgatggtgatggtgtggtggtggcagttgtggtgattctttatcttaaaaatgtgttgggaaatgagtatttgcaagtgttgtcgagtccttctcaaagacttgtcaaaggaaagatgtttcctgtagtttcaagtgtcagtatttaatgaaattcagcttgaagaccaatacttaggatcacaagtgaacaaaacctaaaggcaactttcagagagtcaagaatttcaggtcagtgatcctgaagggccttgcaaaccagtcatcaactgcttttctgtaattccattataaaaggtaaatatgtgtttctctgatgagtagaatgaaagcagtgtatatgtagataatgggattattacagtttgagtataattttgcccagtaacattttttgctctaaatttaccataatcagtagagctcagcctttttagtaagcaggctgattcacaatttattgcttgatatgttcttcctctgtatgtaaaacactcttctcttttttgatagccattttctttatgctggtttttctgatgaatctatatgttatgtcatttaaaaagaaaaattattgccacattttgctgtactaaagatcagaaagcaaagtgttactcttcaccttcaatttaaatcttagaaatgtggcctggtgtttttcccttttttaaaaagtctgctttggaggtatattcactgtaaacgttattattttaaactgttcagtctgtaaaaacattaggatgacaaggaattaaatgcattaaactgttaattttagcattcccctcttaaagccttatactgacttgaattgagactcaaacctgtttttttgatcagagtgctgtcattctgatttgtttctctagggcaggagactatgttaagaattaagtggtttttcagggacacataaaagcttttaaaagtattttatatttattttaattactccgataaatttgtagagagtggcgtatatgcttgtttctttggggagagacagactttgagggagttttgaggaacaggaagtggtgacctcctgaacatgtgtatgtaaatactgaaatttctcttgcctcagctgtgttgttattgggaggttatgttttgttgaacatggagtcctcattaatatgcccctgtgttagaccaagtgcagttccacagaaaccatattatagttcagctcatatttacaaaataatccttctggtctttgcagtggtccttttccaacacacctgggatattctttcattgtacttctctgtatgcctttgtatatctatttgattttttgccttacttgcacggtaatcacagtatatcattacagaaatggtcagtttttcaacttttaactcaaactttaatacattatctattagaatgattatggattttctacaaatttgaaattgtataaaaacatttgtcaaatttatatcaactcaaatgatatatattatttattaatgaatccatgtttttctttcaaagccacttattgaagtcatattagtgattttttaagttgtggtctttggagtcataggactgtggttcaagtcctgtcccctcctaagaacaatattaattttaatgaagttacgtactaaataaaatggagattataaaagtaaatccttcatttggatttgagaagatcaaataatgcaattttggtgaagtacttatttatacatatatcggtgttatatgtgtataatgtaatattttgtgtatcttattttgaaagccaaacatggaggcactcatataaaatgcagatatatatgtgtataaatatgtgtgtgtgtgtgtatatatatattatgtatatgccaatacataatacctatgtatgttttggcagtgagggagtaagttatatttgccaaataacttggtctcaagaaacatacaggtctcagtcctcaactgtatgaggttttaaagcattcagatagattcctcacattatctttttctttccaagatttaaagctgtcacagcaaatttattattagagaataaactttttcagtcagctctgtaaaaatgtagtaacagctctgtaataattcctgcagcatatttcctaaaagtaaaactatgaatatctattaactatttagaaggaattaaaaatcataatatcacaaattcatgtcaaaacccaattctttttgtttattttgagctggaaggtggacttcacttgtgcaactctgagtgagcacatttttattaacaccgtaaaccattgttccccggatgtggtcatcatttaagtggctggtctgtattatataaatttacagcagtagtcacttgattctcatgttgtcacgatagtcttaaaataatagtttatttaaaagagcagataatttgtttttatcaccgggtaattcttctgttttgcttttgattttatgtaaaataaaacttacccataaatgatgaagataaatacttctacagactgtttagaaaacaaattttaatttagtattgtcttgggaagcaagctttcttttcttctggaaagcacaagaggaaacaatttgaggtttttaatggaaacttacataattggtacatttagcacatacctctttcttgctctgttcctttaacagattaatatcaaatgaaacagtttaaaggaaaacgtatagttttttattttctttacatctcatcaacttacggtagctctttcaaatgcagttcagcaagtggttaattccatcggggaatcttagctttcatagcaattttccatggaattgggatttttcgttgttatttccaaaacgtagtaaaagttttagaaaatgttaaaatcagtatattcttataaagtgcatatgcatttgctgcctttgtcttcacattatacttgtgcctaaaaaagacctgaaaaagaattatttttgtgctgtttttgaagtttatattaaatttggggacatatacttagcatatattatatttttctacaaagaatacaatatcatacagttttttgaaatgtatttaggaagcgactcctttttatatattccatcaaggcaaccctttaaatttttttcctttgccaagtttcaactaagattgagaacagaattatctacagataacagggtcatgaactcaaaattctcatctacttgatcctcttttatattgaactgtaatagagggctaatttctgaagtgactgggtatgtttgctttggccacataaagtgggcagatggaggcatataaaaatctgtggatcattcctctgaactcaagagaaactagcaatattctgatagttttattggcatttccagtaagaatatttgaaagcctctgtctgaaattacaaagcttaatttttttgttttacaagattcctcaacctctactttttactctatactagtttcaaattggtttataaatagaacttaatgtttaatggctataattttgttattggcaaatattaaagtgttgttagctctacctaatcgtgatcaagctcttctttcacatttgtttcactttagtttcttaccattttggctatgtacccagaattctttaggtatgcatgaactgtttcagtaatgctcatcccctcttctcaatttaagttgaaaaagcaattttctccatttttaaagtacgttaaactggagcccagactcccccctgtgtagtgagttcataactctcattaaattaatctgcatttttatttttcacatccctctgcctccactcagaccaaccagggtcaaggagggccagggaattgggttctggattctcaagaccttgtagactccaaagagatggaaagactgtgaagcacaagaaagagaaaccagaacatccactggagaacttggaagagccagaacaacattgttcatcgaagagatccctgtcatcctctagctcgggcaaagggagggacaatccccatattaacaatgagcagcatgaaaggaaacggtccactcaggagaggcctcggagacctctgcttcccacgatcagtggtgaagtgtttctgagcactgaatgtgatgactgggagactaagattaaccatcagactcgaaattgggaaaaacagtctcgacaccaagatcgactttcacccaagtcctcacaaaaagcagggcttcactgcaaggaagttgtatatgggagggaccatgggcaaggtgagcacagaaaaaggagacacaggcccaggactcctccattctcagagagtgaggagcagctccacctccatgacgcaggtaatagaggacagtctcgatggaagtcctggtatcatgtatataactacaaaccaatgaatttaataagtaccttaagcaacctttctttctctctagttcatgctcatgactttgaaataaatcctagagcaacatattataaaaggtatacacttaatctcaggtctgtaagaagaaggaaaatatttgtaacttttcccttctgtgagaatgcactgatttcttggagagttattccatgcccaggttgtattagaggtacccattccagatatagttcttcatttaccgagactgtgtatcagagattctgataccaaatcaaaactcctgaatttctggttttacttcagtgaacccagaagagctgatgagcctgtcttgatagtgtttgtctaactaaaaggccgatagagccggaaatactgtattttttagacctcatctttctcatttgtaaaatgaggagttggataggcagtcttttaagaaagtatttttcaaataatatgcctcagttcattttcatcagaatcagctgttaactaacaatggaaatgtctgggtttcacatgtattatcatctctggagtgaggcctggcagtttggacatgttttagacctggaggtggattcttaggaacttaaaagtttaaagtcattgcattaagttactttttatgctgtaactttctccagctctaactctacagttggtgttctaaagtaccaatacaggtaagttcttggtacctatataagaatgaggtaaatattatagataaacctcaaatttctggcacccctgaggcttaactctgaagtccatcattgacgcagtaatggctctattttctataaactgctgaggtgatgttttccatgtgtctgtaacactaggaatcatagtaccaaggagccagtcaagctctatctgtggtcagagaacttgtttctaggttgcggattcaggttaagttggtttttcctgtcatgttatttcttattgaaggacttggttatgcagaaaattaaaatttagttccagaagccattctgagtagctgccacaaatatccttgtcttaggctttgtgcttggatttcagccagaaagatggctttgtaaacaattccaaactagatccactttgttaggaagacataaagagctgcggaaaaatagaggaaagtgtgatataatctgtcttgagtaggtttatgaggaggttacacccctagcattttgaggtttacaagttccaaaggtgtgggggaagtatggaggaagaatgatgtacactgacctctacgtttctgcttctgtgaatctgactttcacgagtgctctgagggctagttaggctttatggcttttagttatgctccaggatattttaaataggctgaggaagcatgacactaaacgctgactcacaggctccactactggaattgcaaatgttttgttttttattttgccagcacaagggattgaaaaacaatgttaccaggcggatattaaaacgactacaacatgagctgctgcttttctatcattttatattcagcttgctttttatattttacctttctagcccccgtaggcatttgattttgtaactccctggaacaggtcagaggattacattaaaatataattactaggtagtggcatctattcttgctgttgtaaaagcacaattcttaaagttgttaggacaggccaaacttacattaataatgaagaaactagcaggatgacacggagctggttctaagagcatttgcagagcagcattaatagaatcagttgaaagggactgcaaaataaaattttaaattaagtataagataactttctacagggcaatgggtacttaacctttcggagttacttctctattggactataaattcttaatggctcatcattttctgcaggttaacttctaaactcacagggccataaaatatctgcactgttctgctgtgaattgttagtcagatatactgtggcattccctaaatgtcagactggcttattacaaatactcttacatgatatcaaaaagaatctatcattttaccttattccaagctcagaataaatttatcttgactgtcagtactttcaacaattttattctgtaaatttatttaaggctgaagttttgtgttcatttaaggatgttcttgtgttctccatctgaaggatgatgaacagaaaaagacaaggaaatgtgaaattaagatatatatggaacttgaaaataccactcacctgattttttgaaagctagtttctagagtctgtttaggatactgagatgagggaagctagtctgttaatttccttcagttaattacatttaaaaaatttttggacatctttgtttaatgacggccttacactgcactgtgagttctttttctatatccttacaaaaatttttgtcaccttgggtccagaggacactgcagagaatgggcatcctgacagtgcagaaatttagtattccaggctgtggagattttctacttaatgagatttacagattccagtgatacatcaagggtttaaataaaccatttcccctctaaatatttggaactgagagatattacctcagattctgactcttactaagtcatcattctctttttaactgccagaggttacagtcttatcaccctgtcaaaacaattagactattcaatggaatattgtctttggtagaatttaaaacaatgtgtctttaataaaactgaaagtgaaaaatcttcttggctaattctgtggtgtactttaggaggcataatagtggagaaaatttggtctcttgaaatttgagcacatcccactgtattatttcactgtatggcaaaagtgaaggaggtaggcatgttctgtcatccttaattaagctttgggctgcttattgaagtatcattttttctatagattggaacatggtttatatagcagactatcttgtccactgacattgcccagtactgagttccttatctaatttcattttctctgaaatctgccttcctagttctgactaagctaaataactcagggagatttatattctatttcagatggtccactcttgggactatgccactgtttttttgtttgtttgtttgtttgtttttgctgtcccaaaccacttagaaatctagattaagcccagcccagcataagactccgtggctctagagttgatttgaagtgatctgtgcaatcaggttctattaggtctgaagctaagaaagccatgtttactagtctgtctttgtaggaaatacagatgtgtatgagtctgtggcttctgaagccgcagaagccaggttgaaagttgtacaaaggtgggcttcacaaaatacttacattctcatcatttgcccagtgtttacttgtattttatttttttaaagattaacagcaagtgagtcaagtgtggtgagggattttgacaaaaatcattttaatttacagtaattttaatggacataatacactaaacaggtgatgccaatattaattgcaagtaagaatgaactggggagatttaaaacaaacttactcaaggacagggcacacccaggctacttaatttagaatctgtgggggttggggcaaatatttttatacgtgttcaaagcaccctcatgtgattcgaatatatagccctgattgacaacccctggcataaagagacaatcaggagtacattttctttctcctctgaatagttaatttactgaaatgaactatttcagataagtaatcttgttcactgtattcaaaatttttattaattctgaatataatacactcacactgtcaagtaaaagtttaaagccagaattgctttataggaataaattggaatagaactctggtcattgtgctctcaatatagctctgattatattttccctaagatgtcacagtgctatcagtctgatcaaagctgtggggaagttctaaagcgagtgggtttatttactctcagaggaaaagccatggcaggaccactgcttgtctcacaggtattatcacatgactgccaggtgctgctgttcctgctccctcggaagtagtaagtatgcaggctgagataaatagaaagaagcctctactctcctccagccttgacagcttagcctcttttaaactctgactctgtaatttgcttttctttaaattatttttgttttcaatgacttttttttcactttgtatttttccagggcctcacttgcaacttcttacataaatttctgctgttgcagaaactatgtgagaggggactttttaccaggcaggcttgcttagatatctttgtttaaatgtatgcattatctacattgccacttccattcctagggcaaaaatatttttaatgcaccccacactgtattctggagtagaggtagtattgtcattgttagctactaaagaaaaatctcctttatcttaaatttcttaacttttcagaaaacatcctcggttgttttattacattgagtttttttttttttttaaaggaatgaagccaagagtgatgaaagaagctgtatctactccatcacgaatggcccacagggatcaggaatggtatgatgctgaaattgccagaaaactgcaagaagaagaacttttggtgagcaaattttaaggcaaaagtttagatatattgatgggtattttttttgtgaatctagtccatcttgaaattatattaatagtcctctatcaattgagaaacctttttttatgagtggaaaaatcatgacaataggaatagagtatccacttttgcttagtgagtaagcattagcagcaaagtccataactccatttctccatctccatgattgttctccataaccctgctgtaggatttgataaaaagagctcctgctctggctggtgaaagcataccaactgattatcaacctcaggaacatgagtcacaattattttcaaaaaccagcttattttgtacaagatactgaaaatgcacaacatagattccaattaaattctttgtttttgtattttcgatatcataggctacccaggtggacatgagagccgctcaagtagctcaagatgaagtaagttaatgagtttagctgatattctttggaaatatcctagtatatttctatctgcacctctgcagttaatgatattgactgtattttgtttaggaaatcgctcgacttctaatggctgaagaaaagaaagcttacaaaaaagccaaggagcgggagaaatcatctttggacaaaagaaagcaagaccccgagtggaaggtagagtgtgttttgtttgttttctaattagaaataaaattagaaatgaaaaggggactctgcttttgagttaagctctgcaaatatatttaggatatatgaatatataaattatctgtattgcatatgtgaatctgatctgtgaagattccatcaccatgaaaaatcactgaattttggaacatatgtaaaaagttactgctaagattgaaaactcattctgttccctttaagacggagtgaaatgcaagtgcttctggtcatgaacagtcttagttttcatatacagtactttgattatagaagaatatagcattttcacatgctttcatattttccacaatgaacttctcttcccgtctctactttctttgtgcttacattatctttcatctctatcatgtatccgtttctctttcctttgatgtaacatggtttgtggcagactgaaagatacatacttatcaccaacaattattatttatgtcacagtgcaagacctatctagcgtgagtttggacggttatctttcccctcgttgatcagaaattgtagacaaaataagcagttactgcaattcattttgctgcggtaattgtgagttccagcttagcagactttattcatcagtgacagcgcgtaagacaacactttggacctccatggaaagacaaagacatttttcctgatagtagtgtataatgtagagaggaagacaaagtgtagacagctaacaaatagaaggttaagctaggtggaaaaagagcagaggaatagggagagaattcgtacaatacagggtttttagggagggagtttaggcccagaagaatgaaacctaggttgtgtattccttacacagttggtgtttagcgctggtctctcttgaacaaattcctccattgggtttctggtcccacctcacagtctcagtaatggttgtgaggaaaaaggtgtagaaaccctgctaatagtattgctgtactctttcctgttgctcagttacccacgagttagtctcaaaacaatgaatgtattattctcatattaattatgtatatttagctctctcttaactaactcagtaattcaagattttttctaatatactgttttagtcaaggattcccaaatacttttgttaaataaattaagccacaaataattacccaggagtttctcagattctttgctaccttaactaggaaagggtaagtatttaaggattaggaatcaagcgtgtcagaaggcaatggccacatctctagcaggtatcatcatgacttctgtaatttttattttataactggtactgatacagttcctctcttggaaaagttgacttgaatgtgccttagtttactggctggaaatcagcctaagacatgtgtgcggaaataagtttgagtgcacaaacctggattccgtagactctgggcgtgcactggttcttggcaattactgtgtagctattatgttaataatcagtggccaagcacacccatctagggaagcatgttcctgtgtgttcagcccattcctctggctgctctaaggctttcagatgagtgggctaaattacaccttccatgtaagcccaaagcctacctttgcagctataaattttctacctctggagtggccatatataaaaatattttatgttcctcaattaaatataattaatctgaaattactaaggaagagcttggcatgataaacatacgttaaacttaatctttccctttgtttgatgattctggattgtatgtgtgtgttatttttgtttgtttgtttgtatttttgtccatagccaaaaacagctaaagcagcaaattccaagtcaaaagagagtgatgaacctcaccattctaagaatgaaaggccagcacggtaagctgacacctgaaaagaaaaatgaggaagttgactttggggtgaataaggagatttcagttccctaagaagagtgtatgttttttggagaggagatccaaaaatctgcatttgtaaggtagtgtcaagacattcagggttatttttagaactttatttccactcttaaattgagttgtgtacatcaaatcagaattttacaatagttggggtggataaggaagaatgtactttttgttaggactgattcttacctctgcattcactgaatttatgctttcagcttggggaatgagagtgattttttttcctaaataaaatttcgagttttaaatatttaccgggtttcatagccacactgatgtgtgcatgccatttgcacatgctcaaactcatttctttctgagtctcagtgtccttgacaaaatcttgaatccttgcagactgtctaaatcccactcaacaaatagctgtggctatggtgtacatactttctgatttatctcaaacagtcgtgcataatagttatggagcagctgctgtctttctgcctcaagttgtcaacatttaagtctctggggaagtaacctctttttttttttaattgctttttgttgcctttcgaaagaaaacatgattggaatgtgaagaaaaagatactaaaaacaagacaaaaaagtaacactaagtttaaaattttgaaaactctgaattattcaaatttgaattttattcttatttgttaattcttgaaacataacgcttatttcattgaataattgacactgttgttgctactcatgcccacactgaagctcctagacttgtttccttcaagtgaatgtatttagtgtccttaaaaagtaatcctctattttaaaactcatttgctttcagaagataatctttcagaaaattacattgggtttgtattgctctgagaagaatagtggcatattctgtctagttatataaaatctttctgttgtagcttttggttaagcacatgccaaacattttcttagaactctataggttagtacattcccaaagtatccaagtaaaagaagcagcagctaatctgttcttagtaagtaaatacatctggattattatcctttttttagtcaaatgaatttaaatcatctttaggcttaattctgcagtcttcagatccttggcctctttagaatactaataccattgacagcatatatgatggaacagtactggatgatttcttaagaaagtttattaaagtctgaaaacaagtttttggaatataatagatactttagaaatatttggcatactgaaagagtgaataatcaaatgatcctgtattaaaaatggctattataaatgaatgaaaagtgacttagggctagtagaatagaaatttttgtttttaccttagaggaacatttgtctttaaatgtcattttagcaggattgtatatatgaccaaaaaaatgaggaattttatgaaacctgtattttcatagttaaaagataaagcttatatatcttgcatatgtagataccttgcacaactaatatcagaatgtatactttctggttagaatctggttttcctctttcacatttaatcatgatggaaaagtttagctatacagaaatatttggtttcaaggattgaaaaacatggcacttcctaggtcaagatgtttattactgaagtgtagtaatagtagtagtgagacacaaattcttatgtagagcttgtaatacttatggttagaaatccaatttctttgtctgttacagaattttctactcttcgtgtatgtgtgtttaacttttgttgttatttttcaaaaattgccatttttattttagattctggggatacatgtgtaggttttttttacaagggtatattgtgtggtactgaggtttgtacttttattgatcttgtcacccagatagtgaacagagtacccagtaggaagtttctcagcccttgcctccctccctccttttggtgttcccagtgtctattattcacatctttaagtccatgtgaacccaggatttagttcccacttataagtgagaacatacaatatttagttttctgtttctgtgttaattcacataggataatgccctccagaggcatccctgttgcagcaaatgatatgatttcattcttttttgtggctgtgtagtagtctatagtgtatatgtaccacattttctttaattaactgttgatgggcattttggttgattccatgtctttgctattgtgaagagtgctgtgatgaacatacgagttcatgtgtctttttgatagactgatttattttcttttgggtatatacccagtaatggaattgccagggtaatggtagctctatttttagttctttgagaagtctccaaaccgctttccagagggattgaactaatctgaattcccatcaacagtgtaaaagtggtgttcccctttctctgcatccatgctaacatctgttattgtttgactttttcatagccattctaattgttgtcagatagtatctcattgtggttttgatttgcgtctctgataattagttatgttgagcatttttcatgttttttggctgcttgtatttcttttgagaagtgtctgttcatatttttgctcactttttaatagggttgttttttccttgttcatttgtttaacttccctaaagagtccagatattaatcctttgttggatgcataatttgcaaatattttctcccattctgtaggttgtctctttactctgtagtttcttttgctttgcagaaatctttagttacattaagtcctatttgtctgtttttgattttgttatatttgtttatttgttttgggggtcttcttaaattatttgccttggccagtgttgagaatagtctttcctaggttttcttctaaaatttttatagtttaaggtcttgaattttttgtatatggtgagaggtatgggtccagtttcattcttctgcatatggtcagccagttttcccagcaccattttttgaataaggtgtcctttccctattgtttatttttgtcaactttgtcaaaaatccctttgttataggtgtgcagctttatttcaagggatctgtactctgttacattggtctgtgtgtcaggttttgtaccaataccatgcttttttggttactgtagccttgtatagtttgaagtctggtaatgtcatgcctccctttgttcttattgcttaggattgcctcggctatgtggctctttttttggttccatgtgaattaaatagtttcttttaaatctgcaaaaagtgacgttggtaatttgataagaagttgttgcatctgtggattgctttgtttagtatgggcattttttttttttttttttttttttttgagacggagtctcactctgccacccaggctggagtgcagtggcacgacctgggctcactgcaacctctgcctcctgggttcaagcgattcttctgcctcagcctcccaagtaactgggattacaggcacccaccaccacgcccagctaatttttgtatacttagtagacatggggtttcaccatcttggcaaagctggtcttgaattcctgacctcaggtgatctgcccgcctcggcctctcaaagtgctgcgattacaggcgtgagccaccgcgcctgacctggacagtttaataatatagattcttccaacccatgagcatagagtgcttttccatttatttgtgtcatctatgatctcctagacttgataaacaacttaagcatagtctcaggaaacaaaatccatgtacaaaaatcagtagcatttctatattccagtaagcttcaagctgagaatcaaatcaagaactcaatcccatctacgataaccacacacacaaaatacttaggaatacttctaaccaaggaggtgaaagatctctatgaggagaactgcaaaacactgttgaaagaagttttctactgtttttaaggaaatagaggatcacttagcaatctgaattctaactcttgtaactggaaaaaatttcaacccatgttccaaattgttttaactacaggattttatacttttaatattatttgttattctacttgcattttttcataggaaaattaaatattttctaaatctcattttattccttgtgcattcttattaatgtgaaatacagttgtctccatttattcatttatcaagtatttattgagcaccctattaattgctcacacataattggggtacacatcagtcaacaagaatgaactctgtcatgttctcatgagtttataatctaaacaaataattatccaaataactgttatgattgtgttaagtgctatggatgaaaagtacaggatgataagaacatagggagacatcctggtttaagtgtctaggagggtttcttaaagaagtgaattttgaagtgaattatgaaaggtgtttggctgtatcactaaattaaagatgtaaatgatttcatgagaacggtaggaaacaggcagtcttaatacaataaaactgtacaacaaagttagttaataagatttttctaacttggatatatatgctgtaactttaaaacaattgtctcaggtataacaaaataatttggtgtaggactcttggcagcagtaagccaagatttgttctctatgtaacctgaaactaaacagaacagtacccttaagagcactgaagtactcttaagagcattctagattgctcttaagaagtactcttaagaagtacttaagaagtactcttaagagcattctagaacagtacccttaagagcattctagattgatttgtttatccttacatggacatgctagaaaacttgtgggcatcctgtgctttgtttcataactttagcatacttttccttgatgagttgatggtgaggcactaatcatggattgtttttgtgagttccactcaacgtctgtctttctgatttttgactgcctaatgacattaataaaagagagaagaacagactgggtcattctaactactaaccctgttttcttgggcctgagtcacttcttaagccacttgtttgctttttgaagctaagttctttaatcctagagtcagactgatttgtcttaatttttctaccaagtcttacattgtttattaaagataagtgttaaaaatatcaggtattggagaaaaatactatttaatttccaatattggtaaacaaatgatttaaaaataaaaattagaaaaaatgcattattcactatgtttccattacttttatatatatatatataaaacagatgcatgaaatgatatttgaaagtataagtacaataacatatgaaagtatacttctgaaaatatacaaatgcatatatataaacacacatatatacatatagtcttttatacagatgatgctgctcctgataaaaatacacacctatgtagtagagtagttaagaacactggttttgaaatccagttgagtttgagccctgggtctgccacttaacagctgtgtgaaaatggacagattatttacctcatctaacctaatctgactcaaatatgtatatgatagttagcattagcatacagacttgtcctgaaagttaattgagataatctgtgtagaacctgtagcatggtcctcagcacatatgccagtttatatcccatgctgacctcttcgggatgctgaatacccagggaaagatttattgcatggcgacaagataaaaaatttggaaacacttgcttttatttttacatgacagagcccattgtaccaaaccaactataactttacaaacttcagaatacttatgccttctagattttacatataaatgtacaaaatggcctacagtatggttatatttgataaatctttgatatattgataaatttgataatctggtgctatcctttagtgcaaactttgagtatacctttgggagataaagaatgagaggttttctgcttcagtgctacatgtttgcataaatctatgttaagtaattttaataaaaagtttagagtagtaaaaattatatctttttttttttttttacattttttgacataaaaagttgcgaatgtattacatagaatttgcaaatgtattaagatctgttttgccacctagtggataaaggaactttgctcatgaaattttgtttctgtttcctccctcctttctgtctcttacccttccttttttctttttttcctttcctttcttccttggctttattattttcttcttttctgttctttattctgttattttttctttgacttggtaagacctaccaaaacaaagtttatttcttataaatggcagcagtcacatctcactaatctttgtttatttagcccagttcctaacatgtattagttgttgaggagataattgtttgtattgaattatgacatcaaaacaaaggaacgggaagataaataatttattcaaggccatgcaactgtccaggaactacagtgtgaattctgaagcattttggcttttcatttcacaagaaaatgtttttagcttgcaatccagtaagaggggtggagttgtagtaagcgttacttagaatgcccctttaaattctggattccttttaggccaccaccacctatcatgacagatggtgaagatgcggattacactcattttacaaaccagcagagttccacacggcatttctcaaaatcagagtcctctcataaaggtaagaagagtatgtatggtcaagtttaggatcttctttttttatataagcctcgtgttgtagtggaaaaatcaaattctgtgttccactagagtggaaaaataagttattctgtcagcacattgttatagaactcctcatttattaaaacagtaacaaaacagaaaacagaacaccctaaattttatgtaagatattctgtgtatttgcattttcctcgagagggagcacaacgctttcatcaaattcactttttttttttttttttttttttttgagtcggagtctcactgtgttgcccaggctggaatgcagtggcatgatcttggctctctacagcctccaccacctgggttcaagtgatccttccatctcagcctcccaagtagctgggattacagacatgtgccaccacacttggctaatttctgtattttttttgtagagatgaggttttaccatgtcaccccaggctggactcaagtaatccctctgcctctgcctcccaaagtgctgggattataggcatgagccaccgcacccagctctttcatcagattcttaaaaggtggtggtgacctccatttagatctgtaggactgcattttctgtagtggctcttgtttcctatctgcccatgactcttattaattagatttaaaatatgcatgcacacctcccacataactgttatgcaaaagaaaaatggaacaaagcataaagaaaaaatagggatacctcaattggacgaaacctttaaaatttgtttccagaaaagggtcccgattcagactccaagaagaaggttcgaataaagaatggctgctcagcagtgtgggctgctggttgcccatttttatggttatttgattatatgctgattaatacaaggggtatattattcatgagttttctgggaaaggggtgggcaaatcctggaactgagggttcctcccctttatagaccttatagggtaacttctgatgttcccatggcatctgtaacctgtcatggctctggtgggagtgtcttttagcatgctaatgcattatagttagcatataatgagcagtgaggacaaccagagttcagatttgtcaccctcttggttttggccaggttctttaccaaagcctgttttatcagcaaggtcttcatgacctgtgtgttgtgccaaccccttatctcatccagtgacctagaatgcctaacctcctgggaatggagtccagtaggtctcaggcttattttatccagcccctattaaagatggagtctctctggttcaaacgcctctgacagaggaacgtatttgctcttgcaaggatctgcgttcacttatgtacatttttatgagagctgtaaaatgaaatggtgaaaaggtagtttctcatattaacttcctcatctgcaaaatggaggcagtctaaatagaaagtgtcagagttgtcaggatcataaaagattaaatatgtgaaagaattttgcacagtgcagtagactttgcaaatatattatatctcattaattgatgctgtttatttgttatgatttttgaagacttaggtgatattgttattcatttccaagtcaataataatgtccccaaatatctttaaataacattttctgctgtcatttaaaaataccatcgcaaaaatgacactctagactacttcaatcagaatctctggatgggggttgtcaagcatttgcatttttaagaagctcccccacccccacattctgactcacatccaatactgagaaaaagacaaaaggcattattttaaaagtaaggttagttggacattataaacatcttcatcaacacatcccacctcaacttccatcagttggtggcattttcactgttcccgatttaacgaagtagctcatatttttctttctcaaactacatgtatcaccttttggggagtaccttactgtctttgacatacatttgatgcataatactaaactaacacattgattctgtatatatgtcacaatcaagaataaagtactattagaaatgtatagaaataaagttattttacttgggcagggagaaaaagctgtttgagtttcaaaggtttttccttaattgtgtttccttttttcttcccctccccaggttttcattacaaacattaaaaacctaggaatctgccttgaaaatggactcactatagcaaatattactgggtgatacagaatgaattctacacttactttttttctcctgtgtttgcattcctgggatttatcctcaagtgcatttctgaccataagtaattttaattcatttcaaatgttttggttattcatgatcacttgggcagtataagaaaatgtagcttctgaatattggccacctctatgctgcatatacttcttgggatatagtatctaagacctttgtaaactgccattttgttaggtatggagtttggtatctagggagtaggccttatttagcaattcaaattttatggagatgaatgatcaaagtgaaacaatgtttggatgcaacgcagaataaaagaatataagaaatagctttttgttgcattaatgtatgatattttgaaggacagagcctttgctttttgtattctttaagaaaagcacaaccataaagtattttaaaaaaagaaacacttggagcaattgaaatatgttattctgactagatggactgtagaggttttgcatttctcagccctcctggggagattggcctagatagcattctttaacacttcctctgcttttgcctcagtagcaaggctttcctaagctcctgggcaatggaacatttattagtatttattgacaaaaatttagttctctgaaattttaactcatatatatgaaaaactttgtattccatctcttctttttcatttacttgtagagccaaggaaatggaattgaaagatgattgcataagtaatgatgccatccttctctctggctgtagactgaggcttttctcttgcttcaagtcagagcagtatttgttgataacctctcaataatgtttggtttacatgccagtaattaaattaattcaacatgaagttgaatttgatgaagtggtcatctatccaagtatttggtttttgttttgttttgttttgttttttgagttggagtctcgccctgtcacacaggctggagtgcagtggtgcaatcttggctcactgcaacctccgccacctgggctggagcaattcccctgcctcagcctcccaagtagctggaattacaggcatgtgtcaccacacccggctaatttttgtatttttagtaaagagcgggtttcaccatgttggccaggctggtctcgaacccctgacctcaagtgatccacctgccttggcctcccaaggtgctgggattacaggcttaagccaccatgtccagccagccaagtatttggttttaaacatttgtattcctttgtgcaagggattgtattcctctgtacaagacctttaagcacctcttcaagaaatttagtctttgtgtagctgctaaccttactgcaatatttattttcccttattttcccatactacttagttgacaaatggcaatcaagctcacttgttctccctctctctgtctcccccccatgtacacatatatatatcccttcagcttgacttgctattatttttcattgtataaatatgaaattcttggcatttcaatatggcatttgtttagggaaaaaatatgtaggtcactagagaaaaatgttaatttttttcccactgtgaattgccttctgtttgccttatcttttcagatagtctttaaagttgggcaatattcaggcagctatttagaacagtttctcagagtggatttgggtctctcatttgagaaagatttgtagtttcaatgaagtttgtatattataggaatttaagtaaaatcatctgagttaagttttgggcaaatgttaatcagaaagataatctacatccctactttatgtagtcattttggagaaatggaggaaaaggaaaataacaggactttttatagctgtgataaaatgggtaaagaaaaacctccatttaaataaggaaggggagacaaaatggaaggtcctggccttaagtcaaattccagatagtgctttcaatatccaaagcttaggccttgtttacttatagtaatgctatatttttctttatctgccctgtgatttcgcttcgtgtccttcaaagtttttttattgtaattttaaaggaaaaaaacaatgtatttttatttgataactaggcaaaatcatttgccattttttatttcataaatatttatttttctatctcatacaatgatcagttttactttaaaaattctgcatttctcttgcctctcatgtacttcatccagttatttattattgtaaaatgttaactggagatactgcattcaaaaaaaagtcggaccacttaacacttaccaggaatgttagtgtttcagctgttttagtaagtgaccaagtaagctatcaccttgtgatagctaattcaacatctttattgaaaatttgttactttttttaaaggtttttaaaagattacaattttaaaatattttatgtttattttatttttgtgtaaagcaaacacttttaaaataatatcagagtaattattaccctatgaataaggagatagaaatgaaattcagccagttaaatcctcatactctttctcattcaaataatataataatgtttgagactatagaagcaactcaactgtattttaatgaactgccagacacttttcactgtgttctctgctttttactttgtcatttttatataaatgtgaaagcattttgttgttgttgttgttgttcctgctgctagaacacatgcagtttaatttttaggcccacagtgtattatgctttaatgttgtgatgtaaactaatacttctggcctgggaaaacctttctgtttctgtatctttgtcctttggaggccaggcctcattaacaccagtattgttgaataagcacaatatatgacggagccttatcataaggctgcttgacatagacacccactctcctccacattttataaatcattgtttggaagtaaagttagataagagtcaaattaaatgttttgacttgaaaaatatttgacttttgcgttcaaaccactgttagacgtaagtattttattagacataagtattttattttgggactagacagttgctttacatgtatttaagggaacattgtgattttcagaaagtggctttacatactattgaattgctatttcccaagttactttacaaccagcagcagcataccaataaattacaaaagcagaaaatgaaaattaaccctaggtgttctgatgatagagaaatagctaaattagaaaagaaagatatggatagatgcttttaggaggaaaacctttttagaatggcaatgaccacttggatctaggtcaacatattccaaaatgtgtgaccttgggctttgtgtttactgaactcactctagaaaattctggacctgattcattaaccccgcttttcttctctaatgtgtcctgaagctgagctagatgatgagtaaattctttgctgactgttgctcatcactttctctcaaagttagaacttttcagtataaaaataattagcttttaactgattattaattttctttaatagtttctgtcaaaacttgtctaaaatttgtgttgtgccaaattggaaatacccactataatatggtgcattcagtttactccacaagtggttaacattttaagtcctagattttttatgtcttgcctttgtataagcatcgctttggggaataccaagatgattcattattcagtgattattttcttgaaagataactatgatgattggctgtaaaatcttcaccctaataaaggagtgagatctctgtgtaaacagctttctgaaggactgataatagaatagaacttgcagccaaaggctttttcccttttgagaagacggtatttgtgtaaggagtgctaaggtagacttcattgtacatagagtgccatattctgttgaaacgatcataacaaaatcaaaacctcatgcttcagcaaaaaggaaaaaagatttttaaattactttgtctattacttactgctcatagagaagtgactatataaaatggtccaattttctcatttctggtggtgcctgtgagtcttaaagccatatctgcttatcttactgttgatagaatactttttttctttttagcccatgataagtaatatgggcaggtagaagcaaactggagactgtcctgttaatgctgcatggggcacaatgtctttcaaattattggtggaagaatctcttttatccatggcgagaggtaagaatattaaagagtcaggatattgttgctcctggtatttaacaactgtcattagaaatgctgaaatttaattgtagagaagtcaagaaagaaagagtaaactgagaaaatcttactactacagagtcacttttacaatgagacctgcactttatgccagcactgtttgtgaggagcagtactgccttaaattagtttgactctgactgatgtcagtgtacgttacttcctttatgtgactgacagtcagctttccattgagatataacattcacagatgatccccaagtatccttgtcatcagaagctttggaccttttctgccactgacttgtggctgatctgtaacacaataaatacataattttatttcatgttgtctgtccacctctgaataagcagtggcatgaccaaaaagactggtagaaggagagaatttcttggccaaatccttcataccaggtaccacttcttgagtaactgagagttgactgtcttctatggtgactacatagaagatatttccaaaggttctgttatgcagtgaagacattcagattatttgtaagaatttcaccaacacccttgtgtattgaaatgcttaaccattaacagggaaaaaaaaggagaaaaccgaacaaaacagagacatttacttgaaatgggaggtttgctaatgtgaagagtgtttctgttttattacttataagagaaaagcaggaaaacttttgctttgataagaaagacaccagagtggtgattctgtttgatgccacaggctaacacaatcgtgtaatcatgttgagttgtagaaatatatggccctaaaaaccattctctttcccttatatatataaatatgtgaacactgcctagtaacattttaatagatttaagatgcatttgtacattctcagcaaactagaagaaaatgttttttctctttttgagttaacttcatagcatagagaaccagcactgtgcaggtttcagcatttcagataagggcataattaattgtgtaacttaatgccctgttattcattgctgaggttcatataaagaatagaaaaattgaaagatgggtttgggcgacattttcttcccaaaagatcaagtaaggagtaagaacaagtaagggaagacagctaagagaacatactatgacatatcatagaattgggatacatttttgttgcactggatttcaggctatactgctaaaataatttctacctgttaaattttgtgagagggtttttgacatcagaatttttgtatttctggtcaaattggtcttggaaatccctatggtctctaatttcagctcttgctgtaaactgcaagccaaatgctctttctcagaaagagctatatttttctcttcttacaggcaacccaatatttatttcataaagtgttataaatattgagaagatacactggggagatagcatataaaaatgatgctccaaaatgagaattctatatggggctttccctaagaagaatccatcccagcacatattttgaaaaggtgctgaattaaaaagtacaagagtttgctcatataaatcaagttgcccaggaaacctgaggtgatgctatcatttgtctcataatttagaaacgtgatctcttgagagagagactacgcattgcctgggcactttcagattccttaggaagtgcccctttgatatttggaatgtggatatatttataaaacaaatggattgttattccaaatccacatggatttataaccaagccccagaagaataggcagctttgaaatagctagttcgtggaattgaacagaaccttgatggaatgcagttgcctgtgtgaggacagaaaacaaagaggctgcctcagaccacatgcctatctagagattaagtgaatttgtgagggacattttgtggatgccttaaagatgaccagtggtgggttctgatgggaatatatacactcatctggactaggccaatggaagcagtctctttcagttcacctccgtacagcacaagttgttcctgctcatgacctcattgaggaaaatgagaattgtggtgctggtgactttcatgtgtcttgggaggttgaggtgttcaacatcgttaaggcactcccaaaacgcaaacctccttttttaaatgccaattgtacatctacattaattcatctatgcaaacttgtgttttcatggtttgttttttacactatatttctcattaggttctttaaacatcaggtttaatattgatattatgaataatttttaaaccaaagtattctataagtctgtgtgctttgttttcctggatggtttgaccaaggtaaacatcagtcttgtccttctctcttaataaagtcatccatttgttaagtcagtggtctctgtctcatgtttttgttttgtttctttacagcattcaaggacagggaaacttacgagagtcttattataattattattatttacaaaatgaccctaataggtctgtttagtaacagtgaaattttttcttactccatttccatacactttctgtaaatatgtataacatgataatgatgcctggtgtattgaaatcctcaataaatactgccaagtgtggatcagttgga

SEQ ID NO: 1207 - DNA, 69586 bp, Homo sapiens; identical to SEQ ID NO: 1206
